United States Patent 9,029,523 (PROMOTER, PROMOTER CONTROL ELEMENTS, AND COMBINATIONS, AND USES THEREOF) - sequence listing, part 9

SEQ ID NO: 9862 - DNA, 3000 bp, Unknown
  misc_feature (1)..( 3000): cDNA_ID_3034263_gDNA_ID_1974092_Annot_ID_180656 3000 nt of promoter + ATG
ttcgataattagcactagagtcgacaattttgaagtcaacctaattaaatactagtagctttcctcttcattcaattataggtaaggctaaataatcatatcgaacctttccacgtgaatatcacgagtcacgacccttcaaaaagacatactccttaaacagttaaaactcgtaattgtttgaaacaaatagtagatgcattttagtgttatatgcacacttttccaaatttgttttattcgcggtatcgatgtaataatggttttgttattaaaatagtaatctcgtcaataaagcaatgataaaatcatgagtatgactatttatgttaacagttaactcccattaatgaaatgaatttagaagaaatgaaaaacattgacatctcttttttgtcaaccattgtccattgacaaagcctttaaatatagttttactttcatagagataaagatattttgcatcacttaagagtttagacgcaatttctaaaattgtcaaataggtttatagttccttcagatgatcagaaatatcatattctatattgtgtatttacataactttattggtaacttttcaatatgttttgtcagtgcctcattgtactaaagttttaatatattaagacattatattgtgttcgatttatagatacgcattaattgttttgtagagagcaaaaacacaaccataagatgatttgttttgagaaaatataaaatggtgtatatatcaaaagattatcattggatgcatagtcatcattgagcgggactctttgactctttgtgcgtatatatcaatacttggtccccggaactagtatgattaattgattatggatcaacgacttgaatcgtccttacgtaaaacaatatttagttcagtttagacggatacataattggatagagcgactctcacgtccacccacttttgtttcttggaaagagtcgatcaaatttcatagttgttaatatgatttcgatggactaatatcctccatatcgagggtatgaatagagatagtgttcaaataggtccatctaggaaaatgatatgtgatgatgaagtgctatggggatggagaattaattgtttaaattgaatggcttgtgacttcatcatttcctccaatctcctacgctttccaacttggtggtctcagtactctttttattaatttaaaagaaattccactacgttgttaaatgttagtgttgatggtttttcatggaaaaatatcccaactgccgatgaattgatttatattcaaatgacacgccatcaaaacaattgtatctaataaataaagataagtcattgtaactaaacaaattttgtccacaacagtatcaattatgttagataaacaacattcaacgtttaagattttacaatggatcattcacatttcactatgcattgaggatgcgtgataggacgcatcaaactcaaaacttggtttacaagaagccaagaagtaaaaaagttgtttgaactcttaagcatttactaccctcggattttcttcattgatgttcattcaatgtataggaaagaataaaccaacgaatataaagaaagaatcctacaagatttactctcgcccactgacaataaatgaagctgattttgaaaatgaaattccgggaaaagaatcaattttgaaacagaaaatgatatttttccaaaacgttacttaaattaagtaacttaatatatattaaatagatttggtatattagttatttcaaagtataccacagctcaccggtgaatttaccggagcagaaaatgttaattcaacatttggtggttacatcactagaagagttctcgaaggttaaaagcactacacatagtatacaaacctcttcactttcttgctaaaagacattttggataaaggtttttgaccacgtcaaagatgttacataatattgaatttatacttcatctgtttcatataaaataaaattaacaaaaactaaaaaaaccaattcatatcatacagagttttaaattaataatgcacaaaaaaaacattagttggtttcttaatagttaatataataaatgattagaattttaaaaaataaattaaataatatcactttctaaaactacaattttttggttcgttttcagtaatagccaaaaatataagttgacaaattcttaggaagcattttaaaatatcggtcatcaactcttcagttaaaatttaaaatgcaggaaaagaaaactctagaatcaatcatatatatttggtgttttctaactctttggtagtttggaatttattaaacatgttcatgttttaatctatttagagatttacgaaagcgacaaataagaatttttccgcatttggtagcgagaaaaatgttgcatagtatgcgacaaaaaatgtaaaaacaaataggatctttaaaagatgagaatgtcggacaaaaagtgcgaacatcagattcaaattatcagattcaaaacaaaatacgtaaaacctgatatttattgagttattctgttgtaatttttctttttagttttgtaaaaaaatgtttttgaaataagaaaatatgtgatttaataaaatcacttgtttaaaataaaaccgagggtacattttaactcatggcaattttgttaattatgtggtaattcattaccatcttgttattctttgttaaataggtattatatattgcgtggcaactattgctatttatttgctattttgtttattattgagtaattcttttcagaaaaatgtttacataattgaccttaaaaagcaaagatttttaattttaatatatttttctccatttaaaaagcagataccagtcttttttttagggaaaaaaatatattttactaataaaatattttagtaaaatatcgctttccttctataaatacacttcgacctacactattctctaatcattaaacactatacaaacgaccaaaccaagaagaagaagatg

SEQ ID NO: 9863 - DNA, 3000 bp, Unknown
  misc_feature (1)..( 3000): cDNA_ID_3034275_gDNA_ID_1974092_Annot_ID_180651 3000 nt of promoter + ATG
tttgtggagcctttttctgagcaatttgattgcttctatctgcagttcaaccttcaaatcccaaggaagcgatgaaatggttgaaacaatctgcagagaatggttatgttcgagcacagtatcagttagctctttgtttacaccatggtcgggtcgtgcaaaccaatctgcttgaagctgtatgtgccttcttctgattcttttcttcatgcttctagttgagattctatattgttttcatgaggtgaagctgttatctagattgaaagtagtatctagtcgtttatactaatggctgcactcttggtggaaactgataatcctatgtatagacatgtgcttagttcgtttgtggaaactgatactgctatgtttggatgggttattggttcatttgtggaagctgataatgctatgtttggacatgtgcttagttcatttgtggaaatgtgcggtttctgtttttcatctttctagaatcagtaaagtttgtatcgatatgatgattggattttttttctctttttcgacagactaaatggtacctaaaggcagcagaaggtgggtatgtacgagcgatgtataacatttcgctttgttattcggttggagaaggcttaccacaaaaccgcaagctagcaagaaaatggatgaaacgagcagctgatcacggccacagtaaagctcagtttgaacacggccttgctctattttctgtaagcacctcaactcaactactgcttctgagagtctacttctcttagtagtaatagggataacttatcgacttatgtatatccagaaacaaacatattacgcaatgagttcattcgattttaggttatgagaaggtttggatatgtaagtaatgaatgtaatgggttgatgcaggaaggggagatgctgaagtcagtgctttacttagaacttgccgaacgtggtggcgaagcagctgctactcccgtcaaagaagttgtacaccaacagctttctgcaacttttggtggtcaggccgtacaccatgccatacaccaagccaataactggcgtcctctaccagttactcgatgactcctatcatttatttcagtgaggtctagtgattggctagttacatgtccataacttaaattccaatttgacaatgtatcaatgacaaaaccttatttcagatttctacttttagttcgtactcatgttttaatccaaatggtgcgactgataaatttgtatccacacaataccaccaaaattgtaaatccgcgtttgcagtaggataataaatattacagattgtttcgattttggttttcttttgtgggtttgaaatgttccatggtgtagtgtacaagtaatgatgatttgaaaacacaaactttatatgaataacatgtaaaccaagcttatcccaaacatatgcgatatgataaatatcatacggtatatcatttctcatagcacgacactgagcgtaccatttgaaaaattcaacgatttcttcagatcttgcttgaaaataaagtttgaatctcaaaactccgttcaaaatagaagaatatcaaaaacacgatggatacagtataatatccaaacacattattttttcgtccaaatctatgtgactatgttgactccgttcaaatctatgtgacaatctgtactattgggaaatttgaaatgcatttccgcatatttacgtaaatacattactaagcaaaatcacattctagctgtttcaacgttacatataactaatcaaatgcaacaacaccttctcactttgatgacaatcgaacatccaattaaaaattcaacaagaacaatgcatatgtatggtagaaacaatcacaacgagttaaaaggatcgtaacgaatgaatcatgacagacaattaaaccagcatacgcaattataagtctgaattcggaataccaaacatttatcaaaatccaacaaaaggttcataaaactactaactttaaagagatctcgctctttccaaaatccaaaagacaacaaaagatgataaaactccatagaagattcaaaaacagagttaagcaaataaattcacctaacttaagcagtaagcacaacagcaccaccagcttccttaatcttcttctcagcagtcttcgaaataagcttcgccttcacaacgaacggcttgttctcaggcaaatgacctttacccaaaaccttgaagaaaccatgttgagtcacatcgatcaacggaacattgtccttggttgatttcgccttcacatcttcagggacgagtgaccaaagcttgtcgaggttaacgattgggcagaagaacttgttcctcagcttgtggaaatacctcataccaactttaccgaagtaacctggatggtacttgtcgaagaggatcctgtggtgatgcatacctccagcgttaccacgacctccgggatgcttacggtgcttaccgatacgtccatgtccggcgctgacgtgacctctcttcttcctgttcttcttgaatctggttgtcattttcgccgatctgctacactctcctccctccctttctctctttgcggctagggtttcttaagatatcactgagtttataaagacgataaggatttttacgtttcctattttaccctctagggtttacgacattttgggctatttagttataacgcgagatgggcctttaggcccgattatatcgtagagggggaagagagatcatctaccacaaccacatgattgaaccttcacgcgcctttctgacgcgccggtgttgttgttgttaccatgtggttcatgccttcggtggtggatctccgtgggttccacctcggtttattttggttgacacgattcttccttacgtgacgtctttcttcttcaatttcgaaacgacgcgttttaattcttcttctgcatttcatatgaaccaaggaaaaagcttgaagcgtcgtgactcgtgaagcttcttcatctttagtccaccgaacataaatg

SEQ ID NO: 9864 - DNA, 1668 bp, Unknown
  misc_feature (1)..( 1668): cDNA_ID_3034260_gDNA_ID_1974092_Annot_ID_180657 3000 nt of promoter + ATG
ttcacaattcagataaagatggggaaaaactttatatcctttactactttgggttaaaaaacttaaagcgagttggatctaactgtattatccaaaataaacgagaattgtcttcttgaggttaattagctattatataacgtcatgttgtgccattgtgccaaactcagtcataattttatttttctctcaatcataagttctctctggtcaactctgcttcggtattgagtataattaatcaaaagccaaatagaaaacagtatggtacaagactcaaatctcaaaagagacaaaaatctatatgcatgccatagtgatttttgaaagaaatggaagagaaaaaaaaatgagaggggaaaagctagaggagagcgatgacccattaagattaaatggactaacaaacgaaacgatcatcaatgtgtaagtgtccctacgaggaccgcacccacttaattccccaaattcaatacctattgaccctcttttcttataatgacccacttataattattatcgtatattgttgtatattgtcgttacaagattgtgaaatgttttatattttctatacacgacgaataacctggtcaagctatatatcgagattcaagtaagtatatataatcgcatgcttggttaaatcagtcctccatttcgagagacaatatgattatactttaaaaaatagagactctcgaatgtcgacaatcaaatgtcacaactcgtactatgctattgtaatgtttttcaatcaataaacttggtttgttttccacaattttatatatagttttattaaatttatatcaccggttggtgttgagcctaacaaataatatgcattattaatagtctactactactagtttgtgatatattctttttccagcttggagagaagattaagcatattttggtctctgattaaagagattacgtaccgtaacctcaagacttctataattaaaagaaaaaaatcaccatatttgtttgttagaaactccaagagattccataacaaaaacatttcattattctacaagcaacattgtgaacatggaccataaatttaacttgtacagtactctacataaacggtaaaaaacaataaagcgcttggaaaaagagagtaacaccagaaagcaaagagctttgaagaaacccaaattcaaaggtactcaatttcatctgactagctctgaccccatttcttcaaaccaaagaatgatcacaccaaatccaaaatttcccctataaattacctatctcacataaatataaagtttacttctcttacctctctttcctctttttatcatttacttcataaactttctagatatctgcaaagcccttaatttgaattcatcactaacccacatgcccaaaactttagcaacacacaaccctaataaatttttgttggagggttcgatgagttaattcattctttattgtttttgatcttctgtgttttcccttaagaaagtgattatgtgtttaataggtttgttgggagatgtgtcagtgacatcaagaagacgaacaacaattcaaaaccgtattaaatgttgtctttttgatcactcaagaagaaaacaacaagacagcagatgttttcatcattcttcacaacaagtttcgttcaagtctgatccgatg

SEQ ID NO: 9865 - DNA, 3000 bp, Unknown
  misc_feature (1)..( 3000): cDNA_ID_4266701_gDNA_ID_1974092_Annot_ID_180647 3000 nt of promoter + ATG
ctctgagcaaagagccacatatcatagtttttctaaccaaaactgaatgtatcatcaggtaatgaggaaggcaggacagacccaaagggactagtggtgaaatgttgcgtgatgtgaaaagaggtaatgaggaatttataagaatttaagagacaaaacaatgtatataaacagcatttgaagggctttgagattggcctaagaaccctttcttctataggccttcttaatcctaccatttgattatgtattatgtaatatttgagaatatattcaccaaaaacaggtgcccttaataaacctccactcttcttcactttttttggtcttttacttttgtgtgagtgtatgcggcctactttggaggacatagagattgaaggtcgtatcaaaagaagtgccttttgcatataattgataaagcaaaagttgcaggtaattactttttcatttgggaagaatgatgaaagatgttcgttatagtcacgtagttgtagacacattctactcttcggatcttgagaaccaaactttaagcagtgtggttagagaatatgcgaacaatttgaagtgtttagagatcgattagacagacatacagaacacgtagaacatgcagttgaaacggcagtggcaaatccgactgatagatttgacaaatagcaatactaaacaaggcaacaaatccgacttatagatatgaatatatgatactcgagtcgatgcatgcgattgttaagtagcggaatgattagatatatgtaactaaattctacaaaatagcgatgctaagtcgaacacctctttaacttaaccagttttactaaccatcaagtcatcaactataatggttggtaattcaaatcctatactatatatatgttaatgttgaattatattgtcaattagaagatttgtgattccttttttacagaataatagtgtaatgattaaaaactaggaatttttcatgagcgtttggattagaatctgaaagggaatgtttgtggtaatttgcagaagcaaactacctataccaagtgtgaatgtgtagaggaatttgtagtgttatcaatattccatcatgagcatttggacaagacaagagataaagcataaggaatctattacactcagctttacgcaatggcctttttgttacttcacatttccaatgcgtgtgaatattgataccgtgtcttaacgttctaaccatcttataacatttcccatttagattatagtttgcattcaaatcaagtctctgttgtaatcacttttagaaaatcacattaattaaaatgcattttgtaaaaaaaatactacgtaattgtttggtaatctaggtgtaattgatggacatgaaagtcgttcacatatacacactttactataaaaagaaaagttgaaacttgaaagaaattagatatgttgtgtactacttttatgtcactaacaagaaaatagaagattatcacgattagaaaagaaaaaaaaaacatcttgcaattttagtccaaaattttgttacttccaaagtttttctttgataatatatgtgaaaattttaaatttttatctttcatgcacaatgctacattgaaatacctaataataataatgaccaccagatttttttctttacgacaatggttacattttttggatcctaactatttagaaatgttttattacatttacatattttaaaagctattttcattggattagcactaagttggtaaaactaaaaaccaaaatttttagtttaaagatttgtattagtgtcgtacatgtgtcacaccctgattcaaatttgatataatgaatattattggaaaaagaaaatcaactagcagaactaaatctatttaaattatcacaactttgaaattacaattcatatactatagataaaagacaaaccaccacactttctataacttaaaaaatgggtctaccgtctactacacgactcaatctaaatggtaaaaatagagcacaccaaacgtgtttagtttgctaggcgataccatttgacaccaatattatcgtcaaaactgttaaactatggataagactaacaagtaagggtaagttttgtagccgcagcctttgcttgtcagcattcagacgccgagctgattcatccacattgatcaagaacccaagatttttagtgcataggctttaaaatagatatagaaagcgactataaacaatacgaaaacacatgtggcatatacacccactaatacccatatctttcttttcttttcttaaatggatttcattttaatttctctttcaaaaagcactttattgagccatgaatttaatatacattacttcattaatctcctttgccgagaggtaatgtatatcactattattttgtataaaacccgttcattaattctcaatatattcatatttaaagttttaaactaattaaccttctcaggcttatacgatatatgtactaagtcttaggtaacgacttattaattaaataccgtaagtcggcaatgcgaaacgatcaaaattatgcaatttttaactaatagaaacacatgaaaaattacaagttgtatattaaattactgatacgttaaaattaaattttaggagtaacgaataatgagaattcttattttattttttattttattaaaacgaggaaagtatcagccaaagcaaacgtggtgggtgaatgataagtataaaagatgtctaaagcttcccactcattttcttgtcttcgtatagaatcaaaaaaaaagtaacgacgatgcaaatatactatatattacataggcttcaccagatcatctcgaatcttaatcacattattaatacaattacatagaaggagcaattaaatctctatatataaaaggaagcgtgtgtttcgccttctcttttcaccattttcagttactttctctctttcatcttttaccattctcttcttcttttttttctctcattctgatcatg

SEQ ID NO: 9866 - DNA, 3000 bp, Unknown
  misc_feature (1)..( 3000): cDNA_ID_4266697_gDNA_ID_1974092_Annot_ID_180645 3000 nt of promoter + ATG
aacatgaaataaataaaaaagaagaagactggatcagacattatgcttattgtggtgtctaatctaacatacacatgtgtcgtgttacattcttttagttcccttttcaaatagaaaaacttttgtttaaagggacagccaagtgggtgagtttaaaccttttattcctcaaaataattagatcctgacaaattatgtcttaatccacaactaatctactttcatatatggcattgatcaatatctttatacactttcaggatgtaatggtctctaactctctctatatataagatatgctcgaatatgtagcaacaattgtaaacgagtatcatataatcaataagactttaaaaaataatcagaatcagattcttactaaccaattactgatgcgtaagaagagaaaaggtgaaaagatcataattatatctgatcttgctatgaacatattcatgtgaaaatagacagactttgatacgaagaaaactaaaacagagggaaattgatcttgtcagtttgtactataacttttgaattcttgctagatattttactctagcctctaaatgaaaacgtaaattttgaaggtaaacataagacgatcctaattataatttgtaagctaagattctcatataaataatatcagattagttcactcaaatctataataggcatagggatattggatgtctccacagattttaatcttgaaagagttccacaatttgtcgaagaaacgttttccttttggaattgacgaatgagtcaacttaattaggttagtctaaatacaagaaaattatcgagtgcccattcgaatttttttattatttttcaggaaatgaccaaagacttattagaagtcaagcacgaaattactcaccaaaatcccttaatctctgcattagtttatttctccctaaatttatattttctccatctaaatgattacggatccacctgccaaggaaaaaaaaataactgtgttacgaaaaaattaaaaatcaatacttggttggaaaactaaaactaaaaccgaacaaaaatccaaatatgacattcctattctaattcaacaatagaattaattattagcgttggaacaatctatatatagatattaaagctttgtgtgtgtaagatagaagagttcttaaaagtctatttgtgtgggtaagccattgatcgtttagtgactaaatgatacaacttctaatcccctttatcaaactttatccagtctttgtttagctgtacttttcactgatatattttctcttcttatgttacgtgaaaataaaataatactattgaaaagtaatttgattgatcaattccaccatgcaattaattaccagaactttctgctttcaattatatcttcttaattaattggttattatttcaacttcataactgaatagaatcccttatcgacaaaatgattactcttgtattgttacattattgtcattgtttccttaataattatcaatgatctagtatcataaatgttaccttctatagttaatagttcatgtactaagtactaaaacatgtgtagtatgaaaaaatacaacatccatgttgtaattaatttatagatagattcaagtatacgtacaacaataaattcttttgcagccgtaacgatttttttattttttattttttattgaataccagtaaattctgggccgaagcccgtaatcccctcaggttcgaaaccacagcatgtaatattagtttcgtcccaagcgtcattcgaactggcgacctctaagattcgcctaaggtctttactaattgagctacaatggataataaaagaatctaaccttccaacaaaaagaaatagtattactaaagtcaataagaacaatctatagccaaagaaaaggtctatgggtgttgtggttataagaactaaacaaaagtcggtcaaataacattattgtcttctctattcgttcaccggtcccgtaactgaactttgacgttggcagcctagttacttgattgatttctcatcatactaataaaaataataaaatgttgatacaacccttacataaatgtatacaacatctcgaccagcacgccaatatccctttctatataattaaaattcatcttctaaaatcattttcaagtaccattgcctatccaaactctatacgctatactacatgtaatatattaatgaccataactcgttttcatgacgtatacgtcgtcattgctcggtattattcgtattgctttttttttctgatgatatagaaaaacaaaaaaaaagacctactattgtcaatttttatatacacacacataatgcgagaattgcttcgtcactcctatcatctgatataagaaaaataaactagttgaatgcaaattttcatatctttttgtgttgattatatatacataatacatgaataaagaagttggttttttattaatttcgtggtaagtccgccgatttggcctttctatacgcattcaaacttcacaatactataagaaattaactcctcagttttattgccttcttgataagtggcaactggcaagtaagggtaattagtagtaacggtagaggctaacgaattcacacgagtcactgtcaaaataaaaaattgaattcaaatgacatgagtaaggatagattaacaaaaagaaagttgtaatggatagacgcacattgccaaattccacattatagctttaaaaaaaaaagtctgaacgaagaaagagttgcaattatttagtaatttcaatgatatggaacttgcaaattgtggaaattcttaagaacgtccccaaccaaaaaccaaaaaaaaaaaaaccaaaagcatgcaacatggaaccacatataagagtacccttctttacgtcaattatctttaaagcaagtcttcgctcttcaatttatattttaccaaatcatcttctctctttctctatctctcaaaacaaaaagtaaccatg

SEQ ID NO: 9867 - DNA, 3000 bp, Unknown
  misc_feature (1)..( 3000): cDNA_ID_3034296_gDNA_ID_1974092_Annot_ID_180643 3000 nt of promoter + ATG
attggttattcaacatataggattctgaatgaccgaaatatattttttctaatataattgtattggctgatagaaacttatacaaaccttttaaaagtttttaaattaacatcaatatatacaaaacatgattacacttacgacatcatgtgtgctgcataattacgtccacctttgttacaacattgctttgtttgtactgtaattcgaatcaaaattaccctcgttatttcttctgtctacagcatcatatatatacaacattttctattcttacaaaccattgataattatgaagtaatgaactaagcgcatcatgttcatgccttttgcggttgattattgaaatataaacaaaataaaatgatatggttgtttcgcactgcatgatgatcttacaagtcaatttcacccaaaaagctacaaacatagcaaaagtaggagtttcacgtcttcttgccatcacacagaatcaatatgttgaaacgtatcaaaagtttcttacattatatggtgcatacggaattaacatctggacctatatcatgcatgtttaatatgatgtcgtgttctaggaacgctagtggcaacgaatatatgatgatggttcatgcatatcaccgataaatgaacaaattatccattctgtattatattgatatatatagagtaagttgttatctgattgtggttggtccaaaaaatacatgaatgtttatttcgatcacactactacctctaccatcttggttttttccaattttttagcatgattttttatttacgattagatatatttctttaaaaaaacatgaacatgcatatgagtgaaagtaaattgacttgttagaatcgtcaatatttagttctaataattatatccattgctttaatcactttctatgttgatattattgtttgatcaaaaccatcagtataacctattatacaatagtttgatcaaaaccatcagtataacctattatacaatagttttgattcgttttgatctcttaggtttctttttagctattagaaacaaattcatagagactatagacattagacaatgataatgtagaacaacaattaatgttcctcaaatatcccataaaacctattgaatcaactggtccaaaaccaatacaacgagaacttattgtctacgtttatatgacccaaagacactaatcaatcggcctcaattagaggcggatttaaagacatcacggtatcatcatatccatgttactttttctgttctcttttttacttacccgtccatttctttcttttggcaaaataattttgctaaattacgtggcaaaataattttgctaaattacagcgaagaggatcacatgcatcagcactatttacaacaatcctttagggtatatgttagtcaaccccgtaacaccattcgtacccattaatcatgaacatttcgcaaagttttcccaccaaaaacggcgtcggataaggtttttggcattttgtgtttctttttttgtgtgcatagcataatttcattttaaccgtactattcgaagatttttaaattggataaagatgattcattcattacatagtcgctttgttgttactagtgataaattcatgttaatgattctatgattttcggccagctatctcattaattattaagacgtttaagtggagctattagcaatcgtgtatgacataatgattagcattttcatgtgccatgcccatgcatgaggcttttttttgtttaaaattttattctattatatccgaattttgttatatactaaatgaacatttgtctctgatttggtctactagttaattaacctttagcttcactaataaaaaatctcatgattttgatacttaaacccaaaacatattaaaaacaattagcagtcttttaaatcgataatgtgcttagatgattatacgttcgtaggaaactcttttgtttccaatgcatgttaagaactaagaactcgtatccttaagcaccaatgctttatgcttaatgcctcattagagatataaactgagattgactgtgttctgaatcatcataatataaggcacacaaagaacagaacaggaaatacttagcaatataataggtttccaataaaagtgaagaagaatacaataaacttttataaaaaaaaaagtatataataatttcacactcgaatcaaccaaatgtaagatgtcttgtccatttacacatcacatgagtaagtggattacagattgcaattgatgaaatctggatcttagctaaaaatttattacgttactatatacatcgagttttaagatgttcataatcacaaccacaaccacaagtttgaagaaataagaaacagagtaataatatatcaaataaaatttcatggctgatggaatcttttttctaattgtaggtccaaaaaagcctaaattaatggggaaacaaaaaccaaaattcaatagtaattttactaattatgtcttggttaaatagagtaaaaagaaaattaatcacaaacctccaaaaatcaactaattgagatcaaaacacgtgtcgcatgccaatagggcggtggatcacatggtaaaaaaattcactttaatttttgtctttcttcataattcatctcacagatttcaacttctcttttggattctctcaccgtacaccgtcggcgtaccactccccttccacaccgtcggcattaaaaatctcaaaccctaaaacccgtatccaataacccacccggtccaaccggttattcaaacccggtcaatccaaaattcgcctcggaatccaaacctccatacccaatctaacatggaaaaacctccaatcacaaacctccacgtggtgatcactcattggctcttattctggaatccaagaggacctttttagtataaagagccccttcgttggtcctatcaccttctctctctcacacactaacagaaagcacaaaaaacagagacaaaaga

SEQ ID NO: 9868 - DNA, 3000 bp, Unknown
  misc_feature (1)..( 3000): cDNA_ID_3034308_gDNA_ID_1974092_Annot_ID_180640 3000 nt of promoter + ATG
ataaactcgacccaaaaagttcaaagaagtctaaacatattgctgttcacgtgaaaaagacaacgacttaagaatatgacatttggtaaatgttacttgaagtcttgaagactactctttaatactttatcatcatcatattcgacaaataagcgtgtgcctgatttggtgtgatattgtatgtaccgtacgactctttcaaagtgtctccaacaagtatcattggatatactacgcggcaattaaacaaaataatgaaaaagctttaatttggttgaaatttttgccaaatgacgtaacctttctttattttacggcatagcaaaactataagtcgcaaatcgtacgtactatttcgattgtataaagattcaatgattctacaatttttctaaatcaaaaagttgttgaaagattcaatgattctaccatttttctaaatcaaaagttgttgtcgaacctccgtccgagtaaagattgagtttaatattattagttttatctaaatttctttttgtgaatttccaatagtcttcaccttaatttggacatctctctgatcatgctgactattaaattttttaacattccagcataaaaattgatcattttcagggattagtataactacaaccgttttttgtcaatcaattatataagatttattaaaccgaatacaaacgaaaacaaaacattgactctgatcgatatcacgcgttatggcggaataacgtttgtaatgcgattatgcagaaattttacttattagaaaaattttcatagtgtttagttgtttaccataacgtaaaaatatagaaattgcattttcgcctaaaaattataaataaatcattatgcaaataagtgaatatctatatagtagtttatatcattatgcagtattttattttgggatttattgcaaattttattgtgagacacatttgtattttattgtatacatttgtattttaaattttattgggatttattgcgaattttattgtgcgattatgcgacttatatcataatagaattatgtgatgttaccactcaaagtcattatcttatcacttatgaatataagttatgttatatatttatgtgaaatacatttgtacgtgaagttgttattagttatggttacgtatacattggtttgacacaggacagaaacatctaaaataaatgcagcgtaatttgcaagtactatttaatggtttcattgacatttgttgcaagtttctttcggtggatactgagtgatcaacaccctagaaagtaaaagacttcaaaagatttggtatttttattttgtttttttcattgacccatttatttatcactgtagagatataaacacgattgcaaaatatttatctaaatatacaataatgttttaatccgagtatataacaaattggcaagtgaatcagtgaattgattaaccgaatagtatgactcgtatctaaactaatacttaaaaagatcgatgttagagtatctccattgcaaatatttcatatggattatacaaaaataataaaaagtagaataataataaaacattttagctttctcaaatagtagtagaaacccacataaaaaaagtttctattttttctctataaaaaattttctttggattttttccgtactgaaaacttcttatattttattatttttaatatatatatttttattaactcatgtgagattttttcattttgcaatgaaaatgttcttattaaaagaaaaaaaaaattggaaaggtgaccaagcttgaccgatcgagctaagtcaaaagaacgcgtcttgcttgggtcatgttttggttgttccaagtggtatcgttttttttctccttttgaacgtcatcctcagtgatgtcatattttagttttaatttttgtttcaaatgatctcatatatatatatttttttgggcacacaaatgatctcatatagattgattttttttgtcacccatattagaaattagaaaacactacactaaatgcatgctccaaccacatagggttaaaagtctatgtcattgactacgaacgatgactccaagaaactaaatgaatatgatgcaaacaaaatctttattcgtcataagattgcgattatgtataaatactataaggtttaccggatatttcatttagtttgtcttaacctgataattgctctactagtggatctgccattgaaacaaaaaggctttccactcaaattctctgaggttgcacttgcacatgcatacaaacaaatattcttctaattgtttgcgcgtaagaaaaagaaaaaaaaaactatatccattattgagaaaagtagctgaaaaataaataaattaatagacaaaaatgttaatcaaaatttgcttttgagtaaaaattaaccagttgaatgaataaaatataacttctacagaaggtataagagtttacatgttctaatcctccattaaacaattataaaatacccacaaaatctaaaacttttaggtgaatattcattaatgaataattgaataccactaattaattatgttaaattcatcacaactttttcatgatacatcacacataaaccaccataatataataatgaaagaaatgtgaatttggttgaaaaaaacaaaagaaaaaagtaaaaaggttgaagcaagagactgacttttatccaaaaatgtgcttgaattttaattaaaaaacacgaattcttcttgactttcgtttcaaatctaaatccttcctcgcataaactcttccctgaatcaaaaacccattctaataaaaacaaagacgatctcaaacacgcttcttcttcttcctcattcctcaatcatccctaagacgtcacctcacttaaacccaatccaacgccgccgaaccaaaatcaacttcttcggttcttccccaattcaatactactttctgggtcgtcgttaaatccctaaatctctctctgttgttaccttcccatggg

SEQ ID NO: 9869 - DNA, 3000 bp, Unknown
  misc_feature (1)..( 3000): cDNA_ID_1989710_gDNA_ID_1974092_Annot_ID_180637 3000 nt of promoter + ATG
cagaatttaaaagtgctcatgagaaacatacgtttcagttttcactctcaaaggaacacatttttggtcaactcagttcagttagtttgaagacttgaagttaagaaaactaaattcaatcgaaaggaaaaaaaaactttttcacttttagtttcttttactttttcagacagcttcgtgacaaaacaatataattggttacaactgaaaaacaatcaaaaagaagtttgatgaacatattttgaaaaatgagaaagaagggggttcaaatgttagctttaaaaagattcatatgagacgacaaaaaaaaaaaaaagaaagattcatatgattttaatgtgaatgtgatccgcaaataaataatctaatgtttttttaatagtacaatggtatcttacaaaattaaatgctatttattctatagaaaacttatttttgctaaaaacgtaagatatacatttctaaaaaacataaatttatctaaaaccagattggatttaaaaaaaatagtaacaagtatttgaacctaaaaaaaaaaaaaaaaaactcagataaacagaaatcacctttaaaattacttgatgttttttcttcttctgttaattatacaaatgttgtattactaattatacttaagctgaaattaaacgggattgtggttggagacttggagtgtgtgggaaaccaattcgctttcaacatgcaagcatgtaagtatgaatgctctcattattatcacgttacgttcgccgataataaatgtatttaatttgtaatacaagtataattagtggtaacgaacacattacacatgaacggctatgttacttacttggccattaattccgttgaccttaagagatggcatatttatgagtttctttgactatttgtatatcgacaacttctccaccaccataggcaccactttccattttcttttatgccaaaactatatcagcccacttaaatcaatattttattcacttttatttatggatttatgaatcacacaattctccacaattctaaaattaataaattttgaagaatgaacataaaaatttgttaacatatatcatatattacttgtagatccttctttttggaataaaataaaagtgttgttagcgtcaatatacttcaactttgttaaaaatgagtaaatgaccacaaattgtgaaggaaaaaaaagtagacttgatcttgatttgtcgattgttgtctttcttcggtgtgtttatgattacctaaggtgacaatgaatttgaaggatttccaaaactagagctgcggaacaaaactgtgacggtaggtttctcctagctagtagagaacttggtttagaggagacacgatttctacagatttgctccatctgttgttagtaaactgccaatgctggttttagtgtagtaataacaccgacgtaacgttgttctctttatcaaaaaggaaaaaacaaaacaccaactttattcactattccttccaagagtttgtagatatgcatatatctttcaaagtggagatatttggtggaacatgaagacatttggtgactgagttcattgaaggttttaaggtagggaataacgtatgcttaacatgatgcacggtagcacgtcatctgtccgcaaaatgaggttgtgattattccttgattccaaaagttatttgacactatttgtctattcaatacaaatcgctactcctgatttaataagtgtccctttaaattaattgttctatttttttaaaaattgtcgtttctttataactttgaactatttttcaatttttgtgtcatctctaaatagagagactatactaattttctctgtactatttctattttattggatactccaaagatatgattactgttttacgatttaatatataatttttaacaaaaaaaaattaaatttattcctatttcatattaaagaaaattcaaaatatagtcaatttgttattaggagtataatagaaaatttaatttattttgttaataagtttattgaattgcttgaaaatacaaaatatagtcaatttctgattaagagtatataaaaaaaattagtttattttgttaataagtttattaaattgcttgaaattacaaaatatagtcaatttcttattaagagtataataatagaaaaacattatactattaataattttattaaattgcttgaagttacaaaatatagtcaatttctattaggagtatagtagaaaattttaatttattttgttaacaattttgttaaattgctttttaatccacatgaaaatatccaatctgcaagaagtataaaatcatcattttcaaaatatagaaagaaaataatggttttgaacattgaaaaaaatgatcttattgacaaagaaaggagctttcgacttttggaaacataatccaaattttagataattatgctaatgtatctaaaaatcttaaaacaggataattataatacgttagtgtcatcattatcatacatttcaccaaaataacgaaagaatagactagcaacaaagatttgattttctgagaatatttgttccaatccaaagtaaaaccaatcagaaaaatagaaaatttctatattcacggtaaaaaatatatattttaaaaacagaggctgtgatattttttacccatcatttctagaattttggggaaatgcaaaacactaatccataaaaattaaaaaataattaaactaaaaataaaacaaaacaaaaccaaatcccaaaggattggtccaaaatctgtgtttacaaaatatcaatggcaatttcgtagtaaagataaaaaacaaggatattgtttttaatctttctattaccctattattctcttatatatatatactcttccctccggtcaaatctcgtcgtcttgtttggtctctgtttttcacgccggagatagagagagagaagtaaaaaagcgagaaaaagctagaaactttagaatacccaata

SEQ ID NO: 9870 - DNA, 3000 bp, Unknown
  misc_feature (1)..( 3000): cDNA_ID_4262201_gDNA_ID_1974092_Annot_ID_180638 3000 nt of promoter + ATG
tttttaaatagatggactaatatctaactttttttataattaaaacttttatatttaaaaggtttttctattaataatttaactaagggtttttaaagtaaattggccaattcgtgaaggatatttcatttaaatccccaaaaattcatattcattatgctgtcgtacaatgaattgaaaatcgattaataagaaggtgggtaacaaaatttcctttagtttccttttatttaagaacaccactttacttctttcattattttgaccaagtttaactaggcccgtaaggagaaccataaagagaggacaagaccttgttacagcttacaaccaaaataaaggagaccacagttaaaaataaaagaggtttaaaaacacttctactaaaaaacatggttgataaaaaagttggcggtatccaattttgaaagtatgcaactaactatgcatcattcataaacaattacatatgtaacgtgtgtagtgtagacaaggtaatcgatattcgaaatgagcaaataaataaagaaattgtgattaaaaaatttttaagagttaatggaccagtctaacattatgtgccacttcatttttatatttcacatcaaaaccgaattcattttaattaattagaccgtgtccatttttataaaatattgacgggacatttcaacattgtgtatgaatgttataatattattattctcttcgttagccgaatggttcacattgacatcatagggacatacaaatattgactttttcgaagacacattacaatatatgtcgttttttgaacctcgtggccttgtcaacttataatttgcgtgtttgcgaagagataatcatcaccaaatgtatgttaaacatgtaagtaattaatattcaaaggggccagtatatcccacttaaacttatactatgtcagaaaattaattaatattattgaaggtattaaccatatcaaatattcgatcactataccatagagagatattggaaacttgtgatttcgattatttgttttagcaacaaaataatttctgtgaatgaaaagggccatgtggtgttggccgtggctcatacaaagtttaatgacaggtcactcccacctcactgttttgcctaataatttactacttaattatagtatagaatctttccgaatttttgtttgatttggagtttacatattcatcgtagttttaagatttctaaggtataaatattggtaggtgcatgcaatcagttgaactttcacatcatttcttgatcgtttgttgatttagaattaaacaggtgatcgtgagaaacgctcctaagcaaatatatagtaaatggaaatcgattaattcaaaaaaattgaagtattattattctattaccatgtttattatactatgtacttatttgattttaattttatcattgaaaacaagaaaggagaagcgacctcaatgattaacattcgtcggccgaatcaatatagagactttaaaaattaaaaaaaatggtggtggggtttgcagtctaagcttttaggttaagcctttaacatgtgattaactttccacaccaatggctctccaaaatcccggaaaagaagaaaattatttcgaaactcacttgggattctaaaaatgtgaaaactaagaataactcgctagtcacttccatgaaaaaagtagtggtaacacttaatttgaaattgaggaataacattttatttttgagaaagaatttgattgttagagtatgttattattagttttctaaataataataacatgttagaaaaatggtaatggtatgggagattttattttttattttttataatgagtaaaaatggtgagagaaatgatggtgaattgagagttgttggaggaggtggggggtccaatggcccctctttttattccttattaaaaagtaaaataaccattacatagttctgattaattttgcaattaatagaataatattaagagtaaattttacaagatgttattttgactaactttacgggtgcttcatacacaaacgtaaaagaaatctatgtacagatgaatagtatcatgcaaatctaaaaaaggttacaaaataatgtaacaagtactttatcaaaaaaaaattaacagtgaaacaaagcatgtagtgtgttatgggagactcatgtcttatccgtttcaagatccatgcaagaggaaacattggaatgtctctgtcagtgtctctactgtgaagaacattaagggacagtagtttttgtctggttcgttctcaggttctgcattgtaacaataccacacactcatcaatgtttctctttatgtaatgaatgaggatcaatcaaatagcttataagcaagcaagtgaaatctcacaataggctactgtgaaatcacaacaaaaaacaactttatctgtatcaggtttcaacagtttctttctaattgaacagaatcaaatctttatgccaatttcattctatctacaagttacaacaaagtaaatcattatcctagttatgctcacttgctcagtcattatttagctagctttctattgaagaataacaataatcaaatatcgaaaatgctatttctctgttggatcaaaggatttcagcttcaagataatgacaattgacacatttcaccattcttgatctctctttggttatatctactctaatttacatcaatttacttactttgaactgcctcactttcaaagacatgaaccaaattacagaaacggcgatgcaactataaaatttggaatacatgtggaatttggaatgagattattcgtttttatttcattttcttgaaataaaacactatatgccaaaatcaaacgtgggacctccttatgacacgtggaatttatgtgattcagacaaaagtaatcctagaagtctctgccattagaaccaatctcaagagataaggaaacttcacaaccaaaaacaagaacaacagacacatagagatg

SEQ ID NO: 9871 - DNA, 3000 bp, Unknown
  misc_feature (1)..( 3000): cDNA_ID_3034535_gDNA_ID_1974095_Annot_ID_180677 3000 nt of promoter + ATG
caagccctccagatatttccaatttgcttaaaaataacaactctctaccattcttcttgcaagttaaacctcccctacatcacatacaacaatcaaaagtcacacctgtttcatttatgttcaaccaaattttttttccatataaatatatacatgaatttcttcccacattgcttgtttagccactgcatcaattttcctccaatcagctagtgtaaccggaacgtgttccctcacaaggacacaaagaaaagatgataatgttattgaaccaggtccaacatgatcaccaaagtcagtgaaagtaactgaaaccttttcattaggattttcatccactttacgcatctttgttggtcctctcttctttctttctttcactctttcctccgctactttacttccttcaccatcttcttccatattggcagcttcttccatattggcagcttcttccatattggcagcttcttccatattggcagcttcttcattctcctgctgttcttgtccagtcaaacaagcttctccttctatctcagaatcttctttctcatcttcagacatttgctttctcagtctgatcagcctccggtactgttacatctttgtcattacccttctcttcttccacaacatccggtgtaacatcttctacctcatcatcttgcggtgtcacatcttctacctcatcatctacaggtgtaacatcttctacctcatcatctcgagcagccattttcttgcttcttcttgtagccactttctttgcttttcttttcttattcacctttaatgttgttgcaggagcaacttgtggtgttatatcttctacctccaagccttggttacgtctactacgacgagaaccaactttacctccacctcttgtcttcaccatttctgaaactgataaatgaagaacagtttcaaccgaaacccaaaaatcataatcgaaacccaaaaaaacataatccaaacaagacatgcatgttctccgaaactaagaatcaaaactaacaaatcaaaattgatacccaaaatcacaaacttccgcatccatgttcacacaagccaagaatcggaaccacaaatcaaaattgttttccattccaaagaacaaagaagctatgattgaatgagaacatacctattgaagattgtagggagattgtgataaatcgagttgagagactgagaaatcgaattcagagactgataaatcgagtgaaataaagtgcgaattagatggagagacagagaaagcgagtgagattgagagaaatcgagtgagagttgcagattttgtgctcaataactcaagaaattcgaatgatacctcaagagagaaaatgagagatcgagaatgaaaagttgattttttagatccaacaaaaatgagaaagttattttttaggattttgtttattttgccttagccaaaatttcactttttcctcatacaattttcaatagcgggatactaaagattagaaccacaaaattgccccgcgtcaatttcattatcccgctttaataatttatagcgtttacaatatacaaaacgctatctttaaaacacgattaagtcaattatagcacatagataaaaaaaaacgctatcttattatgctatcaatacccacatttcctgtagtggtcattactcgcaatttgtacaagaaaacctgattgatttcataagtataaatattacacaacatgttaccaaacatttataagtttcatggccagggcctagtgccaaaagcacgatacatattagaaacatacttgttttacaaaaggcacaaaactactgggtttcctaatgtccaccacgccctctatttcccactacgggtttcctgcaaaacaagtagaatcatgagtaatctaagattactcagtgagcttgggattccctgcaacagacatttgtttaccccaacccaaatacccaacatgaaacacgcaacatagaatggcaacgaaaggtagcttgtcgaagcaactacataaatatgcaatgcattaagactccagttttattaaatcttttaaatagggccggatatgctgccaaacccaacaccaaacacacactcccgtgatctcccgcattacaaccacaaaggtatgcaatcggagcatcactaccaaacgctacaccgtcgtgtagacactcggccaaggtaacaacgttacaagaccccaaaaatagcacggttcactacgaaggccagacttatcacgatcttggcacgcttatagtctttgcctcctaccacaagcaccacgtaccaagaccccaaattttaagatattatgaaacatatgattaaatcaacacatagaatcatcaatatctcagcacaacctctcaaccataagcaatagcataagaatctaaagatcacatatgcaatcgaatataaccattcaaacaattcatataactcatgaaatcaatcaagaatgcatgaggatatgattatgaaacttaaacaattatccagaactcactcagtaaccaacggaaagcttctaatgattcaggcagagttctcggctatgggaccctaacttggatcgaacagacgggttaaactcggcagcctctcactcccacctcaatttctcttcacaaatcaaatgtggtcgagttgggcttttataggcaagggattggcgagtcagcatgtccacgtgtcatgagtatgggcgagtcaccaatccacgtgtcatctacccgcgatgacacgttcgctactcaagcggatgagtgacacgtggccacctaaatttcggctccaagctactaatattcgattccaaacaacttttcttgggccccaagttagccgagccacgcatccttggcgcggtcaacagtcggtcaacgcttggcaaggcaaactttcgcccgtggcacgcccgttcttgcccaaacttgcccatttgtgcccattcttgcccaaacttgccctttgatattct

SEQ ID NO: 9872 - DNA, 3000 bp, Unknown
  misc_feature (1)..( 3000): cDNA_ID_2186306_gDNA_ID_1974095_Annot_ID_180687 3000 nt of promoter + ATG
tccaacatcttattgaggagctaaaagagttgtggtctactggagtcgatgcgtacgatatttcattgagtcagaattttaatctaaaagctgtattactttggacgattaccgactttccggtgtatagcatattatcaagatggactactcatggtaaattgtcttgtccagtttgcatggaaagtacaaagtctttttatctacccaatggacggaagacatgctggttttattgtcactatagatttcttcctcatggtcatccatcctgtaggaataaaaaagactttctgaaaggaagagatgcttctcgcgagtatccacccaagtctttgacaggggagcaagtttagtacgagcggttggctagtgtaaatccaccaaaaacgaaggatgttggtgggaacggtcatgaaaagaagatgcgaggctatgggaaggaacataattggcacaaggaaagcatcttgtgggagttgccttactggaaggacctcaatcttcgacataatattgatgtgatgcataccgagaagaattttcttgacaacatcatgaacactctcatgagtgttaagggtaagtcaaaagataacatcatgtcaagattggatattaagaaattttgttctcggccaggcttacacattgatagtaagggtaaagctccaattccagcgtatacactgacagaagaagctaaacagagtttatttcaatgtgtgaaacatgatgtttgatttctagatggttattcttcagatttggttagttgtgtagatctggagaattcaaagttttcaggcatgaagagtcatgattgtcatgtttttttggagcgactacttccatttatctttgctgagctccttgattaaaatgtccaccttgcattatgaggtataatacttactattttttttccaacacttttttatctaatcatttaacttgcacatatattttaggaattgtaacatttttccgggacctatgtttgagaactttacagacaagtcgcgttcaaattctcaaacagaacatagttttaatcatctgtaacttgaaaaagatctttctaccattattttttgatgttatggaacacttacctatccatctctcatacgaagctgaattgggtggtgatataacccgattttcaccaattttatctataatttaggtataggattttgattctttatgttatttctcgagtctttttaatgtcttttcaggtattctatgcaatgggacaacaatggagataaggacacattttggagcaaaacctaaggaaaaggaagctaaggacgattttggttcaggaatcagcgaggagtgtcgaccgacacactcttggtgtcgatcgacaccagttttggccccgtaaaaaccctatatgcttttgagtttccagaagctcaagtctgccccagaagatttctctatttacattattagtccctggacgtttttagggtctatatatatatattgtttttagacctaagtttcttttatcaagtcttttatcaagttctttgcaaaaacctattgtgagagacataagctattcatcccttgttcttcagagttttcattcagatctatatacagtgaagagttcctttcttttcccctctttatttactgtgtttatgctttttaattcaaccatgttttttgcttcatccaatatgcctgagtaatctgcttgttaggaatagggtttctcattagggattcatatggtttagtagattgccccttttgctaggttatctatagaattcttcatctttagttatacctaatgctagatctagagtaattaactagatcttgaatccagacaatagatatgcccgccataggtatctgtagttggatctattatttgatgagtctggtctataggtgtgtaataaaaatcggcctatttactaagatgaacaattgaactcgttaagaatgcatacctaaaggttcttatgaaaaatggtgatttgacaaatcttcgattaaattttttggaaatcttacaatttcttgagtcacaaaagtttttgtaatatatcacagctgtatctatgaatccactttagaaagcttccatgtaaaatgttcttacgaaaaatggtgatttgacaaatcttacaatttcttgactcacaaaaaaatatgttcacctaaatgttttacgaaaatggtgatttatcatatcttattagaattcttacaatttattgactcatgaaatatatatatgtatatacactttctctacgaacattcatgtgttcttttatctcacagttttcatattgaaaatgtaaaatgtacataaaaaaaaagtaatatgtgtgtttgtaaaacataaaatttacataaaataaaaatataaaatatacatataataaaagtacaaaactataagaacacaagagaaagggaaagagatggcgcaccattgataaatttgtaagtgtattttcttaactttatatgttaactatatttttcaactttctcgttatgagatttcaacacatgtccccacctttttgttgcttgaatttttaattatcatgtcatttgcttgtaagaagagttttacgagttatatttttgtgtcacaggtgtacatcttcaaacatgtatcgagcccatcatggagatcaagaagtccttgaagaaacagaaagaaatgtattacatgatgacgagttggatgctgacattattttgttggtgctcctgatttcttttcggatgttgtatttgaggaaatgcctacgacatcgaccttaatattctattcgtcgtgcgatcacaagaggcagagaaatctttatagaaaatgtgcaaaagcaaaaccttatgcattttcgacagttgtgtcgaatatatccacaaatatttctgaagttatgtgaacaactccgggagctgacaagtttatgcgatacgaaatatattagtgttgaagaa

SEQ ID NO: 9873 - DNA, 3000 bp, Unknown
  misc_feature (1)..( 3000): cDNA_ID_2186317_gDNA_ID_1974095_Annot_ID_180691 3000 nt of promoter + ATG
catgagtaatctagcattactcaatgagctcggattcctcaagaaaacgttagtctaatccccacccataatccccacatgaataacatgaataatcagagtacacagagaaggtagtaaaccacacaaacacaagcaagaaataacgtttcttaaagttttaattagggcatgaatgcactcccttcctcaacacacgtgaacacccgagttataaccacaaaggcatataaccggaacatcaccttggctacaccgtcgtgaaagcgacaccggcccttgggtagctaacccagtctctctgggtccttcgaaccccttgggtagctaacccagtctctctgggtccttctgactctaggacaaaacttgctcaccaagttagctcgcccgggtggattcggctccaagttggctaaggcgtggggtcgaagttgggcttgcatggcttgggagaaaacttggtcaccaagtcagctctgcccgaatggatttggctccacgttttaaaacttgggctctactctggcttccgcggattataaattggcagcccttcttctcatttcactcaccattctctcttcttcttctcttgcccttctttcttgctcggggtcaatgagcggggtactacatgcaccatataggttggtgccagctgagcttgcagaacttcagaaacaattggaggatctactcgaaaagggatttatttgtccaagttcatcgccatggggagctccggtattgtttgttaagaagaaagatggaagtatgtagttatgtatagactaccgaggtcttaacaacatgaccattaaggataagtaccaattgccatgagttaatgagctaatggatcagttgggaggagcaagttggttctcaaaaattgatctggcctttgggtatcatcaaatttcaatctcgggatcggatgtaatgaagactgcctttcagacgaggaatgggcaatataaatttgtagtcatgccatttggacttacaaatgcgcccgcagccttcatgagacttatgaacgaggtattacacgattatctggatagcttcgttatcatatttatcgatgatatcttggtatattcacagagtgcggaagtgcatcgtgaacatttggggaaagtgttggatagacttagggaacaacggttgttcgctaagtttagcaagtgtaagttccggcaacgagaaattggatttcttggctaccgaatttcaggacaaggagttacggcggatccagaaaagattactgtaatatagcaatggccgcaacctacatccgttacagaagtacggagcttcttaggattggcaggctattatcgtaagtttgtcaagggattttcatccattactaagcctttgacccgacttactggtaaaggtgtacccttcatatggagtaaggatgttgaggaagcctttgttaagttgaaaacggaattaacaaccgccccaaatctagcattgccaaagccaaataaaccatatgatatctacacggatgcctcgcgagttggcttggtatgtgtccttatgcaagaaggaaaggtgattgcctacgcatcatggccattaagatggcatgaggagaattatcccactcatgatttagagatggccgctgtagtattttcgttgaaagcatttgagatcctacctgtatggagagacggtacgagtatttacggaccaccaaagtcttaaatacttattcacgcagccagatctgaatttacgataatgaagatggatggagttaattgccgattttgatttgaaaattcaatatcacccgggaaaggctaatgtagtagcagacgccttaagtcgccggaaaatggaagtagatgttggaaaggatctagagtcgttatctgatgagctaaagaaggtaactttgttagctctagagggtgaatctagtgagcccttgggtttacaagttgtgactcaagcaaacctacttcaccaaatccgagaggaacaagcgcaagatgaaaagttgcagaaaatcgtggaggagttaaaaacattagatggaccaaacgctagtggcaaccatctagctgatgacggcaccttattactcaatgggagaattacagtgcctgatcgtaaaggattacgataagaaattttaagggcggctcatacttctttattgagcattcatccgggaagtataaaaatgtacaaggatataaggaagtattaccattggcctgggatgaagagatcagtggcgaaatgggtaagccaatgtgagtcatgccaaagagttaaggtggaacaccaagtgccgacaggtttattgcataacctaccaattcctgcatggaaatgggagtcaatatcaatggtttttatcactgaattaccaacaagaccaggacgtagcaatgaggctatatgggtagtagtagatcgcttgaccaagacgactcatttggtatcaatgaaaagcattgatcagtcacctatcctggcagaaaagtatattgatgaaatcttaagactccatggggtaccaactaatatagtatctgatcgagatcctaagttctcatctttattttgccaagacctccatcgtgctttagggactgatgttcccatgagcacgacattccatccaaaaactgacaggcaaactgaaaggaccatccgaaccataaaagatatgatttgactatgtgcactagagtgggctggtgattgggaagactacatgcctttaattgaattttcttccaataacagctatcactcgagcatcggtatgtcgccatttgaagcaatgtatgggaggccatgtcgaactcctctttgttggactgaagtaggagagaggacgagttttaataatcggttgatcgatgagtctacggagaaaattcagttcatccgagacaatatgaagaaagctcaagattgacagaaaaagtatgctgaccgaaacaagaaggcgac

SEQ ID NO: 9874 - DNA, 3000 bp, Unknown
  misc_feature (1)..( 3000): cDNA_ID_3034523_gDNA_ID_1974095_Annot_ID_180685 3000 nt of promoter + ATG
ttctgcatttgatttcgtctatcaccttgtttctctactctttatctctttacttatgcaatatacttatttacctatgattatgttttttagcatgttgtctaagtaatgacatttagttcttaaggatgggatagaatggttgtggaatctgtagtctatagaatagttaagttttagaattgattgaatcccttctagactagttgtgtttactgcttatttctgtctgatcaactggaattcgatcaacaacactatcgcacccagaaggtgttcgatggaatgcttgatccactagttcttgagatatgcgtctctatcccaagggattggccgtttagagcgtttattaacttcatcagtcggttcttattgcctgcatagtgagattccgttaatgggaattaagctaggctagctttgcttgaggatttctatcacgggagtgaattaatctgttgttgaacatgttgtctagggatagcttgattgtgcttgttaaccatccgaataggctaggataccactcattgcctgtttcatcgttgatcccttaatcgttctcattgcttgtttcttagtttttgcattcactagaccaacttactcgaccacacctagtgtctggcaacagtctgtgcagtcgagtatagttgtttcattttctgtctgttactcgaccacatcctgcttctagcatcagccagttgtggtcgagtgatttgtgttaaaaaccccaaaacctgttatttttggcttgacttagtgacttctgatcacatctcatctgtttgcatcacacccatttggattgacaccctaagtactacaacgacatgatagtgctataggattaattgactaaaaacctattatcaatttggcgacgttgccaattgggtgtttgtttgttatatttgagatcattagaattgttaagatcaagttcgtttttgtaacaagagatactaacattgtcttttcagtatttgtatttcaggtacttagcaacctgatttacagactcatctctaattcgtctgttatagttgggttgctacttgttgcatgcatacacggtcacaagggaatcataacctcctattcaacgataacatcgaccgtattgttcgacaactaagagaatagacaacaacagaaacaatggctgaccttgtagatgagcaaatacaacctaacaacattggtgctggtgactttccacacaatcacaaccagcgtcatggcattgttccacctctagtacaaaacaataactttgagatcaagagcagcctcattgcaatggttcaagggaacaagtttcatggcttgccaatggaggattcgcttgatcatctagacgagtttggaaggctctatagccttactaaaattaatggagtcagtgaagatggtttcaagcttcgcttgtttcccttctgatgcggacatcaaccttatttcacaaactgctgaactacaagttgtaccacatcttgtactacatcctgtaccagaagtcccggagggtatcatgacacgttcaaaagctaaacaactgaagaaaaggttcaacttagctgtgcaagatattttgagctccctagagctaggagtaaactggtccttagcaccccataccagatatgatctaatagccgaagaagagcttgctgaagcattcacccaaatgagtcttgaacgaactactcccccaggtatgaaatatcgtttgacaggttcaaggacctctagaaaccaagagaaaactttggagcttcaagagacggacgattcaagtgtcatctctgaaagtgatcgagagagtcaagatcaagaacaagatatcaaggacatggaaaagctcaaagacattgatcaaaatactcaagaggaactccacaaagacccctacttcaaggaacaagccaacaaacaagcacaagacttgattccagaagtacctcaagaagtactacaagaaatgactcaggcgacatctattaggcctaaaacgcatctaggtaaggtttattcagtttatattatctttgcaggtccacacagcccagacaacggctagagtcgccctcaatcgtgctccgcaagagaacttaattagtttccttattttagcttattttctttctaaaaacaatggtttttgtgttttgattttatttgcttccttgttgcgtttttacatttaatttcggccttagggctagctgaaggactcttataaggtccccatacagcagttgtacgatttttacctttgattatcaataaagaaccgcattttctcacttcttctctttaagtgttcttaagagaataagcttgttctttgtcttgtgtgtgtgattcaccaaggccaagttcatgtactgtatcagagacttatcacatctctgtggtgtacttcaatccgccagcacttcccctccattagatcccacacgagagaagcgatcgtcatcgtgttagatctccatcatcgaccatctttccttcacaagagagaagcgaccgccagcttgtgaagccaccatctctatcagatacaaagctcaccaccgagtcttgtatcatcttggtataagagcgcagttgtgcttcctttgcgaggtttcatcattttgttttgtctgccctactttctgaatcagtttttgcattagtctagtttctgttttatttaaattaaaaaaaaaagtatttcagtttcattttatttcgtgttaagtatttgtttttgagtttcgtaatattaattaaaaaaaaaataaaaaattattgttaactttgtactacattagcaagtgtgtcaggaagtgattcaacaagtcttaggtttcttgttttttatctttcttttctagtgctgtggtacattgatttctttgttgtttttgtctaatcccatgtcagttttaggcatatactatgggagaagcagcagaaattccccaaaacgccgtaatgcaaatg

SEQ ID NO: 9875 - DNA, 3000 bp, Unknown
  misc_feature (1)..( 3000): cDNA_ID_2186283_gDNA_ID_1974095_Annot_ID_180681 3000 nt of promoter + ATG
ccaacaaacttgaggatattgtggtttccaacacaaccactaaggcttgagctaatctcactactcttccttttacctctttaaacggttagtattcatagatattgactccttgttcatacatgatattgagaccaatgtgataaaaagaaagtgttcgtctccctataataaaaaaataagaaaatgagagattgataggattttcatatagtgtataggggtataaatgtttcctataacctcattattatacatagtgatgttaacttgggcatggaatacccatttattaaatgggtacatgcaaaaaaaaattaacccatttaaacccatttagagaaaaatatttaatggggtttacctacaaacaaatgggttcccattcaagcccatttatgtttatttatattaattaattttattaaaatgtaaataacttaattttaaataaaataaagagcaaaatattatatatattgaaaacaaaacgtaaaatcatgttttttcaccaaaataaccttttcagccaaaattgaaaataacgttttcccaccaaaatcgtaaacggatgttttttcgccaaaatcgtaaaatcacgtttttcccgtccaaaccgtaaaatcacattttcccgccaaaaccgtaaaatcacgttttcagccaaaattgaaaatcacgttttcccaccaaaatagtaaaccgacgttctcccgccaaaatcgtaaaatcacgtttttctcgccaaatccgtaaaatcacgtactcccgccaaaaccgtaaaatcacgttctcccacaaaaatcacaaaaatcacaaagtgttttccgccaaaccgtaaaatcacgtattcccacaaacactgtaaacgatattttcctataaaaatcataaaatcacttttttccgccaaaatcacaaaaaagtattttccgccaaaattgaaaatcatgtttcccgccaaaactgtaaagtgacattttctgctaaaattgcaaaatcatgttttcatccaaaatcgtgaaattgcattttattaccaagaaaacattttcccataaaatgacattttcccgccaaaatcacaaagaagtgttttccgtcaaaattgaaaatcatgtttttcgccgaaattgaaaatcatgttttccgccaaaagtgttttctctccaaaatccgaaacccgtattttctggccaaaattgtgtttttgcaaaaaaaaaatatattcactcataatggggtattcatcatcgttttgagtccagtttcgtatcattcatcactgttttatatcatttctcatcattcttgcagactttgcatgattaggatagctttgcatacatattgcatttctgagttgttttcaagtgatttggagctgtttgcgagcaaattggaagaaacgagccagaaccagaagacaaactcgaccaccaggtcgtgtgcatccagcaccatactcgaccccctagtcgagtgactttggagccattcttcccatctactcgacccccaggtcgagtaacctcagctcaggccactcgatgacgccactcgacccccaggtcgaatatcacttcgacttaccacctgaccacactcggccgttcactctaccacgttactcgaccccctcgtcgagtatcatcactcaccaccaacaccatcactcgaccgggccctcgatcacatcatcatagtctactcaaattcgcactcaaccagacaagctgagcacaaggaagagaagaggagaagacaaagtgtttggaaacggcctggacctccatcggatcatgaagcccacctcggcccattatcattctatgggccgggcgattagttattggcatgtctactatcattttacttcgttttgtataaatagatgtcttagggttctgtcctgagacatctagtcgacattgagtttttgcttcagttttatttttggttttactctagctacgccgcttttgcttctgtaacctataattcgagatttttccaagttattcagattctgcattcgatttcatctatcatcttgtttctctactctttatctctttacttatgcaatattatcatttacctgcgtttatgtctttgagcatgttgtctgagtagtgacttagaattcttaaggatgggatagagtagttatggaatccgtagtctctagaatggttaagttttagaattgattgaatccctttaggactagttgtgtttactgcttatttctttctgatcaactggaattcgatcccaagcattcccgcacccagaaggtgttcgatggaatgcttgatctactagttcctgagatattcgtctctatcccaagggattggccgtttagagcgtttattgactttatcagtctgttcttattgcctgcatagttagattccgttaatgggaattagtctgggcttgaggatttctatcacgggagtgaattgatctgttgttgaacctttgtctagggatagcttgattgcgcttgttaaccattcgaataggctaggataccactctattcgattaccccatccttaggaatttctcatccatctgatttctctgttttaacgttatcacttaatcaatttagtaattctgttattgtttctgttttctgcatgttcgcttaggattgttagaaaccccaaaactgttattgcttggcttgacttagtgacttctgatcacatctcatctgcttgcatgacacccatttggattgacacctaaaatactacaacgacatgattggtgttttaggataattgactaaaaacaaattatcaatttggcgccattgccaattgggtgcttgtttgctatatttgagattttagaattgttaagatcaagttcgtttttgttataaaagatactaacattgtgtcttttcagactttgtatttcaggtacttagcaaccaactttattcgtctcttatagccaggttctacatgttgcatg

SEQ ID NO: 9876 - DNA, 1539 bp, Unknown
  misc_feature (1)..( 1539): cDNA_ID_1011923_gDNA_ID_1974096_Annot_ID_180696 3000 nt of promoter + ATG
gaattcagtggacccaaagacagtaagtaactcaattcgtcccgtgaataatttaaatcatagagttttgattctgttttttcttgttcttgctgctgatgatgatcatcatagggttttgtgtcaatttcaacttatcagtatcaacttgttaatttttggtgattttatctctgtgtgtttgtactatggacaggtatatatgagggaggtgtgtggaagataagagttgaacttcctgatgcttatccttataaatctccatctgttggtttcattaccaaaatataccaccctaatgtcgatgaaatgtgagttcaatcgaatcagtagatcttttggaggagtgattatgttccttctccaaatcttgagtggtgcttatttgttatccctctttgtatgtggttatgcaggtcaggttctgtttgtctagatgttattaaccagacctggagcccgatgttcggtatgatcataacaaatggaacaatatacaagatagttttaactcctgttagtttttgttatgttaattatgatttggatttagttattcagacctggtgaatgtgttcgagacatttcttccgcaacttcttctgtatccgaatccgtcagatccattgaatggtgaagcagctgcattgatgatgcgtgatcgtcctacctatgaacagagagttaaaggttagatattgagttgattagattcttgttaccctacattatcttatcttcttgctcggtttcagagtattgtgagaaatacgcaaagccaagggcggatactgaggaaatgtctagtgatgatgaaatgagtgaagatgaatatgcctcggatggtgatgatgaagatgatgttgcaatcgccggtaaacttgatccttaatcccgcattggtcttgatatgaatcatgtagctggcttaatagatggctaaaccggggatgacaaaaagaagctggtgactttgtatgtatcatgtatatatgaataatcaatgaatgtttaaaggttccagttttaattgaactgtaaaatctctatttctcttgttgtttacgttgtcattttatggtcgtttaatgtaaattattgaagcttttttaatcttcatgttgtgcacctctgttcaaagtatagtttgttgtaaattatgaatggtcttacagatttatctaataaaatattaaaatcacagtattatttaagacagaaatgcccttatagctcagtggtagagcgtcagtcttgtaaactgaaggtccgtagttcgatcctgcgtgagggcacctttttaccatttttactattttttttcttttcctatgggcttctttaggcccacataataaataaacggcccaaaatagctagctatctccgcctcacgttttgaatgacaaacaccttgccgttttctcaacacttcgctatttttcttcagtcgtcttcttcttccggcttctctcgaaacccttacctaaaaccctaatccgccacatccgtgttttagcctcacgacgaatcacgatg

SEQ ID NO: 9877 - DNA, 3000 bp, Unknown
  misc_feature (1)..( 3000): cDNA_ID_2186387_gDNA_ID_1974096_Annot_ID_180707 3000 nt of promoter + ATG
agttgagttggtttaatacaccctttgtggtcccttcgtcttgggcctcacttctacactttcttcagcccattttcataacacgtgacctacacatgctataatgtacatgatttaattatttatctcttaattgtgttttctttaaaaaagaagaagatataattctctttattttctcttgatcttatgaaaaaaaatgtatggaaaacttgatagacattcatcatttataatgtaacacttcacactggatattttaacaaatacaactacgctttatcgttctcactatgaaatatatcatcttataagctctttttttttactcttattttggatcttttggacgcttatcagtgtcccttgacaatttttggacaatcacatatactatctttggaaatgtaaatagaaccttagtgaaccacttagtttgatactcagttaatcacataaacttacttttcattctagaacaattgttttcgtaccaaattaaacaacgagttatttctgatcatcctatcccaatacgaaagtattggaagacccttggacagtttcctggtgttccaagcaactttacaaatttttttccagttagtactgaaagtttatctattcttttgatctccaaaagtctatacgaacaatatttatatacatacgcatgttagacttcatatgtcaacgaggaaaaatgttatgtatgtgcgtgatatacaatttaatttgttggtacactatctcaagctcttaagtataattcatctactgtgttcacgtatgttaatgttatataacgaataaaggattataatatgcgtagccaaatcgacataattatattatattgaacggcagagagaaactttggtgaaaagttagatggatttgattattaataacataagacaagtggacaaccacacgcataccgttacaagtcaaacaatcatatttatgttccaccaatttctatacaataatacgaatgcaatctcaaattttaataactaagtcatattgactaaagagttagattcgttactggcgataaagggatgaacagagcaacacttccggtttgggtaaacatggaataagtgaaacagacgaaaaagagtggattgattcatcaataaaaatcatttgtactaattaacaaaattaagagttaaagcaatcaatgtcaccatctcaactacgacaaatcacatgtcaatagctagtattattactaatcaatatgagaacaacaaacacatgtaaatttcagattattttacgcataaccttattaaaaataacatttgtaaagatattacagacccggtagcaaataccaaacacataaaatagaaagaaaaatggaacatgccgtattgggatcggctactctataattatatactccttgatattcagatattaacttcttgatatatacacacacatattaaatgtgcatgtgtatacacgtactaagacgtagatggaacaatacaagtctttacgttactaattttataaagattaatctgcggaaaataagactaataatattcatttaaggactcgagaaccaattggtaaatgtcaagaaagactataacagcaaaatattatacgtaataaataataatcataaaagcagatgtactactttatttcattatttgagtttgattccaacggttacatttttcgataaaataaattttgggccaaaaaaaagtacttctaccttttattgacagtgataagttaatgtttaaaatcacataaaacccatggtaatatttactatgttttactcaatatactgtatgtatatatatttagagataagaagaggacagaaataaaagctttatttgaaagcattgtcttatatgtgaaaccatctgcaaatttcaatgtctctttcattctcacgtccctctcctcctttctcattttctctcatttattttacaaactttaggaaaaaaactatcattaaccattttttttattttaaaataataatttcaaattattacagtataaaaacaaaaatgtacactaaaaatgtctgatcgcctgcaaaaaaaactgtctgaacatctaaaataaaataaaaaacagtaaatctattggtcttttgtttttttcttttcacttattcaaaaaaaatatttcctttaagtttataagtttgttattttcttcctcttcttcctcttcttctccataagccaaaactaaaaccctctttaatggcgagaggacccatctccaagaataaacagtaatcttcatttattgtcattacaaatttttctttaagtccaaaaaaatccccaaattaaaaatcttttcttttttaattacatgggcagatgaagagacaagggtccctataattttctctttagatcttcaaaacccaaacctcaatcatgttggtcactttttcttcttcttttataatctatgtagaaacaaaaatctatggtttttaacttttcatgtttattcagtctctccatcatcacaaagctgagtgcttgattggctccacagacaaacataaagtttgcatctttttttctgactcatttcaaccaaaaagctccggtaagcaaatctctcttatttatgtaagatatactcacttatttatgataaagattacatttttaggctaaaggaagtttcttttttcatgaatgtctgaatgagaagttttttttataatgaaaatctcagtttagggtttaggggaaggaaaaaaaggtaacccaggaagtaaaattgacagttttgtatacaaaagaagcaatttttggacactatttgaagaattctctgtttttgttgttgctatgtttgtaagatttttagtttaatgctaaaagatataaaaaaaaattgtttttcaggtctttgagaatcggttttactagattgaagacgagagttttgaatgattggtgaatttgttgatcatca

SEQ ID NO: 9878 - DNA, 3000 bp, Unknown
  misc_feature (1)..( 3000): cDNA_ID_3034546_gDNA_ID_1974096_Annot_ID_180709 3000 nt of promoter + ATG
tcaataattttaacggaattcaatttgtcaaacaaccctgactacgtacctagctgtttttcaatatccttaattcattctagtgaaaaagattgagttaattaaatagttgcatatatctcttatgcaaaaaaaacatttgataacgaacaagttgtattttagtatctattgcttgttttagacgtataaacgaattttagttacattgtgcttacattttcatattttgatcagtttcttgttttttttttgtgtgtgtgtgtgtcaattttatctaactaccgtaaatcaaaatgtttggttgatggaacatagctaaaaatccgaaactactgaatagaatctaagttaaacacgtatatatatatatatatatgtaatatgtgaattcaaatggaaatctattgtttgtgtacgtatacgtaaaaagacaatctattttatgatggaaaaagacaatatatataagacaatgacagaagatccaacatacaggcattacgtgagaggtcccattcaaagtgactctgaattcttaggcactttcaataattcgaatttatacaggtctcagaattataagcaaagcttattgaatgggttaaaggaattaatttagatatgaattttggttggttttataatttatgatggaatcaaaatcatagagagtggctcgcgctgacaaagttattaatgctaaattaaataaactggaccccaaaaaatggactgttcgatcactcttttttttttttatcaacagtagactctgttccgtgcaattaatgcgagcatctctttcattttactttttcaatattttgtttttatttctattgtgtgaagaatttatttatattttcagtctcgataaaacaatgcatcatcatctgcggcgttagatattataatgaaagatttattagttgtgtactagctaatggttaatatgtcatatgtgtaacaaaatgaggtgtatatttagtttgtttttttgtttttttgttttttgtccaatgcattagaagtactgtccagaattgtagtatttcactacatttttatagtcaaattatatatattaagcaaaagtcaaaatgaccctttttgagctgagagccggagactataggctacagaatctaatgtttgcgtgtgttcacgatgaccacagtgtaactagatgacatatcttttaggaaagtaacgaaaaaaataatcagcaaagaaaaactatttaagaaattactgaaaacacagacgttcacgttgatataaatgtacaaatcttcatttatcaggttattatgttttatgaatcatacagttagtacatgaaataaacaatatctgactccgtttttcaacgtacagacacgacaagtagtcctagttaggggtgataattttgggagatgcgaagaattaattaagagcatgcacatagcatatgataataatgactcttggtttcttctttattaatcatctcatttaaatatcattttctcgtgattttgatcaacataggttgttacatagctaaacccattatcaatcccttaccttagaattgaagtcaaggaagaatactaaaccttacattatctttagatcccaaattcactcgttcttgataaccttattgtctaactccatatataattggctcgtgtacgcatctttaatacaaataatttacgaggttgcgattaattaaaatgaaggtgcatagaaaattaattagcaattatacaaatgttctatggtatttccgaagattcgaaaacaatgtagaatatatatattcaatgaacatagtatatattatattttagttaaaccatacaacgtaatttagtcaatactagaagcttgtctctctctccagggtatctcctcgaggcataacattaatttcatgtctttcttcgtgtttcaccattaggatttgttctatcttaaaatcaagttaatatttgtgtatatatttgaccagtaaggcagtaacatataaacattgcttataagggtggcaaattggtttggttggatttgtaagtgttatgcctatgaattttttttttggttcaaactctgcttaaagtctaaagacctatattatgagttactaaaaaaagttatttcctccgtttcaaaatataagatgttttaaataaaaatataaaaattaaaaaatcaaaatataagatgttttaattaaaaatataaaaattaaaaaatattttttaaaaaattcagcagattataaaagctgatgcataatataaatatgtatacaatattaaattaatctataatttacataaaaacttgaaaatattttatattgtgaaacaaacaaatttcttcagaacatcgtttatcatgaaacgtagagaataggacatatcattgatagaaaaaagattttagagatggaaaaataactaatttctcttaacaaaaataaatttccaaaaggagagtggtgcttggaacaccgtattcaaaagggttatacactagacactacttttttttttttttaccatcttgttttatatatatttatttaaaattcctcgtaaagttcagtgttttgtgattatatacagtgtacacacacctaaaataagtatccataaagagatttggtcattcggacaccgtccttttctctcaactcaaagctcaattcaaccacaacagatagtaacttgaaagtcacaaatatttaatattttcccattatagaaggttaaaaaaaataaatatattctgggttttgttgtcttcttctttcttcctcaggaaaccaaaccaatgtcatgtaaaaatcactaactcatgactagtcataacctttaaatcacttctgctttttttctgtttctcttttgatttattcaaagacaacaaagttttgtttttgacaaaaaatctgatctttgtttgttcgtttgtttgttacatggggatgaagaaacaatg

SEQ ID NO: 9879 - DNA, 3000 bp, Unknown
  misc_feature (1)..( 3000): cDNA_ID_2186407_gDNA_ID_1974096_Annot_ID_180712 3000 nt of promoter + ATG
agacaaggatcccaaatccatgaataaagctgcacgcttctcataacaagacaatggatcctaatccatgagtaaaacttcaaacttacgaaaacaagaccatttccttaatcatacgtgaatcttcaaacttttatgttgtgtgtttctatttttctatcagagacggtagaaatttgaaaccttcagtgattcaaatttcaaagttgttttcacttatagagacatcagaacaagttaaaattgaccatcacataacatatctcatttcaacagtgaaataaataagcacgacaaataaaaaaaaattaacaagtggaaacatcagaatcgaaatcgatcaagcaagaagcaaaatggcattgaatcttccattatttcattcatcctccaaatgatgatcctgcaaagcaaacacactaagctaatcagagagggttaatctagactctgtatcttaaatttgacttggacaattcgatagcaaacttctccgaaacccaaaatgaaagagcataaactgaaaagaaaaaaaatgagacgaggacatacctcactcttctgcagatcctccaatattgcaaatgcttttcgtaattctttcttactgcataagccggccagcatacagtggaaagtgatgtaatctggagccacaccacaagaaatcatctcattgagaaggtcttgagcggcatcgagatcacccacttgacaaaacccatgaatcaaagtagtgtaagtaactgtattagcaactattcctcttcgatgcatctcacagaaaatctccattccattgtcaacccttttagccttacaatagccattgattagggtgctaaaagtgactacatccggagagcagcccttgctagccatcgaatctaacatgcgctttgcatcatctacacgatcctgcttgcaaaatccatcgatcattgagttatatgtgattgtggtaggaaatatactccaacgaagcatctccttgtatatttcttcagcctcggagacctttctttctttgacaaatgcattgatcaatgcactgaaagtaacaatatcaggattgatttgcttttcaatcatatgacgcaacaattggtcggcatcactccatctaccagagtgacaaaaagagtctatcatacaattgtaagtgagaacattgggaaaaatacctttctcatgcatttcagtgaaaaggttttgagcattgatgtggttcccgtccttgcaaaggcgatcaacgatggcagtagagattacaacatcggctttgatgtggctttgccccatcttcctaagcagattcaaagccgagacaaccaatcttacacaatccatttacaattgttccgtaagtaaccgcgttaggttgatgaccttcttctaccatccgatcaacaagagctagcgcttcaagaactcgaccctcacgacaaagactgttcatcagtgtgttgaaggtgacaacattgggtctacatccagtttcaaccatataatcaaagaaagctacggcctcagaaatcctacctgattttttgtttgaacattgggtctacatccagtttcaacattgggtctacatccagtttcgcctgattttttgtttttcttctcgatatctctcttttctttttttcacacttctcgatctctctaaccataaaggagtgtacattcaaacagtgtgagctctgagaccgagtgagcgtagtaaaacataatcagaaaactaccggttccattaattggtcggtacattgaccggttaagattaatctagccggaccgggactttaactctggttttgccatctaaataacgtttttttcttttcctataacatctacttaaattttgacattagttaagttggagctattgaagtcaatatcgttcttctttctaaattttagtgatttttttttaagataaattttagtgaaactaaataacctatttttctcctacggaacaaattattgggctctgtaacgagtttcgcttcatactaaaccgtacaagaatctgccaaatatatattcaattcttaatcaaatcttctaaatatagtattgttaaatataaaatatttagtgtataagtgggataataatttgaaccaacctattatattttctatgaataaaatttataaacggatggacatctataagatccgatagtattttgttccacccaacagtattttgttccatccgcttaatgcattaaacgtaaaatatgaaaataaactaaacaaatatgtcgtgagcaattacaagtctcttgtaaaccaacgtttggttcccaagactcaaatcaaacagtgacacacaatggtttcttctcttagtatgatgtgagatctaaccatatcatcgaacaaatcagtggcatcatcttaaattttgagataatgaaacccacttgtcaatttcaaactctctccttctaatgttccttggccctttgatgaaagtatacatgtcttgacggaaagaagatgaatcaatctcgtgctgatcaatcaggtagaagcagtagcagattccgatttcaaaaccctagccaacatttttgttgttgtttcgcctgtttttgtttttttgttctcttatcgatcttactctaactctaagcgagtgatgaccgatgatgaaggaatcccagaaaaccggtaattttaaatttgaatcataaaaccggttcgatctcaacgattccgaaaccggtttgattggtccagtggacttgtcacaacgtcgtaaacaaatactattttccttatccgaaccggttcgtaccaatttcctgatgaaatcaaatcaattacacaataatcaaattttggaagataaggaaaaaagaaaaggagcgtgcaaaaaaaagtcacagtcgcgagataaaatccgaagctagcgaaaagcttcgatttccagcgatcctagtgttggattctacgattttagggtttaaatcttgag

SEQ ID NO: 9880 - DNA, 3000 bp, Unknown
  misc_feature (1)..( 3000): cDNA_ID_3018798_gDNA_ID_1974096_Annot_ID_180710 3000 nt of promoter + ATG
tgattcataaaacataataacctgataaatgaagatttgtacatttatatcaacgtgaacgtctgtgttttcagtaatttcttaaatagtttttctttgctgattatttttttcgttactttcctaaaagatatgtcatctagttacactgtggtcatcgtgaacacacgcaaacattagattctgtagcctatagtctccggctctcagctcaaaaagggtcattttgacttttgcttaatatatataatttgactataaaaatgtagtgaaatactacaattctggacagtacttctaatgcattggacaaaaaacaaaaaaacaaaaaaacaaactaaatatacacctcattttgttacacatatgacatattaaccattagctagtacacaactaataaatctttcattataatatctaacgccgcagatgatgatgcattgttttatcgagactgaaaatataaataaattcttcacacaatagaaataaaaacaaaatattgaaaaagtaaaatgaaagagatgctcgcattaattgcacggaacagagtctactgttgataaaaaaaaaaaagagtgatcgaacagtccattttttggggtccagtttatttaatttagcattaataactttgtcagcgcgagccactctctatgattttgattccatcataaattataaaaccaaccaaaattcatatctaaattaattcctttaacccattcaataagctttgcttataattctgagacctgtataaattcgaattattgaaagtgcctaagaattcagagtcactttgaatgggacctctcacgtaatgcctgtatgttggatcttctgtcattgtcttatatatattgtctttttccatcataaaatagattgtctttttacgtatacgtacacaaacaatagatttccatttgaattcacatattacatatatatatatatatatacgtgtttaacttagattctattcagtagtttcggatttttagctatgttccatcaaccaaacattttgatttacggtagttagataaaattgacacacacacacacaaaaaaaaaacaagaaactgatcaaaatatgaaaatgtaagcacaatgtaactaaaattcgtttatacgtctaaaacaagcaatagatactaaaatacaacttgttcgttatcaaatgttttttttgcataagagatatatgcaactatttaattaactcaatctttttcactagaatgaattaaggatattgaaaaacagctaggtacgtagtcagggttgtttgacaaattgaattccgttaaaattattgaccacgtgtatggtcataaacaaattatgaattcatgattcgatcaatattacgacctactacatatgatatgatgttgtaattaaccacattctcttgctttttatctcattaaaatttatttattttaattcattattttataccaccactattttccacgttctatggatgatcatagtggagccacgcatgaacatggcaaaaatagaaatatgcacatggcaatatatatacactatctacgtatgtgtcaatcagggcaatccaactttgttgtggtataaactctaagctcgaacagatccgaagatattctttcgttctctgacctgattaatgatcacgaagctaaaattgattatcttttatttttgtttataaattattagttatccttaatctgaaatcattttaacaaaaattttactgaatttaatcataaaaataggcttatgtataagctaacacatattttccaatgtccattattatttaatggtggaattcgatgtttaacgatatgattcaagttataaaaaaaccgaattaagtatctatttgtttctataataaaattctgaaatccaacatctctaaactatatactgcattatataataaacagatcatatttatttgaatagagtagctaagattaggcatactagttcaaatgtttgatggacatccgatccagttagtccgggccttcaatatttgggctcaaatgggccgaaactatattgggtcgtatatgaaaagttgaaatatctccaaactgaattttggatgggaaaaagcgggaagtcgagagagtaccttatttctaattttctataacgagggtagggcccaccaagaccatatagcgtaaagcaaaatcaaaatcaaacaattaggaaaaaaacataattttctcttttttcgaaattcgaaccgtaattagccttttgtttttcttggaatctaaaagaaataaaagagaggaaaaaaaggaggaacagtgagcaaaatcgtgcgactgggaaaaatttcgaatttttttctcttccggcgagggattcaaacttccgcctccaatttctcgccgtgaatctgagttttttttttccgtagcatttcaataggagcagtcttcattctccgtcgtctacactatagagaggtttatctacaagcttcttcttctccttatggcgttttaggttcgtatcgttttttttttttttggccttcgtctctgtgttacaaaagcgttgttggcttcttagggtttttgactggatctgcgtgattttggtggaatatagagctgattttatgggttgatttggtcgacattgtggatatttgctaagcgagatgttgaaatgtttgaacaaacttcatcattgtttacaatttaaagcaaattttggctgtttatctctttaattggggaactagtcttatctgaaattgaaagcatttgataggtattttaccatatgaggatttggtgtagaatgatgaagtaaggtctttcatgatttaaccatggattaggaattaggaagtatatgtgaaaccaattaacattgatgctaactttgttgttggctaattggttcatttgctttagggtcttctcgctactataattctgggagtcgcgtaatctctgagttgaa

SEQ ID NO: 9881 - DNA, 3000 bp, Unknown
  misc_feature (1)..( 3000): cDNA_ID_3034550_gDNA_ID_1974096_Annot_ID_180708 3000 nt of promoter + ATG
ttttcaggtctttgagaatcggttttactagattgaagacgagagttttgaatgattggtgaatttgttgatcatcaatggagaagaagagatcaccaagaagtagtaagagtcctggacctgcaattttccctaaaagccctcttgtctacgagagttataagtctggttgtggttggaaattgataaagttcttcgatttcggtcatgtcaaatctggtaataagagacttggttcagagaagaagaaattcgtcagagattctgctggttagtagtttttaaaacactgtttcttggatcatttcgttacatgatcttagtgttaatttgattcttcttctttttttgtaggtaatgtttatactaaaagtcagcttgatttgcttaagaagcttcatgagaagtgtcagtgtaatgatgtaagttttttttgtagttttttggtttagcttaaggagagatttgtgagtgagaaactaaatctcttgatttgttcagcggattgtggaagaagagagatcatgtaagcctaaaacaaggagaagatctttgagttctgatagagaacttgagaagtatgaatctaaacctgttcagggattgctagagagagagataagaaggatcaagaatctaaaggatgaaacttgtgatgtcccggataaacaaaagcaatcttcgttgagtgaaattgagaatgatagtgataagcagatggatatgaagaatgggagagattgtaagaagagttcagagattaaccttcaagcttgtgtgaatgaagctgctgaaacctttatctgttcaaaggcagaagagaaggggaaagatcggtctaagcagttcatggaggcgttagatattctaagttcgaacaaagaattgttcattacactcttacaagatcctcattcattttcggcgaaaaaaagcttagacttggagggatctaaggtaaaagaaccgcgtgataaatctccatcaatggctgatgatttggatagcattgttctcttgaagcctagattatcaagctcggttgatgataaagtgtacttgagattcaaacatctagccaagaagttgaaacttgttgttggatctaacaaagacagcaatcacgcagaaaacaaacccgaaggtagcagtagaggtagagaaatcgaggctgctgcttttagaacaagtgatgtttctaccagtacagttggtcatagaagcccggagtcaccggtgtttaggcgcaagaaacgggttgaatccgatgttttcaagctaagtatcgagaacgatgttttgccaaggagattcatggtggaaaggcaacaggagagattaaattcttcaccggtttatgaagttccttatgcattgagtagtttgcagacaaagctcaaagaaagaagacagaagctagagaagaagagagagagcttcaagttgtggtctttggacaagaacttcgaggtttttgacccgaatccatacaattctaatctaaggtttctcgaaaacaattgtacaggtaaaagattacataacttttaacaaatcatcttcaagccaatgagactaaactgttaaaatgtgaaacaggttcttctgagtacaaaagtctgagaactcatgtagaagacggattcgtggaagatagatatcttgagagctcattagcggtaaatactgagagaaagagtagacatttgttatgtctctactgtctacgctgatttggtgttaatatatgctttataatcgttgcaggagacgaatttgagcctagaaagacaagactgcaacattcatgacccgaaacaggagcaggaacaaccgagtcctgtctctgttcttgaaaggattcatttggaagacgaaacagttatccccggaaatgttaaaatatctaaccttggtaaaagtccatgaatcaaagctttcactattatcatccttggatctgtttgatttacctgaaaaagtctgttactttcttgcagaagagaagattggattatcatttgatgatcctaacattgatcttatagaaaaagaatctgttcatgagtttgtgaagaaagttcttgaagcttcaagattgaattggactaatcttatggcaaggtgcaacgaagacacatcactactcgatgaattctcacacggtagtcacaacgaccagcttcttcttgttcttgattacaccgacgagattctccgcgagatttaccgtcaagacatcaagttttggcctttctcgccatcgaagagctcgagagtcctcaatctagaatcatcccttagagaagatgatctgattcacgagacgatgagacattttgactggagtttactctgctctgactctcctacaagatcattggatcagatcattgaaactgatctaataaagccatgtctttggttggattttggtggtgaatctgaaggtgttgtgtctgatattgtggaaaagattcagcaacaattggtgcttgagatctctcatgagctaagaacaatgcagagaagcatattatgtcgattaatctgaatctcttcggagatattcaactttttttttgtctgtataaaaaagtttataatttgagaatctactcttcatttttagttatctaaattaagaaagattcgatcttttgattctttcagccccgaacataggctggttcaagtaaaaagcttctaattcattgaaaaggttttgacttttgaccaattgagattttgtattggatttagggttttagcagcggccggaaattgtgggcaaaaagattcgaactttttttcattatcccaaatattaatgacaaaagatctcggctttctcgatttttgtgattcagacaatattcacaaaaccctagttgctgctcctgctctgtttttataagcctccacttcccgccaagcccctcttagccataaacagtgaaaaacccttttgttccttcaccaagctctaagaccctatcc

SEQ ID NO: 9882 - DNA, 3000 bp, Unknown
  misc_feature (1)..( 3000): cDNA_ID_3034554_gDNA_ID_1974096_Annot_ID_180706 3000 nt of promoter + ATG
atctttataaaattagtaacgtaaagacttgtattgttccatctacgtcttagtacgtgtatacacatgcacatttaatatgtgtgtgtatatatcaagaagttaatatctgaatatcaaggagtatataattatagagtagccgatcccaatacggcatgttccatttttctttctattttatgtgtttggtatttgctaccgggtctgtaatatctttacaaatgttatttttaataaggttatgcgtaaaataatctgaaatttacatgtgtttgttgttctcatattgattagtaataatactagctattgacatgtgatttgtcgtagttgagatggtgacattgattgctttaactcttaattttgttaattagtacaaatgatttttattgatgaatcaatccactctttttcgtctgtttcacttattccatgtttacccaaaccggaagtgttgctctgttcatccctttatcgccagtaacgaatctaactctttagtcaatatgacttagttattaaaatttgagattgcattcgtattattgtatagaaattggtggaacataaatatgattgtttgacttgtaacggtatgcgtgtggttgtccacttgtcttatgttattaataatcaaatccatctaacttttcaccaaagtttctctctgccgttcaatataatataattatgtcgatttggctacgcatattataatcctttattcgttatataacattaacatacgtgaacacagtagatgaattatacttaagagcttgagatagtgtaccaacaaattaaattgtatatcacgcacatacataacatttttcctcgttgacatatgaagtctaacatgcgtatgtatataaatattgttcgtatagacttttggagatcaaaagaatagataaactttcagtactaactggaaaaaaatttgtaaagttgcttggaacaccaggaaactgtccaagggtcttccaatactttcgtattgggataggatgatcagaaataactcgttgtttaatttggtacgaaaacaattgttctagaatgaaaagtaagtttatgtgattaactgagtatcaaactaagtggttcactaaggttctatttacatttccaaagatagtatatgtgattgtccaaaaattgtcaagggacactgataagcgtccaaaagatccaaaataagagtaaaaaaaaagagcttataagatgatatatttcatagtgagaacgataaagcgtagttgtatttgttaaaatatccagtgtgaagtgttacattataaatgatgaatgtctatcaagttttccatacattttttttcataagatcaagagaaaataaagagaattatatcttcttcttttttaaagaaaacacaattaagagataaataattaaatcatgtacattatagcatgtgtaggtcacgtgttatgaaaatgggctgaagaaagtgtagaagtgaggcccaagacgaagggaccacaaagggtgtattaaaccaactcaactgtacatggcggtggtcggtccacgttccaaattaaagtggccatgtggttttatcgtcttctatcaacgaccaaaatacggctctccaaataagagaaaaacaaatacaaaactacgttatactactaactgactttagtgcaaaaaaacttaatataacttaggctcttaatgatcatgtacatggcgggacagatttgtatgcatagcagataatataatatcaaaaatcatgaaattttggatgcaattccatctcttttacacccatttctctactagggcgttagaaagtctaacattagaagttggactttagttactcaatgccaattagaatctaaacttcggccaactatagataaaaccattagctttttacaaaatcaagaaataaaatcaacctcttatgtcagaaaaccaagagccatcaatctttttcttctataaacaattcaaataaaacgtttgtttggttctctgcaacaacatagcaaattagcaatcattaagcaattttgtctactcatcaaacaaaaatatttctctgtaacgaaaaaaagatagtgggctaatattatgggccatgagactgccttagaagcccatcctttcactacacactttgtaatatacattagaaaccctataaattaatactcgataaattaataaacacgataaattaataaattttgccggtcgaagtcgggccaatgtaaaaattaacgaaaatcgataagataataaaataataattttttgaaacccctatgtaaaaatatagtcccaataatatcataaattaataatcataaatcttaagcatacattctaagactaattttatatgaaacttttattcaagctacaattgcaactctttttagaatagagttggtatgatctcttttatactcacataattctttgcgtatttgatccgtcatatttggttttgtaacattttttctatgaaaaaccattgctaagatttttgtaaagaaaaattgatttaacctccacgttaacgtcgtagatatagagacactatatcttgcagaaaaataaatttaaaatatcaaaaataaaattaaagatctaacataattgaatatacaaataacaaaatatgagaaaaatactaaatcggaaaagcatttttaaaataatttagtattgtgttttacgttaatattctattaattactatttattaatttataaaataaattaatattattataaattaataaaaatttatagtccaatcattattaatttatagagtttctcctgtacatatcttttaatcgtttttagtacacactgcaccgttttatcggcgtctttgatttctttaaacgcatcgtttgtaacccaaaaatgaaaaaacccaactcttatcccctggaaaaaacctttcactgcttgctttctcagtctctctgtctccaatg

SEQ ID NO: 9883 - DNA, 3000 bp, Unknown
  misc_feature (1)..( 3000): cDNA_ID_3034569_gDNA_ID_1974096_Annot_ID_180698 3000 nt of promoter + ATG
ctaaaagatgtgataggttcatgagttactgtattagcaacataggactcctgtctttcatgtgaaaaacaatattttagctaactacgtaataaagataggttcagatttctacaatagaagttacaacatttcacatgactatttgataaactctatgaattttccgttcttgttagggacaaggaatcgaagatggttgagacgattgctagagatgtatcaaacaaactaaacactacaatctctaaggattttgaagatatggtgggtattgaagcacacttgcagaaaatgcagtctttgttacatttagataatgaagatgaagctatgatagttgggatttgtggtccttccggtattggtaagactaccattgcaagggctttacatagccgactctctagcagttttcagcttacttgttttatggagaatcttaagggaagctataatagtggtcttgatgagtatggattgaagttgtgtctgcaacaacagcttctttcaaagattttaaaccagaatgatttgaggatattccatttaggtgcgataccggaaaggctatgcgaccaaaatgttcttatcattcttgatggtgtggacgatctgcagcaacttgaggctttgactaatgaaactagttggtttggtcctggaagcaggattattgtaaccacggaagatcaagagcttttggagcaacatgatatcaacaatacataccatgtggatttcccaactataaaagaagctcgtaagatcttttgtagatctgcttttagacagagttctgcaccatatggttttgaaaagcttgtcgaaagagtgttaaaactttgcagtaaccttcccttgggtctccgtgtcatgggttcatcattacgcagaaagaaagaagatgactgggaaagtatattacataggcaagaaaatagccttgatagaaagatcgagggagtacttagagtcggatacgataatttacataagaacgatcaatttctttttctcctgattgcattcttcttcaactaccaagacaatgatcatgtgaaagcaatgcttggtgacagtaaattggatgtcagatacgggttgaaaaccctcgcatataaatctctcatacaaatatcaatcaaaggagatatagtgatgcataagttactacaacaagttggtaaagaagcggttcaaagacaagatcatgggaaacgccaaatcctaatagactctgatgagatttgtgatgtcctcgaaaatgattctgtaagttcatcttcgtttttttaaaaatctatctgtttaaccatgtcatttcgaaaatactctgcatatcttattaatggtgctaacatttacttttattttgaaatttgtttagggtaatagaaatgtgatgggtatatcttttgatatatccacactcttaaacgatgtgtatataagcgcagaagcttttaaaaggatccgtaatcttcgttttctcagcatttacaagacaagacttgatacaaatgttagactgcatctatccgaggacatggtttttccacctcaactaaggttattacattgggaggtatatccaggaaagagtcttcctcatacatttaggccggaatatcttgtggaacttaatttgcgagataaccagctcgagaagctttgggaaggaatccaggttggtatatatttttgttttgtccagatgaagtaattacttgtcaccatgagctgatgatctttactcctttttgtgctgttttgcattcagccccttacaaatctcaagaagatggaattgttacggtccagtaatttaaaggtactcccaaatctttcagatgctacaaatcttgaggtattgaatctggctctttgcgagagtttggtagagattcctccttccattggaaatcttcataagctagaaaagttgattatggatttctgtagaaagctaaaagttgttccgactcacttcaacttggcatctcttgaatcactcgggatgatgggatgctggcaattgaaaaacattccagatatttctacgaatatcacaacactcaaaatcacagacacaatgttagaagatttacctcaatcaattaggctctggtctggcctacaggttctcgatatatatggcagtgtcaatatatatcatgcccctgcagaaatatatctagagggaagaggtgcagatattaagaaaattccagattgcatcaaagatcttgatgggttaaaagagcttcatatatatggctgtccaaaaatcgtatcactgccagagctccctagctctcttaagagactaatagtagacacttgtgaatcactggagacactagtacatttcccttttgagtctgcaattgaagatctatatttctccaactgcttcaaattgggtcaagaagcacgtagggtcattactaagcaatctagggacgcatggctacctggaagaaatgtaccagctgagttccattaccgagctgttggaaattccttaaccatccctacagatacctacgaatgcaggatttgcgtcgtgatatctcctaaacagaagatggtagaattttttgacttgttgtgtcgtcaacgcaaaaatggtttctctactggccaaaaaagacttcagcttctccccaaggtccaagctgaacatctatttataggccactttactctttctgataaactggacagtggggtattgttggaatttagcacctcatccaaggacatcgacattattgaatgcggtatccagatctttcacggacactaccgatagattagaagcagaagaagctaaatatagttggtgctaagctggtttagtatcaattaaaacgttaataattggtgctaggctggtttagtatcaattaaaccattaatcactttatactttatcccctccagctctctctttctcaaaacttataagtcaaaagtcaaagtcaaaagtcaatg

SEQ ID NO: 9884 - DNA, 3000 bp, Unknown
  misc_feature (1)..( 3000): cDNA_ID_3034562_gDNA_ID_1974096_Annot_ID_180701 3000 nt of promoter + ATG
tcgttttgttaaggaagtctgaggggtccatttctaagatttttcttatccaataacaatctccgatttatgttcttcctaattagaccatggttctgtggattacgtcgagtagtatcggttgtgggtggaggcgatatttttttgcaaatgtcagaccaccatgcttctcttagccaactatgccggacgcttatttttcagagttcttccaggatttgtaatcattcggaggtgaccgtccgtcgtgtggaacggtctgaacataccatcaccagtacatgtgcttgcgaagccatattcgagtttgagaacattttgagatacatgatcgttagattccactagtaggaagtagattagatgaattagaattgaggttttagaataatttttaaaaaatgtgaaggaagcaaaactgagtttttggtatctgatttgagaaatgcttaagtttgatttgtaggctacatatatataacattctcttcacatatttgtggtctaatagtttcaaaattctaataactgctgattaattttggtaaagtttgatcaggtttggttacggaaaatgtttatttcttcaaattatagtatctcaaatgaagctttttaaacatacgtgcccacatgaacaaggcaagtgaacttggtctctttctaaccacatttacacattattaatttattatatatccaaatattatagctaaagggttcataaagctggtggtaatggattttttctgataagttcgaatcttaaagtagatttatataatctgacttttattgttctatattgtctttggtatgccttttacttggaagaaatctcacatacacttcttgttcatttgttcatccagctttgatgcacgtgaaatctggtgtcatgttattatctcaacaaataactataatttatctgcgaagttaaacttttaattagaggataatagcgaattttctcacttcataattagtctttgcaaaattgtcttcctttttaagacttgttaggaaaatactaaatctatgagtgcaaagttggttggttacacgtgtcaaaagcatgagttcggaagtggggttgatgacctaactcattgaacttatgattttcttaataatccaagttatgattttcataaaaatttatattttcttaaacggacaataatgtgtttttaacttttaacgacgtgactcttttgttttcatttcagaaaacgacttaaatctaattcccaaagctcaagttcatgttcctaatataactaagaactaaataatttgtgttctgtttataaaaaatattgtgatttagtaaaagtagacttttaatgtactttctaatcgaaggtcaagatttccttagaaagatttcattttattaaatatcgacaacaaagatgacatgtttaggattaaattggtgtcttagacctaatctatgactcttgtattggaactagatgttgatgccgacaaaaagaagacgaatgaaataggtgttgatgatgatatttaatttcaaggcctaaacttttttcagcttattaatctcgtaagaaattatatggatttttatcgatatgattaaagtattaaaccagattattattagctacagatattttttaaaaatatactttcccaaaggtaggtgaaatgcttatcaatctcaataaaaaaaataaaagcaacatgacgaatgtatccttaaacttggccataaacctcatcattttctactttttttttttttttttttttttttatctttttacatttttaactctttagatttaattcttctaactcccaacaatctccttaccaaaatttcctccttaaaattcaagttttttggaacgttcaaaatagtactataagtttgtttttattagattttagtgagctcaatcggtgacagctaaacattattgcacaattaaatcacaataactctctgcctgtcttccttttttgtgtaaatgcttcaataataattttcccctttttggaaccaagaatcagtcaattgcattgattcttttttaaccaagtaagctaccaaagtttgtagtattattcaaagatgaaaccaaaaactactgtaattattggtcacattatgtgactcacatagatatttcaccaaagctgaaaaagtcgctttattattgggtatggggtagagaaaagtaaataagacccaaatataaagtcaagccaccgtgcaaaacaaattgaaattgcgttgtgacatgttcttataaatttctgaattatcttattacttagtttagccccacacttaatgtgcacacgagaaacctaaaactaaaagagatagattcgattctcccacacgtgcgcttctgctgtgtcacctttctctttgaaaggaatgatcgtcattttcttttgcttaaattatcttcaatttttttttccttaaaatatcttcttccactaatcttcgttagttatgcacacaaaattctgaaatattttgacaaacaatttgtcatttttttttttaaagagaaaatagtcgttataaattaatattttaaacaaaataatgatatcttaataaataaattagagaaagaaaacagggaaaaaaacaaattagtcaaaattttcgcaagtgcaatggacaaaattacccctaaagatcgtataatttacaaagaactttgtctttgccgtgttttgaccttaaaccttgacacacacatacacacgaacacacatatacatatacatgtatatatgtatttttctggaagagaaacaataacattcccagaaatttcggggttacgtgtcgctttatttgtaaaacgatttttcagattttgattgttaaagaagctttctgtgtattatttttgatttttactagagaaaaactcgaatgctctgttttgttctctcgagaaaattctcagactcagagaaaagtaaaaacagagaagaaag

SEQ ID NO: 9885 - DNA, 3000 bp, Unknown
  misc_feature (1)..( 3000): cDNA_ID_2186372_gDNA_ID_1974096_Annot_ID_180703 3000 nt of promoter + ATG
aagaaataaagggccacggttaggtatacgtacttaagtcggaaaattcaacatttgttaattgcagagtctctatgaagctttatgttataatatatgtttacttataattgtatggtttctacatactcaagagttgcatgagttcacacttgcttttaaaaagaaatacttctgctaataaaacagtaatctaatacatgagttcatatattaatatatacaccactataaatgagtataggccttgtcattatcattattatttatcattgtcaatgtcattatacttgttaattcttatagtataatattagttatgtcccctggctcgaggtcaaaatgaaagaaaaggcaaaggtcaacggtacgaagcaaggaaccaccgaattcaaaggctctctaatttaacatgctcgtctataaacacgtgaagatgacattgacatgcaagcaatgatattattatacattcaaattaacattaccggaaacagaaataaactagatgtcccaattcgtatacattgatcgttttatgaatagattatataaattaagggcaaaaacatccaatttgaatgtcgttgatgcgttacacatcttactcttaatcaaaatcgtactattttttttttatgatctaactatttatttttataatatcatattttaacagctaatgatttacattaattaagtttgtgtgtgattattccattacgcattgtgcctacggatacgctcttgaaacatcaaaaatctaacattaatttgatgcgacgtaaaaacacaaactaatcaatgtttcgatatttaaacgcttcatttttctcataactaccaataaatagaatgacgaatacatgtaatggttaaatacttaatttaggtctggagcaaatatttttgaaattatattattcgaacagaatcatatctcacaaaaatatactttgatattgcatgttcacctaatataatcttcataaatctgttggttcataaactaatatgtgtataatacacgtaccttatatatgataatatgaaaaaatcatgggatgttgatttattttatacattatggtttttgtgctttacactgataaaaatcataacaacgcgtttcacaaaagcctaacgtgacatcattatctccaatctgaccgttaagatcaattagctgacgtgttataacacatcattgtcctcttgtcatatacttttttttttctattttcacaagccacccaatgatttggaagtgttttcatattctaatcttctgagaaaaaaatcattataaaagtcagcaactaaaacttagcataaatcaagataacaattctcaaattacaaaacaattcataacttatcccataaatcaagattatttttttcctcaaatttctcttcttgatcaaatcatgcaattagaaagaagaagaaacatgacacttttgtttaggttcgaatcaatcaaagtatggtatttttttccactcaaacacctaatgaattggaagtatttcatattcttcccatatttgagaatattactataaagtaccaaaattcaacaaaattagcatagaatagatcaagcaaattaatctcaaaatgtttactaatcttttatcgttttagatcaatcatagacgacaactaagaaacaaaaaaaaaagatactactcattagcttaattagtccaatgatcaagactcaaaatttcaaaacttttttcaattatggtaaacaaaatatatacacaaaaaaaatcagaacaaaatcggagttctgtcttttcattttttttttttacaagttctgtctttttcaaggtaataaaaaagttataaaaaatcgaaataattaattaaggatgatgttttaattatcggttataatcaaaattagttactactagtacaaagattaacgcaccaaaggagaagaaatctgaagaagtgaatgctttcttcaaacgcgctctctctttctctctctctctctctatctccagttcttattctctctctctttctatctctaccaaatttctgagaacctcttcgtcttcttcgttatctcttcccttcttctgtgtcactaactcacttcactgttagtggaagaagctcttaccatattcacacttgtaagcaacgattttagggatctgaaacgctttcactgtttctgttttggattcttcgattgcttttgagctttcgatttgattccatttcaagctgctgaatctggtaatttttccaagaaattaggtttcgattaagctttccctcactatcaattttctccatgaaattggaaaacttgcttcgggtggtgttttgttgtcttgtgttaatcctccaattttgtgtgtgtagatttgagcaattggttgttctacttagggttttcgttttgttgttgtttctggggtttctggaatttttctgtgtagatccgtttgtgaggtgggaattttgagttactgtttggaaatggatcttgtgtagcttaggttgaagatgatcacattgatttttgaaactagctcaaactaatctgaagatgatacttttttattatcatcactcaagatgctattttttttattatctcttgggtgttctatcattttagaatttgctgaaaaaattgggcttctgtgaattctggtgaattttgtatctgtctgtatcttcaatttcacacggaatcatagttgttgtaaaccctaacgctgggttttgttgttgtaatcagatctttcaggttcttcttggtattgtggtcaaaacaccaatgggataataataaaatggtgtttatattgggacttttcttcgtttgttgacctatgttgggtcaaccaagtatgatctctgaagtggtcaaaaggagagttactttgtaatgttgaacaagagcttttaaaagagtgatagtgtgagtgagtgtgcctcttggtttgtgggaagaagatc

SEQ ID NO: 9886 - DNA, 3000 bp, Unknown; identical to SEQ ID NO: 9504
  misc_feature (1)..( 3000): cDNA_ID_3034573_gDNA_ID_1974096_Annot_ID_180697 3000 nt of promoter + ATG

SEQ ID NO: 9887 - DNA, 3000 bp, Unknown
  misc_feature (1)..( 3000): cDNA_ID_3045665_gDNA_ID_2096290_Annot_ID_195331 3000 nt of promoter + ATG
atgtaattaaaacgacgtcgtatcatagttaaccctacgagaggaagtacattagtttggagaagagtaatagacagagagatagagagaaagagaagcagttcggagaaacaatggcggtagaagacactcccaaatctgttgtaacggaagaagctaagcctaattcaatagagaatccgattgatcgataccatgaggaaggtgatgatgccgaagaaggagagatcgccggaggagaaggagacggaaacgttgacgaatcgagcaaatccggtgttcctgaatcgcatcctctggaacattcatggactttctggttcgataatcctgctgtgaaatcgaaacaaacctcttggggaagttccttgcgacccgtgtttacgttttcaactgttgaggaattttggaggttaggtttttgattttattttatttccgactcaatatctggtttgttcaattattctgcatctgggttttgttataggtttcgatttgttgaggaaagttatgttctttattgggggattagaagatcccattgaagtcattatatgtttttgatgaattgctatgtttggtgtttgaattcgtagctaaagcttatgttagggtttagctttgatattctgttcacttgtttgtgaagtaaagtagaagagcaaagtttgtgagagaaagagaccaactttgaaatctttcttagtggttttctaggtatcagaatttgagcaaacactttcgtgatgactgagggttgatgttgtatagttcttgctcttcccaatgagattcataggtttgtgtattgttctttcgacttcttattttaaaagacattttggtttgcagtttgtacaacaacatgaagcatccgagcaagttagctcacggagctgacttctactgtttcaaacacatcattgaacctaagtgggaggatcctatttgtgctaatggaggaaaatggactatgactttccctaaggagaagtctgataagagctggctctacactgtacggtttctattcttcttttattttgactcgtaactcctgcgtcatcatccaattgaatctcaccggtttttctttttacatgcttggtttagttgcttgcattgattggagagcagtttgatcatggagatgaaatatgtggagcagttgtcaacattagaggaaagcaagaaaggatatctatttggactaaaaatgcttcaaacgaagctgctcaggtaaatagaaaagacctttctcatcaaaactcatcaaacagtctctctgtgtaaaaataagactttaattctcgtctgcatcaaatgttgcaggtgagcattggaaaacaatggaaggagtttctcgattacaacaacagcataggtttcatcatccatgtaagaagaaagcttctcataattctaattcaaaagtcttcattttcttcagatctctcattgtttggtttggtttctttttttttcaggaggatgcgaagaagctcgacaggaatgcaaagaacgcttacaccgcttgaaacctctcaaatctttgcattgtttcaattacagttttgtatgtgagagatctctatttatctaaacatgacttgacagtctgtctttgctagtgttgattgttcacgaagctctaacatttcatttagtaatatattagtatggttcttcataatatttacgttggtgcccttgtataaaaccaccggagtgagcgcaagctttacagacaaacagtgcttctgtctacccaaggcgggccttaaaagcctgaatagtgtatatgtttacttgacaagagcccatgtacactcatgagcgattgactttaaccggttttagagaaaagtacttttacattgtcacatttacatcctttataattaaccttttaatttaggttttaaagatccacctcagcatttattttaatggaatgattatttagcagtgtgaaccgattaactcggtttttgacggtgaccggtttagaggaaatgggagtgtcggtaggagatctaagtagcgagtatgtaaattgtccaactgtctgaaaaggaccacttgggacgacaagattcttcggctaataataatacatcactcgtttcaacaaataaaattttcctttctattattatgcaatcttatagcatatggatttgatcttttttaatatataaacaaaaggttttccaattatgctaaaccataatctgaaattgattttaaatagctacaatcaactacccaaaagcttcaaatatgcaaaataataaagtataggtttatatatataaacgcacacaaaagaggttgaataaaaataaacataaggatgcatgtgcagtccagattagatctaaatctattgagtattgtaataatattgttatgaagatcttgctgcgaaactacacacatttaattccaacatgttttgtttatagaaattgaataaaatcaaacgcgccttcatcttcaagttaaaaatcaaatcttaattagtgaagacaaagaagaagaagacattattttaagtgagttctctctctgtcacactcacaaagctttatactttctggctactgcaagctcatcactgaaaagagcttaaaccagagagatctgataagagaaattttagagtctctctgcttcaacaagatctacatcgaccaggttcaatatttttctctactgttagttcgtgttctagctctgtttcaacgagatccgattctgtgttttcgatttcagtgctaaagttacggtctttgaatctttctatgttaggattagtcttttgaatccataaactctagatttcaattgttaaaggctaggttttgattagtttgaattagctagatccttttttaacagatcttgatgtttaagctcaaagttgtgtcgttatactgagaatcaagtttgtgatttgttgggaatggtttcaggagattagaaagaatcatg

SEQ ID NO: 9888 - DNA, 3000 bp, Unknown
  misc_feature (1)..( 3000): cDNA_ID_3593585_gDNA_ID_2096290_Annot_ID_195337 3000 nt of promoter + ATG
aatattccgaacaaacaaagtccttgaaggatgttcaccataaggatgttcgccagcaatcgatcccactccattttggaaaatgttttgaggcataacattgtcaacgttagaatcagcaaaacccattcttgagaagcccttgtttagactgtcatatggatcagtctccaattcaagacctcctccgctaccgaataaatcataatcttccaagtcatccaacgtagctggcaaggaacttaagtttaaatcatccattagaccagagaaaagctcttcctcatcatcaggaagcatgtttccgattggatgtgagtcaccatcatcaagcatattgccaatgcctccactaaaatggtctaagccagaagccatttcatcaacagactgatggtagctgtcacgagggttgactgcaagagttaaagattataacatcatccaacatatgacgatataaagacgaattaggcaactcaatgtacatactgttttggtgttgaataagaggaagagagcttgaaaagagagaagcatcacttgaagcatggaaatgatcagatcttgagaaggttccacttgggatattcatagtgaaagctctgaactttgattaattctgcttcttcgctacaacgacgaaaaggggactcttttaaaccctgatggaggcaagtgattgaaagatgactccaattgaaacagagaaatatgattttctaaaccaagatggatacaattttaaaaaacagaggattgcaaattccattagcaataataatcaaacaaatccttaatgattcaatctctataaaccctgaactttgattccactgagtttataaaccctaatcaaaaccttattggggtaaatcatcatcatcaagacagaaacgatcacagcagaggaaagagggaactaaaggaaacagaacaagaaccctattttcaatatcgaagaagctaaactgtgatcatccaactgtttttgattaaaaaagaaaccaactttattctacttcacccttttgttgtatttagcaggatcactaacacaaactcattgccgctagagccaaaggaacacacaagtatcaattagtttaaaaatcgaaactttagcaggaagaacaaaaaaaaaaaacttacctagaagaaattgttttttgtttgtttctcccacgaatacagaagaaacactttcttatatatgtgtgtattatatatacacattgataaagaagagagaaattaaataagtttttgattattcctgaaattagatattcttttgaaagcattattaaaagagagaatctttaattggatggagaagagaagagtaatgatcggaacaacggcgaatgattgagtaacaaaggaccaagtggctcgacattttttactcctttttctattttttcccattaaattcaactatatttaaacttcttttggaatccgaaaaatatatctgtttaattgtttttagttgataatacttagtcaactaaaacatttgacaaaacaaaaaaaatcagtttggcccgaattttttaattttgtgtttagataatcattgattaaacatgttccatttatttagggcatcattttttctatttttctaaataaatgtaaatttgaaacctaagtgaatttggagactccaatgaacctctataaataaagaagagatcgattgttttagagccaaaacagacataatttaatcaacaaggcttttaattatggagggcacatcaacatggattctaaactatgaatctaagactcacatcgtcgatcacaaaaattcaggatccttctcaataagtatccaaggaattgagcggattcttatccggagtcctagcggtcgtgaaactttggctcaacaaaaatcgctaggaaagaagaatgcaacagtaagaatcgcatccgagatcccacctgttttcctcaccggagaagaaatatgcagtatatttgtggctaacgtgttgtccaagtcaaagatcaacaagtggattcagcaaagtattgttcctaaaatctgcgaagacctgattgatataagacgccaccttgaagaagaagaaaaagatggtttcttggttgaagttgaagttgttctagaaacgttgtatagtgattggttaagagtcaatgattatgactctcaaggttgtctaataccaatagaagaagagtgcataatatgtctagaagagttagcatcatcaggtagtgagaggaggatcatgaagttgctttgttctcacagttttcataaagattgtattctcccctggctacgctgcaagcgatcatgtcctacttgtcgtgacgacatccacaatcgtcgagcagaagaagaccaccatgaatgatattttgtaaaaagaaattaagaaacaaaaaaagaaaaaggaagaaagaaacaattcaagcgtttctcgtttctggattgataatatgcaagatgtttggtgctagattctgagttaagagttttgatttcctttgttgtgtgcttccttagtcgtcattgttttgacttgtttctcttgtagtgttgttatttgctctccatatttcttggcttagtttccgaggatatctttgtcatccttcgacttagtttccgggatcatgtattgatcgtcggctttttgtatttcacctaatatctcatcaatgaaaattaatcttccagtgaaaaaaaaaaaacgaaaaattttcttaattgaagaaaaaagtgtattttccttttagtttaataaattagattgttttcttaagagcatacaatttctttagttgaaggaaaaaacgaaaaggccgtgaaagaaatcttattgggccacaacgtgagcccatttagtaatgtaatatcagaaaccctagtgtacgcttataaaagacattttaggtttgttcagctgttttacggagtcgcttttgagatatcgatcttacgaagaagcaaatatg

SEQ ID NO: 9889 - DNA, 3000 bp, Unknown
  misc_feature (1)..( 3000): cDNA_ID_2178042_gDNA_ID_2096290_Annot_ID_195341 3000 nt of promoter + ATG
catgctttgatcccaaaatatcggagagaatggaacttttggtcactgctactcagaattgcaacaacaacgaggaacagaatataggtaaggcttgtttcttgaattctacaaataggtcggtcatctttttgttttaaatttgttctgatgatgcttttgattactataggtttggattcttctactagggatgttgtaacaaatgaaccccaagacctgctagttgaagacagttccaaaaatgcgtcgaatatggatacaatattttcacctgttcttgatgatgaactgtattctgaaactgaccgaggtatattctcttactctttcatttttttatttaagctgtctttttgattgagaatcgagtaatctaagaatggttttccttagtatttgtggaagggaacaatgtgcaatgggaaatgcctaggtggggagctgatgactgcagcaacaatcagttttgcaacgattctgattactttctatctgatgtgctgattgcaagcttgccattctatgagagtggaaatgttgattttttcactgagataagtcccttgcctcattgtatctttccagagccaagtgtgttactagatgcagctgagcagtacatgttattaccttacttagaagatagatcagccagcagtgatgatgttaagtctgatgaggataacaggattaatcggtcaagatcaaaaaacttggaagcagcagagaatcacactgaagctgaacaaactgaagattttgatccacagattttcttaagaaatcaaccagaattagctgatgtggtattcaattatgtcccggatatgcagcagcctagggactctccgaaaaggaaggcggtaacctttgtcttgatttggatggtatgatatgaaccacttggttaagttttgcctccatggtacaaccacacttactaatcatctttaaatgacattgcagaaactctggtccattcgactctggaagtctgtagagatacagacttttccttcagagtcactttcaatatgcaagagaacactgtttacgtgaaacaaagaccatacctttataggttcttagagagggtggttgaactttttcatgttgtcatcttcacggctagtcacagcatctatgcgtctcagcttctagatatattggatccagatgggaagtttgtatcgcaacgtttttaccgggattcatgcattctttcagatggtatttataccaaggatttaaccgttttgggtcttgatctagcaaaagtggctatagttgacaactgtccacaggtattttctaaaggattcacttcactacctttgtttcattaatttttgcttttaccttagtctcagtgatagacaccacaagcaaatcgaatttcaaagaacgatagttacagtgcagaatttgtagtttagttgagtattacatggaccctcattgttcttgtttcaggtgtacagattgcaaataaacaatgggatccctattaaaagttggtatgatgatccaactgatgatggtctgattacattacttcccttcttagagacattggctgatgccaacgatgttcgtcctgtcattgccaagagattcggtaacaaggaataagaaatctcttccttttgtttccactatatcttgattgcagattctgggtttctttaacagatttagtcatagactagtttagttcctcaagacttcttaggtgctatttaattagtgaaccatagaataatgctcggtgatattagtacacaagtaaagcgtaacccttgttttagccaggataatagatcattgaaatcttaagtgttctaaatgtacagttggtgaagctgagatactgaatgtataaaagtgagtaactattgagtgaaatatcagttttggaggttaacaacagccattatctccttgtggtaaattcaaactgttggttagatctttgtactactgcattgtcagtaatataaatgaagagaggttcaatctggaaccttctttttcgtgaatttatcgaattttctagcttctgtggtctttcataaaggaggaatatcgtatatgggcgcccggatctggtggttctgtggtattataataagctatttaatctataactctcagtaaaagtttcatgattctgttggcatggtccttattgtgcagatcattcaacaagaagttcttttgattaggcgtaaggaagtgacctgactattgttcttctctgtgttaacttgactcttaaggttttgtctaaggtcttaagctccctgacaaacttgccaatatgtacatctttacaatgttaacttgttttcattaacatttgatagtcatatattcttgttactagttaataaacctgtcagaagaatcatattttctaacattggttcttatgaaccaagaaagtcattgatttcttacataacatcagtcgtttagatgctttggagattgcttttggtaactctcgactaaacatagtttcaaatttggctcaaaagaaactttgtttttttttcagaagtatgaggacattatcaaagttgaaagttttgaccaaaatatgttgaaattttgaaggtctattaaatttgagaaagacattagccatttcttcaatagattcagagtaacaaaaaaatacttattccatggaacttttttattcacaaaaataaagcaatttaagaaaagggaaaaaaaatgaaagtgaatcggtggtggtcaccgaacaagctgtacgtgtgggagagaatgcaaacagagtagcaaaaaaaaagcattgaaggaagcaaaacaaaacatgaaaagaagaatcttgaggtaaaaacgaatcccaaatatcaaaaaggaaactttttttacttctttctttctcttgctgcaaatgatacagaatcagcttcttcttcttcttcttctggtcgaaactcactccacactttcccctaagctatg

SEQ ID NO: 9890 - DNA, 3000 bp, Unknown
  misc_feature (1)..( 3000): cDNA_ID_2105872_gDNA_ID_2096290_Annot_ID_195344 3000 nt of promoter + ATG
ctcctgttcctcctccctctgcctatgggttcggtggaggcgctgtctcaagtaataacttccctttgaatcccacaagtgctgcaaactcctacgaagatgtcttgagctcacagtttaatgagagcaaccacttggcatcatctcttcagcagcaggtaaaccatgaaattcttctcaggttttataatcatgttggtgtgttttggttctgtttggtttccttcctctgtttagtcagctggaatttatactggagtattcgattttatttatttttgttcgattttggatgggtttggctcagttttgaactgttggattttaagaaaatcggtgcagtttggtttctgttatttgtgcgttctctttttcgcaaaccttaacgagtagctttctttgttttgctttgatctacagaacgaaaaaacaacagcatggcatcaaggacaacaagccaactcgcgagtggttccaggaagcggatattacagctaccctggtcatcagaatcagcagcctcccggtttccgtcaagcccaacaactgcaacatcagcagcagtcgtctcaacaacaacaacaacaacaacattatggaggacatgggtatgtgagtccttaccattcacaagctgtaatgtcactagaacatcttcatcaccaataccaacaacagcaaaacgctagagacgcgtcgaaactgtcccaacaatagttatgggccaaccactactgatgaaaagcaatccattcaaatccttctttcccccttattttcatctctcattccagagcagcgatgggatgattccgttgtttgaaaatggcgttgtgttgtgtgtgtgtttaaggttcagggtagggtcttatgagagggttttgtgagagaaccttcaatgggttaacttgtttacttgctaaccttcttatattactaaaaagaactctatttttctttcttgtctgtttcttatcattttactttttaactatttagtcttgacattctatatcagaccaaacttcatagtaaagattattaagcttagcatgtcctgactaacctgcgtcatattaaatagtatggaaagagaagaaaaatttgaaaacagagaaattcaattactatttacacattttgacggtgtgattatgctaatttatctactattaaataagttgtgtataatgaagaaagctaatcaaatcatgtgttctttgtttggtactagtctactacacaatatttaattggatagtatagttaatagagagatgtgtacttatctaactctggaaaaccacgtcatgtgagatttgttaacaaaacgacacattttgccgttttatttgttttcagctccaaaaattcaagtcatctctgtgtttaaaaattttaatatgagagagacgctgtacctttttgtcaaacatagttgacactttaattcggtcgaagtgtttactggaattcaaacttacaacttcgacccctccattttaaaattacggttcccaatggtgacgaaaccgcacgttgcagtacaattttaatactccctccatttttatttagttgatgttttaggagaatacacatgcataaaaaaattatttaacttttatctattttaaaactaaaatatcatctattatttaatcaaccagtagaaaaataatctgcaaaaaaaaatcattaaaatcaataaaaatacaaataattttccattgaaaatttaaaacatcattcctttaaaaacaaaaataaaagtttaaaacatcattacggaaagagtagtaacaaaattttctgaaattgctagaattttagggccacaatcaattgcttctttttattttgctcagttacaatataataatacaatgaaaactacatcgcatttgatatgtagttaaaccgtatatctccattcggaacttatttatctgatctataatgtcaattagatttattattcggaacacaattcatataaatgttagttttagataaaattttagagaaaatatgaaaggagccaaactcaatcttagacttaataaagagtatttttccacaaatagttacaagaaaaccaattcaattattagcagcatgtgtaatgtgtgcaatctagtaatctgaaatagaataacaaaatcggtctggatatattattattgaagaagatgccatattattaattattataaaaaaaagatgccatattaattttaaaaaatagcatgttatataggttcttatagtatcatatgtaaatgtttcttgttttttgtgcaaaccgcatcaaatcattattaaatgaatatcagtatataacctttgatttctctctaaaaaatgttaatagccacaagaaaaacttaagaaagcgccatttctgcttcttcttacttcaatcctttgcgagagagagagagagagagagataaagtttcttcctttttcccacgtttcacgttcctcctcttacctctttctccttcgcttcaatcccttcaagtttcagtctttagatcaaaccaaaaaaaaaaaacgatctttttccgataattcagttaacttcaatcggaaaaccatttccagttttccggcgagatggccaacgaaggaagtgaccctttacttcaatacatgattagcccgagattgaaaaaacctccacagctgctgtttccattaccagaagacaacgaagttgcgattccgatgccgatgacaccgtcggagttcaaagagcgtttaatcttcggacccttttcatgttcgccgcgagattcgtctcacttcatcgattccatgaaacaaccgtcaccgtcgtcttcttcaaccgccgttaataatcctttctccgattcctcaaccctagatcctctgcttccaccaccaccaccacaaccagagccatggttgtccgatcaaacttcgagtcactgtcaaggccacgctcttcaccgatccaaaacagcaccagca

SEQ ID NO: 9891 - DNA, 3000 bp, Unknown
  misc_feature (1)..( 3000): cDNA_ID_2178054_gDNA_ID_2096290_Annot_ID_195345 3000 nt of promoter + ATG
atgtgtttactagaaagtagaaataaatttcataataatatctttatatgttaggcacaaatccccaaaaataggtcagacatttcaactgcagacagatacagttatgtatacgtgtaattgtaagctaatgtttttttttcacttacaggttacaaattacatagaggtccacggtctaactttgggtaatttaaatgtggggcttatggataagacaacgcaaacgattaggcaccaattacggcgtttagtttctgcctaaattaaaactataaatgtgtattaatatatatcttagtatgcattaatgtggttaggtacgagaaacagattcatataccaccattatggcattattatagtatgcaatagaagattgaatatatatttgacttcgaagattgaattttttttggtttagagattattctattactcatatggaatctgataagagttgctgtttctctttcccaaattaaagtatgtatacgccttgatgttcttggtcaaatgtgaatggttaatgtctcttttggttcaaagagaattattcggtcttcttaattatttcgaccaaagattactagattggtattgattttctcgaaaacgtttttcatcgtagtttgttttgaccaaaaagcgttaaaaacatggaaattattatgcccttctttcattgatcaaatttttatataccaaagccatagtattttgattcattccaatattttatactgagtatcactgagacactgactatatatatgtatgtattctcgcgctatccgtaatatgctaggtaatatagcagtgattattaaacgcattaagatcatcatacgtaattcacgataatttgtaatccaaaaacttaggtgtgaccaaaaaaaaaaaaagagttgaatccttcacctaccaaaaaaatggattgtgaccaaaagaccatgacatatcaaatttttagtgattaaaccgatttcttccaagatgctagtatttgtttttatcttgccatattttagtgatttttcatagtagtaaatatatcactttgaccacatttaaagttgatgtatgtccccttcgcatttgtcatgtcggttaggcattatatgtctccttttttcctgatcatatgctcctatcaatttctacaaactcatgaaaacgattactagctatataaatcaagcatagggttcataacatgcaactttaattccccacaattatcgcaaataaaattgtatataaagggtttatcgtaattatcataatgttaacattttcataatatagatacttttggtttgaccatcttttccttaatataagttaataaattaagatgctcttttacttgcaaacagaaagttctaatgtgaaaaagaaattgttattgcgtaatcatgatctcacttatccgtcagcataagtaacgatccactccacatagctacgtcacttaaagtcccatagtaactaattttctttgaatgttatagcaaattattagcaatgtatgattctttgggtcaaatcttacactaaaaacatgaaaataatttgaatatcaagagattcatatattcatattttataaccaaaatatgtagggtctaaattattgcttcttgactaggaattacctatgaataattattaaggttcgtgaaacagtgagggaaaaagaagaagaagaagagaagacagtctctagcacgtgccaggtcatgtgtcggcgacggtcaaatgccggtgcaagtgtttccacgtggcagcctaatactcccaaaatataatcttttgttttcgtaaacttttttccctttgaatctttgactgcctcttactgcattcttcacaccaaacgaccggccggtgactgagtgtttccggtttccggtaacacatagttttcgctgactaagactccttcaataacgtcgtcttcttccacgcgccgtttagtcgtagcgcgtgttatcaagcccgtccactatatatgccacgtatagagtggggaagaaaatgaaggtgagaacttttcatgtcctactttttggccccataaaaaaggcagcacacaaaaataacccaaaatttatgcatgtttatcaaatgtggaaaaataaaagtagaattttaggaaatttatacgaagatacaatgcaaagactcgaagaaatgtatttagtggtatagaaatacttgcaagtaagcatattctgaattaaaaatatagaagcttaagtatgtttcctcactagaagccagttttgcagctctatttttgtcaacttagctttacgtaaagttcttattgcccgaaaccaaaaagtcattcaaaaggcataacatgatatcacaaataaaattatcatctacttctatatcttatttcttgaatatatatatatatatatatacctatctattaagttgcttatcgttcacattattaatttataattaactttatgtacatttgactgataaacattaaaaagacttatttgaacctttttgtatatgaattcaaaattatactgataaaataacgtgaggaagaaatattatgaaagcttttaacatataaattaatttgcataggaaaaaattacacaacttaaattgagattagttaagaaacaagaaaaaacaaagttgatagaaaaataaaagtattaacacgactttggattcacacacgtaccattgaattatatctcaatacacttttacttaattaacttatttccaaaccaagtagccaaaatcatattattcttctctctcttccttttttgagtttcaaaatgcataaatacgagaacgagagacgaagaccaaattaaagtccaagcaccaatctagacctcttaggaaaaaaacctaaaaacctaatccccaaacctaaaaggcttatctcatctcttcttctttgtcttctttactctttttttacctctctcttcattgttcttcacc

SEQ ID NO: 9892 - DNA, 3000 bp, Unknown
  misc_feature (1)..( 3000): cDNA_ID_3090853_gDNA_ID_2096290_Annot_ID_195340 3000 nt of promoter + ATG
caattcttccaaaaacgacataagagactaatctggaatcaaactcaacctaatctggaatcgaatgaatattgttcatgagagaactcaggcaagctaaaatcatcattttcatgtaatatcttcatagatagagactaatgtcagatgtttaattcaaccaccatattgcatcctaaagctacaaactttaagatacagctaccaataaaaacttaaaggaacaaaacccagagattgatctactaaaatcctaaaactctgtgaaatcaaatgagaaaaagggtttaccttgacggtgattctacggtcactctggggtctgatgaacttagcagacctcttcttcacaaccttcttggtaagcaatgggaccgccatatttgcttcttcgtaagatcgatatctcaaaagcgactccgtaaaacagctgaacaaacctaaaatgtcttttataagcgtacactagggtttctgatattacattactaaatgggctcacgttgtggcccaataagatttctttcacggccttttcgttttttccttcaactaaagaaattgtatgctcttaagaaaacaatctaatttattaaactaaaaggaaaatacacttttttcttcaattaagaaaatttttcgttttttttttttcactggaagattaattttcattgatgagatattaggtgaaatacaaaaagccgacgatcaatacatgatcccggaaactaagtcgaaggatgacaaagatatcctcggaaactaagccaagaaatatggagagcaaataacaacactacaagagaaacaagtcaaaacaatgacgactaaggaagcacacaacaaaggaaatcaaaactcttaactcagaatctagcaccaaacatcttgcatattatcaatccagaaacgagaaacgcttgaattgtttctttcttcctttttctttttttgtttcttaatttctttttacaaaatatcattcatggtggtcttcttctgctcgacgattgtggatgtcgtcacgacaagtaggacatgatcgcttgcagcgtagccaggggagaatacaatctttatgaaaactgtgagaacaaagcaacttcatgatcctcctctcactacctgatgatgctaactcttctagacatattatgcactcttcttctattggtattagacaaccttgagagtcataatcattgactcttaaccaatcactatacaacgtttctagaacaacttcaacttcaaccaagaaaccatctttttcttcttcttcaaggtggcgtcttatatcaatcaggtcttcgcagattttaggaacaatactttgctgaatccacttgttgatctttgacttggacaacacgttagccacaaatatactgcatatttcttctccggtgaggaaaacaggtgggatctcggatgcgattcttactgttgcattcttctttcctagcgatttttgttgagccaaagtttcacgaccgctaggactccggataagaatccgctcaattccttggatacttattgagaaggatcctgaatttttgtgatcgacgatgtgagtcttagattcatagtttagaatccatgttgatgtgccctccataattaaaagccttgttgattaaattatgtctgttttggctctaaaacaatcgatctcttctttatttatagaggttcattggagtctccaaattcacttaggtttcaaatttacatttatttagaaaaatagaaaaaatgatgccctaaataaatggaacatgtttaatcaatgattatctaaacacaaaattaaaaaattcgggccaaactgattttttttgttttgtcaaatgttttagttgactaagtattatcaactaaaaacaattaaacagatatatttttcggattccaaaagaagtttaaatatagttgaatttaatgggaaaaaatagaaaaaggagtaaaaaatgtcgagccacttggtcctttgttactcaatcattcgccgttgttccgatcattactcttctcttctccatccaattaaagattctctcttttaataatgctttcaaaagaatatctaatttcaggaataatcaaaaacttatttaatttctctcttctttatcaatgtgtatatataatacacacatatataagaaagtgtttcttctgtattcgtgggagaaacaaacaaaaaacaatttcttctaggtaagttttttttttttgttcttcctgctaaagtttcgatttttaaactaattgatacttgtgtgttcctttggctctagcggcaatgagtttgtgttagtgatcctgctaaatacaacaaaagggtgaagtagaataaagttggtttcttttttaatcaaaaacagttggatgatcacagtttagcttcttcgatattgaaaatagggttcttgttctgtttcctttagttccctctttcctctgctgtgatcgtttctgtcttgatgatgatgatttaccccaataaggttttgattagggtttataaactcagtggaatcaaagttcagggtttatagagattgaatcattaaggatttgtttgattattattgctaatggaatttgcaatcctctgttttttaaaattgtatccatcttggtttagaaaatcatatttctctgtttcaattggagtcatctttcaatcacttgcctccatcagggtttaaaagagtccccttttcgtcgttgtagcgaagaagcagaattaatcaaagttcagagctttcactatgaatatcccaagtggaaccttctcaagatctgatcatttccatgcttcaagtgatgcttctctcttttcaagctctcttcctcttattcaacaccaaaacagtatgtacattgagttgcctaattcgtctttatatcgtcatatgttggatgatgttataatctttaactcttgcagtcaaccctcgtgacagctaccatcagtctgttgatgaa

SEQ ID NO: 9893 - DNA, 3000 bp, Unknown
  misc_feature (1)..( 3000): cDNA_ID_2178023_gDNA_ID_2096290_Annot_ID_195333 3000 nt of promoter + ATG
taactgtcagaatttgtttattgtgcatcactactcactagtaacttagtaagtagtaactaattgtgcagaatatactcaaaaaagttattctcgacaccaggagagactataaatatagagtttggtttttgtttacatttctatgctatatattctttagattttataagaaataagattatttgattcgctgcaaaaacataattgcatggcttgtctatatgccgtcaaaccaagaatctcgaatgttagttatacacgtttcaaatatatatttgatatgagttattcgagaatatatttataatgatagtacatacgtaattcgaaaagaataagtttaagtttgctttagttgtcaaccattctttataccaaaaataaataaattgtcaaccattctttataccaaaaataaataaattgtcaaccattcttaatctaacttctcagtgcgtgtgatttttttttaagcagatgtaagaaagaaaaaggttgtcgacgttaatcatggctcatgcaatgaatcaaataaacttattttatatttatcaacatattttatatacgggagatttttcaaatctatcgacttttttgtttagcaacgagcgcttaatgatggtcgatagatcaaagtttgtcgctagttgacgttttcttttgtagtaaagaactgatcaacagtttttttttttctttttttttttgtaaagtttagaagtgactgcctgactggtattgacgacacaagtgataattgataaatgatgagtttggatcgtatgaattgacttgtatggtaatattgcataacgcgtcatcgtttctcccattattctataaagattagaatcaaaatctctttttaatttcttttcaacttttaaaaaattaacattaatatttacttttgaaaagaaagtaaacttacaaaacatgtccaaagaacagagaaaatttgaatccataattgatgtacattctttttatgaaaagatatgtaagacttacatagagtatatataatttaaattgtaaaaagaaatttaaaggaaatggaaaacaaggttaatgcatactttgcttcatctttttttattaatcacttttatcaaaaatatataaattaatcactatattctttgggttttcttttccttgacactgtcatgaacatttatgcgctatacatgtaatcatttcacatcaaattgtcactgattaagttcactcgaatataattgtcactgattacgtaatcattggtgaatgatgatgcccaaggaagcaaacttgtctcttatctggtgtttatatttgtttgaagttatctcataacaacaactcgatgccagaaaattttatgccacaacaacaactaaaattatagcttgaatctatcaatgggcggtgaactatccgtatggcccgtgctggggagatatatacctaagtaagtgttgtttgattataagaattatttctctttgatatatatcgtacaccacatgatttatattactcatttcctttcattatgcacatcttatacaattttcacacattaaaaactataaattcatcttataattaacatttatgatatgcaatttcattttatttcattaactaagaaagcaaaaattaaacagaaaagtttggaacttaatttttaaaatatacattgaaaaatattttttgttaaagtatataacaacatttattatgaaaaatggagtaatacttagagaacacttataagttatcaactatacacatatataccatcttttccaaaagcaagttttcacacaaatttgcggatataaagatgtttgattctccactaaggattatccttaatccatatgactaaattatttttaatatgattcttgttaactctaaaccaatcaattaatatgccgacaaaaaaaaagaccaatcaatattatattatacgtgtactttttaggcttttagcttcccatcttaataacaaaagtagaacatttacaccaaaaacaaaacaaaactagaacataataagtgaatacaaaattaagcaaataaagagtgtaacagttatattattatttagtttgctatctgaacaaaacatttaattagtcacatatctttggtggagccgaacggaataaactatggtcaaagtttggggggaattcggaatttccgaatcgataaatattattggaatatatattggaaaggtcgcttgaagactacattatgttcttatattattacatgcttttctacattaaaatgtatctagtattttgttccggctaatctcctaaagtaaaatatactttttgttttggtcaatttacttaatgcctaattgatcagaatttattattccggcggtttgtatttcattgatgtgttacgtgtactagttaatactgattttctcttattttatccattcaaatatgagatgatatatattgttaaaaaaacaataactaacgtttaatttcttaaaagctctaacaacatcataagtcataacgcaaacgtcaaagagaataattaaaaatagttatcaactatctaactctatattaaggaagagagacgatcacgaaaagtaagtaagtgacttgtatatatataagtgagatctaaaaaatccataacggtatttggaatttcaccagttttgttctcctctctcttcgttgcctcacttctgtatctccctcttttggtccttctagaaactctcttaagattctcataattttacagtctggattttattttgttaccaatttgttttttttcaagaacgcgtatcaaattttgatatctcttgctacgcaataaccttcccttatatataaagccttctctatttttatttccatctccttccttatagatcccgtgaaagtttttatattacctaacttttttttccctaggataactatgaaaaaagaggaggaaagaaaagaaaga

SEQ ID NO: 9894 - DNA, 3000 bp, Unknown
  misc_feature (1)..( 3000): cDNA_ID_2179036_gDNA_ID_2096291_Annot_ID_195358 3000 nt of promoter + ATG
ttgctttctagatgatccttctagaagatagatcgggccaactcgaacaatctttctagttacttcgttctttatttctatttaacggaatccttaggaaaagtatttggtttctaccgagctaaaacaatataatatgtcgatgtctttagtaaaccaaagttctcgtttaatagctattttgcttcaatttttctataccaaacaatgaatagaactgaagatttagttacgattagaaagacacttttctagctttatccatggatcctcttgttatacttattgaattgtaaatagtcatccaattcaaaaattatgtttcggaatttcataatccaaatttacaattgattagagtctttggatataaattacgagaatctataatcttccttgaatctttcattgaaagggaaaggactaaatccttttaagaaataaaatttttgatcggaagattaatcaaaccgagagaccctttaactattaaagggattaaaggaacgaatcacacttttaccactaaactatacccgctacaatgcaattattgcatataaattaaccttttgtcgaacaaagtaatcgggggtgtaataaaaaaatctgaaaaaatttagaaaaaactagagttgacttaagaaaattagtaaaagcgaattcaattccacttttttttttatttcaaatctttttttatctaaaaatccatcggatgagtctttttaattttaacaaaaaaaggcccggctggggactgaccaggccaggctattaaaataaaaaagatcttttacttgtgtttttgttttgacgagacaaaataaaaaaaggattctctatttctatgattatggttttatttatttcttttttgagttcgcgccttttttatctaatctttagctaaatttttaatgtaactagaattgctgagaaagttctataaaaacagttatataatagtaatatatatattatataatatatattatatatatattatatatataatagaggatttatataatttatatataggatatatattatatatatattatatatttaaatataggatatatatatttatataatcaaataatcaaaaagaatatatatatatataataatataataaaatatagaaaaaaatatagaaaatgaaaaaaaatatatatatatataatataaagataaagaatatctataacaaaaaaagaaagctttttaagaataaagtggagaaggttctttttcaagcctttttttttttttatggaacctaattaaatatcccttttcgattaggagagatggctgagtggactaaagcgttggattgctaatccattgtacgagttaatcgtaccgagggttcgaatccctctctttccccttctccttttgatggtgtgtaatagataaaatcctaataaaattcgagcatttccacgaattaaataaagcaataaaaaaactttcttttttattcttcacgtcccggattacgtcctggatcattagataggaatccaaatatgaagagagaaacaaagaatataactacagtgtatacaaaaagtttgagagtaagcattacacaatctccaagatcttactaaaaaaaaagagaatagattctctatttttatatcaaatatctaattttgataccaataaaaaaaaaggtttcagaaagttatttgtaattaagataatagtcgaatctttcatattcaaacagatttgcataccaacatctagatatttttttggtgaacttgaatctaattaggttctttcatttagggaaaagaggataaaatttaggaaatagaaatgatccagatttagtatggctaccaaaaaaattaaatgtttgaattgagagttcgttcatacgtcaagattttttggatcttttgaattgttggaaaaatcaaaatcgtgaatttgtttaagacagtattaagaattttatcgaaaacttacagcggcttgccaaacaaaggctaagagaagaaagaaaagaggtattacgggcataacatctacgattggattcaaaaaggcgtaggcctctggcaatttggcgactaaaaaagtgcttgaaaaaagggtagaattaaaaaaaatacagatcaaattaaatatattaagcataacaaaaattggtgttcttgtggataatttaattttgattgagtttttaatatattttttatataaggaaaaaataaagaaagatagtctaaaaagactttgttgaacttactcaatcaaaaatccttttattctcttatgagaatgaaagaaataatattttcatacaatatcttaattgaattctatgtaatgatcaataaagtaagttttatttgctatctacacgtgttaaaactttagcaccaatgtaatctatatttcattttgaattgacgaacaaccaataggaatattactcttttagtagtcttgaataaaaagcgaaatggggcgtagccaagcggtaaggcaacgggttttggtcccgctattcggaggttcgaatccttccgtcccagagtacagtcattacagaatcaatcttctattgcctttgtacaccatctttctctttctgtttaaaaatccaaattttttaagaataaaatattgaaatgaaaagaagaataaacttaatttttcattatttcaaccgaattcaaaaaaaatctatttgcttttttaatttgtgtgatgcgggtaagtaaggtagaaccgcagattctaagagttttaataaaaaaatctatatttatttatttatatataaatatagatttctattcaaactaatatggaattcattttcattctgaccgaacctttacgcgtaaataaactattccattcatagagaaagaaaaggtatagattattatatactgactgaactatgactattcatgattccatcattgaatcaattacacaaactagaggaatgttatg

SEQ ID NO: 9895 - DNA, 3000 bp, Unknown
  misc_feature (1)..( 3000): cDNA_ID_2179108_gDNA_ID_2096291_Annot_ID_195374 3000 nt of promoter + ATG
tatccattgctttacttagctcacctctgtattccaattctcccttagaaaacataaaattgaaccacgatttttccatagagcttctggcctctatttaaatgaaaatacaataacaatagatgaatagtcattcaatgaaaaaattgaaaaatgcaaaatttttttgaatagttcattttctattcagagtaagcaaaacatatcgatgcaattgctaagattattaagtaaagtaattgaaatgaatcaattttaattctaaatgaaaagaaggattttcttatattgtgtaaaattctcataaaaaaaaaagaaatatttgttcttcgcttatgaatataagaatattaagaacttttttagtaaaatctcgtatactaatataaaaaaaaactttttttattccaatacggaatgaaaagaaaaggacaacatgcaggatggggtagaagaagcggggatacttggttcaagccctgacacgaaagaatataacactcctaagaattaagaatccatgtttcgtataggatttcttgtggacacaacactacaataacaaaattgtagttgtgtttaatcttcttttttttattgaagagttttttttctatctaaatttaagtatgtatctatcaaaaaaaatagtatatacaacagataacctcggctcaatcttttttagtaaaaaaaagattgagccgagtgcaattaaactaataaaacaaacgtgaattactaaatctaattcatctactcttggccatctaatttatcgatggttgggaagttaaatgtgatctctttccatacttcacaagcagcagctagttcaggactccatttgcaagcttcacggataatttcattaccctcgactgcaagatcacgtccctcattacgagcttgtacacatgcttccagagctactcggttggctacggcacccggtgcatttccccaagggtggcctaaagttcctccaccgaattgtagtacagaatcatctccaaagatctcggtcaaagcaggcatatgccaaacgtgaataccccctgaagccacaggcagaacaccaggtagtgagacccaatcttgagtgaaaaagataccgcggcttcgatctttttcaacataatcatcgcgcagtaaatcaacaaagcccaaagttgactccctgtctccttcaagtttacctactactgtacccgcgtgaatatgatctccaccagatagacgtaaagctttagctagtacacggaagtgcataccatgattcttctgtctatcaataacagcgtgcattgcacggtggatgtgaagaagtaggccattatctcggcaataatgagacaaactagtatttgcggtgaatccccctgttaagtagtcatgcattacgataggaactcccaattctctggcaaatacagctcttttgatcatttcttcgcatgtacccgcagtagcattcaaataatgccctttgatttcacctgtttcagcctgtgatttataaatagcttcggcacaaaataagaaacggtctctccaacgcataaatggttgggagttcacattctcatcatctttggtaaaatcaagtccaccacgtagacattcataaactgctctaccatagtttttcgcggataaccccaattttggtttaatagtacatcctaataggggacgtccatacttgttcaatttatctctttcaacttggataccatgaggtggtccttggaaagttttagtataagcaggagggattcgcagatcctctagacgtagagcagccagggctttgaacccaaatacattacccacaatcgaggtaaacatgttagtaaccgaaccttcttcaaaaaggtctaagggataagctacatacgcaataaattgagtttcttctcctggaacgggctcgatgtggtagcatcgtcctttgtaacgatcaaggctggtaagcccatcggtccacacagttgtccatgtaccagtagaagattcagcagctaccgcagcccctgcttcttcaggtggaactccaggttgaggagttactcggaatgctgccaagatatcagtatccttggtttcatattcaggagtatagtaagtcaatttatactctttaacaccagctttgaacccaacacttgctttagtctctgtttgtggtgacataagtccctccctacaagtcatgaatttagaattcttgcaataaaacaaaacaacaaggtctactcgacataaattaggaatagatttaattaacctttttcacaggaatctttcacaaaattatcaactaatcagaattattctttattagaccatgatatttgattcgccaaatacatcattattgtatattctttcatatgtatagcgcaacctaatacttctttttcaagttttgaatctttgactttttataaatccaaatatttaatattaaaattaaaatattaataaaatcactcttgacagtaatatctgttgtatatgtaaatcctagatatgacaatatgcggaattcatccatgaaaatgaaaaacaagggggggttgctaaagggatgaataaatgggacgcataaccggatatgctaaaatgaaaatacgaaaaaaaaggctaatgagatcgaaataatgaatcataactaaagttccgtttcgaattcgctagataaaacaaaggcttgcctattcctattatgataaaaaaataaaagactttccgcaaaaaatttttttattcatatattttttattttaaaactaggtttcagttagttgagcttgaaaatgactattccttcattgaatgaataaaaaattgaattccacatccgcttgggtgggaccaacgaaatcgagtgcttactcccactttttattgaattaaccgattaatttgctatcgaagattttttctgtattcgaaaaaattcgtaacaaaatttaacatattttttttattatg

SEQ ID NO: 9896 - DNA, 3000 bp, Unknown
  misc_feature (1)..( 3000): cDNA_ID_3034635_gDNA_ID_2096291_Annot_ID_195388 3000 nt of promoter + ATG
tttcccccgcttaatggatactcatttgttatcattgggggttttctaaaaaatggagttgattggatttgcaccaatgtaaaccataagtttcagacacaatagagtatatgaacgatctatattttgtaaataatgaatcgagttcgtccattctattttattcataggtactgatccgtgatatttcaaaaagaatttcctttttatgtctcagtctatgatctaaacgagtcgcacatacacccgagtacatgttcctcgtcgctgagggcatccccgaagcgctggggatttcgtgacgtttcggattggctgtcttgtatttctaataagttgtttaatggttggcatacggaatcatataaataatgggctggtttagattagttctaaccggctaattctgaattacttctcttcaagattctcttcaatatttttttatttttatattgaagagaatattaaactaaacctttaatctaaaaagatataaaattctaaattgtagatttgcatgaaatcgctcctattttttattgaaccgctacaagatcaacaattccatgagcttgggcttctgttgctgacataaaaacatcccgttccatgtcttcggatataacccatataggtttgcccgttctttgtacataaacccttgtgatggtttcgcgaagtttaagtaattcttccgcttccaagataaattctcccgtttgtgcctcataaaacgaactagcgggttgatggatcattaccctgatgatataatagaaaaggtttttctatttcgcagaatgagacgggataacaaaaaaaaaaaaatagataaatttgaataaccgtacaggctttttttgtgcattgcatacggctccacaatggaattgacttttttgacctttccttaaatcatccaattaccatccttcttttttttgtaggagttaaaaaaatactatgatggttccgttgctttatatatcattgttttgattcgtcgatgattcagcaatcccaaagtgtctttttttttttttacggtgtgaaaacaaagtttgtgacgctgaaatgtgcccgaataggtaagatatcatttgaaaaacctcttccttatctcatactactctttcaatatataatcgaatttttttttaatctaaaaaatttcatattgaattcgaagtgccatgctattattacttaactaattcatatttcaaatggcgaaggcatagtatttttttctcgaaaataaaaaaactcattggcgccaagcgtgagggaatgctatacgtttggtaattgctcctccgactaggataaaggatgctattgaagcggccaatcccatgcatattgtctgtacatcgggtcgcacaaattgcatagtatcataaatagccattccagatattacccatccaccaggagagtttataaacaaataaagatctttggtatccttttctatactgagatatatcataagactaataagttgattcgagatttcggtatcaacctcttggcctaaaaaaaataatctttctcgataaagtcggttgattaggataattttttattccttaggagccgtacaggcaccttttggtgcatacggttcaataaaaattgtgaaaaaatcaatgtgttgattccaacctacccttttttcatagagggtttttctttctaacttataacggaagggcttgccccaaaagtaaaagaaattttgagttttggcgccttttattagatattaaaatcctctaaaaaaatgattgattcattgatatttttttttttcatcgagattcagttgaaatggcgatggttttttcttgttcctgaacgggcttcttcctttttttattccattttttaggtttatgctctaccccgagtaaaaggaaaaatttgcccgattttgatttgcacatataggacaaatgaaccaaataccgcgtctttttttactactccttcttttttttcaattcagttctttcacttgtcttctgtcaaatagtcaacaaattttgaattatattatatattatttgtatttgatttgagcaacagttttagatcgccctgtttcaattttttttatagagtttttatcataattttgcatataatagaagtagtaattataaaaatattatatattaattatcaattgggtttttgctaaacggagcctggatacttcattttattagtccgatcacgtaaaccataaaaaaattttgataatctaatatcaatctaaatactccctgcatttaattccactttattttttgcgcttcgcgttacaaatttttgataattcaatcaatctttttgagcgaaacagaggatatctcgatcgagggagaaaatggggaaatcccatatagcccgatatatctgacaagtcgcactatatgtcaacccaagatgtatctccttctccaggacttcgaaaaggtacttttggaacgccaataggcatgaaatgaaaaaaaaagagaatgaagttctctatttcactttgatgtggaaacgtaaaattggggtttcgttttttaatactattatccttttttcctactttattaatcatatttaaattaatgatatttaatacataagttgaataagctaaaataaaatataaaataaaagtaaagtaagagagaatgaataaaactaaaggaaattttttacgaacgggcttctgaatgatcaacaacaatagctatcttggttcatagaaaataggattaacccccattgcatattggtacttatcggatatagaatagatccgcttccctttttttctatgaattgaattgttccattattactaacagaatagaacaaatattaatcctttctccgaaataattacctaaaaagggggggtacgtagcatagttttttccaatgcaataaagttacatagtgtctatttttcgttgataaaggggtatttcc

SEQ ID NO: 9897 - DNA, 3000 bp, Unknown
  misc_feature (1)..( 3000): cDNA_ID_2179156_gDNA_ID_2096291_Annot_ID_195387 3000 nt of promoter + ATG
actatccatagggtcaattctaacaagtcacacactcatattccggaaatatacaatgcagaaaaaaatttcgcggtcgaactaccaaaggagaataggctaaaattgttagacctgcatactttacttttttgtatcgagctaaaagctagaacttcaagattcttctcagtctaattcactgaaattccatccagtagaacagaagaattataaatctccaaaataatagataggaataccgcaaatagagccattgcaacacccatcaaaggggtcgttccccatccgggagctactttaccatattcggaattcaatggtttcaataacttccctacagtagtgcttcttggaccagatctagaactatcttcaacagtttgtgtagccataaatcttattttgtattcattacgatctgttgactttgtataccattccgttgtaaataaatgatcttagcatagatccggtgtggtctttcaattctataataatggaaacagcaaccctagtcgccatctttatatctgggttacttgtaagttttactgggtatgctctatatactgcctttgggcaaccctctcaacaactaagagatccattcgaggaacacggggactagttaacgtaatcagcctccaaatatttggaggctgattacgttaatgaagataatgaaaaattatttcattttttagttgaaattttaggtggttcccgaaaaaaaatagcgaaaaaaattatccctaaagtggatactaagagaaatgtataaaccaatgcttccataaatttgatcgtggtttacaattatagctttcatacctgttttgtttacgttttgtttacttgggaggataaagaaagaaaaagagtcaaagaaacggcagcgatttaaataaagattcctacagtaccctacctattaaataaaataacaaacagaaactagaagaaaaaaagcaatgttgcatcagactgcttgtcgttttgtagttggatctccaagtttttggaatgccccgaattccacttgagcatccaaatctggatcaataccagcaaaaacatctctgaagagggttctagcaccatgccaaatgtgtccaaagaagaaaagtagagcaaacgaagcatgtccaaacgtaaaccaacctcttgggctgctacgaaaaacaccatcagatttcaaagtcgcacgatctaattcaaaaatctcacccaattgagcccgtctagcatattttttcacagttgcgggatcactataactcactccattgagttcaccaccataaaactcaacagttacacctacttgttcgacactatattttgattctgcccttctaaacgggacgtcagctctaacaattccgtctccgtctaccaaaactaccggaaaagtttcaaaaaaagtaggcatgcggcgtacaaaaagttcacgcccttctttatttctaaagacggggtggcctaaccatccaacagctattccatccccattgtccattgaacccgctcggaataaccccccttttgctggattattaccaatataatcataaaaagctaatttttcaggaattttcgcccaagcttctgataaactttgattttcagccagtccagcactaactcttcgatatatttcttgttgaaagtatccctgatcccattgataacgagtaggaccaaataattcgatgggagtagttgcagaaccataccacatagttccagcaacaacaaaagctgcaaaaaagacagcagcaatactactggaaaggacggtttcaatattgcccatacgtaatcctttgtatagacgttgaggcggacgaacactaagatggaataggcccgctaatatacccaacgtccctgctgcaatatgatgagaggctattcctcccggaacaaaagggtcaaaaccctccacgccccacgccgggtttacgggttgtacctttccggttagtccataagggtcggatacccatattccaggaccatataatcctgttacatgaaatgcgccaaaaccgaagcaagccactcctgaaagaaataaatgaattccaaaaatcttgggcaaatccaaagaaggttttcctgtacgttcatcacaaaaaatttctagatcccaatatacccaatgccaaatagctgccaagaagcacaaaccagaaaacactatatgtgctccggctaccccttcgtaactccaaagacccggattcgttatagtcccccctgtaatattccaaccgccccaagaattggttattcctaaacgagtcatgaaaggtataacgaacataccttgtctccacattggatcaagaacggggtcggagggatcaaaaactgctaattcatatagagccatcgaaccagcccaaccagcaactagagcagtatgcattatatgaacagcaagtaaacgaccgggatcattcaatacaacagtatgaacacgataccaaggcaaacccatggaaatacccctttatcaacgaaaaatagacactatgtaactttattgcattggaaaaaactatgctacgtaccccccctttttaggtaattatttcggagaaaggattaatatttgttctattctgttagtaataatggaacaattcaattcatagaaaaaaagggaagcggatctattctatatccgataagtaccaatatgcaatgggggttaatcctattttctatgaaccaagatagctattgttgttgatcattcagaagcccgttcgtaaaaaatttcctttagttttattcattctctcttactttacttttattttatattttattttagcttattcaacttatgtattaaatatcattaatttaaatatgattaataaagtaggaaaaaaggataatagtattaaaaaacgaaaccccaattttacgtttccacatcaaagtgaaatagagaacttcattctctttttttttcatttcatg

SEQ ID NO: 9898 - DNA, 3000 bp, Unknown
  misc_feature (1)..( 3000): cDNA_ID_3034595_gDNA_ID_2096291_Annot_ID_195417 3000 nt of promoter + ATG
tttcttctgactctttttcaaattcgataaatgttggttgatcgtatctttcattatagttctatgattcagagtatcatttcctattagatccctttgaattccatattcgaagttgcgatcaggtctcttcattaaaaagaatcgattcaatacatttcttatgtacccatagggactatattggaattggatttgaatcatatttcggatcaatctatattgattgactgcctccattatgttgttgctagcaaataccactcttttttgatcttccaaataattcccgcaggagatccggacccaaatttttctgagccttcgataaaaagattcattttcttcataaaaaataggaggtagaaccaataaagatttcttttttgattcatccctgaagttgaaaacctccttcaagaattgtctttgatccaatccgtaggaatcaatagaaaaggcaaatcccttatgatacaccagatccggctcggttattgatagagtgaatagatctgccatttcttgaaatctctcttctgactcgtggcgtaacgtgtatccccccctcttccgttcatggaatagatgaaataaatcaaaaaatggatttttgttcaagaatgaaatcttattggaactgtccatatccagttcatccttcggaaccatatcacatcccagatctgatgaaataggatgaattgagacggtattttgtaaatacgtaattatcttgaatatattaactatttctttattttccgatcgcctggaagggacaaaagaaacatcttgttctttcttcaacaatttctgatccctagtggacctctcagtaggattcgaacccagatgaagttctgaccatctgtcagagaaaaaagaacgaatggctcttgtaggattcccaagaaattcttcgctttcttccggaagcagatgattattcattcgcttctcacgttccgtgaatagccggggcattgaggaatagccagaaaggtatttagggaatcggtctgattctatctctcttccttccgtttgaataaaggaaggatccaaaagaatcgatctttcttttagttgttgaatctctctttgattgatcaatgtgtgatagtgatattccgaatcctcattactaatggaatcgaaaggatctatgaattgatcagaagatccgttcaattggctagaatccgttacttgaacgaaactagatcttgtagaatcatattgaatatttgacgatacgtttcgtaccttgctaaaaaatctatccttgtttaccaaccacacattgtctaaccaaatccaattctctctcgatattttcctaaaaaaatccgattcgtgcggattcttcccccaactaacgaagagatcttggtggaattgccacatatgaaattgagcacaattttgcaaagaaatagcccacttgtttctcgagaagagatgggaaacatgctcaatatcatttgattgaatagttgacccagctccttgttgtttgcagaaaccctccacttcaattggtattttttcacgaaaagcaaacatgagataacaaatccagtctttcactaagatttcgaatagctgtcccgaattcaagttgattatgtttcgcctcttactcggagaaagacgatcaaacaattcccaatcatggcccttgcggatcggatcatccatataatatacaaaaagaaactccagatatttgatatctttctctttaaatgagatatcaattccagcgacggtttcattagatatcttacaacaaaaacccctcttttttccgatccagttcctccaccaccgcgaactccagttagattcaggcatgatacacttttgagttattgggagaacccaagtactctctttcggatcccggaaacagctctcagagatcttttttccttttgtaagatacaggagcgaaacaatcaacctattgatattgcaagacccaaaagattcttccgatgtatcatttctgggtccaatggaattcataggtataggaagaagccctttcaaatagagatttttgctttcgaccatatttcgattgttaatacgatatagaagggccgctactacaaatagtactacacccttgatcgtgaaatatcgattgcttgttgaaccctgtgaattgcgcaaaagtaggatactaaaaatccgagggtccaagagttttctaaaacgttcttggtggaaaaaaatatgaatgaaagatcccactgaattgaattgggtccatgaatctaagaaatagtgagcattcttgatctctctcactatttctctcaattcgaaaatccaggatttgaattgatgtcctttcattgattcctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatcggaccctccaataagtctattggaattggctctgtatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagc

SEQ ID NO: 9899 - DNA, 3000 bp, Unknown
  misc_feature (1)..( 3000): cDNA_ID_3034602_gDNA_ID_2096291_Annot_ID_195415 3000 nt of promoter + ATG
gaaaagaaaagaactgtcttttctgtatacttatgtatactttccccggttccgttgctactgcgggctttacgcaattgatcggatcatctagatatcccttcaacacaacataggtcgtcgaaaggatctcggagacccgccaaagcacgaaagccagaatctttcagaaaatgaattcctattcgaagagtgcataaccgcatggataagctcacactaacccgtcaatttgggatccaattcgggattttccttgagggatattggtaaggaattggaatgtaataatatcgattcataatggattcatatcgatacagaagaaaaggttctctatcgattcaacaagtgctgtacttatgggaaagcgatagagaaagagaaaaaaaaaaacgaagatttcacatagtgatttttttttttttttttgatcaaaaataaatctgattgaatttatttcgtaccccttcgctcaatgagaaaatgggtcagattctataggatcaaacttatgggacttaagaatgatggaagggaataaaatcaaaaaagaaatcaaataaagaaaagagagagaaaataaagaaaaaataagtaaatcaaaatgaagtagaagaacccagattccaaatgaacaaattcaaacttgaaaaagtctctttctgattctcgaagaatgaggggcaaagagattgattgagaaagatctcttgttcttattataagatcgtgtgattggacccgcagatgtttggtaaaaagaataatcttatcctttgagaataatcaaaaatagaaagtgttcagttggaacatgaaaacgtgaccgagtttgtcctagttactcttcgggacggagtggaagaagggaggagattcgcgaacgaggaaagggacccaatgacttcgaaagaattgaacgaggagccgtatgaggtgaaaatctcatgtacggttctgtagagtggcagtaagggtgacttatctgtcaacttttccactatcacccccaaaaaaccaaactctgctttacgtaaagttgccagagtacgattaacctcgggatttgaaatcactgcttatatacctggtattggccataatttacaagaacattctgtagtcttagtaagagggggaagggttaaggatttacccggtgtgagatatcacattgttcgaggaaccctagatgctgtcggagtaaaggatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccacgagacaaaagatcttctttcaaaagagattcgattcggaactcttatatgtccaaggttcaatattgaaataatttcagaggttttccctgactttgtccgtgtcaacaaacaattcgaaatgcctcgacttttttagaacaggtccgggtcaaatagcaatgattcgaagcacttatttttacactatttcggaaacccaaggactcaatcgtatggatatgtaaaatacaggatttccaatcctagcaggaaaaggagggaaacggatactcaatttaaaagtgagtaaacagaattccatactcgatttcagagatacatatataattctgtggaaagccgtattcgatgaaagtcgtatgtacggtttggagggagatctttcatatctttcgagatccaccctacaatatggggtcaaaaagccaaaataaaagatttgagcccttataaaaagaaaacagattcttgaacccctttcacgctcatgtcacgccgaggtactgcagaagaaaaaactgcaaaatccgatccaatttatcgtaatcgattagttaacatgttggttaaccgtattctgaaacacggaaaaaaatcattggcttatcaaattatctatcgagccttgaaaaagattcaacaaaagacagaaacaaatccactatctgttttacgtcaagcaatacgtggagtaactcccgatatagcagtaaaagcaagacgtgtaggcgggtcaactcatcaagttcccattgaaataggatccacgcaaggaaaagcacttgccattcgttggttattaggggcatcccgaaaacgtccgggtcgaaatatggctttcaaattaagttccgaattagtggatgctgccaaagggagtggcgatgccatacgcaaaaaggaagagactcatagaatggcagaggcaaatagagcttttgcacattttcgttaatccaggaacaggatctatatagacacatagatccatggatccatacatctcgatccgaaaagaatcaatagaaaaagaaaaaatcggaattgatcgatctctttctcgaaacaaacgaaaaggaaagaaaagacgaaacagaaatcatggatcaactaagccctctcggggacttgcttaagaataagaaagagcaatctcatgtaaataccatggaataaggttttatcctattcatggggattccgtaaatattccattccaaaaatcaaaaattggtttttttttggagattggatgcagttactaattcatgatctggcatgtacagaatgaaaatttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaa

SEQ ID NO: 9900 - DNA, 3000 bp, Unknown
  misc_feature (1)..( 3000): cDNA_ID_2179276_gDNA_ID_2096291_Annot_ID_195413 3000 nt of promoter + ATG
gaacctaaacctgcgctcgagagatagctgtccatacactgataagggatgtatggattctcgagaagagaggagccatagtggtcccctccggaccgcccggatcccacgagtgaatagaaagttggatctacattggatctcacctgaatcgccccatctatcctcctgaggagaagtttggtttcaaaccccggttcgaacaggaggagtacgccatgctaatgtgccttggatgatccacatctcagggtcaggcgctgatgagcacattgaactatccatgtggctgagagccctcacagcccaggcacaacgacgcaattatcaggggcgcgctctaccactgagctaatagcccgtcgtgcgggcctcctgctgggggcccgctatgccaagccaaaagcgagagaaaccccatctctctctttcctttttacgcctccctgccgccacacgagagggacatgggggcgtaaaaggggatcctatcaacttgttccgacctaggataataagctcatgggtttggtcttacttcaccgtcgagaaacgaaagaaggcttccacctccaagtttaactcagacgtagctcccttctttttgggtgtgaagctgtgtcaaacctaaatacccaagaagcattagctctccctgaaaaggaggtgatccagccgcaccttccagtacggctaccttgttacgacttcactccagtcactagccctgccttcggcacccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctgcaatccgaactgaggacgggtttttggagttagctcaccctcgcgggatcgcgaccctttgtcccggccattgtagcacgtgtgtcgcccagggcataaggggcatgatgacttgacgtcatcctcaccttcctccggcttatcaccggcagtctgttcagggttccaaactcaacggtggcaactaaacacgagggttgcgctcgttgcgggacttaacccaacaccttacggcacgagctgacgacagccatgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgcgttagctacagcactgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactcaagcttggtagtttccaccgcctgtccagggttgagccctgggatttgacggcggacttaaaaagccacctacagacgctttacgcccaatcattccggataacgcttgcatcctctgtattaccgcggctgctggcacagagttagccgatgcttattccccagataccgtcattgcttcttctctgggaaaagaagttcaggacccgtaggccttctacctccacgcggcattgctccgtcaggctttcgcccattgcggaaaattccccactgctgcctcccgtaggagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggcaggttcttacgcgttactcacccgtccgccactggaaacaccacttcccgtccgacttgcatgtgttaagcatgccgccagcgttcatcctgagccaggatcgaactctccatgagattcatagttgcattacttatagcttccttcttcgtagacaaagctgattcggaattgtctttcattccaagtcataacttgtatccatgcgcttcatattcgcatggagttcgctcccagaaatatagctacccctaccccctcacgtcaatcccacgagcctcttatccattcttattcgatcacagcgagggagcaagtcaaaatagaaaaactcacattcattgggtttagggataatcaggctcgaactgatgacttccaccacgtcaaggtgacactctaccgctgagttatatcccttcccccatcaagaaatagaactgactaatcctaagtcaaagggtcgagaaactcaaggccactattcttgaacaacttggattggagccgggctttcctttcgcactttatacgggtatgaaatgaaaataatggaaaaagttggattcaattgtcaactactcctatcggaaataggattgactacggattcgagccatagcacatggtttcataaaaccgtacgattctcccgatctaaatcaagccggttttacatgaagaagatttgactcggcatgttctattcgatacgggtaggagaaacggtattcttttcttaaacttaaaaaaatagagaaataagaaccaagtcaagatgatacggattaatcctttattcttgcgccaaagatcttcctatttccaaaggaactggagttacatctcttttccatttccattcaagagttcttatgtgtttccacgcccctttaagaccccgaaaaatcgacaaattcccttttcttaggaccacatgcgagataacgaaaaaaaaaaagagaga

SEQ ID NO: 9901 - DNA, 3000 bp, Unknown
  misc_feature (1)..( 3000): cDNA_ID_2179272_gDNA_ID_2096291_Annot_ID_195412 3000 nt of promoter + ATG
aaattatttcaatattgaaccttggacatataagagttccgaatcgaatctcttttgaaagaagatcttttgtctcgtggtagcctgctccagtccccttacgaaactttcgttattgggttagccatacacttcacatgtttctagcgattcacatggcatcatcaaatgatacaagtcttggataagaatctacaacgcactagaacgcccttgttgacgatcctttactccgacagcatctagggttcctcgaacaatgtgatatctcacaccgggtaaatccttaacccttccccctcttactaagactacagaatgttcttgtaaattatggccaataccaggtatataagcagtgatttcaaatcccgaggttaatcgtactctggcaactttacgtaaagcagagtttggttttttgggggtgatagtggaaaagttgacagataagtcacccttactgccactctacagaaccgtacatgagattttcacctcatacggctcctcgttcaattctttcgaagtcattgggtccctttcctcgttcgcgaatctcctcccttcttccactccgtcccgaagagtaactaggacaaactcggtcacgttttcatgttccaactgaacactttctatttttgattattctcaaaggataagattattctttttaccaaacatctgcgggtccaatcacacgatcttataataagaacaagagatctttctcaatcaatctctttgcccctcattcttcgagaatcagaaagagactttttcaagtttgaatttgttcatttggaatctgggttcttctacttcattttgatttacttattttttctttattttctctctcttttctttatttgatttcttttttgattttattcccttccatcattcttaagtcccataagtttgatcctatagaatctgacccattttctcattgagcgaaggggtacgaaataaattcaatcagatttatttttgatcaaaaaaaaaaaaaaaaatcactatgtgaaatcttcgtttttttttttctctttctctatcgctttcccataagtacagcacttgttgaatcgatagagaaccttttcttctgtatcgatatgaatccattatgaatcgatattattacattccaattccttaccaatatccctcaaggaaaatcccgaattggatcccaaattgacgggttagtgtgagcttatccatgcggttatgcactcttcgaataggaattcattttctgaaagattctggctttcgtgctttggcgggtctccgagatcctttcgacgacctatgttgtgttgaagggatatctagatgatccgatcaattgcgtaaagcccgcagtagcaacggaaccggggaaagtatacataagtatacagaaaagacagttcttttcttttctattatattaggattttctattctattagattagttagtgatcttggcgcagtgagtcctttcttccgtgattaactgttggcaccagtcctacattttgtctctgcggaccgagaagaaaggaggctccgcgggaagaggattgtaccatagaagcacggaggtaaacctctttccaatatataaattctggcaatgtagttgggctttcatgttgatccgaatgaatcatctttttcgcggagtgaaatctttgcctgctaggcaagatgataggatagcaagttacaaattctgtttcggtaggacatgtatttctattactatgaaattcataaataaaatagttaatcgtggggttaccattctctctttttttttttcgttatctcgcatgtggtcctaagaaaagggaatttgtcgatttttcggggtcttaaaggggcgtggaaacacataagaactcttgaatggaaatggaaaagagatgtaactccagttcctttggaaataggaagatctttggcgcaagaataaaggattaatccgtatcatcttgacttggttcttatttctctatttttttaagtttaagaaaagaataccgtttctcctacccgtatcgaatagaacatgccgagtcaaatcttcttcatgtaaaaccggcttgatttagatcgggagaatcgtacggttttatgaaaccatgtgctatggctcgaatccgtagtcaatcctatttccgataggagtagttgacaattgaatccaactttttccattattttcatttcatacccgtataaagtgcgaaaggaaagcccggctccaatccaagttgttcaagaatagtggccttgagtttctcgaccctttgacttaggattagtcagttctatttcttgatgggggaagggatataactcagcggtagagtgtcaccttgacgtggtggaagtcatcagttcgagcctgattatccctaaacccaatgaatgtgagtttttctattttgacttgctccctcgctgtgatcgaataagaatggataagaggctcgtgggattgacgtgagggggtaggggtagctatatttctgggagcgaactccatgcgaatatgaagcgcatggatacaagttatgacttggaatgaaagacaattccgaatcagctttgtctacgaagaaggaagctataagtaatgcaactatgaatctcatggagagttcgatcctggctcaggatgaacgctggcggcatgcttaacacatgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcccgaggaggggctcgcgtctgattagctagttggtgaggcaatagcttaccaaggcgatgatcagtagctggtccgagaggatgatcagccacactgggactgagacacggcccagactcctacgggaggcagcagtggggaattttccgcaatg

SEQ ID NO: 9902 - DNA, 3000 bp, Unknown
  misc_feature (1)..( 3000): cDNA_ID_3034606_gDNA_ID_2096291_Annot_ID_195410 3000 nt of promoter + ATG
aaaaaaaaatcaaaaatttgattgatagaaaaaagacaatcagaaatcaaatagaagaaatttcaaaagaaaaacaaaacttaactaatagttgtaccaaactgcgttatgattctaaaataattgagtcatcaaaaaaaatttggcagacattcaaaagaaaaaatacccgattaattcgtaaatccatttttttttttaaattttgcatcgaacaaatgtctatagctatttttctaggtatcattaatattccaagaattactacacaacttttttttgaatcaacaaaaaaaattcttgataaatatatttacaagaatgaagaaaatggagaaaaaaaaaaaaatactctttattttatttcgactataaaaaatttaatatccaataaaaaaaaaatgagttatgacctatgctctttatcacaagcatatgtattttacaaattatcacaaattaaagttagtaacttttgtaaattaaaggctgttcttgaatataacatatgcataacatccttttttgttaagaataaaataaaggttttttttcaagaacacggaatctttcattatgaattgaaaaataaaacctttttgaattccgaagtaaatcaatggaaaaactggttacgaagtcagtatcaatacaatttaccccagatttcatgggctagattagtaacccaaaattggaaaaataaaataaataaagattctctagttctaaacccaagtttaaccaaagaggattcatatgaaaaaaagaaatttgataattataaaaaacaaaaattttttgaggccgactcattattaaatccaaaacataatgtaaaaaaagattctatatataatcttttttgctataaatctattcattctacagaaaaaaattttgacatgtctataggcattgccctagataattgtttagtctcttcttttctagaaaaatataatattcggggtatgggggaaattcggcatagaaaatatttggattggagaattcttaacttttggtttacaaaaaaagtaactattgagccttgggttgatactaagagtaaaaaaaaatatattaatactaaagttcagaattatcaaaaaattgataaaataacgcagacggatcttgctaataaaaaaagaaacttttttgattggatgggaatgaatgaagaaatactaaatcagcgtataacaaattttgaattttttttctttccggaatttttcttattttctagtacatataaaatgaaaccatgggtcataccaatcaaattacttcttttaaattttaatgaaaacataaatgttaataaaaagatcattcgaaagaaaaaaggttttataccatcaaatgaaaaagaatcccttcgattttataatctgaataaagaagaaaaagaatcggccggtcaagtagaacttgaatcagataaagaaacaaaaagaaatcccgaagcagctcgattaaaccaagaaaaaaatattgaagaaaattttgcagaatcaacaataaaaaaacgtaaaaataaaaaacaatacaaaagtaatacagaagcggaacttgatttatttctgacaagatattcgcgttttcaattgcgatggaattgtttttttaatcaaaaaattctcaataatgtaaaagtatactgtctcttggttagactaaacaatccaaacgaaatagcggtatcttctattgaaagaggagagatgagcctagacattctaatgattgagaaaaatttcacttttgcaaaattaatgaaaaaaggaatattgattattgaacctgtgcgtttgtctgtacaaaacgatggacaacttattatatatagaaccataggtatttcattggttcataaaaataaacacaaaataagtaaaagatacaaaaaaaaaagctatattaataaaaaattttttgaaaaatccattacaaaatatcaaaacaaaactgtaaataaaaaaaaaaataattatgatttctttgtccctgaaaaaattctatcccctaaacgacgtagagaatttcgaattctaatttgtttcaacttaaaaaaaaaaaatgctagggatacaaattcaagatttgataagaatattcaaaacttgaccaccgttttgcataaaaagaaagatcttgatcttgataaggataaaaataacttaattaatttaaaatcctttctttggcccaattttaaattagaagatttagcttgtatgaatcgctattggtttaatactactaacggaaatcatttcagtatgataagaatacgcatgtatacgcgatttccaattccttaatcataaatactttttactatatataataagttacggtatatgaaaacaactatatgcacaaatatgagggattgttttaaattaaatctttatacatgagattaatttaatcaatcacatagataccaattatagcggattcataaataaattaacagaatccttctttttgagatctaaatttagatttttttctaaaatgaagaattaagaggttgataattaaattaagatccttgtacaaaaaaactaccattattattactgatcagtaaaattaatatctttcaattcatattaaaaggggaaggatttctttttatgataaaaaatatagtcatttcatttgaagaacaaaaagaagaaagcaggggatccgttgaatttcaagtatttagtttcactaataagatacgaagacttacttcacatttggaattgcacagaaaagattatttatctcagcggggtctacgaaaaattctgggaaaacgtcaacgactgctggcttatttgtcaaaaaaaaatagagtacgttataaagaattaattaatcagttgaatattcgggaattaaaaactcgttaaattcaaaaattgtgaattagtgaattttttagatcttgaattttttgataaacttctttattcagaaatctaattcatg

SEQ ID NO: 9903 - DNA, 3000 bp, Unknown
  misc_feature (1)..( 3000): cDNA_ID_3034610_gDNA_ID_2096291_Annot_ID_195402 3000 nt of promoter + ATG
aattgtaatcagaagtctttggtctttgtattgtgagaaccttttgaatcattgtactacttgattcaaaaggttctttatgatttactactaaaactaaatgagatttcttaacttatatgaagttagatatagatgctatttttttatttttttatttagatttcgattccttcttatttgttactttaattcgatgtaaatgaaccataactatgtaaacctattcctaaaagattgacgccaaaatagcatatccaaattaaaataaaaccgatcaaagccacaattgcagaatttatacccctaacattcctatttgttttaatatgtaaataaattgcgaatatagtccaagtaataaatgcccaagtttcttttgggtcccagttccaatatgaaccccatgtctcattagcccagacagctcctgaaagaatgccgacggttaaaaagataaatccaagactaataatacgaaaactccaaaaatctaattgttgaatcagttgatacctataataatttctagaaaaactaaaattaatgttttgttgtagtaaaatagaatttctttcatttatgtagtaaagtacatcaaaagaaaataattcatttaataaaaaatttttttttatattctttttccaaaaagtaggtccgactttgcgaaatgtaatcactagaagagctattgataataatgatccgcataacagagcgccatagcctaatatcatcatacttacgtgcatcattaaccactgggactggagagctggtactaatattgcagactgaggcattttgtttaaaagacctgaagtagcaaaaccctgaataaaaataacacttggcgcagttattgtgtttaacttattttgttgttttttattaaaataggaaaccatatgaataattgaaaaagcccacgaaagaaaaattaatgattcatataaattacttaatggaaaatgtcctgaataaatccaacgagttaataataatcctgttataccaaaaaacgtaattatgattcctttatctgatgaatcaaaaaatcctatgatttcatctaaattaactaataaagttaaaaaataaattgtcagcacaattgaaacgaccgaaaaagatatatgagttaatatatgctctaaaattgaaaaaatcataaaaaatttgttaaaaattaataaattaatactaggttttacccgattttagaaaaaagtcgggtattattttgattataaaacttataatatctcttttagaagatcttatgccgctactcggactcgaaccgagatgctctagcactgcttcctaagagcagcgtgtctaccaatttcaccatagcggcaacttgttcaaaacaatattaacaagttttgattcaatcgtcgagattaaaatttaaataaagaagccaatttattaaaatttccaattgatttttaaaattatttcaattgactttttgtcctttatatttttttcgagaatacaatgaaaaatgtaactaaattaaagtagttggaacttcaacccaaagacaaaactctaaatgctctttatcattttttttcatttatatgaaaaaaaattgataaaaaaatgctttttcgaaaaataaaaacttcttcaaaatccttagcaattttaaataaaattagattttcctaattgctcaagagaaatcaaaaaaattatcaaaatattttttttgatgtatctttttatattgtacaaacataagattttttgctcacttaaagtaattaatttcaagatcttttatttcctcattaagaggaaataaaagatctttttttattattgtctcaaggtagtgatgggaacaatacgaatcccctttttggaactaaaaaaatgcgaacctttattttttatatattttatctatatattgtctttttttcttcttttgcttcctattttttttagatgtatttaaacaaattggtttttaagttaggctaattctaattattatagtgttttttatttattttgctgtacaaaaaaactttttgaattacctgtagaaagtgatttccctaatgaaaaagctttcaacgatgtccaatatcccttccttttccaaatttttttacgaatacgctttttcgagatagaagtacgtttttttggaactgccattcaaaaatgaaaaaaaatttcagtggtataattggatgtcaaagacatttattattttattctttcgtactccgtacgagtttttttctttcaaattttattatatattattttcaaaacaaaaaagacattcaaaagtttcaaacccaacttttttttttaacgtttgaaatccgtatgagagtactcatttaaataatctatactgatagcttatattataaaaaaattataatatttcttcacatcatatgtaaaaaaaacatatcattatagtaatctttcttaaaaaatataaataaaaaaagctcacttagtgtactgaaagacaatcactaaattccacgatgaaaatccattccttaacaatcctaaataatcaaactcaaataactttgttttaggtcaagctttttttatataattaatattaagtttttttttgtcgtggaaatctttgttctattcttaatatatgtatataaattattgtaatatggaattataattcactttttctgtatttgcataaaatcacaataaaattttatttagtagtaataaaaaaagacaaataaaatcttttgacagtaacttagtaatattttttaatcatttctaatttttttatttgaatatatattgcttttcaaagatttatgaaggattatattaattcgaaaacatttctatttaggtttgaaatcgcgtgcttttttattgtcccctttgaaaaaaaaatatatatatacaaaccagtgaataagaaaaaataaaattaagaataaaataaaaaggattttttattttatg

SEQ ID NO: 9904 - DNA, 3000 bp, Unknown
  misc_feature (1)..( 3000): cDNA_ID_2179226_gDNA_ID_2096291_Annot_ID_195401 3000 nt of promoter + ATG
agccccgtaacttcgggagaaggggtgcctcctcacaaagggggtcgcagtgaccaggcccgggcgactgtttaccaaaaacacaggtctccgcaaagtcgtaagaccatgtatgggggctgacgcctgcccagtgccggaaggttaaggaagttggtgacctgatgacaggggagccggcgaccgaagccccggtgaacggcggccgtaactataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagcttcactgttccctgggattggctttgggcttttcctgcgcagcttaggtggaaggcgaagaaggcccccttccgggggggcccgagccatcagtgagataccactctggaagagctagaattctaaccttgtgtcaggacctacgggccaagggacagtctcaggtagacagtttctatggggcgtaggcctcccaaaaggtaacggaggcgtgcaaaggtttcctcgggccggacggagattggccctcgagtgcaaaggcagaagggagcttgactgcaagacccacccgtcgagcagggacgaaagtcggccttagtgatccgacggtgccgagtggaagggccgtcgctcaacggataaaagttactctagggataacaggctgatcttccccaagagctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtaccagttatcgtgcccacggtaaacgctgggtagccaagtgcggagcggataactgctgaaagcatctaagtagtaagcccaccccaagatgagtgctctcctattccgacttccccagagcctccggtagcacagccgagacagcaacgggttctccgcccctgcggggatggagtgacagaagttttgagaattcaagagaaggtcacggcgagacgagccgtttatcattacgataggtgtcaagtggaagtgcagtgatgtatgcagctgaggcatcctaacagaccggtagacttgaaccttgttcctacatgacctgatcaattcgatcaggcactcgccatctattttcatagttcaactctttgacaacacgaaaaaaccattgttcaactctttgacaacatgaaaaaacctaaaattctgcccttctatccaaaggatgggggggcagaggcctttggtgtccactccagtcaagaattggagcctcacaatcactagccaatatgcttttctcgcatgcctttcttcgttcatggttcgatattctggtgtcctaggcgtagaggaacaacaccaatccatcccgaacttggtggttaaactctactgcggtgacgatactgtaggggaggtcctgcggaaaaatagctcgacgccaggatgatgaaaagcttaacacctctcattcttattactttttcatattgaaaaaaaaaatgaaaaatgaaaaggttgtcttattcaaaaccccaattatgaaatcatcccacttcacaccccggaacgcaccgttcttatagagagaaaggcactttcacatccgaaatggctggggagaggaaaggttcctttttttagggtactcctgggaacagatccagtggagacggggtggggcttgtagctcagaggattagagcacgtggctacgaaccacggtgtcgggggttcgaatccctcctcgcccacaaccggcccaaaagggaaggacctttccctccgggggggtaggaaaatcatgctcgggatagcgatagcggactcaaagctatggaacttggggatgggtcttttgtcgaaatagagtggagtgaccttcttttttatttgaatttagatatatatctattatatctatcgcttttttaattttacatatagtatttttaaacggccgaatcagcatattttttgaagccccgtaactcttcctcagccaggcttgggcagaatagcggagcaagtattagtagcatagcaaaaatgcgttcctcatcattaagtcattaaattcatatgtttgctcgcggtaattgtgaactctcgggagaatcgatgactgcatcaaagatgcacttgttagtacatctgaaaattctgaattggctagttgtaaatagccccaggactatagaataaaggattatcccgaacctacaccgaggtattgacggtgattctcaaatatcacagaacagaatgtgatacgatgagatagaatgcaatagaaacaaagacacagggaacgggttaccgactcttaacggtcaaagcgaacccgttcattcttacattctgaattcttaaattcggaatgaatcaaatctccccaagtaggattcgaacctacgaccaatcagttaacagccgaccgctctaccactgagctactgaggaacaacgggagattagatctcatagagttcaattcccgttctcaacccatgaccaatatgaactcgaagtttccttcgtaacccccggaacttcttcgtagtggctccgttccatgcctaatttaatagggaacctcaaagcggctctatttcattatattccatccatatcccaattccattcatttaatatccctttggtgtcattgacataagagatgtcgtttctagtctatctctttctatttctatatatggaaagttgcaaaatcatcatataataatccagaaattgaaatagaaaagaaaaaagggaggtttgtg

SEQ ID NO: 9905 - DNA, 3000 bp, Unknown
  misc_feature (1)..( 3000): cDNA_ID_2179222_gDNA_ID_2096291_Annot_ID_195400 3000 nt of promoter + ATG
ctgaaattatttcaatattgaaccttggacatataagagttccgaatcgaatctcttttgaaagaagatcttttgtctcgtggtagcctgctccagtccccttacgaaactttcgttattgggttagccatacacttcacatgtttctagcgattcacatggcatcatcaaatgatacaagtcttggataagaatctacaacgcactagaacgcccttgttgacgatcctttactccgacagcatctagggttcctcgaacaatgtgatatctcacaccgggtaaatccttaacccttccccctcttactaagactacagaatgttcttgtaaattatggccaataccaggtatataagcagtgatttcaaatcccgaggttaatcgtactctggcaactttacgtaaagcagagtttggttttttgggggtgatagtggaaaagttgacagataagtcacccttactgccactctacagaaccgtacatgagattttcacctcatacggctcctcgttcaattctttcgaagtcattgggtccctttcctcgttcgcgaatctcctcccttcttccactccgtcccgaagagtaactaggacaaactcggtcacgttttcatgttccaactgaacactttctatttttgattattctcaaaggataagattattctttttaccaaacatctgcgggtccaatcacacgatcttataataagaacaagagatctttctcaatcaatctctttgcccctcattcttcgagaatcagaaagagactttttcaagtttgaatttgttcatttggaatctgggttcttctacttcattttgatttacttattttttctttattttctctctcttttctttatttgatttcttttttgattttattcccttccatcattcttaagtcccataagtttgatcctatagaatctgacccattttctcattgagcgaaggggtacgaaataaattcaatcagatttatttttgatcaaaaaaaaaaaaaaaaatcactatgtgaaatcttcgtttttttttttctctttctctatcgctttcccataagtacagcacttgttgaatcgatagagaaccttttcttctgtatcgatatgaatccattatgaatcgatattattacattccaattccttaccaatatccctcaaggaaaatcccgaattggatcccaaattgacgggttagtgtgagcttatccatgcggttatgcactcttcgaataggaattcattttctgaaagattctggctttcgtgctttggcgggtctccgagatcctttcgacgacctatgttgtgttgaagggatatctagatgatccgatcaattgcgtaaagcccgcagtagcaacggaaccggggaaagtatacataagtatacagaaaagacagttcttttcttttctattatattaggattttctattctattagattagttagtgatcttggcgcagtgagtcctttcttccgtgattaactgttggcaccagtcctacattttgtctctgcggaccgagaagaaaggaggctccgcgggaagaggattgtaccatagaagcacggaggtaaacctctttccaatatataaattctggcaatgtagttgggctttcatgttgatccgaatgaatcatctttttcgcggagtgaaatctttgcctgctaggcaagatgataggatagcaagttacaaattctgtttcggtaggacatgtatttctattactatgaaattcataaataaaatagttaatcgtggggttaccattctctctttttttttttcgttatctcgcatgtggtcctaagaaaagggaatttgtcgatttttcggggtcttaaaggggcgtggaaacacataagaactcttgaatggaaatggaaaagagatgtaactccagttcctttggaaataggaagatctttggcgcaagaataaaggattaatccgtatcatcttgacttggttcttatttctctatttttttaagtttaagaaaagaataccgtttctcctacccgtatcgaatagaacatgccgagtcaaatcttcttcatgtaaaaccggcttgatttagatcgggagaatcgtacggttttatgaaaccatgtgctatggctcgaatccgtagtcaatcctatttccgataggagtagttgacaattgaatccaactttttccattattttcatttcatacccgtataaagtgcgaaaggaaagcccggctccaatccaagttgttcaagaatagtggccttgagtttctcgaccctttgacttaggattagtcagttctatttcttgatgggggaagggatataactcagcggtagagtgtcaccttgacgtggtggaagtcatcagttcgagcctgattatccctaaacccaatgaatgtgagtttttctattttgacttgctccctcgctgtgatcgaataagaatggataagaggctcgtgggattgacgtgagggggtaggggtagctatatttctgggagcgaactccatgcgaatatgaagcgcatggatacaagttatgacttggaatgaaagacaattccgaatcagctttgtctacgaagaaggaagctataagtaatgcaactatgaatctcatggagagttcgatcctggctcaggatgaacgctggcggcatgcttaacacatgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcccgaggaggggctcgcgtctgattagctagttggtgaggcaatagcttaccaaggcgatgatcagtagctggtccgagaggatgatcagccacactgggactgagacacggcccagactcctacgggaggcagcagtggggaattttccgca

SEQ ID NO: 9906 - DNA, 3000 bp, Unknown
  misc_feature (1)..( 3000): cDNA_ID_3034614_gDNA_ID_2096291_Annot_ID_195399 3000 nt of promoter + ATG
cctaaacctgcgctcgagagatagctgtccatacactgataagggatgtatggattctcgagaagagaggagccatagtggtcccctccggaccgcccggatcccacgagtgaatagaaagttggatctacattggatctcacctgaatcgccccatctatcctcctgaggagaagtttggtttcaaaccccggttcgaacaggaggagtacgccatgctaatgtgccttggatgatccacatctcagggtcaggcgctgatgagcacattgaactatccatgtggctgagagccctcacagcccaggcacaacgacgcaattatcaggggcgcgctctaccactgagctaatagcccgtcgtgcgggcctcctgctgggggcccgctatgccaagccaaaagcgagagaaaccccatctctctctttcctttttacgcctccctgccgccacacgagagggacatgggggcgtaaaaggggatcctatcaacttgttccgacctaggataataagctcatgggtttggtcttacttcaccgtcgagaaacgaaagaaggcttccacctccaagtttaactcagacgtagctcccttctttttgggtgtgaagctgtgtcaaacctaaatacccaagaagcattagctctccctgaaaaggaggtgatccagccgcaccttccagtacggctaccttgttacgacttcactccagtcactagccctgccttcggcacccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctgcaatccgaactgaggacgggtttttggagttagctcaccctcgcgggatcgcgaccctttgtcccggccattgtagcacgtgtgtcgcccagggcataaggggcatgatgacttgacgtcatcctcaccttcctccggcttatcaccggcagtctgttcagggttccaaactcaacggtggcaactaaacacgagggttgcgctcgttgcgggacttaacccaacaccttacggcacgagctgacgacagccatgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgcgttagctacagcactgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactcaagcttggtagtttccaccgcctgtccagggttgagccctgggatttgacggcggacttaaaaagccacctacagacgctttacgcccaatcattccggataacgcttgcatcctctgtattaccgcggctgctggcacagagttagccgatgcttattccccagataccgtcattgcttcttctctgggaaaagaagttcaggacccgtaggccttctacctccacgcggcattgctccgtcaggctttcgcccattgcggaaaattccccactgctgcctcccgtaggagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggcaggttcttacgcgttactcacccgtccgccactggaaacaccacttcccgtccgacttgcatgtgttaagcatgccgccagcgttcatcctgagccaggatcgaactctccatgagattcatagttgcattacttatagcttccttcttcgtagacaaagctgattcggaattgtctttcattccaagtcataacttgtatccatgcgcttcatattcgcatggagttcgctcccagaaatatagctacccctaccccctcacgtcaatcccacgagcctcttatccattcttattcgatcacagcgagggagcaagtcaaaatagaaaaactcacattcattgggtttagggataatcaggctcgaactgatgacttccaccacgtcaaggtgacactctaccgctgagttatatcccttcccccatcaagaaatagaactgactaatcctaagtcaaagggtcgagaaactcaaggccactattcttgaacaacttggattggagccgggctttcctttcgcactttatacgggtatgaaatgaaaataatggaaaaagttggattcaattgtcaactactcctatcggaaataggattgactacggattcgagccatagcacatggtttcataaaaccgtacgattctcccgatctaaatcaagccggttttacatgaagaagatttgactcggcatgttctattcgatacgggtaggagaaacggtattcttttcttaaacttaaaaaaatagagaaataagaaccaagtcaagatgatacggattaatcctttattcttgcgccaaagatcttcctatttccaaaggaactggagttacatctcttttccatttccattcaagagttcttatgtgtttccacgcccctttaagaccccgaaaaatcgacaaattcccttttcttaggaccacatgcgagataacgaaaaaaaaaaagagagaatg

SEQ ID NO: 9907 - DNA, 3000 bp, Unknown
  misc_feature (1)..( 3000): cDNA_ID_3034616_gDNA_ID_2096291_Annot_ID_195397 3000 nt of promoter + ATG
aagaaaagaactgtcttttctgtatacttatgtatactttccccggttccgttgctactgcgggctttacgcaattgatcggatcatctagatatcccttcaacacaacataggtcgtcgaaaggatctcggagacccgccaaagcacgaaagccagaatctttcagaaaatgaattcctattcgaagagtgcataaccgcatggataagctcacactaacccgtcaatttgggatccaattcgggattttccttgagggatattggtaaggaattggaatgtaataatatcgattcataatggattcatatcgatacagaagaaaaggttctctatcgattcaacaagtgctgtacttatgggaaagcgatagagaaagagaaaaaaaaaaacgaagatttcacatagtgatttttttttttttttttgatcaaaaataaatctgattgaatttatttcgtaccccttcgctcaatgagaaaatgggtcagattctataggatcaaacttatgggacttaagaatgatggaagggaataaaatcaaaaaagaaatcaaataaagaaaagagagagaaaataaagaaaaaataagtaaatcaaaatgaagtagaagaacccagattccaaatgaacaaattcaaacttgaaaaagtctctttctgattctcgaagaatgaggggcaaagagattgattgagaaagatctcttgttcttattataagatcgtgtgattggacccgcagatgtttggtaaaaagaataatcttatcctttgagaataatcaaaaatagaaagtgttcagttggaacatgaaaacgtgaccgagtttgtcctagttactcttcgggacggagtggaagaagggaggagattcgcgaacgaggaaagggacccaatgacttcgaaagaattgaacgaggagccgtatgaggtgaaaatctcatgtacggttctgtagagtggcagtaagggtgacttatctgtcaacttttccactatcacccccaaaaaaccaaactctgctttacgtaaagttgccagagtacgattaacctcgggatttgaaatcactgcttatatacctggtattggccataatttacaagaacattctgtagtcttagtaagagggggaagggttaaggatttacccggtgtgagatatcacattgttcgaggaaccctagatgctgtcggagtaaaggatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccacgagacaaaagatcttctttcaaaagagattcgattcggaactcttatatgtccaaggttcaatattgaaataatttcagaggttttccctgactttgtccgtgtcaacaaacaattcgaaatgcctcgacttttttagaacaggtccgggtcaaatagcaatgattcgaagcacttatttttacactatttcggaaacccaaggactcaatcgtatggatatgtaaaatacaggatttccaatcctagcaggaaaaggagggaaacggatactcaatttaaaagtgagtaaacagaattccatactcgatttcagagatacatatataattctgtggaaagccgtattcgatgaaagtcgtatgtacggtttggagggagatctttcatatctttcgagatccaccctacaatatggggtcaaaaagccaaaataaaagatttgagcccttataaaaagaaaacagattcttgaacccctttcacgctcatgtcacgccgaggtactgcagaagaaaaaactgcaaaatccgatccaatttatcgtaatcgattagttaacatgttggttaaccgtattctgaaacacggaaaaaaatcattggcttatcaaattatctatcgagccttgaaaaagattcaacaaaagacagaaacaaatccactatctgttttacgtcaagcaatacgtggagtaactcccgatatagcagtaaaagcaagacgtgtaggcgggtcaactcatcaagttcccattgaaataggatccacgcaaggaaaagcacttgccattcgttggttattaggggcatcccgaaaacgtccgggtcgaaatatggctttcaaattaagttccgaattagtggatgctgccaaagggagtggcgatgccatacgcaaaaaggaagagactcatagaatggcagaggcaaatagagcttttgcacattttcgttaatccaggaacaggatctatatagacacatagatccatggatccatacatctcgatccgaaaagaatcaatagaaaaagaaaaaatcggaattgatcgatctctttctcgaaacaaacgaaaaggaaagaaaagacgaaacagaaatcatggatcaactaagccctctcggggacttgcttaagaataagaaagagcaatctcatgtaaataccatggaataaggttttatcctattcatggggattccgtaaatattccattccaaaaatcaaaaattggtttttttttggagattggatgcagttactaattcatgatctggcatgtacagaatgaaaatttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaaatg

SEQ ID NO: 9908 - DNA, 3000 bp, Unknown
  misc_feature (1)..( 3000): cDNA_ID_3034620_gDNA_ID_2096291_Annot_ID_195396 3000 nt of promoter + ATG
gaataaaccaatttaaaaatgggataacatcctcgataaggcataagttctaatatcataagtgcttcttcataggaacgtccacgtatttgatcaattactctccgtgctttatgggcagacatagatatatattgccctaaagcatatacttccgtatatgatttcttttttctcttctttatcataaggtttacctctcactcaaaaaaaatctatattcattttttttaatttatttaattaacgacgagatctattatcatttttggcatgtcctcgaaaatttatagtaggtgaaaattctcctaatttatgtcctaccataagatctattatataaacgggtaagtgttcccttccattatgaatagcgatcgtatggccaatcattgtgggtataatggtggatgcccgggaccaagttattatgatttctttttccgcctttgtattaagcttctctatttttcttaataaatgctttgctacaaaagggtttttttttagtgaacgtgtcacagttaattaactcctatttttttaagacgaagaaagaaattcgattttctctcctatttactacggcgacgaagaatcaaagtctcactatattttttcctttttctagttcttcttccaagtgcaggataaccccagggggttacgggtttttttctaccaattggagccctcccttcaccacctccatggggatggtcgacagggttcataactactcctcttactacaggacgtttacctagccaacatttcgatccggctctacccaaacttttctggtttaccccaacatttcccacttgtccgactgttgctgagcagtttttggatatcaaacggacctctccagaaggtaattttaatgtggccgatttcccctcttttgcaatcagtttcgctacagcacccgctgctctagctaattgtccaccccttccaagtgtgatttctatattatgtatggccgtgcctaagggcatatcggttgaagtagattcttctttttgatcaatcaaaaccccttcccaaactgtacaagcttcttccaaagcatacggctttctggatgtagatgatgatatctatacggatggatcttatatatatcgtagaattcttctatatatggtagaagtaccacacgagtggatatataggaatcaaaatctgccgaataacttatgttatgatcttctacatcctaggtcttcccgttccgtcatctggcttatgttcttcatgtagcattcagaccgaatgactctatgaaattacgtcgatacttccacatattatgggtaacgtaggagacatctctatttttccccgggggaatctttagaattaccactgcttagctttcaattcgcctctgaccatcaaatgaaatgtgaataacccgtcctcctctctttgaaacaaggggcgcttatggttctgtcggtgcttgaaacaattttgtcttctccatattactatatctctagagtcaataattttatatgaggaactactgaactcaatcacttgctgccgttactcttcagttttctgttgaggtctatcctgtagaggtactcaaattggatcagtgatcgatttctaggtttcgtcgtaaacctaattggttacttccaattacgtaaatcaaatagttcaaaccgcactcaaaggtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtcttttgcatttcgtcgaaaatctattttacggtatagacgcttatgacctccccctctatgccttgcggtaattattcctctggcattacgacctttaccacaatgatgctgcccacagatcaaattatttcgtggattggatttcacttgactgtctacggctccattgcgtgtgctcggggtagaagttttgtataaatgtatcgccatgctattaagtattttgatttaagttcttttctttctaagaggtggaatagaataacccggttgaagcgtaatgatcatacgtctgtaatgcattgtatgtcccagaataggtcccattcttttaacctttccggggagtcgatgactattcatagctattaccttgacaccaaagaagagttcgacccaatgctttatttctgtcctagttgatcctgattcgacattaaaagtatattgatttttccccaataaccgaatacttttgtctgtaaatactgcatatttgattccatccataaatcgattttcttccctatgagttctagtctcaataagaatgctagttcttactgttcatatgttatgatatgaatataccacaccaattcgttatgtatagatgatgagaagattccattgatacagagccaattccaatagacttattggagggtccgattggcgtgcatccagtaggaattgaacctacgaattcgccaattatgagttgggcgctttaaccattcagccatggatgcttagtggggatcctcgtacatggtgaataaccaaattccaattgaaatgaaatctttaggataaatcaatgcaatttaggaggaatcaatgaaaggacatcaattcaaatcctggattttcgaattgagagaaatagtgagagagatcaagaatgctcactatttcttagattcatggacccaattcaattcagtgggatctttcattcatatttttttccaccaagaacgttttagaaaactcttggaccctcggatttttagtatcctacttttgcgcaattcacagggttcaacaagcaatcgatatttcacgatcaagggtgtagtactatttgtagtagcggcccttctatatcgtattaacaatcgaaat

SEQ ID NO: 9909 - DNA, 3000 bp, Unknown
  misc_feature (1)..( 3000): cDNA_ID_3034595_gDNA_ID_2096291_Annot_ID_195395 3000 nt of promoter + ATG
cttctgactctttttcaaattcgataaatgttggttgatcgtatctttcattatagttctatgattcagagtatcatttcctattagatccctttgaattccatattcgaagttgcgatcaggtctcttcattaaaaagaatcgattcaatacatttcttatgtacccatagggactatattggaattggatttgaatcatatttcggatcaatctatattgattgactgcctccattatgttgttgctagcaaataccactcttttttgatcttccaaataattcccgcaggagatccggacccaaatttttctgagccttcgataaaaagattcattttcttcataaaaaataggaggtagaaccaataaagatttcttttttgattcatccctgaagttgaaaacctccttcaagaattgtctttgatccaatccgtaggaatcaatagaaaaggcaaatcccttatgatacaccagatccggctcggttattgatagagtgaatagatctgccatttcttgaaatctctcttctgactcgtggcgtaacgtgtatccccccctcttccgttcatggaatagatgaaataaatcaaaaaatggatttttgttcaagaatgaaatcttattggaactgtccatatccagttcatccttcggaaccatatcacatcccagatctgatgaaataggatgaattgagacggtattttgtaaatacgtaattatcttgaatatattaactatttctttattttccgatcgcctggaagggacaaaagaaacatcttgttctttcttcaacaatttctgatccctagtggacctctcagtaggattcgaacccagatgaagttctgaccatctgtcagagaaaaaagaacgaatggctcttgtaggattcccaagaaattcttcgctttcttccggaagcagatgattattcattcgcttctcacgttccgtgaatagccggggcattgaggaatagccagaaaggtatttagggaatcggtctgattctatctctcttccttccgtttgaataaaggaaggatccaaaagaatcgatctttcttttagttgttgaatctctctttgattgatcaatgtgtgatagtgatattccgaatcctcattactaatggaatcgaaaggatctatgaattgatcagaagatccgttcaattggctagaatccgttacttgaacgaaactagatcttgtagaatcatattgaatatttgacgatacgtttcgtaccttgctaaaaaatctatccttgtttaccaaccacacattgtctaaccaaatccaattctctctcgatattttcctaaaaaaatccgattcgtgcggattcttcccccaactaacgaagagatcttggtggaattgccacatatgaaattgagcacaattttgcaaagaaatagcccacttgtttctcgagaagagatgggaaacatgctcaatatcatttgattgaatagttgacccagctccttgttgtttgcagaaaccctccacttcaattggtattttttcacgaaaagcaaacatgagataacaaatccagtctttcactaagatttcgaatagctgtcccgaattcaagttgattatgtttcgcctcttactcggagaaagacgatcaaacaattcccaatcatggcccttgcggatcggatcatccatataatatacaaaaagaaactccagatatttgatatctttctctttaaatgagatatcaattccagcgacggtttcattagatatcttacaacaaaaacccctcttttttccgatccagttcctccaccaccgcgaactccagttagattcaggcatgatacacttttgagttattgggagaacccaagtactctctttcggatcccggaaacagctctcagagatcttttttccttttgtaagatacaggagcgaaacaatcaacctattgatattgcaagacccaaaagattcttccgatgtatcatttctgggtccaatggaattcataggtataggaagaagccctttcaaatagagatttttgctttcgaccatatttcgattgttaatacgatatagaagggccgctactacaaatagtactacacccttgatcgtgaaatatcgattgcttgttgaaccctgtgaattgcgcaaaagtaggatactaaaaatccgagggtccaagagttttctaaaacgttcttggtggaaaaaaatatgaatgaaagatcccactgaattgaattgggtccatgaatctaagaaatagtgagcattcttgatctctctcactatttctctcaattcgaaaatccaggatttgaattgatgtcctttcattgattcctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatcggaccctccaataagtctattggaattggctctgtatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatg

SEQ ID NO: 9910 - DNA, 3000 bp, Unknown
  misc_feature (1)..( 3000): cDNA_ID_3034624_gDNA_ID_2096291_Annot_ID_195393 3000 nt of promoter + ATG
agtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagatccatccgtatagatatcatcatctacatccagaaagccgtatgctttggaagaagcttgtacagtttgggaaggggttttgattgatcaaaaagaagaatctacttcaaccgatatgcccttaggcacggccatacataatatagaaatcacacttggaaggggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccatccccatggaggtggtgaagggagggctccaattggtagaaaaaaacccgtaaccccctggggttatcctgcacttggaagaagaactagaaaaaggaaaaaatatagtgagactttgattcttcgtcgccgtagtaaataggagagaaaatcgaatttctttcttcgtcttaaaaaaataggagttaattaactgtgacacgttcactaaaaaaaaacccttttgtagcaaagcatttattaagaaaaatagagaagcttaatacaaaggcggaaaaagaaatcataataacttggtcccgggcatccaccattatacccacaatgattggccatacgatcgctattcataatggaagggaacacttacccgtttatataatagatcttatggtaggacataaattaggagaattttcacctactataaattttcgaggacatgccaaaaatgataatagatctcgtcgttaattaaataaattaaaaaaaatgaatatagattttttttgagtgagaggtaaaccttatgataaagaagagaaaaaagaaatcatatacggaagtatatgctttagggcaatatatatctatgtctgcccataaagcacggagagtaattgatcaaatacgtggacgttcctatgaagaagcacttatgatattagaacttatgccttatcgaggatgttatcccatttttaaattggtttattctgctgcagcgaacgctagtcacaataagggtttcaaagaaaccaatttagtcattagtaaagctgaggtgaaccaagggaatactgtgaaaaaattaaaacctcgtgcccgaggacgaagttacccaataaaacgatccacttgtcatataactatcgtattggaagatatatccttctatcaacaatatgaagaatatttaatgtatttaaaaaaacctggatgcagcaatgaaaacagaaatctaacatgttatgatacatatagtagtggaggcctatgggacaaaaaataaatccacttggtttcagacttggtacaacccaaagtcatcattctctttggtttgcacaaccaaaaaagtattctgaaggtttagaagaagataaaaaaatacgagactgtattaaaaattatgtccaaaaaaatataagaatatcctctggtatggagggaattgcacgtattgaaattcaaaaaagaatcgatctcatccagatcataatctatatgggatttcctaaattattaattgaagataaaccccgaagagtcgaagaattacagatgaatgttcaaaaagaactaaattgtgtcaatagaaaactcaacattgctattaccagaatttccaatccgtatggggatcctaatattcttgcagaatttatcgctggacaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttctttatctttatattttatccgacgataaaaaaacgaaaattatataacacgatacagacagtaataaaaaattgcagtcttcttttttatgtttaaaaataaaataagcaattctataagattgaataaaaatttccatcaaaactcctttgatataattgctatgcttagtgtgtgactcgttggtttaggattagataaagataaaaaaaaaagaaaaaagaacttacctataacagaaactaataactatagcattaataaataacctaagcaactcattgcttcacattatctggataaaaaaatcagtcaagatatgatggattgatcatattattgtagcaactgaaaaaaaaaaagaataaagaactataattataagttatgaaaggtaatcgaaaagtatgcggattcagtggaaggatgaaagaaagagagaaaaaattgaatattaatgatatattattccaatttggaaagtctatg

SEQ ID NO: 9911 - DNA, 3000 bp, Unknown
  misc_feature (1)..( 3000): cDNA_ID_3034628_gDNA_ID_2096291_Annot_ID_195390 3000 nt of promoter + ATG
aaaaattgaatattaatgatatattattccaatttggaaagtctatgaggtcactgtaagaaaagcaatgtaataaagcatcaatacagattcattcagaataattagataaatctgttccgaaaacaaaaaaaattaagagccttgagccaataaaaactaagaaaattgactcaaaaacaaataaaaaaaatgaaattcccgatttcatataagagctccattgtagaattcgggcctaatgattaatcaagaagcgatgggaacgacggaacccatgaatatagaggattctattgaaaaataaatcttagtaattcattggacaggatggcggaataaaccagattattatctattcttatttttattcagagatctcctgggataaacaacaaacttaatatagatattgaaagagtaaatattcgccggcgaatactttttttttaataaaagtaataaaaaacaaaaattaaaaagataaaagaaaataaggatttgttagaatattctaacaaaaacgacattcgagatgatgatattacgttacgttatttttaaataaatagaattaatcttggattccatttcgaaaaagacatacacaaatttagaagagatcagatgaaattgaatatcatgattaatagaattaatcattaactatatcttaatacaagcttttttagtccttttattcgcgaggagctggatgagaagaaactctcacgttcagttctgtagtagagatggaatttctaatttagaaccatcaactataacccaaaaagaaccagatttcgtaaacaacatcgaggaagactaaaaggaatatcttctcgtgggaatcgtatttgttttggcagatatgctcttcaaacacttgaacccgcttggatcacatctagacaaatagaagcagggcgacgcgcaatgacacgaaatgtacgacgtggtggaaaaatttgggtacgtatatttccagacaaaccagttacagtaagacctgcggaaacgcgtatgggttctgggaaaggatcccctgagtattgggtagctgtggttaaaccaggtaaaatcctttatgaaatgggtggtgtacccgaaaatatagcaagaaaagctatttcaatagcggcatcaaaaatgcctataaaaacccaattcattatttctgaataggaatatataatgaaaaaactaaataacatttaagggtaaaaagattataagttttctttttttgacaaacaatatttttttacttcgtcctttgcattaaaagaagagatacaaaaaaaatgatatgattcaaccacaaacctatttgaatgtagcagacaacagcggggctagagaattgatgtgtattcgaataataggagctagtaatcgccgatatgctcatattggtgacgttattgttgctgtaatcaaagaagcaataccaaatactcctctagaaagatcagaagtgattagagctgtaattgtacgtacttgtaaagaactcaaacgtaacaatgggacgataatacgatatgatgacaatgccgcagttgtcattgatcaagaaggaaatccaaaaggaactcgagtttttggggcgatcccacgggaattgagacaattaaactttactaaaatagtttcattagctcctgaggtattataagatctaaatatcgatagcgatagttagtatcggattaaaaaaacaggtattgaaataaaattaattaatagattctgtatcacgcatatacccttaataataaaatattaagaatttaattcatatattaatatataattcgtctatatctatatataaataaaagaaaaagaacatgttgattatatcaaaattatagaacaataaggaattttaacttatcatggggaaagacaccattgctgatataataacctctatacgaaatgctgacatgaatagaaaaggaacggttcggataggatcgactaacatcacggaaagtattgttaaaatccttttacgagagggttttatcgaaaacgtaaggaaacatcgcgaaaacaaccaatattttttgattttaaccctaagacatagacgaaataagaaagaatcctacaaaacgattttaaatttaaagagaataagtcgaccgggtctacgaatctattctaactctcaacgaattccacgaattttaggcggaataggaattgtaatcctttcgacttctcaaggtataatgacagaccgagaagctcgactaaaaagaatcggcggagaaattttgtgttatatatggtaatccttctaatataaaaattagatatctgtaacttacaatttgtgaaaaaagggggttgtgtaataccacccctgttcaaaaaagtttcggatgttttacttcgaatgaaattaaagaaaaaatgaattaataaaagttttctttcttaatcacttccgaacggcatggttcgattttgtttagatactaaagattttttttcgttcatgcttctgaaaggattcgacatatttttgtataggtatacctataggataaaaaggtaaaattttgagtaagttcttaagtataagttaataaggggacagccattttctagactccataataagtattcaaatgagtaagtgttttttcaatttcaaccattcctttcacgaagatacaattcaagattcaaaaatatcaagaaacctttttttcgtccaccaataaatatattcacagaattaaggaataacaactatgaaaataagggcttccgttcgtaaaatttgtgaaaagtgtcgactaatccgcaggaggggacgaattatagtaatttgttccaacccgaggcataaacaaagacaaggataatcttactaaaggaactaaagtaaaagaaaaggcacttccaaagagttggaaaaaagggtctattttgacctgaaatggatatatccatatatttcttgtgaaatgaaaaaaaatg

SEQ ID NO: 9912 - DNA, 3000 bp, Unknown
  misc_feature (1)..( 3000): cDNA_ID_3034631_gDNA_ID_2096291_Annot_ID_195389 3000 nt of promoter + ATG
attttttttatagagtttttatcataattttgcatataatagaagtagtaattataaaaatattatatattaattatcaattgggtttttgctaaacggagcctggatacttcattttattagtccgatcacgtaaaccataaaaaaattttgataatctaatatcaatctaaatactccctgcatttaattccactttattttttgcgcttcgcgttacaaatttttgataattcaatcaatctttttgagcgaaacagaggatatctcgatcgagggagaaaatggggaaatcccatatagcccgatatatctgacaagtcgcactatatgtcaacccaagatgtatctccttctccaggacttcgaaaaggtacttttggaacgccaataggcatgaaatgaaaaaaaaagagaatgaagttctctatttcactttgatgtggaaacgtaaaattggggtttcgttttttaatactattatccttttttcctactttattaatcatatttaaattaatgatatttaatacataagttgaataagctaaaataaaatataaaataaaagtaaagtaagagagaatgaataaaactaaaggaaattttttacgaacgggcttctgaatgatcaacaacaatagctatcttggttcatagaaaataggattaacccccattgcatattggtacttatcggatatagaatagatccgcttccctttttttctatgaattgaattgttccattattactaacagaatagaacaaatattaatcctttctccgaaataattacctaaaaagggggggtacgtagcatagttttttccaatgcaataaagttacatagtgtctatttttcgttgataaaggggtatttccatgggtttgccttggtatcgtgttcatactgttgtattgaatgatcccggtcgtttacttgctgttcatataatgcatactgctctagttgctggttgggctggttcgatggctctatatgaattagcagtttttgatccctccgaccccgttcttgatccaatgtggagacaaggtatgttcgttatacctttcatgactcgtttaggaataaccaattcttggggcggttggaatattacaggggggactataacgaatccgggtctttggagttacgaaggggtagccggagcacatatagtgttttctggtttgtgcttcttggcagctatttggcattgggtatattgggatctagaaattttttgtgatgaacgtacaggaaaaccttctttggatttgcccaagatttttggaattcatttatttctttcaggagtggcttgcttcggttttggcgcatttcatgtaacaggattatatggtcctggaatatgggtatccgacccttatggactaaccggaaaggtacaacccgtaaacccggcgtggggcgtggagggttttgacccttttgttccgggaggaatagcctctcatcatattgcagcagggacgttgggtatattagcgggcctattccatcttagtgttcgtccgcctcaacgtctatacaaaggattacgtatgggcaatattgaaaccgtcctttccagtagtattgctgctgtcttttttgcagcttttgttgttgctggaactatgtggtatggttctgcaactactcccatcgaattatttggtcctactcgttatcaatgggatcagggatactttcaacaagaaatatatcgaagagttagtgctggactggctgaaaatcaaagtttatcagaagcttgggcgaaaattcctgaaaaattagctttttatgattatattggtaataatccagcaaaaggggggttattccgagcgggttcaatggacaatggggatggaatagctgttggatggttaggccaccccgtctttagaaataaagaagggcgtgaactttttgtacgccgcatgcctactttttttgaaacttttccggtagttttggtagacggagacggaattgttagagctgacgtcccgtttagaagggcagaatcaaaatatagtgtcgaacaagtaggtgtaactgttgagttttatggtggtgaactcaatggagtgagttatagtgatcccgcaactgtgaaaaaatatgctagacgggctcaattgggtgagatttttgaattagatcgtgcgactttgaaatctgatggtgtttttcgtagcagcccaagaggttggtttacgtttggacatgcttcgtttgctctacttttcttctttggacacatttggcatggtgctagaaccctcttcagagatgtttttgctggtattgatccagatttggatgctcaagtggaattcggggcattccaaaaacttggagatccaactacaaaacgacaagcagtctgatgcaacattgctttttttcttctagtttctgtttgttattttatttaataggtagggtactgtaggaatctttatttaaatcgctgccgtttctttgactctttttctttctttatcctcccaagtaaacaaaacgtaaacaaaacaggtatgaaagctataattgtaaaccacgatcaaatttatggaagcattggtttatacatttctcttagtatccactttagggataatttttttcgctattttttttcgggaaccacctaaaatttcaactaaaaaatgaaataatttttcattatcttcattaacgtaatcagcctccaaatatttggaggctgattacgttaactagtccccgtgttcctcgaatggatctcttagttgttgagagggttgcccaaaggcagtatatagagcatacccagtaaaacttacaagtaacccagatataaagatggcgactagggttgctgtttccattattatagaattgaaagaccacaccggatctatgctaagatcatttatttacaacggaatggtatacaaagtcaacagatcgtaatgaatacaaaataagattt

SEQ ID NO: 9913 - DNA, 3000 bp, Unknown
  misc_feature (1)..( 3000): cDNA_ID_3034645_gDNA_ID_2096291_Annot_ID_195373 3000 nt of promoter + ATG
ggttggatgaattatccgaagaggatcgcttaaccgtagcaagagcacgaaaaattgagcgtttcttatcacaaccctttttcgtagcagaagtatttacaggttctccgggaaaatatgttggtctagcggaaacaattagagggtttaatttgatcctttccggagaatttgattctcttcccgaacaggccttttacttagtgggtaacatcgatgaagctactgcgaaggctacgaacttagaaatggagagtaaattgaagaaatgaccttaaatctttgtgtactgactccgaatcgaattgtttgggattcagaagtaaaagaaatcattttatctactaatagtggacaaattggtgtattagcaaaccacgcgccgattgccacagctgttgatataggtattttgaaaatacgccttgctaaccaatggttaacgatggctctgatgggcggttttgctagaataggcaataatgaaatcactattttagtaaatgatgcagagaagaatagtgacattgatccacaagaagctcagcaaactcttgaaatagcagaagctaacttgagaaaagctgaaggtaagagacagacaattgaggctaatctagctctcagacgagctcggacacgagtcgaggctctcaatacgatttgattttgtaactagctgacgtgtaaaaaaaaagaatgtataaaaaaaataggatcgaaagacgataaaaacaataaaataaaaaaagctggttacaaaaacttattagacaccattgatcatggtgtctaataagttatacctactattggatttgaaccaatgactcctgccgtatgaaagcaatactctaaccactgagttaagtaggttatttatcattgtaaagagaaggaaaggggatacctatcacatcgataggattataaatccaatattatttctaagcaataccaataaacaatgagatcaaagagatataatgttcgatcatgtaatattaatcttgacaagaaattatctacatgataagataaaatgtgtatcacaaacacaagggctatagctcagttaggtagagcacctcgtttacacgtgcgccaaagtttttcagaggagtccatcacgcaatcaaactaattgattgatcttattaagaaatcgatgtcttactccatgacttttttttaggaaaaaagaggagaacaacagcctgacattaggtcctattaaagtaccccgttaggtagggaatgaatagaacccatcattgatttgagatattgatagggtgaatacccagtctactcaatgctaggtagaatgagtataaggaactcaaaaatgatcttttcgtcctatgaaccttaaggtgtatcaagtttcatgtttgattttttaatcaggatgttagagactatatttaacttaagttgatctagaccaaaagcaaacctacgtcaagagaacccttctttgaaacactttggtagttcttctgtattgtattagaattcaaaaataatcaatcagagtacttggaaccatttcttatcttttttttaagaaaaaatatggtagactaactgatctttcgatcagttaatgaaagagcccaatgcaaaaaaaaatgcatgttgggtctttgaaagagttcgaatcattttgataataataagttcgaactcttttaccgagcaggtctacggttcgagtccgtatagccctaactaagaaatttattctaaaaaatcacattaaaatcaaaataattggataaatttttttacttttttttgtattctttatttctaacaggttacttttaattgctcggttcataaaaaaaatttccatatcataaaccataagtcctggggatcgttcagaataaaacggaaaatttcattttatttcaatggagccaatcactatctatcgatatatcgagatagatacttaatttataatttagaataaacctttttcttcattaattttcatagttgtaatttttttatatgaattttcctcgttcactagctacaatcaaaaagttcataatactttctttttttttttgtatccccactcaatcttggttactttttttatcacacggccttgtttaaaaataaaaaaagaaatctaattaaattcaaccaaaattcaatctatctaatactaagtaagatgagtatggtaaagtcttactggattttttgatacgtcatcatttaaaaaacgaagagatttttcgaaaaatttttttaaacataaacagaaataaaaaaaattactagttattaatcagattaatattatattattatattagaaactattagtaatagaaacatggaactattaagtaataagtgtactgaaaataagaaatcaataaatcttaaaacgagacgtctaccacaacaaccaaacgaaaaaaaatgattcgattaacctgaatttttgttttgactcaagagttctatatcccttgcccaatccactccgattggaattgactaagcgggtattttttccacattcataggagttcgtctatgtttctgctttacgaatatgatattttctgggcatttttactaatatcaagtgctattcctgttttggcatttctaatttccggagttttatctccaattaggaaggggccggagaaactttctagttatgaatcaggtatagaaccgatcggggatgcttggttacaatttagaatccgttattatatgtttgctctagtttttgttgtttttgatgttgaaactgtttttctgtatccgtgggcaatgagtttcgatgtactgggggtatctgcttttatagaagctttcattttcgtgcttatcctaattcttggtttagtttatgcatggcgaaaaggagcattggaatggtcttagttcgtttaccgaatacttgatacaataataaaaaaaaaaaaagtaaaaaaaaccattgaaacaattatg

SEQ ID NO: 9914 - DNA, 3000 bp, Unknown
  misc_feature (1)..( 3000): cDNA_ID_3034665_gDNA_ID_2096291_Annot_ID_195363 3000 nt of promoter + ATG
tgcactggagtactgatgtgtcccatgcacccgaatttacatatagtaatgtccacctcttaccaaaaacaagtcatttatggatattatccggaggttcatgtggatctagtctaattcgtttttcgatccataaagatcaagatcaaatgaatataccctttctttccgccgaaagaaaatctatttctagcctctcagtgaataatgatcaagtgagccaaaaattttttagttccgattttgccgatccaaaaaaattagggatttacgattattcagaattgaatggaaacttaggtactagtcattataatttaatatattctgctatttttcatgagaactcggatttattagcaaaaagacgaagaaatagatttctcattccattccaatcgattcaagagcaagagaaagaattcataccgcagtcaggtatctcggttgaaatacccataaatggtattttccgtagaaatagtatttttgctttttttgatgatcctagataccgaagaaagagttccggaattcttaaatatgggactctaaaggcggattcaatcatccaaaaagaggatatgattgagtatcgaggagtccaaaaaattaagacaaaatacgaaatgaaagtagatcgcttttttttcattcctgaggaagtgcatattttacccgaatcctctgccataatggtacagaactatagtatcattggagtggatacacgactcactttaaatataagaagccaagtcggcgggttgatccgagtagagaaaaaaaaaaaaaggattgaactcaaaatattttcaggggatatccattttccggacaagacagataaaatatcccgacacagtggcatcttgataccgccaggaagaggaaaaaaaaactcgaaggaatccaaaaaatttaaaaattggatttatgtccaacggattacaccaaccaagaaaaagttttttgttttggtgcggcccgtagccacctatgagatagcggacagtataaatttggcaacactcttcccacaagatctctttcgggaaaaggataatattcaacttcgagttttcaactatatcctttatggaaatggcaaaccaactcgaggaatttctgacacaagtattcaattagttcgaacttgtttagtcttgaattgggacaaaaattcttctctcgaggaggtccgtgctttctttgttgaagtaagtacaaagggtttgattcaagatttcataagaattggcttagtgaaatcccatatttcatatataagaaaaaggaataattcgccagattcgggattgatctctgcagatcacatgaatccgttttattcgatttcgcccaagtctggcattcttcaacaatcacttagacaaaatcacggaactattcgcatgttcttaaatcgaaataaggagtcccaatctttgttaattttatcatcatctaattgttttagaatgggtccatttaatcatgtaaaacatcacaatgtgataaaccaatcaataaaaaaaaatactctaattacaattaaaaattcgtcgggccccttaggaacagctaccccaatttcaaatttttattcgtttttgcctttactaacttataatcagatctctttaattaaatattttcaacttgataacttaaaatatatttttcaaaaaattaactcttatttaatcgatgaaaacggaataattttaaatctcgacccatatagtaacgttgttttgaatccattcaaattgaattggtattttcttcatcaaaattatcatcataattattgtgaggaaacgtccacaataattagtcttggacaatttttttgtgaaaatgtatgtatagctaaaaaagaaccgcacctaaaatcgggtcaagttttaattgttcaaagggattccgcagtaataagatccgctaagccctatttggctactccgggagcaaaagttcatgggcattacagcgaaattctttacgaaggggatacattagttacatttatatatgaaaaatcgagatccggtgatataacccaaggtcttccaaaagtagaacaagttttagaagtccgctcgattgattcaatatcgttgaacttagaaaagcggattaagggttggaacaagtgtataacaagaattcttggaattccttggggattcttgattggtgctgagttaactatagtgcaaagtcgtatttctttggttaataagattcaaaaggtttatcgatcccagggggtgcagattcataataggcatatcgaaattattgtacgtcaaataacatcaaaagttttggtttccgaagagggaatgtctaatgtttttttacctggagaacttattggattattacgagcagaacgaacggggcgtgctttagaagaagcaatctgttatcgagccgttttattaggaataactcgagcatctttgaatactcaaagttttatatccgaagcaagttttcaagaaactgctcgagttttagcaaaagctgctcttcggggtcgtatcgattggttgaaaggcctgaaagaaaatgttgttctagggggggtgatccccgccgggaccggattcaacaaaggattggtgcattgttcacggcaacataccaacattattttggaaaaaaaaacaaagaatttagctttattcgagggagatatgagagatattttattctaccacagggaattttgtgactcttctatttccaaatctgacttttctaggatttaatgatttctaatagcggactatttaaaattttagtttttgttgtttgctgtagtcatttgctttcgtaatttgttaacactaataaagataataatcaatacaaaataatggcttggttcatgcataaatggccatccccggtacaagagaaggttccatcggaacaaaattttattttagtttggggtgcccccctttttaagtgtgaaaagaaatg

SEQ ID NO: 9915 - DNA, 3000 bp, Unknown
  misc_feature (1)..( 3000): cDNA_ID_3034661_gDNA_ID_2096291_Annot_ID_195364 3000 nt of promoter + ATG
ctgagaagatcgttttttcgggcaatggtgatactctaagcattccattaattatgtatcaacgctcaaacaaaaatacttgtatgcatcaaaaacctcaggttcgtcggggtaaatgcattaaaaagggacaaattttagcggatggtgctgctacagttggtggggaactcgctttggggaaaaatatattagtggcttatatgccatgggaaggatacaattttgaagatgcggtactcattagtgagtgtctagtatatggtgatatttatacttctttccacatacggaaatatgaaattcagacgcatgtgacaacccaaggtcctgaaaggatcactaaagaaataccgcatctagaaggtcgtttactccgaaatttagacaaaaatggaattgtgatgctaggatcgtgggttgaaacaggtgatattttagtaggtaaattaacacctcaagtggcgaaagaatcctcctatgctccggaagataggttattacgagctatacttggcattcaggtatcgacttcaaaagaaacttgtttaaaattgcctataggtggtagaggtcgagttattgatgtgaggtgggttcagaaaaagggtggttcaagttataacccagaaataattcgtgtatatatttcacagaaacgtgaaataaaagtaggtgataaagtagctggaagacatggaaataaaggtatcatttcaaaaattttgcctagacaggatatgccttatttgcaagacgggagacccgtggatatggtcttcaacccattaggagtaccctcacgcatgaatgtaggacagatatttgaatgctcgcttgggttagcgggaagtctgctagatagacattatcgaatagccccttttgatgagagatatgaacaagaggcttcgagaaaactggtgttttcagaattatatgaagccagtaagcaaacagcgaatccatgggtatttgaacccgagtatccaggaaaaagccgcatttttgatggaagaacaggagatccttttgaacagcctgtgataataggaaagccctatatcttgaaattaattcatcaggttgatgataaaatacacggacgttctagtggacattatgcacttgttacacaacaaccccttagaggccgttccaagcagggggggcagcgggtaggcgaaatggaggtttgggctctggaggggtttggtgttgctcatattttacaagagatgcttacttataaatctgatcatattagagctcgccaagaagtacttggtaccactatcattggaggaacaatacctaaaccagaagatgctccggaatcttttcgattacttgttcgagaactacgatctttggctctggaactgaatcatttccttgtatctgagaagaatttccagattaataggaaggaagtttaatcggaatgaatcacaaaatttcttatatgatcgatcggtataaacatcaacaactccgaattggcttagtttctcctcagcaaataagtgcttgggccactaaaataatacctaatggagagatagttggagaggtgacaaaaccctatacttttcattacaaaaccaataaaccggaaaaagatggattattttgtgaaaggatttttggacctataaagagtggaatttgcgcttgtggaaattatcgagtgatcggagatgaaaaagaagacccaaagttttgtgaacaatgtggagttgaatttgttgattctcggatacgaagatatcaaatgggatacataaaactgacatgtcctgtaactcatgtatggtatttgaaacgtcttcctagttatattgcgaatcttttagataaacctcttaaagaattagaaggcctagtatactgcgatgtgtgatttgatcgaaatttttcttttacagattaagaatgataaactctcatccccttcaatcaatttgggatgccctcgatctgacatgtctcttgaaaagagtaacatgaagctcagaattgtgggtgtattcaatactcccaaataaaaaaaaaggcgattggtctatggtcgattcagaaattcaaattgataggcgtacctcgtgaaaagaagaccttgttttgtcgaattacgcattcccttatctttctaaaagaaaataaatttggttttttatagttttatattattttatttttatataaagtaaacaaatatgtcatggttgcagaagtctatacatcgcatataagctttaagaatattgtggcataaccatcgaggtgacgcaggacctaaaagatcgaatggaacaatacatagacaaataaatcccgtatgaattttaaggcattcctttcacttaaggtaaagagtattccggcattcgaagggaagtagactactcaagaatttgacatttttttctgtcgtaatttttaattcactaaagaatttaaatagaaatcaaagaagaattaattgaatcaatgaaatgttggttggtttgcactgagaacttgagtaaggcgtagattctttttgggtttttcactttattttataaaatgaaatttgaaagcgagacccctttctttatttggtataactacttgagccggatgagaggaaactttcatgtccggttttgaggggggagatcttatagtggaccctatcccaatttttcttttgctaggcccataactaaaaaacctactttcttacgattacgaggttcatttgaatatgaaattcaatcctggaaatacagcatcccacttttttttactactcaaggtttcgatatatttcgaaatcgagaaatttctactggggcgggtgctatccgagaacaattagccgatttagatttgcgaattattatagaaaattcgttggtagaatggaaacaattaggagaagaagggcctacggggaatgaatgggaagatcgaaaaattgtaagaagaaaagattttttagttagacgtatg

SEQ ID NO: 9916 - DNA, 3000 bp, Unknown
  misc_feature (1)..( 3000): cDNA_ID_3034649_gDNA_ID_2096291_Annot_ID_195370 3000 nt of promoter + ATG
tcgtattcgtttagaagaaaaacaaaaattgcgttttcattatggtcttacagaacaccaattacttaaatatgtgcgtatagccggaaaagccaaggggtcaacaggtcaagttttactacaattacttgaaatgcgtttggataacatcctttttcgattgggtatggctttgactattcctcaagcgcgccaattagttaatcatggacatattttagttaatggtcgtatagttgatataccaagttatcgctgcaaaccccgagatattattacagtgaaggatgaacaaaactctagaactttggttcaaaatcttcttgattcatctgcccctgaggaattgccaaaccatctgactcttcacacattccaatatgaagggttagtcaatcaaataatagataggaaatgcgtcggtttgaaaataaatgaattgcttgtcgtagaatattactctcgacagacttaataaacctaacttaagtaaaaaaaaaaattactaaaaacaagagttcggacaactccccttttccattaaaaataaaaaggcacaaggtaagggattttgtcaaagaatatttttcctattcatgtatcatagattggtagggagattgggatcccttgtttgctcttcccagcattttccatatgaaagaaattaggaatagagaatctatttcaaaatcaaaacaaggtagatcttatatcgattcttttttattggatttgatacattgtggtcaatcacgtaagattggtgaatttgttgaaagtacggaaagagagggattcgaaccctcggtaaacaaaagtctacataacagttccaatgttacgccttcaaccactcggccatctctccgacatcaagattatgactgagtatctgggtgaatagcgagttattcatcgttttttagattatggttaatagataccctttttgaccggaaaatttggaagtagatagaaggttttttttaatgagtccgcttttatgttagttcgtactatacaattcctttgtttgtgagaaaattttctcacaaaagaaaaggtaaaggaaataaaaagagttagagaatggattactacctatgccaagatcgcgtataaatggaaattttattgataaaacctttacaattgtagccgatatcttattacgagtcattccgacaacttccggagaaaaagaggcatttacttattacagagatggtgcgatttgattatcattattttttttctcgccgattttgattggaatagaaagaaaaacgagtattgaaaaaaaatctacgcttttgaaggtgaagtttataatataaaaaaaacaatcccttctgtcatgtatccacgattaatgcagccttagatgcttcaattgtgaattatagtattgagcaaaaggtttttacctatggttcccgtattacagatcaatcctactacactaatacaatatacgaataggaggcataggggaagaagcactacgccgagaaatcaacaacacgaaaactttcttaaaaatgattccctttcttcttcttcgttgggattgggactaattaaaatggttggaacaataaacatccatctcgttcgtattttggatacccgtataaccattgaagactgttgaagtgactaattcctggaaacttaggggcgttgagaacaaagaaatttttagagtttccttttttatttttatctagcatgaacccacttggtagtaagaaaagatcttttgcaagaaggttggctagggatttcttgtaaaaacattagccccgcttagttcataatgacatcacatttttacatatattattttcattatgcacctaaaggaggagccgtatgagatgaaaatctcacatacggttctgaaacggagagttcgttaaagcgaatgacgaccgtaacggatgtcggctcaatctgaaggaaattatgcggaagcattacagaattattatgaagctatgcgactagaaattgacccctatgatcgaagttatatactctataatataggccttatccatacaagtaatggggaacataccaaagctttagaatattattttcgggcattagaacgaaacccctttttaccacaagcttttaataatatggctgtgatctgtcattacgtgcgactatctccactatagaaaaaaagaacgaacgctagtcaataaaatactagaaacacaaaaaaagggctttctacataagcatcgcctaaaacgatttttatcagctgtagcaaataactaaacttcatccatcgaaatatgaagtgaagactagatatgcctaaatactttcttttctatggataaaaaaagatttaattgatagaggaagcaccgtaaagatcaattggaaaggttttggaccgacacaacaagagctgtttatttatatcataatatgagataaatcttaggaatctacttatgtaatagagtaatccccgaaggtattgagcagcggtgtagcatcagatcctaaagacagtaagtctttttcttttttatgaagtatgaaaaagtctttttcaaagattctatataaatttttatatgaaagcgggatagttacctttcagaaaattctaatatctaataacagtggacatgcttttttttctgaaggtaggagaaaagataaaacttattatattaattaatatattaattaaatcaaaatgaaagtttgaaactcatgtaattactctcttttgtttaatccaagaaaaacaaaaaatctataagaaatctcattcaattagacattcaattagatataaagttcaaagtaggttaaagttaaaaaactggtacaccaaaacaaaagagttggttgtcgagccgtatgaggtaggaaactctcaagtacggttctcagggagggaattgatccgcctattccgaccgtggagaacaggccattcaacaaggagattctgaaatg

SEQ ID NO: 9917 - DNA, 3000 bp, Unknown
  misc_feature (1)..( 3000): cDNA_ID_3034653_gDNA_ID_2096291_Annot_ID_195368 3000 nt of promoter + ATG
gaaaaaagaaaaatcaaataaaaagataaatgaaaccattttcatccccttgctcggaaacaaaaaggggagttgatgtattgaatccgccgggactgacggggctcgaacccgcagcttccgccttgacagggcggtgctctgaccaattgaactacaatcccatggaaataaagcgggtagcttacatattccttcttatgatttcattttaatcatttcaattttaaattcaaatttttgttttgtaacaaagaaagtcacaagtgatatattgatatctatatggatatcactttagtgagagcaagacggattactgggtaatccttacattattatcaaatcaattgataatctattttttacaaaaaaatagattattttatcgactctgttcattaaagtttctctttaaaggatccatatcggaatccttagcaagatcaagatcggaattttttatggaaaaaaaaagtaactaaacataagaaataaagaaaaaagtaaagtcgaactataccctataccctgaaatttgacctttttttcttaccccttctctgtcatttatgcaaaaaaaaaaaaatggttatgtagacagctaattattgggccgagctggatttgaaccagcgtagacatattgccaacgaatttacagtccgtccccattaaccgctcgggcatcgacccaggaagaatctattctaactttatggataatccatgatcaacttcctttcgtagtaccctacccccaggggaagtcgaatccccgctgcctccttgaaagagagatgtcctgaaccactagacgatgggggcatacttgctcaaccgccatcatactatgatcatagtatgatcagtttttttaaattgtcaatataatgaaatgaaatggtatgactagcttataaggttttttcttttttctatagaattctatatcattttttttttacatttgtattcatattctaatcataattctataacaaataaatatactttctttttatatttgaagtggaaatattaaaattaaaaaataaataaaaaaaaatctaaaaatcgtctagtacggaatcttttcaagaagtgattggtctaacataaaaaaaaaaaagaaaaaaagagggttaagtttcgttttttttttactttccttgatagattgcctcatctcattgttaagaaatagtagtatccctgtctaacactaatccaagaaagtcagccagaatccatcttctaattagggaaaaaggtggatttataagttaagttatcaaaaatttgctttttttttttttagaaaattattgttcagaggataatccgtatctcttcatcacatgtcaagataaaatatcttgggtgtatgtcaacttgctgagtacatgtataaatcaaattaatttcgttcgatgcgctaggctattaaaaaaaaattcattgcatggatatttatcaaatccaatattaaaaaagcaaaaaataccccgttaagtaaatttgaagtcaattcaaattctcatttctagttcccaaatgagctactaaccactatgcgtctattgtatatatatttaatatatatatatatatagattttatttactaccggctcagtcaggaattaaaccaagacggcccttttaactcagtggtagagtaacgccatggtaaggcgtaagtcatcggttcaaatccgataaggggcttttacgttctttactttctaatagtcaaaatttcatttgaaagtctataatttaatttcaaattttgttaatttcattctaataaatttcattctaataatataataactaataataaagttagcgagtaatttaaaaaataaaaatgaacatttgtatattataatacaattacaatgaataatgataagtcgtctcttgaatcgccaaatatatattctttttttttcgatttttcgatagattagaaatcgacaaatccaaaagaaaaagtaagtggacctaacccatcgaatcatgactatatccactattctgatattcaaattcgatagagattaaattgaaacagtagattttttttatttcatatttttgtattaggaaatccgtcgatatctcttattgaatcttcttgtttctatatatttcataggaaatatattgcgttcctgcctagagaaagagagtatttttgcaaagtaataactaaaagggcgtttcaatattttttttgattcgagaacataacaagatcctacattctctttgtattaagaatcaatttgtattaaaaataaacaaaaatcgaatcataatcatggcttcagatatcaattaaatatttccatattgatgcatccgagatgacaatgtaatgtgatcgaaggtgtatgtgagaaagaaactctcatttacagtttcctataattttatttaaatattgaattaaatataaataagaaattttccccttttttgacagatacataagggcatgtacatatagatatcaaagaaaatagaaaaaaatattaaaagttccctttttgcttcaacccgtcaactaaaaaaagggtataaaaggaaaataacaatagttgatactatagtatttaatagacaagtatttaatacacgcaaaaaagaaaaaaaaaagttctttattctttatctgaataatgagtcatccgacaattcatgatttagattcaactacttatacttattaataaactaatagcaaggaagaaacaaattgagttgatccgtttacctaagtaaggaccaataaaatcaaaaattttgatcttcgaaaccaattaaatgaaattctaagggttccattttatggggcagtgcgcgagaaattaaatcataaacaaatgatagaatttgagcgccctgaaaatgccataatatataacatcaaaatctataacattaaggtgttcggaaatggttgaagtagatgaataggaggatcgct

SEQ ID NO: 9918 - DNA, 3000 bp, Unknown
  misc_feature (1)..( 3000): cDNA_ID_3034669_gDNA_ID_2096291_Annot_ID_195361 3000 nt of promoter + ATG
acaagagaaggttccatcggaacaaaattttattttagtttggggtgcccccctttttaagtgtgaaaagaaatgacaaaaagatattggaacatcgatttggaagagatgatgagagcaggagttcattttggacatggtacgaggaaatggaatcctagaatggcaccttatatttctgcaaagcgtaaaggtattcatattataaatctgactagaactgctcgttttttatcagaagcttgtgatttagtttttgatgcggcaagtaggggaaaacaattcttaattgttgggacaaaaaataaagcagctgatttagtgtcgcgggctgcaatacgggctcggtgtcattatgttaataaaaaatggctcggcggcatgttaacaaattggtccactaccgaaaaaagacttcataagtttagggacttgagaactgaacaaaagacagagggattcaaccgtcttccgaaaagggatgcagctgtgttgaagagacaattatctcgcttggaaacatatctaggcgggattaaatatatgacgggattgcctgatattgtaatcatcctcgatcagcaagaagaatatacggctcttagagaatgtatcactttgggaattccaaccatttctttaatcgatacaaattgtaatcccgatctcgcggatatttctattcccgcaaatgatgacgctatagcttcaattcgattcattcttaacaaattagtattcgcaatttgtgagggccgttctagctatatacaaaattcttgattaataataagataaataaatcaattttttttttagggaggggctccctgtatttcgatttcaaaaatcggttactactcctgaattgtagaaaagaaaaagagagaaaaaactggggatattgtgtgatttgtttagttgggatccaaaactaaaatataaaatttaagtaaataagtaaaaaaaaagggggggtcttgaatcaaaataatttaaagttcttatttctgtcagagggcaatatgaatgttttatcatgttccatcaacacactaataaaagaagggttatatgagatatctggtgtagaagtaggccaacatttctattggcaaatagggggtttccaggtccatgcccaagttcttattacttcttgggttgtaattgctatcttattaggttccgcagttctagcgattcgcaatccacaaacaattccaactgacggccaaaatttctttgaatttgtccttgaattcattcgagacgtgagtaaaacccagattggagaagaatatggtccatgggttccctttattggaaccctgtttttatttatttttgtttctaactggtcaggagcccttttaccgtggaaaattatccagttacctcaaggggagttagcagcaccaacgaatgatataaatacgacggttgctttagctttactcacatcagtagcctatttttatgcggggcttagcaaaaaaggattagggtatttcagtaaatacattcaaccaaccccaattcttttacccattaacatcttagaagattttacaaaacccctatcacttagttttcgacttttcggaaatatattagccgatgaattagtcgttgttgttcttgtttctttagtacctttagtggttcctatacctgttatgttccttggattatttacaagcgggattcaagctctcatttttgccactttagctgcggcttatataggtgagtctatggaaggtcatcattaatggttttttttttaatattcttttttaggttagcccaattaattatagaatagttggtttacattatgtaagaaacacttgtatatgtgatatttgatattgcctaggtatatatgagttaaagatctatataatctgaatctgctctactatttttgtgaatttctatttagatttagatagggattcgattagaagttcttcctttttatctgtgaattggctgaaaaaatgataaaaaaagaacgaagaattcaaagaatggttcataaaaaaaatggcataaaaaagtcgtatatatattatggatttttaaaaatcccgcggataggaactactatcaaagtaattcttatgattcaataattttattatattatttcatatttcaattaaagtttttggtttttttggctggattaatcttagcgattacttaattagaattacgtcctaagtcattggatgattgtatcattaactatttctttattttggtgtgaggaacttatcatgaatccactggtttctgctgcttcggttattgctgctgggttggctgttgggcttgcttctattggacctggagtcggtcaaggtacagctgcgggtcaagctgtcgaaggtatcgcgagacaacctgaggcagaaggaaaaatacgaggtactttattgcttagtttggcttttatggaagctttaacaatttatggcctggttgtagcattagcgcttttatttgcgaatccttttgtttaagcccagaaatcacaaaattctggattttttttgtagtttttttaattctatcaagatttaactcctacaattattcattgagacaacaatccttgggaaggactaatttgaggatggggaattagcacatcgattcgctttcttccttccccttattcttttagtttaatagaaacttttttttaaggagtgttgcgaaaaaagtaggtttaggttttttgaacttgacataaaacttggtctcaaattctagcttaattctaataagtctcattattattattgaaaattaaaaattttggaaaatacgtttgtaaatagaataggtttttgattctgtttacaaatatccaaataggtaaattaaattattaaattcaaatttctttttattttcaataaaaagaataaaaaaaaaaggacagagttccttttttatagtttagctagaagaggagattatatg

SEQ ID NO: 9919 - DNA, 3000 bp, Unknown
  misc_feature (1)..( 3000): cDNA_ID_3034735_gDNA_ID_2096292_Annot_ID_195420 3000 nt of promoter + ATG
tcttgactgtatcggcttacgttagccgtgatgaaactcaaggagtgaaaatgggattagcttttatggcattctttatttttgtgtaccttgtgcgacaatttatgctttgggttataagacatacgccagaaggagccccggtgaagaacgtctatctctacattggtctcttgcttgcttacttatcttatctttattggagccgcttcttattcttcggaccgctaggggcatttgctcttggtttggctgtccctaacgggccgccattaggatcagtatttatacaaaaattcgatagcttcaacgagggcatttttttacccctctttggatcacttagcatgatcaaactagattggtcatttctacgaaaggagtttggaaatggaaggcatctccatggacatatgtacgagtgtttttccttccttcccatcgtatacatagcgaaattcgctacttcgtttttagccgccttagctacaaagatacctttgagagactcaattatcctaggtgtcattatgggcaccaagagtagtttcgagttgggttacgtacttacagccttcgaaaaagacgtaagaatattttagctatactcatataacggatatgatgatcatcttaatttgtatatatatttctgttttaatgtttctcatttttaacagaggattagtctggaggtcttgtcgctcctgggcgtatacattctcgtaaactctttgttaacaccaatggctatacatttcctgtatgaccggtctaagagatttgtgtgttacggaagaagaaacttgaaagagaagccagaaatgcaaacgctggtgtgcatcaacaagcctgacaacataacatcgatgattagccttcttagagcaacttccccatctaaagactctccaatggaatgttgtgttcttcacctaatagagttattgggtcaagctactcccacgtttatctcccaccagcttcaaaaaccaaagcctggaagtcggtcttattccgaaaatgtcataagctctttccaactgtttcaagaggtttattgggactccgcttccataaacatgttcacgtctttaacttccgctaaagagatgcatgaacaaatatgttggtttgctcttagtcaaggttccaatcttattctcctctcgtttcaccgcacttgggagcctaacggaaatgtcattatctcagacgatcaaaccctaagaagtcttaatcttaatgttctgaaacgcgccccttgttctgtcggaatctttgtttatcgcaaaccaatttggcaaaccaaagccctagaatctccgtgccgtgtaagtaactacattcttttttttttgtttttttttgtttattctaaatgatgttgaatattttttattttcatacattaaatgcaggtgtgcttgatttacgtgggtgggaatgacgacaaagaggccctggcattagctgaccacatgagaggtaaccaacaagtgattctaacggtcttgcgtctgatccctacgtcttatgccgatgagagtagcttgaggattcatagccaaatggtagacatgaaccgtcatgaagaccaaaggcctggagataagtcaaccatcattgactggacggtgggagatggcacagagacatccaaaattttgcactccgtgtcttacgactatgatctattcatagtcggtcgaagaagtggggttggtactacagtcaccagaggactcggggattggatggaattcgaagaacttggagtcattggagatttgttagcatctgaatattttccttctagagcctccgtgttagtcgtccaacaacaagagtgagaagcatttatcctgaaattgagttagcttcaatcttggtttattttccttattgaaattaagatcctttacaaacaaagtgtaacggatcttataggaagcacacaatagatttttttgtgttgtaaggactacaaaacacatgttcatcattcatgtataggggagaaatacatatactaggtgatgagaaggtaaatcatcgatcccacaaattaacaggcggatttagtgaagaaatacagggtgcatgtgcaaccactaaattattgaaatatgtgttttattttaattctacactaagatttgtatcctaattggccaattaaacaagataaagattaaaagttgaggaactcgtaaacagcccttcacgcgcttaattttttaattttacggaaaacagcaatttcgcatggatttcggataggtggcgtctacgcgctcattgtgcgaatgagtaagatacttagatttcacagttcgataaccatacgcgtcacgtttgggctgacattatactgtctattgggctataacgatattttttccatatcatagacccacataaaataaaaaggcccaataacaaaaatttaaaactagggcacagtttagtgtatgagtatccattagtgatagcatttgatgtaatttataaaatattatatttacaataacctttgaaataatcatcacaattttgtccaaatttgaagttttcaaaaaaataaaatttgatcattgggatctattaaagatttggactaaccctaattagtaattacaggtagaaactctggataaaaaatcgtattctttcggcaaatccgaaccatcttaagatatcttagcccgcttcttcaggtggtcctaatttggcccaacataaaggagagagtggcgggtgagaaattctgccgccaatatattatcacctttcttcaaggttgcaaacttgcaacacctgtcctttctaaaaccctaatttcaaaatcgactgatgttagcgattcgatcgtcgaattacctccgatgcataccttctctctgtactaaaacccaaatctctcaattctcctccgtgttaatctcttttagccgccaaatttcccacttgcgtcttagctcgtgccatagagccatg

SEQ ID NO: 9920 - DNA, 3000 bp, Unknown
  misc_feature (1)..( 3000): cDNA_ID_3034913_gDNA_ID_2096292_Annot_ID_195443 3000 nt of promoter + ATG
gtacttggcaattgatcagatggagtggacgatctctattcatacacaaacctgaaatgtagaagttaaacagaaaatcaaaagtctaagagtgcttaattaaaagagctttatccttgttaagaaaaagaatggagctttatctttggtaaagaataaaagagccttatccaatatgtagaagataaataagatgattggatataagattaattggaccgatcacaagaaaatggaggtagattattaagaaaactatcgacttctctaggtagaaaaaaattgagcgagaagaaaattaaatgagagtttgtaatttagtccataaaataaaaatagaagaaagagagcagaaaaagaggaggaacccactagaatcactgactcctactccacaatctctctctctctctttgtaaccgcctgtttgtgcttattggctctttttcatcaaatctctttttgggcttattcacgtacacattttttcaataatctatcatcttttctgtagtattattcatcgtattcacgtacatgcctatatcaaaatacgtatctgtatatgtgaaagtaaagtggtgaaatttgcataaaagaattgggtttcactctatcatcttagcagcatggatcatgcatgaagttattttttctaagtagtctgtgtgttaatctaaaaccaaaagaaaactaacaggaaaattctagaattatatcaagaatctttgaatgggcatgatatatacagcatatactttatatttttgccaaaaaaaaaatgatatatatatctttagtctagtaaacaaatatatactataactaaatgatcgaatacaactccccagctatagtttaagctaaattatatatattatttggatgatctaatgagtttgttattggaatagtactagagatagtgatgaaataatgttaatacacataatcataaattcataatcaaagacaatgcattaatgtgggataaggaatgtttgttgatttgtgtatgtatattaaaatagcagaatcgagtgagtttctatttctaaactacaactctttttgttaaatgacctttgagacagagagagggataagaatagtatgaatataatacgtctacttatatgtaacacactatacataattacagatttttttttagtttcatcttcagtctataaccttttgaaagccgagagtgataatatgtgaaacagtttctgaaagttttttcttcttctcaaaaattaacagcttttaggctttaagtttcaaatttggatataatagaactagagcaactttctctagtcggttaacctaacatacttaagtattgaataattaactattttgcctctaccagttcaaccaaaaaagccttagaataatgacaattatgtagaccaataagataaaattaaacggccttcttgcattaatcgtaaataaatatagaaaatagcattaaaattatcaataattattgtaaacatctcaatcgagtgttatttaaattgattagtttggtattatcctataattttgttgatcggtcaacatccactccctgtcatcacctaaatcctaatgccacatttcagattcctttcctttattagaaattgttatatgcctcctttgattcgtatagctgttttagtcaatgcagctctcttgcaaatccacatttgtcatggctttattcctttagtttgtgtcataatgaccccctccgaattgagaatttatttttcacggctctttagatgctttttttgggttcggtagaagtatataactcacggttaagcttttatagaatctcaatattaatttgtccatcaaggcatcaaaataatgtttagattaccatctcagcccaataccggccataatcttatatggaggatgcatattattatgtagacatcaatgatcaatcactttgggacaactactcaagctcgttttctaacgaattgggatttttgaattacttactcaaaatagtgtagtcggttttggtctagcatgatctaaaaagtccaacaagccgagaggcccaaaaccctaatattcaaaacttcgtggcctaaatgtttcatcctgtgtaattttcttcaacaaccattatcttgggtgaaaattgtcaaatttgcatattttccattattgtcattgactttctgattcggtaacagtcatatgatgtaaaaatgggccacatccttatttggtttgcttcaggcccatattcgtttgggctgttagattgtagcaatggtacaaagatctgcaattgatgtaatttaaccttggttaatggtgtaattttattttattttgttggggtcaaactgaaagcctcaaaggataagagtttttttctgttttttttttttcacacttttttttgttttgttagaattcataaaagggtaatataaacttgttaaaaagaaatacagtagatacgtcatatatacagaaaaagtaagagagacagatgttatcaaataggggggagtaaaacccactctaatactacttgttatgcttaaatataaaaatgaataaaagacttggaaatcaaataaggaagtgagtgattcccacgtcgcaccttcctcctaacccttttcttcatcgccactcaatctttctctctgcaacatcctctcttgtaacgtgtaacttgccaaccttttcttttttattaacccaagttcgttgccggccattaccaattcctttatcccataatctcttctctgcttccttcttccatcacattccccaaaaagtctcaacacagagcgagaagaagactcaggttttgcgagaggagagatagagagacttagaaagctcggtaagtccgaactttggtggttcggcggctctacgtcgtctgtaggtcgagtcgtcctggagctcgcccgttgtttctcgacggcggaggtggaagacaacgaccgaccagcc

SEQ ID NO: 9921 - DNA, 3000 bp, Unknown
  misc_feature (1)..( 3000): cDNA_ID_2182941_gDNA_ID_2096292_Annot_ID_195441 3000 nt of promoter + ATG
tgttgaagaaaattacacaggatgaaacatttaggccacgaagttttgaatattagggttttgggcctctcggcttgttggactttttagatcatgctagaccaaaaccgactacactattttgagtaagtaattcaaaaatcccaattcgttagaaaacgagcttgagtagttgtcccaaagtgattgatcattgatgtctacataataatatgcatcctccatataagattatggccggtattgggctgagatggtaatctaaacattattttgatgccttgatggacaaattaatattgagattctataaaagcttaaccgtgagttatatacttctaccgaacccaaaaaaagcatctaaagagccgtgaaaaataaattctcaattcggagggggtcattatgacacaaactaaaggaataaagccatgacaaatgtggatttgcaagagagctgcattgactaaaacagctatacgaatcaaaggaggcatataacaatttctaataaaggaaaggaatctgaaatgtggcattaggatttaggtgatgacagggagtggatgttgaccgatcaacaaaattataggataataccaaactaatcaatttaaataacactcgattgagatgtttacaataattattgataattttaatgctattttctatatttatttacgattaatgcaagaaggccgtttaattttatcttattggtctacataattgtcattattctaaggcttttttggttgaactggtagaggcaaaatagttaattattcaatacttaagtatgttaggttaaccgactagagaaagttgctctagttctattatatccaaatttgaaacttaaagcctaaaagctgttaatttttgagaagaagaaaaaactttcagaaactgtttcacatattatcactctcggctttcaaaaggttatagactgaagatgaaactaaaaaaaaatctgtaattatgtatagtgtgttacatataagtagacgtattatattcatactattcttatccctctctctgtctcaaaggtcatttaacaaaaagagttgtagtttagaaatagaaactcactcgattctgctattttaatatacatacacaaatcaacaaacattccttatcccacattaatgcattgtctttgattatgaatttatgattatgtgtattaacattatttcatcactatctctagtactattccaataacaaactcattagatcatccaaataatatatataatttagcttaaactatagctggggagttgtattcgatcatttagttatagtatatatttgtttactagactaaagatatatatatcattttttttttggcaaaaatataaagtatatgctgtatatatcatgcccattcaaagattcttgatataattctagaattttcctgttagttttcttttggttttagattaacacacagactacttagaaaaaataacttcatgcatgatccatgctgctaagatgatagagtgaaacccaattcttttatgcaaatttcaccactttactttcacatatacagatacgtattttgatataggcatgtacgtgaatacgatgaataatactacagaaaagatgatagattattgaaaaaatgtgtacgtgaataagcccaaaaagagatttgatgaaaaagagccaataagcacaaacaggcggttacaaagagagagagagagattgtggagtaggagtcagtgattctagtgggttcctcctctttttctgctctctttcttctatttttattttatggactaaattacaaactctcatttaattttcttctcgctcaatttttttctacctagagaagtcgatagttttcttaataatctacctccattttcttgtgatcggtccaattaatcttatatccaatcatcttatttatcttctacatattggataaggctcttttattctttaccaaagataaagctccattctttttcttaacaaggataaagctcttttaattaagcactcttagacttttgattttctgtttaacttctacatttcaggtttgtgtatgaatagagatcgtccactccatctgatcaattgccaagtactagcttcacccttgacagctataaagttagtcaactaaattttcaattttctgtacaacttttttgaacccaatattattatttggaaaacaaaaaaaaatgcaacacataaatatagcctggagacaaagtctaggaaggacaagatcttcgtctgatttaccatgaaaaattatcaatatttctttattgttttcttcaataaaattttgaaatttagcaagtggaatttgtgtttactatggaaatagatagagaaaggtggtgaaaaggagagagtgatgatgaatcacaaaggtttcttcacatacaagtatagagagaatagtaataaagagagaaagagtaatgatactatacattagtcaattactaatactttattatcatttctctatccaactacaaatatatacacgcccacataattttgtatatgtatctcggaaagagaaaagattggaccctcttttgtttttctgttcagccataaaaaagcctttgacgagaaagcttccattctactttctctctctcctctttgttctcaaacaccaaaagcaaaacatcacaaaaggtaaacacatagatatcttactttcatgttcatatcatcaactagctttttcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatg

SEQ ID NO: 9922 - DNA, 3000 bp, Unknown
  misc_feature (1)..( 3000): cDNA_ID_2991145_gDNA_ID_2096292_Annot_ID_195438 3000 nt of promoter + ATG
catcatatacatatgcagcaaaattctcacaaaaagaagtgtatgatcaatagaaggaattaatttacatggtaatgtatgatcatacaattatataaacaattatttaactgtttttaaacatttatacacaaagtacaatacattacggaatacataataataatatacttctttttgtttaaaatatgttgttaattattttgttattaatgtgttgttgaataattaagatatatataaagttttgtttgctgcgatatgataagtttccctttgaggggaaaatgttattcttcaaaaacaaaatgaatttatcgaccgttttttgttttttgctagcttatatgggaaaataagtaaataaccataaatgaattaataccctatgataatggcaaaggtaaagttgatatagtgctaatgtttctttttcttggtaaataatacattgacatatagtaagaatggttaacacataatgcaagatttgtagctgatatgtagattatctaacaaatcatataggaaaaagatgatatttagagagaagacgtacctgcatgttattgtacctattgaatgttttgctgcaaatagagcaagcaaattgcattggaccgacatgaatctgagccggacttggtatccaaaacctcttcccacatacttccacatcagaatcaattatctcctcatcaaacttcatcttcctcctcttcttcatcatcaccacaccatcttctattatctctctcttgatgggtttcttctgatgatcgaaagttatatcagagccatcctccgagctaccacggtggtatttaggaaatccgatttggagggtaaccacatcatccttattctcttctttgatatccgaggcttgactattattttccatgagcttgtttagaagaggcaagcattgaatagacgtgttgagtggttcttgtggttggtacaagaatagagatcgttccaacatgttcatctgactctggtggtgatttgatcttgatatagcatctcttgtcttcccacgatataacacagatttagaagaagtagtagaagattgaggtttaagccattcaataaagcttggggattcgaaacttaagcctttcgtctcataagaattcatctctcgctttctctcctctctttcactctccctctctctctctctctctacctccacacgaagaagggtaagactagtagtatgaaaagtttatatattaatatcaacctacctggtgtgtatcgtagccgttcgtcaaaataggttctctctttatttttctccaatacaaaatcttcttctttaaagttttgttttcttttcctcctaccccccaaaacgtatagtgcagaaatgtcgcacgtgtctgtctacgcgtttacatcaagaggaaaagagtgaaattttcttcacaaaaatgtggtgggtcttacttcacatagtgaaaaggaaacgcacaagcgcaaggcttttcaatgaaagagaatcctaagaatcatagtctttttttttttcttctttaccctcatttcctttcccattattaaaattttgtaacatcttaaaccaacaaatacgatatcctttcatcatattatagtcatgattgtcatttaagtgcatatagaccggcgaagacaaaattcatcattacatatcaaaacaacaattccaacatcattttagccgtctttttagggacaaatgataaaaaaaggtaaattgttataaaatcacgcgttcacttttattgacgttggatgatccaagtagcagattacacgatattgatgatacatacactgtttttcatacgcaagacttttctagctagtactctaatccatgatttgcactttatttaaagatatatgaaaatatttattagctttggaaatgagttcactgatattctttgatgcatgattgggttcacgggtctatagttgatatggcagcccacacacgtatatgtttgcaaatggtactatagaaaactgaatccaaaaagtgtgaaactactttggttgtatttcattcccgttttaaatctgtcgaagctatattcattcagaagtaataaagcttaacattaatccaaaaagcagtcgcattagacattcccatcctcacggtagcgttagaaagactggaatggagcacaacaagcagatgagatgacctacacgaaggagtacgttgacccaaaaactgtaatgaatttacgttaatttttgtgttatagacgaggttttaggacgttgtaagattttgaatacaaagaggtagtggagttttgacccattaagcacaagatttttcttagaaaacaaaaaggttaccgcaagtaagtcaatacctgaagaataaaatacttgaaagaaaaacctaagaagagtgagtattcattttaagacgaaaatagaagctgattcaatgtatgtgtcatgttgtggtggaccctaaaacaatattaaccgcgcaaaatttccgaatggtagtatagctaaccgttgaaccgtatgctactatgctttcattcactaaagaattatggtttacgtcccatgcggttcaaacacggtatatacatatctggtcatattttgtgaaaccgggtttgaacaactcaccaatacaatagtactacaattcaaattaaatttttctttttgtaattaaacttcattttggtataattaaagaaaaaaaatgtttccttttgttgaccgatacaatgactgtatattcaaaaaattacttttagacatccaaattatattttcatctatcaattacaatattatgaaaattatatatttacagatgctaaatcaaaaacggtacgtttcaccttaaaccctaaccctccgaatgagctagagagacaccagcccttctattaaaagttaaaacccttccctctttacttctccgatagctttttattttcctcgtttttgcgccgacca

SEQ ID NO: 9923 - DNA, 3000 bp, Unknown
  misc_feature (1)..( 3000): cDNA_ID_3034706_gDNA_ID_2096292_Annot_ID_195434 3000 nt of promoter + ATG
caattgttattaagtaacgtccttccaaacccgttctgccaaacccgtcctgtaaaaaaaaaccgcggtaccccgctagttgaaatttataattaaaataaatattttatggattgcgattgtgttttagtttgtcaaacaaaattttgttttaaatagttgtcgaaatctagttcaaattttggagaaataagatttagtgaattgataagaaatgtatttagttgcgtttgctcattttaagggattgcaattgtcttttgggttgtcaaacattttttgttttaaatagttgctgaaatctagttcaaattttggaaaaatctgcgtgatatatgggattgaaatatatttggaatgtttttcgtttgttaatcaatttattgctgaaaaaactaataattaaaagccagtgacagccattgtaaataagtttcaactccaggatttatttcacaaaatggatgcaaaaatatatatatagattatatctatatatatgtattttaaaatctttctcactttaacctcaacatccaaagtttatatgtatatatagtttatttgctcgatatgcaaaagcgtctgtagtccaacggttaggataattgccttccaagcaatagacccgggttcgactcccggcagacgcatttatattttttaacaatcttttctgaaaatttgaaaagacaacattttgcatacaccaaacatatgtacatatgttgtgttcttgttggactcgatggtttatcaaccccaggtccaataggacaacacgaaattatcatacaaaccacaatgattgattgtccccaaacccttatttctgttaccaactccaccatattgtcacaacttttcccctgttatcaaaacttccaaatcaatgttctatgaattttagtttaaatttttaccaattgtttattgatttatacgaattcaatcaaatgtaaaacaccaaacagaatggatcagtaaatataaaactttgttatcttctccaaaatttacattttcatgtgtgtatagactatagtatggttacgatgaagttgatgatgttggtgaccaaggagtcatatccatgggataactcccaagcacccgcaagaacgatgtaaactcctgaacctcggcaagcgcgttctgagcacgcgcctccgccatcgaggcctcgaagtcaacataaaacatgtactcaaaatgcttcgccgtcccgacattggcatcatccacgaccctgatcggacggttgtgattcggcctcgattcgatcttcgtcaagctaatgtctctgaaggcgaaagcagagagcaccttgaaaagcacgctggttcctttctcgtgcgcaaagacaatgctagtcttgaacggtctatctgttctaggtatgattggctcacgcgccagcatcacgaagcgcgtcacgttactcacgtcgtcctgaatcccatcttccaaaatctccaacccgtatatctcggcggcgcgtgcactcgcgatagcggctgtgtcgcggaggttgttagaggcgatgaactcagcggctcctgcggtgtcatcaactgcctcacgtgcgacattaagtccgagctttgtgagcgtgtgctcacactgagcgagaccttgagggtgtgagatcacacgtgtgagaaactctttacgaacgccgggaagagccagtaaacagtgatgaacagggagttgaacttcgccgactatatgaagacggtgacggaggaggagatcgtaattacggtggatagaaccgccgagagagttctccaccggtaaaacagcacgatctgcgatccaaagctccaccgcttgaaacgcaacctcaaattgatcgcaaggtatagcttgacaattaggataagctttaccagcggctgcttcagagtaagcaccgggaacaccttgataagcgacgcgtagattagatccgtgcatcggagccggcgagagatccgtcatgctaaggggtttcagtggattatgacgatgctgtggaaccaacggattgctatcagatttctcaatcggaacaagattcattcctggaactcgtgcggcggcgctgttatggccgttgagatgatcaactccgccggaaactggaggcacaggtaaggattcagattcttcttgagaaataaccttgcttgttagaatagcgcaggagctctgccattcagaacgaccagatcgcgcgataagcgcagtcgccgtcgccggctggctagcacctaatattggagaagaagatgatagagctttcatgttttagcaatggcgtcttaaaattggttattcaagctcaatgaaatagcaaagtcgagaatgtagaaaaacatgttttcctggggtagttcgtttgtgtggtcacttctccacctaccacaaccaccttacaagtcacagtcgtatggaccataccggcatttaactgaaaattaattcgacccgatccggtttaagttatttggtttcataaaccgattttctccataccccaattgagatatgagagtgtttaagactttaccggaggtgattcgagttcaaggagacagtctacacttgtgacttgtgagtcggagcttgagaacacctacagctacaagaaggaagtttgttttcgcctcgagctagaaatcctaatttgtcatcatcgtctcgaatggaaaggctgtgttcgaaatccaaaatgcaaatgcgataaagatgggcttttagataggcccaattagagtccaaaaatgaggggcttatcagtgatttggttgccaataccaaaagcgcgggaaaatgataaaagatttttttttcctctctactctttcactcactttctccggcatccacgaagccctaccagtaaaagcccttttgttgaccctaaattctccttcaaagcttctccaggaataaagctcctctctatataggaatctctctctgtcccgcgtaatttataatcgccgcaaa

SEQ ID NO: 9924 - DNA, 3000 bp, Unknown
  misc_feature (1)..( 3000): cDNA_ID_2182888_gDNA_ID_2096292_Annot_ID_195423 3000 nt of promoter + ATG
tcccgcttccaagagtgaaggcactttgaagaaaacagataaggttgagaagaagcaggagaataagaagaagaagaaaaagaagaagagagacgatttggcgggagatgagtataggagatatgtgtataaggtgatgaagcaagtgcatccggatttaggtataacgtcgaaggcgatgacggtggtgaacatgttcatgggagatatgttcgagaggatagcgcaggaggcagcgaggttaagcgattatacaaagcggaggacgttgtcttcgagggagatcgaagcagcggttaggttggttctgcctggtgaacttagccgccacgctgtcgctgaaggctctaaagctgttagtaacttcgttggttatgatagtaggaaacgttagttggttttgattccctaatcgttgtatcttttttcgtgtaatgtttttttcaacttgactgttagtgtaaggtttaacttagagagtatggtttctatagttgtatttcgttttatgttacatgttctgtagaatatatgttatgttgttgaaaatggagatggacttgatcatttgaatcgtggtttatttagctttcatattttgttctcttacatttgttgtgtcgttaaaattagtgacatccactaaagtaatttgatcttgtgtgtgtttgtagaaacagagccattgacaagtgatgcagaataagggaaaagataatgggaactatggaaaaggtaaaagtaaaaagtactcactacatgctgagcattgaagttggtcgccgcatatcccttgaaagatcctttctccttgaccttctccaccccaacctctacatatattgatacacatacatgagaacgtgtctgagtatatatgtgtttttgtaccataaaaacacacaaccaactcagaatgcataacaacaatatatgcataagcagcaccaccaaaaggaatataccataagttattcgatatgtagaaatatatcccccccccccccccaaaaaaggtgaaaaataaaaattgatcccacttcaactgtatcaacttatactaattacaaaggcatactttattatacaaaaaagcatgtatcatcactttgcaataactttttaaagtttcactagtgtcacatgcattttctataaaactatcttcttgtacctttcacaactaatgaattatgatcgccatctctcacccggtgccggtagcatggctaataataagagcaaagtcgagccaaaaactcacgaagaagatcttcgggttagtcgtttaatgatgattattatcattattttgtttacctctattcttctaataattatgactactcttctgatcttgtcctgaaccagtctaagggatcaccgacacctactataggctataataagaagagtcgatgaacatgtttggaagagaaaagagatcaagattttgaccgacttgaaaacgtaagtgtggtcaacggcaaccacaatggataatagtcgaacatcatgtgtctttctctttgaccgggcaacttcggaacctttggcaatgtttctctctatttttaggttttgttattgttgatctttctataatctatttgtagtaggtcttgttgttatttcgattgaacggaacattatcctcgtttacactaatgttttttttttacgagctgagcaacacatatatttgctctgcataagaaaaagctttaaactcgatcaaacgcactcttgacggaaggtgaaaacacagcacagaagaacaccaaagttctttgttttggttataattttatctgcttgatcacgtttcttgttacatgaacacaattgagaaaagaaagagaaagaagctcccactttgctctgttctgctttctccgcttcttaacggctctgttaagtgttaacgaaacagatataaaagtgggcctgggcccaaatatattaagtccctctttcggtcttaaactgggtctgggcccaactgttaacagaagtgaactggttttgatacgctgtcgttctgactgttctaaaaccgaaaacagagttaataagtcataattttccttctttttttttatacggatgtgaatttatttctgcagaagaaagttgtaacttacaaaattgtctttgattggccaaaaaaatagagcaggggaacatatttctgcagaaaaaatgttatttgtttttttcccttaagttcacaacattttttctgactatctttttttcctttgcacatttcgggaaaggaataaaggcttccgacaaagcaaaggagcataattaaataactaatcataacaatgttagttaaagacttaaaagtaaaatggaaatggaaatttatctctctattcaagaaaaacttttaggcttttagctgaatgtactgatgagtgacgcctacaatctcacacaattctttgttccttcatctataaatgaaactgtagtaccttcatgtgaattagaatgttgatttttgttattaactaaattgaaaccatacatacaccacacgaagtctccttttctttattttgctgtgtgttaatgaaaatgtaatatttacatgtaaatgcagttgttgatgttagatataaatatgcgtacgacaaaatttacagacgaatcggatagagaaaacataaatgttatcaacacccaagttgtagtgttgtacaacgttacaaaaagaagcaaagaattaaaaccaaaaaaaaaaaaaaaaaaagtaggaatcttccagcttccaagatttcttgattcattcacaagcaatgctaaagaattaagaattttaaatcagtagttttgtgactaatccttatacaaaggcaaagaatctaattgtccgtgttagtccctttatatatatcgtcgaaccatatcaaagcaatcaaatcaatctttgctctctatcctttccaagcaattaactgaagtccatcaaaaccttctctgacaatg

SEQ ID NO: 9925 - DNA, 3000 bp, Unknown
  misc_feature (1)..( 3000): cDNA_ID_3034723_gDNA_ID_2096292_Annot_ID_195427 3000 nt of promoter + ATG
atttattaaaataggtatataaaagtgatcgaaaattatgtgtaaatcaagtaaagaaagaagagtatatctacagaatcaaatttgattcaggcactattactccttcgtttcttacggacatggtttggttcgtgaacaaataaagtctctacctcttggctcccgacgtcggtggcttcaaagaaccgaagatctttggacaatcttgtcttctttgtgagagaaatctcacgcggtcgctttcttggcggcggaggacacgtctccacctccggaatcttgtgatcacttgaagttggagtacacagagattctaacaactcttctttcttcgagctatcttgatgatcttcttcttcttggcttctgggtttctgctctactgtcttttcttcttctagggtctcgagaagcttagacatggtcacatggatgtgaaagtttcgtgggcttttaccttccaaaggaaagaatattaatttgaaagtgaaattggaatatagaaagtgatatcatataggtagagagagagagagagagaaaaaagaaggggattaaagagtttgtattttgcgaaaatgtacatgtatgaattaatcttgaatattcggatattcaatgctttttgtgcaacttaattgtcttgggaattagaagtgaaacttttcaactgcccctatgtccaaacctatagaaatactatgccggagtcaattagttagttagattcatttgtgtttactgtttaacgtaattaatttgaatataagtttggttaattacccttgttacctattaaaacttgaatgttaacggagaagcttatccaaattaatgtctcatgtgtcacatcattcttcgattgtatgtctaaatacgtacaaatggttggcataggataccatttcatcaacttaaaaataatattttcatttcataattgatgtccactttccgactcgcccctttggaattattcgctccttcgcagcctactatataaaccaatcagataccgccatgtcatcctccactgatttgtgttcgagaattgctcatgttactgtagtcttttctccatgaacaaaattacttacaacttacaaggctaaatgatgtttgataggtttaacattttaattactctgtgctctatataagtccacaatttgaataatcaaactgaaacctgtattttaagtttgtccccccattgaagtaagtatatggttatgttggcatttagtgtttgcatcgaatggtcgtttatgtcaatgaaagacgtcccgtcgctgccattgaacgtacgtaataagcattaaatcttaacagtgtgatgcaaaatttctcttatagctcatcatcctcttttttttttcttaagaatttgttgcatgtgaagatatttggtcactagagtatcgtttctatagatgttcaagacagtagtagttggaaggccgtattgaaaacagtctgagatggtagaaagaaaatcttattttacattgatctaatatatgaagactcttctgatgatgcatatatatatttccaacttcgtttgcgctttattcctacggattgtcaaacttttaagagaaatatgttgtccttttaggttgttattggtcatcagggagatgtaggggccatgactgtacattctttttggcctatcaaaactcgattctcttttttaactcattggattcgtgctgatcatgctctttgagaatgtattcttatagtcaaattcaaaactgttgtagttaacatttgttaaacaattaatggctttaaagtcatacttttgatacctactaaaataaaacgttattaattatgttgcaaatggttagaaggtgtaagatatacaatgcaatttggttaggattccagaaaaggctaaagaacagtgacactactagcaaaagtgaaaaaaaaaacatggccatatttatgtatacaaagtctacgcttaagaggaaaatgaaggcaacagtaaaatagtgaagaaaatgacaatcttataactaagaagatagagacatataaccccatttagtaaagaggaaagttgtaatgagaatggaaaaaataaaacctagagactcagttaatgggttgaaatttcaggctaaaatatgtttcgtcttcttgtacgactacatataacacacataacaaaactaaaactcgtaaggtgtatgtgtgaaactagttgtgtatatacataagaacaaatggtgaaaaccagtagttagggatagatctctgtccaaacatattcttgatcgatcttagatcaatcatgcactcatagagatctacttcgtttgtttgtttattagactcattatctctatgagtgattgagtattatatgaatccgtttctaaacaaagatgccgaaggagttgatgttggggtctgatcgcgccagaaaacttaggtttttctctctgtgtttgaaccaaaagtcgtggtaactctgtctcaaagaatctaataaatctctaattagaccgtttgtaagtaaaagaaaaaaagcttcaagttcaatgaaaaataaagataatgattgggacttttaggtttgtttgtgcttctttaattattttctaacaaccttttatagaaaaaaaactctagactagtgaaaattcggagagtttcatgttgctgcgactacaccacgtctctatctaaacagaaaagggtcaggtaaaggagattaatgtaacaatcgcacacgtggcacctttttctttgtcgccttccaaatcattaattaaatttccatttatttattttctctgctgtcatcaccaataattttaatttaatttttaccaaaaccagaatcaaaattttgaacggagaagaagattgaattcagaaaggaagaggcagatctgttattctctgttgaagtctgattgatctgatcggagctattgcggaggaggggtttactgcaattgcacggtggta

SEQ ID NO: 9926 - DNA, 3000 bp, Unknown
  misc_feature (1)..( 3000): cDNA_ID_3034719_gDNA_ID_2096292_Annot_ID_195428 3000 nt of promoter + ATG
tactcaaatttccagacagaatcaggctgttctcccaacaatctctgttcctattcgtttaagtacggtgatggaagtggcacttctggttactacatctcagatttcatgtcctttgatactgttattaccagtaccttggctataaattcctctgctccctttgtttttgggtaagctaacagcaaagaattgtgtatttacgtggggtttatatatatgtacatatcccataggttttatcttgcatttggaatcccctttcgataatgatgatttctttagtatggtgcattgccttctctaaatttaactaatgactgcatcttcgggggggagaaaatgttggccaaatgagaaacaatatttctgcctatcaaatacactcattagttttatgtttaagtaattaacatctaccaggaagtacaatatgatctaacttccaaatcatcttttctgtactgtttcaactttcaaaatatgtgatgcttgtcttcaatattgctaacaggtgtagcaatttacaatctggagatttacagaggcctagaagagcagtagatggcatctttgggttaggacaagggagtttatcagtaatttctcagcttgctgtgcaaggactcgcgccacgagtattctcgcattgtctgaagggagataaaagcggtggaggtataatggttctaggtcaaatcaagaggccagataccgtctatactcctcttgttccatcacagtgagttctcaatctttctattatacatttaaactcttatcatattacgtaaagagaagcacaggtagattttggggtacttaacatcatgatgaatcagacttcaatgttagggtaggattcctagatttatttttgtataagacaaggaggtagatccagggtttaactgatgattatgaaagtcatttacacagatataaatgcgagagttgttacaatatctgctatatcattctgcttgtaggaatcatatgatccagaaatagacattttgtagctgactctatggaaataatatgcagttcgtatatcttgggttaggaaaatcaaaatatataaacccacgtcttgattcagataatatgctgcaaaaaaatatttcaggccacattataatgtgaacctgcagagcattgctgtgaacggtcagatattaccgattgatccatctgttttcacaatagccactggtgatggaacgataattgatacgggaacgactcttgcttatcttcccgacgaagcttatagtccattcatccaagctgtgagtgtttttttcttcctcagttcaccttcagctttttcagtcaccaaaccgtgtataccatattcagtagtttttgccattgttgaaagtatctgtcctcaaatgttacatttttggaatgaaattacaattcgatgtagacgatatatgttattagaccttacaaaaaagaagatttataaaacgttcaacctgcaggttgcaaatgctgtttcgcagtacgggcgtcccattacctatgagagttaccaatgctttgaaatcacagctgggtaaagttcttctcatgtgtatgtatatataagaagctattatctcctatgcttaagtgctaaaaagatctccatgttgcagtgacgttgatgtctttccccaagttagtttgagctttgctggtggtgcatcaatggtcttaggaccccgtgcatatcttcagattttttctagtgtaagcatattcatacacttacactacttcataaattgtcttttagtgtgtcaatgataagctttgaaaaagtttagctgctcaactcttagctatacgtctactatatctagcctaagactgtatctagcagattagaggtgttaggggtttgtaagcgagccgttagtgagggctgggacgttgggtttataaggatgtctcaacagattgttttgggtgtggatttctcttaaggtttacagtttgaaaaatttgatatgataatttttcttttgctatttcagtcaggaagttcaatatggtgcattggtttccagagaatgtctcatcgtcgtataacaattcttggtggtaactactcttgtttgttaactcaatcaagtgaaactgtaacagtgcagctatttttctcaatgagtgattgctttgcagatttggttcttaaagacaaagtggtggtctacgatctagttcgccaacgtattggatgggcagaatacgactgtgagtgtgttatctattttaccacagagcaataacgaaattggaatacaaatgcagataatgaaattccattccaggttctctggaggtgaatgtttcagcatcaagaggaggacgaagcaaagacgttataaacacaggacaatggagagaaagcggttcggagagttttaatagaagttattacttgttacaactagtagtcttccttgtccacctttttgctcgtttcttgtagtagcttttagcattcactccaccaattatggttggactttgtaagcttatattattgtaatttaatcacactaattaattcttacttacccacccaccacttctctcgtttctctgtttaatcaacctcctatctaccactaaggccaccgacgaattagcacaattttacatgtcggtgtaaagcaacaaacatacccaaaaaaaaattgaaactatatactgtagttgtaatctactagttttaaaatagatttcacgtgaacaatcagcagattcataataattgacttaagagagaatatgacacgtaacgaaaacattaatttcacgtggtgggagtaatgtgcaaggctgtgagagtgtagggaacattattatacgcctttaaatatccatctctcatttctttctttcttttctcccattctcacaaatctctcttccacccattgttatctctgtagaagcgtgagagagatcacgcgtgttcaccgacacaatcaaaatatg

SEQ ID NO: 9927 - DNA, 3000 bp, Unknown
  misc_feature (1)..( 3000): cDNA_ID_3034710_gDNA_ID_2096292_Annot_ID_195432 3000 nt of promoter + ATG
tcctcctccgtcaccgtcttcatatagtcggcgaagttcaactccctgttcatcactgtttactggctcttcccggcgttcgtaaagagtttctcacacgtgtgatctcacaccctcaaggtctcgctcagtgtgagcacacgctcacaaagctcggacttaatgtcgcacgtgaggcagttgatgacaccgcaggagccgctgagttcatcgcctctaacaacctccgcgacacagccgctatcgcgagtgcacgcgccgccgagatatacgggttggagattttggaagatgggattcaggacgacgtgagtaacgtgacgcgcttcgtgatgctggcgcgtgagccaatcatacctagaacagatagaccgttcaagactagcattgtctttgcgcacgagaaaggaaccagcgtgcttttcaaggtgctctctgctttcgccttcagagacattagcttgacgaagatcgaatcgaggccgaatcacaaccgtccgatcagggtcgtggatgatgccaatgtcgggacggcgaagcattttgagtacatgttttatgttgacttcgaggcctcgatggcggaggcgcgtgctcagaacgcgcttgccgaggttcaggagtttacatcgttcttgcgggtgcttgggagttatcccatggatatgactccttggtcaccaacatcatcaacttcatcgtaaccatactatagtctatacacacatgaaaatgtaaattttggagaagataacaaagttttatatttactgatccattctgtttggtgttttacatttgattgaattcgtataaatcaataaacaattggtaaaaatttaaactaaaattcatagaacattgatttggaagttttgataacaggggaaaagttgtgacaatatggtggagttggtaacagaaataagggtttggggacaatcaatcattgtggtttgtatgataatttcgtgttgtcctattggacctggggttgataaaccatcgagtccaacaagaacacaacatatgtacatatgtttggtgtatgcaaaatgttgtcttttcaaattttcagaaaagattgttaaaaaatataaatgcgtctgccgggagtcgaacccgggtctattgcttggaaggcaattatcctaaccgttggactacagacgcttttgcatatcgagcaaataaactatatatacatataaactttggatgttgaggttaaagtgagaaagattttaaaatacatatatatagatataatctatatatatatttttgcatccattttgtgaaataaatcctggagttgaaacttatttacaatggctgtcactggcttttaattattagttttttcagcaataaattgattaacaaacgaaaaacattccaaatatatttcaatcccatatatcacgcagatttttccaaaatttgaactagatttcagcaactatttaaaacaaaaaatgtttgacaacccaaaagacaattgcaatcccttaaaatgagcaaacgcaactaaatacatttcttatcaattcactaaatcttatttctccaaaatttgaactagatttcgacaactatttaaaacaaaattttgtttgacaaactaaaacacaatcgcaatccataaaatatttattttaattataaatttcaactagcggggtaccgcggtttttttttacaggacgggtttggcagaacgggtttggaaggacgttacttaataacaattgtaaactataaaataaaaatattttatagatagagataatttgcaaaattttatatatactagtttaaataaaaaaaattatctccgcggtgtaccgcgggttaaaatctagtctatatatacatttttgcaactattttgtgaaataaatcttgtagttgagaattatttacaatgattgccactggattttaatatttgtttttgataattagaaaaaaaatcttcgaattaaatatttgacatttaataaatttttttaaaatctctttacattaactacacgattggttactaaaataaaactttcaaaatatttaatatcatttaattactacaaaattatcattattgatattgtttttcttcatgactattacaattcaattataatcatcaaaccgcagagatatttgataacatttaattactacaaaattacaaaatatttagacaatgattcataaacatatgataaagaagatcaacattaataaaataaatgagctttttttacgggatgggttggcgggacgagtttggcaggacgagtttggcaggacgagtttggcaggacgagtttggcaggacgttacttaataacaattctaaactataaaataaaaatattttatagatagttacatagattgttacaaattacaaacttttatatatactaattttaaaatataaattgtccctacggtatatcgcgggtgaaaatctagtattattattattaaccgaaagaaatttctttcaattttaaaaattctgtcagttataatgaaaatgtaaaactgtaataaggatttaatatacatattaacatgttatattgatatgttattactattatccaatttgctttttctattactgtttgttggatgtattgaaaatttaagattgtctccaaaatcgattattttgaaattatatataaaaaataagatttaagagatttgtttccaaaatattttgaattctccatttattttcatattctatcatatattttttaaagaaaataatcaagatatacacattttataacttcataaatcgtttgacacagaagagaatcgataaactataaatctgcaatgtttaatattattacgaaatgcttttaggtaaaagatgatatgatagcaagtgtgttttttggacttataaaagtgagtagcacctagtggggggagagagagagaaagagaaacaaagagagcgataaagagatg

SEQ ID NO: 9928 - DNA, 3000 bp, Unknown
  misc_feature (1)..( 3000): cDNA_ID_2182911_gDNA_ID_2096292_Annot_ID_195431 3000 nt of promoter + ATG
attctttttctttttacatttgctctttcctataatcaaagctgcgacaaatttaccttaagagaatttcattcaagattgagatgtatagttgtacgtagacatacgtgtctatatgaacttctatacgtaataattgacacacggccggtaccactccaataatttcatccacgcaataaaggaaggtacatgtcctacgtaataatttgtttgaacaaaaaaaaaagttaatttttgtgtgaaaacgcgagatggaatacttataatcacgtttgctattacgaacaacggaattttataagaaaccaagtaaacattggtatgagctcaacttttgttcgtggttggttaatatcacaatatatgtattgtgtaaacctatgatttttaaaaaaatacttttctatactgtttggtcttgtttcgaattataagaagaaaaaaaactaatcatatggaattcatattatagtgaattttttgatatggcttgcttcggttcaattttgttgggatccggatcgaagtgttgaccattccacatttccactcataccactgttaagtttcaactttttcatgcgttagatagctgtctctttccgtgtcttgtttcatttttgatgcagaaatttgtctttcaaaactaatttcaatttttaaaaatatgtgcgtgtcagaagagtattcataaaacgttggtgccgaccaaaatttaatcttatataagtaaagttggataggttcgatctgctttcaaaagtagaatattctaaatttcagatcctacataggattcgatccaaattaggatagttacgctttgactgtcgactaccaaggaaatccacatgtcaacaaaacttttaagacaaaatttaacgtatttatctatgcaaaaactacaaaatgatgagaaaaaattgattgaaattttttatcttactggataattctgttttagtagctaatatgaaactaaatccattatgcatcgaatcatcgatttggattttagttttcattagagtacaccgctaatctgaaggatttataggaattcgatttagcccactttttcgggactgtatacaactttaattaggataaggtaaagtataatacaggttccgaatgtttgattagttaagatcagtttggttttcctcttaacaattattggggtgtgtttgataaggtccgaaatggggaaggtactacgttggaccaatacaaatggcggtgtgctatggtgtggttattgccaatgcgctcttgggagggcaatgcctaaaggcaatgtacttggtagtgcagccaaatggggaaatgaaactctttgagtttgtgattatttttggatgcttacttttggttttggcacaattcccatcctttcactctctacgatacatcaactcactgtctctcctcctctgcctcctctacagtgcttctgccgctgctgcatccatctacattggtactcttctttactaaaccactttactcttaattcttaaaccttttatattgttacatttaaaaggtgagttttctgttaaatatcaggaaaagaaccaaatgcaccagagaaggactatactatagttggtgatccagaaactagagtgtttggaatctttaatgctatggctattattgctactacatacggcaatggcattatacctgaaattcaggtttcattttgtttccattctttgtttagaacaccactttaatatttattcatcaaaaacaaaagggcagtcacatgatcgactcagttatatatatagagtatttgatatatgaatactatcttcttgcaacgcaggcaacaatatcggcaccagtgaaaggaaaaatgatgaaagggttgtgtatgtgttaccttgtagtaataatgacatttttcacagtagccatcacaggatattgggcattcggtaaaaaagccaatggacttatcttcaccaatttcttaaatgccgagacaaaccattactttgtccctacttggtttatttttctcgtcaatctcttcactgtccttcaactttcggccgttgctgtggtaaatacaatttttttttaacgtttttctttcacatatatacattgttattattttattttattttcgtcacatatatacattgttactaattttgagttatgcaggtatacctacaacctataaacgatattttggaaagtgtgatcagcgatccaacaaagaaagaattctctatccgcaatgtcatccctcgactagttgtgcgttccctcttcgtcgtgatggctacaatcgttgcggcaatgcttccattttttggagatgtaaactccttgttaggcgctttcggttttatacctctagacttcgttcttcctgtagttttcttcaactttactttcaagccgtctaaaaaaagtttcattttttggatcaacactgtgatcgccgtggttttttcgtgtttaggggtgattgctatggtagcggcggttagacagattataatagatgccaatacgtataagttgtttgcggatgtataaaagaacatgcaaagcaaagtgagattgttatttctatatttaagaataagcctttttttttcttagaaaaatgtttatgattataaatttggaaaataatattcaaattttgataacaatatttttacataatttaaattaattaattttgaatgaaataaatacagatgaaataaatatctagaaaattgataaatcacagtacaggcctggaatatgagcatttgaaacccaacgcaaaacaattcctagaaacggaagcccaaaagttgggggctataattaaaccggatttaaaaaatcggtttgattggttacccacacaaaaatctggttcaggattttagactcgttttcaatttcaagcgtgtttggttcgccggcagagagacataaccaaacaaatagggtttaagctctactaaaatg

SEQ ID NO: 9929 - DNA, 3000 bp, Unknown
  misc_feature (1)..( 3000): cDNA_ID_3034727_gDNA_ID_2096292_Annot_ID_195422 3000 nt of promoter + ATG
gtggttactactttttgaaggaaattcacatgtttccggctgttggacccttccttttgggtttgtgtgtgcctcacggtcctcctctagggtctcaactggtagaaaagtttgaaagctttaacactggaatccttttgccacttttcttgttcttctcaatgctgcaaatcgatggaccttggttagctaaccagatcggtcaactaaggcattttgacggtcagttgtatgaagccttgaccatcatcatcgttgtctttgtcgccaagattatcttctcaatgattcctgcattgctagccaaaatgcctctgaccgactctttcgttatggcactcatcctcagcaacaaaggaattgttgagctgtgttattttctgtatggagttgaaagcaatgtgagttcccatatttaactttatattcaagacaattcaactctccaacacttaatgtttttttttttctttctgtcttataagattattttgttgtgttacaggttcttcatgtgaagtccttcacgattatggcaacgatgattttagtgagctctacgatatcaccagtgttgatacattacctatatgattcgtcaaaacgattcattagtttccagaagcggaatctaatgagcttgaagcttggatcagagctgaagtttctagtgtgcattcacaaagcagaccacatctcagggatgatcaaccttctagcacagtcttttcctctacatgaatccacaataagttgctacgtgattcacctcgtcgagcttgtgggtttagacaatccagtctttatctcccaccaaatgcaaaaagccgaacctggaaaccggtcttattcaaacaacgtcctaatcgcttttgataacttcaaacattactggaaatcgatatcgctggaattgttcacatgcatctcaaaccctaggtacatgcatcaagagatttactcgctcgctctcgacaaacaagcttcttttctcatgctccctttccacattatatggtcccttgaccagacaacggtggtctcagacgatgtcatgcgtaggaacgctaacttaaatgtcttgagacaagcaccttgctccgtggggatctttgtccatcgtcaaaagcttttatctgcgcaaaagagcagtccgtcttttgaggtaacacatatttgaaggtttgattgttccatacgctaatcattagtttccgtgcttgaatttgtgtttacgtgtgaaacttgatttgtctaaaaccaggtctgcgcaattttcgtgggcgggaaagacgacagagaagccttggcattgggaaggcaaatgatgaggaatccgaatgtgaacctgacagtgttgaagctaatcccagcgaaaatggatgggatgactacagggtgggatcagatgctggactcggcagaggttaaggaggttctgaggaacaataacaatactgttggacaacatagttttgtggaatacgtagaggagacagttaacgacggttccgacacatcaacactccttctctcgattgctaattcttttgatttattcgtggtggggaggagcgccggagtagggaccgacgtggtgagtgcattgagtgagtggacggagtttgatgagttaggtgtgattggagatctgttggtgtctcaagattttccccgtagagggtcggtgttggtggtgcaacaacaacagaatgtagcttgtagatgatattacattggcaactactctttattcatttataagatacaaaaaatagaaatacacttctcacacgagacacatttgtagccccaaatttttaagtgacagttcgtctccgtggccttgtgatgataacatttgcaaatatgactttaaatttaattgattccacataattttttaaaaacaatgaaatcagaaaaaaatagtacatgttttataattaaattaacattcaatgtgagagttacatctatttacatgttttacaagttttaatctccttttcgctatacaataaagaaaaacggcaaaaataagcaaactagacaaataaattacatagcaaattagtatatagtcttaaaagacctacttgccaccaatttgatcattaaaaatgatgagaatttcacgcacgtagtatacattcaatgaaattacccaattaaaacctttagaggaatctattaccaaccaataggaattgagttcaaaatggtttgtaggtgatttacacttgttctcatttctttatagtcttaagaccacaaatacgactagccaatgaatatttaatgcctaactacttggaagaatcttaatcctgtgattatgctttacgtatacgtagggttcaagcattaattagtaattttgaatttggagaaattttataagagagtaatttggtatcctgacctaggtacaatattctttagtttatattgttatttatcttaccctgccttgattagtaagactcttttagtatccattttcctttgctatattatttggtttaatttgcatgcttagctgtttgaatgacttaatttgtatggtgattttaaagtataagttcctatttcaccaaacatagaaaaaattgtcaaaacaaaaatatatatatccctgagaaagtgtgcaagtggatgcaaaattccctaaatatatatcgttatatgtatagctttggcgttgttgattggtgaaatagacgatgtacaatcatacgtgtgctaatgttgacaaggaacaagagatggagaagaatgaagctataaaaagaaaacaaaatgggtaaatattaactgtacctgagatgcgtatctgttgtttgctggttattcgaccttaattagtcaacgtttataacaaaaccatccctagtcttcttctttcccaatcgaattacaaaccctaaatcattccattagatcttcttgatccctaagcaagtctcttcgttaacttttgtctttctccttaaaatg

SEQ ID NO: 9930 - DNA, 3000 bp, Unknown
  misc_feature (1)..( 3000): cDNA_ID_3034731_gDNA_ID_2096292_Annot_ID_195421 3000 nt of promoter + ATG
agccctctctggggctatggtgactgacatgttggcttttggtgtaacattttttaatgcaatctactacgaaaaattgtacggcttcatgcaaaccgtaggtttctgcctctttgtcgtcgttatgatatgcgttgtgcggccggctatgtattgggtgatcaagcagactccagaagggaggccggtcaaggatttctacctctactcgatttttgggattgctttcgcctgcttcactttttttaacaaggttattcatctttttggacccgcgggatcatttgttttcggcttgacggttccaaatggatatcctttaggtactactttgattcaaaagtttgagagctttaatcttggctctattttgccactctttggatcattaaccatgatgcaagtagatctcttacggttgttcaaagagagtggagatttaatacggatggagggtcaaatctatgaggtcatttcctttattcttttggtgaataccacaaaattcgttgttaccaccataaccgcgtatgcttttaaaatgcccttgagagactcttttgctttagcccttgtgcttagtaataaggggatcttcgagctcgcctactacacgtacgcggttgaattaaaggtgcgtacaattaaactcttctatatatatttaaagtcagaagaattagtttattttcataaaaattaatcaaatctttggacatgtttcacagctaataaggccagaggttttcacaatcctagctgcctacaccctcttgaactctatctttataccaatgctcttggagctcgtgcatgacccaaccaaaagattcagatgctaccgaaaaaggaatttgggcatcttgaaagacggtgcggctctccaatgtcttatgtgcgtctacagacctgatcacataacttccatgaccgacctcttggaaacttttagcccatcacaagattccccaatggcgtgtaacatacttcacctcgtcgagcttgtgggtcaagccaatcctatgttcatttcccaccagttgcaaaaaccagagcccggaagtacttctctgtctgacaatgtcataatctccttccgtggcttccaaagacaattctttgaatacacatcgttggatattttcacttccgtctccgtgtcccaacacatgcatgaggacatttgttggctagccctatccagaagcctatctttgattgtgcttcctttccaccgaacctggtccgttgatcgatccacggttatctccaacgatgataatctgagaatgctcaacgttaacgtcctgagacgagccccatgctctgttggaatcttcgtctatcgcaagcccatcgttgaatctcatatggctaagtcccacagcaaggtgcttttcattttattttgaaaactaattaattatccgtttgggtacgtgaaaatacaaatttcagaattttataaaatctaaaagaatatttttgcaacgtctaaatgaaattaaatgctgaaagaaaatcttttcattttcctttaccatttatgatgaacaaaagaaatggtactaatatattagcatttttaacctgataaaactctcatctttgcagatatgtttgatttttaacggtggaaaagacgatagagaagctttggcgataacaaatcgaatgagactgacagaaaaacgaacaaggctaacgatcataagattcattccaaaatcttctgaaatggataacgatgagtgggagcaacagcaatcgattaacctaaaggagtccgtgactagcatcgttgggtccaacatcaaagaaaatgatgccaaggtgacatatatcgataaggcggtttctgatggatctgagacctcaagaatcttacgagcaatggcaaatgattatgacttgtttatcgttggaagcggcagcggaataggaactgaggctactagcggaattagtgaatggacagagttcaatgaattgggacctattggagatttattagcatcacatgaatatccttcaagtgcatcagtgttggttgttcaaaaacaagtgtacattcatcatacaaaaagccaaaggagaaaatctttctaagaaataatgcgagatatgttcaatgctcagcttttcaatgttgtatttctctacatcaataaacattagttttaggctgcttgaagttatggagtaattgattcgagtttcttctggatatgatgatataaacttcacgatttttttaatcaaattttgagttaacaagattagagtaatttcttgtggcagtgcctgctctatgataacgccttccaactatagctgcctttgttatcacaattcaaaaatatatattctcttgtagtaacagggtctgtttaacatacacactttgtcacgttataattaagtttagtatgtgttagagatatcagagggaacagagcaaaatactctgtttttctcaacaaaaagagattttggtacctaacagagtactctgctctgttccctttgataaaagattgaatttgaggtcttaattaatggatcatcttattaaaaatgggtaaagcgtttatttagactgcctaaagaggtcattttattttaaagtaatacaacttacaagcgccaaaaacaaagacaacacctggacgagacaatccctatatttatacccttatcctaattttagagatcctttgggatctgtgtgaaaccatcagaccggttttaattttagttctttttttgactgcaaaatcttttcattgtcaatttttttttttgttctttttggttttacgtagacaagatttgtcccaaatggatgcagaaaatgcgacttggcgcaaagagttcatgtggaacaacgatgagaaaagagcagagatggggacgaagatgttttgcgatgtaagtccacatataatgttgaactcacatggcgttgcagagaaaatggcttccggatctaagggaatg

SEQ ID NO: 9931 - DNA, 3000 bp, Unknown
  misc_feature (1)..( 3000): cDNA_ID_3034763_gDNA_ID_2096293_Annot_ID_195454 3000 nt of promoter + ATG
gtgtatgtctcaaggcgaaaccctttgagacttatttatactaagataagaaagcgggtttcgagcccacttaacggcccatggacgatgtgatcaagagtgtcgactcaaagtgggcttcctgatggacttcgaatgggcttcgaatgggccttctcttctcttctctttccgttgctcaggttgtctggttgagtgcggattgatcaaagggtcgaggtggtggttgagtaggttggttgacagaatggtctgggctgcttcttggcctctgtgaccgagtatgtgtgttagctgtcaggatggattggttcttctcctctgcgatcgagtagaattggtggactggcaaagtggactgcatggtcgcctctgcgattgagtagaattttcaggatggactccttcaactctgtgatcgagtagaactgcagttgggattgactcctctcctctgcgatcgagtataagtgtctggatggactgttgagctaactgcttccctctctcctactggtgattgagtatgttggtggaaatgtgactttctgttctgtttttcctctttctgagcaccaatagacgcaagactagtcctagactcgactaaagacgcaaaatgtacaagaatgatgatgaatgctatgaaagatggatgaaactagactcaaagtggtgaaaacaggatgtgtaaaacatgcaaattatagacatatcaactcccccaaacttagtctttgcttgccctcaagcaaacaagtagacataagctgaaggagaggtttgaaggtggggatccagaaccaaatcatcaaataaatcagataaaatcaatgtccaaaatgacagttctaggatacgatatgatggaattctactcaaaaacgttagccatgccttattatagttaaatctcactcttatactcgacctacacatgatttcaaatctaccaatccctttaacattcattagtttaggaacgtgaatcaggcaatgcaccatcaatgaactcatttggctaaggtgaaggtcaggagacaaagatgatccctttctggttgttcaagtttagtaacaggggactctcaaaagaaatggactgaggttttggagaatgctaaaggtaagagccaacctatgcatacaaaaatagtatcccatctacccaataacatagacagtgtatacaccagcagatggtactaccatcaagcccaaaatatgatcctagttctaccctttgcactcaaggtatttttttttctcattcttatcttggatcaaaccactctttcttttctttgactcttattctaaggagaagtttcttttactttgatggatctagtggacttttggttttctttgacaactctgactcttgtcctaacactttcttccaagctcaatcctgaaacaggcctcacaatcgtgatctttactatattacggtgagaaaattataggttcggacattgttttcaaatattttgcatgtatcaaagctcttataaacaagataggatattcctacatagctggtgggaccccaacaaatggatcatgaagtcttcaaaaaagaatagatacgattgcattgcatgtagtaacagatgcgatcataccagcactaatgcaccagataccatcagaaatccgcagttaagcgtgcttgggcgagagtagtactacgacgtgtgacctccaggaaagtccttgtgttgcataactcttttgttttcgatttttctcatattttttgttaaaaatgtattactctataacttttagaccgtgaggccaaacttggcatgtgataccttttcggaaagccgaaagagtgctctcaaacgaatgaggaatgggttgtttttctactccaaattttgacctaaatgtactttttatggccttttcttgatctttgctatattacgggacaaaaattatatgttcggacattgtttttgaatattttgcatgtatcaaagctcttataaacaagatagggtattcctacatatctggtgggacctgataatatgtttttagtcaattattctaaaacaccaagcatgtcgttgtagtattttaggtgtcaatccaaatgagtgtgatgcaaacagatgagatgtgatcagaagttactaagtcaagccaagcaataacagttttggggtttctacagtcctaagtgaacatgcagaaaacagaaacaataacaaaattactaaaatcactcgaccacaacaggctgatgccagaagtaggatgtggtcgagtaacaggtaggatatgaaacagatatactcaactgcacagtctgttgccagacactgggtgtggtcgagtatactggtcgagtaacagacaggaaatgagacaactgtactcgactgcacagtctgttgccagacactgggtgtggtcgagtaagttggtcgagtaattgtaaaaactaagaaacaggcaatgagaacgattaagcgataacgataaaacagagaaatagtatagacgagaaattcctaaggatggggtaatcgagtagagtggtatcctgataggttacgggtgacgttggctggtgtgagaagaagggcgagatcaaatggaaggaaaggcagagctcgtgagaagttcctgaggaagcttctatttaaaagtggctaaggcacaaaaagacagctcgccagctcggcacagaaagacagctcgccagctcgccaactgtgtcgttttacttttgggttatcgaaatgctgcgttttgtattgagtctcagtagatgctatttaaggaaccttcccttttagggttttgttatcaaaataaacaatcaacaacattaatcttgaaattctctctctcatctacactctccgccgttcaaggtgcatttcctattgtcttgttattttatcagtcttagtctttttcttgtcttcgatagggtcagaccttatcattggtgcttcttcattggagagaccgatg

SEQ ID NO: 9932 - DNA, 3000 bp, Unknown
  misc_feature (1)..( 3000): cDNA_ID_2186427_gDNA_ID_2096293_Annot_ID_195456 3000 nt of promoter + ATG
tatcttctaacaaggaaacactatttgggctttcaagatccggttgccaatctagttcttatactcaatcatacacaggacatcaattaatatttgactccaaaacactaatcaagcttcttcttgcttctcgatggtgtagccgaagtctgtatgagtatttggctttgtatcttctaataaggaaacactacttgggctttcaagatccgattgcggttttagtttttatattcaatcatacacatgccatctagtcatatttgactccaaaacactaaccaagcttcttcatgcttcctaaaactttgatggtgatgtcgaagtccgtatgagtctttgggtttatatcttcaaacaacgaaacactacttagatttttaagatcaggttgtggttcttgtacttatactccatcatacacatcacatcaagtcatatttgactccaaaacactaaccaagcttattcatgcttctcaaggtctttatggtgtagccgaagtccgtaagactctatggctttgtatcttccaacaaggaaatacaacttgggctttcaagatgaggttgcggttcgagtttttatactcaatcatacacatgacctgtagtcatattttactccaaaacactaaccaagcttattcttgcttctcaaagctttaatagtgtaaccaaagtccacatgagtctttagctttgtatcttctaataagcaaacactactcaggcttttaagatatagttgtggttctagttcttattctcaattatacatattacattaagtcatatttaactcagaaacactaactaagcttcttcttgcttctcaaagctttgatggtctagctgaagttcgtttgagtcattggctttgtatcttctaacatcgaaacactacttaggcttttaatatcgcgttgtggttctagttttacacgccatcataaacatgacatccagtcatatttgactccaaaacactaacagaacttcttcttgattctcaaagttttgatggtgtagccgaagtccatatgagtctttggatttgtatcttctaacaaggaaacactacttgggcattcaagatccgattgcggtttgagtatttatactcaatcatacacatgtcatctagtcatatttgactccaaaacaataaccaagcttcttcatgcttcctaaggctttgatggtgatgtcaaagtccgtatgaatcttttgttttgtatcttctagcatggaaacactacttttgcttttgggataagtttcaagatctagtccaaatacttaaccatacacatgacatcaagtgatatttgatccaaaacactaaccaagcttcttcttgcttctcaaagctttgatggtttaaccaaagtccgtatgagaatttggctttgtatcttctaacaaggaaacactacttgggctttcaagatctggttgtagttcgagtttttatactaaatcatagacatgccatcttgtcatatttgactccaaaacactaaccaagattcttcttgcttctcaaagttttaatggtgtaatcaaaatctgtattagtcattggctttgtatgttctaacaaggaaacactatttgggctttcgggattaggttgtagttcgagttcttatactaaatcatacaaatgtcgtctggtcatatttgactccaaaacactaaccaagattcttcttgcttctcaaagttttaatggtgtaatcgaaaatctgtatgagtctttggtttgtatcttctaacaaggaaacactacttagacttttaagatccggttgtggttctagttcttatactcaatcatacagattacatcaagtcatatttgactctaaaacactaactaagccccttcttgtttctcaaagctttgatagtgaagccgaagtccgtatgagtcattagctttgtctgttctaacaagaaaacactatttgggctttcaatatccggttgccaatctagttcttatactaaatcatacacaggacatcaattcatatttgactccaaaacactaaccaagcttcatcttgcttcttgatggtgtagccgaagtccgtatgagtatttggctttgtatcttctaacaaagaaacactacttgggctttcaagatctggttacggtttgagtttttatactcaatcatacacatgcaatctagtcatattggactccaaaaaactaactaagcttcttttggcttcctaaggctttgatggggatgtcgaagttcgtatgagtctttggctttgtatcttctagcatggaaacactacttttccttttcagatccgtttgcggttcaagttctaatattcaaccacagacaggacatcaatttatatttaactccaaaacataaaccaagatttttcaaagctttgatggtgtagccgaagtccgtatgagtcattggcgttgtatcttctaacaaagaaacactacttgggctttcaagatccagttgcggttcgagttcttgtactcaatcatacacatgccatctaggcatatttgactccaaaactaaccaagcttcttcttgcctctcaaagctttaatggtgtaaccaaagtccgtatgaatgtctggctttgtatctgttggagtaagcttgagtattacttaagaaataagttatttagttttgagaaggattagattaaatctttgggagttatctaaagatattattaggagttatctaatattaatctaaatgtttattctagaattatctattgatctctatataagagttaccaaagttgtggttaaccttatcgttttttagagattgtgaagagatcaatagctttaggttttgagtaattttcctaaagagattaaagagagttattctttactttgagttcttaaacacatctctaaactacaattggtatcagagcttacaaatcttgagaccataaagaagaatttgtaaggagaagat

SEQ ID NO: 9933 - DNA, 3000 bp, Unknown
  misc_feature (1)..( 3000): cDNA_ID_2186441_gDNA_ID_2096293_Annot_ID_195459 3000 nt of promoter + ATG
accagaagacatactcgacccccaggtcgagtgacttcggagccattcttcccacctactcgaccacttgacaacactcgaccgttcactctaccacatcactcgaccccatggtcgagtatcacttcgccacaccaccttacaacactcgaccgttcactctaccacatcactcgaccccatggtcgagtatcacttcgccacaccatcaccatcactcgaccggacactcgatcacgtcttcacagtctactcaaatccgcactcaaccagacaagctgagcacaaggaagagaagaggagaagacaaagtgtttggaagcggcctggacctccatcggatcacgaagcccgtctcggcccattatctttctatgggccgggtaattaggttattggcccgtttaccatcattttattttgttttgtataaatagatgtcttagggttctgtcctgagacatccagtcgacattgagtttttgcttcagttttattttctgttttactctgctgcgccgcttttgcttctgcaacctgtaattcgagatttttccaagttattcagattccgcatttgatttcatctgtcatcttgtttctatactctttatctctttacttatgcaatattatcgtttacctgcgtttatgtctttaagcattttgtctgagtagtgacttagaattcttagggatgggatagagtagttgtggaatccgtagtctgtagaatggttaagttttagaattgattgaatcccttcaggactagttgcgtttactgcttatttctttatgatcaactggaattcaacccaagcattcccgcacccagaaggtgttcgatggaatgttcgatcgactagttcctgagatattcgtctctatcccaagggattggccgattagagcgtttattgactttataagtctgttcttattgcctgcatagttagattccgttaatgggaattagtctgggctagctttgcttgaggatttctatcacgggagtgaattaatctgttgttgaacctgttgtctagggatagcttgattgcgcttgttaaccattcgaataggctaggataccactctactcgattaccctatccttaggaatttctcgtctatcttatttctctgttttattgttatcgcttaatcgttgtcattgcctgtttcttagtttttgcaattactcgaccaacttactcgaccacacccagtgtctggcaacagactgtgcagtcgagtgcagttgtttcatttcctgtctgttactcgaccagtatactcgaccacacccagtgtctagcaacagactgtgcagtcgagtatatctgtttcatatcctgcctgttactcgaccacatcctactcctggcattagcctgttgtggtcgagtgattttagtaattctgttattctttctgttttctgcatgttcacttaggactgttagaaaccccaaaactgttattgcttggcttgacttagtgacttctgatcacatctcatttgtctgcatcacacccatttggattgacacctaaaatactacaatgacatgataggtgttttaggataattgaccataaaaacctattatcaatttggcgctgttatctttttcattttttctgaaagttactaactttgtgttttttctgtttgtctgttttgatttaggtactacgataccagctttacaagttggtactcgttgtatgcaaatacggtcacgaggaaatcagaatctcctgttcaacgataacatcgaccgtattgcacgccaactcagaacacagacagaaacagagacaatggctgcagttgttgatgagcaggtgcaaccaaacaacataggtgcaggcgatgcaccacgcaaccagaatcagcgtaatggcatcgtgcctccacctgtgcagaacaacaactttgagatcaagagcggtctcattgccatggttcagagcaacaagttccacggcctccctatggaggatccactcgatcacctggacgagtttgataggctctacagcctaacaaagatcaatggagttagtgaggatggtttcaagctcagattgtttccattctctcttggagacaaagcacatcagtgggaaaagtcacttcctcaaggctctatcacctcctggaatgactgcaagaaagccttcttggctaagtttttctcaaactccaggactgcgagactaaggaatgatatctccagtttcactcaaacgaataatgagactttctgtgaagcatgggagcgcttcaaaggttatcagacgcaatgtcctcatcatggtttctccaaagcttcacttctcagcactctctatagaggtgtccttcccaagatcagaatgcttcttgataccgcttccaacgggaacttcctcaacaaagacgttgaagaaggatgagagctggtagagaacttagctcagtcggatggcaactataatgaagattatgacagaagcatccgcaccagctctgattctgatgagaagcaccgcagggaaatgaaagccatgaatgacaaactggacaagctactccttgtgcaacaaaagcacattcattttctgggtgatgatgagacagtccaagtgcagaaccaaggaggtcagctatgtgcagaaccaaggaggttacaacaaaggtttcaacaacttcaagcagagccatccaaatctgtcttacaggagtacaaatgttgcaaacccgcatgaccaagtctacccttcacagcagcaaaatcaacccaagccctttgttcatacaaccaaggtcaggggtatgttcctaagccgcagtatcagggcaactatcagcagcaacttccaccacctaggttcacacaccagcaacaacaactagcttcaacaactccagattcagacttgaagaacatgttacagcagattctctagggacaagctgcaggtgcaatggatcttgccaaaaagatg

SEQ ID NO: 9934 - DNA, 3000 bp, Unknown
  misc_feature (1)..( 3000): cDNA_ID_2186563_gDNA_ID_2096294_Annot_ID_195476 3000 nt of promoter + ATG
catgaattttctaaagaaaagaagaactgagaacgaaacagtacctgacgagcttcatctttggatgcgaagaaagaacaaccaaacaaagaaattgacgaggaaacagcgaaaggtgtgaaaaccctcaaaacccttctttcgctgtgagagacctcacgatggagcgggtacagatccgattccggttttggatccatcagctaaattacaatattgggcccaaaaatgtagtaaggcccataaagtccaatggtggaccagtagatgtttcaaccagaaatctacatacagttggttcagcaaaccggaaattgaacacgaaacgttaatttcggaaaggcgtaataaaagcgcgcgagaggttgataaacacgcgtcgaagaattcgcgcgtgaagattgaacgacttcagacgagaagacgcttttcaacgttctctatgcgttaaacagttgactgttgacagatctcctccggtagagagagagagagagagagagagagttctctgaaaaaactgcgtaaatcctaactcgtcaatggcggattcgagctccaatcagaatcgatacactcctcctaatcaaaggtaacttcttcttcttcttcttcagtggtctttgatctgctgatttcgagtgttctttattctactgatttcgctactccgttcttacctttcgatgttgcttctccgtgtcacaggaaggcttctgggaatcgccggaagtcgggaggtatgtgagctctctctctctctctctgtcttctttgcctcagtcgttctttattgattcttaatcaattcggttcttaattccgagagtatctagttctgtggagattatagcttagatcaaagattgtcgatgaatagaagtaatcttgttttgtagattcaggaattgattgcatgcgaatctgtacacattgtgtttgtgcatagttggtaacttcaagaaccgtttctaagaaagtgaattattaggagtttagcctgaaattcagatctcgctctctctttattagcaaatccgctggttgattcatttctccatgtgtgtacttgacccatttgtttgcctgttttcttgaaaataaatcgtcgttcaagctatatctggttttgctagtatgctatggttcttggctaaataaagagtgaaatgcagatcgaacaagtagccaacagaacaacgataatgagagaaatcagcctcctgctactggtcttcagatggaaaacatatcccagacccagaggataataacaataaaggactgctccaggagtgcagcttatcagctcatgagccaacgtataaatctgaactatctctttaaacatttagctggtttattctttgctctgtatcactatctggtcgttcttctatcaactgttgctatgctaagcatttgttgagtcagtgctagttttagaaatctttgaacttaatagataaggtgtgttgaattcactgcttatgcagtcagttttatgtacttgtcttatttacgtgctcttgatttgtcatgaacaggatgggcagctgaaatgcatcaatacgacgacccaactgtggatctatctggtgagattaagggattctaagttttcctttgtcctttgtgtctattatacttgtgctgcttgagttgcctccaaatacaatcagatatatctatgttcttatctggatctctgtcttccggttagtcaagtataactgattttcaagtttgcctactttctctgtttcacagtgcgaccaatcatgtactatggagggagtgtttggggtaaactacctcatcaggtggaactaacttcaaactcttatcatatgcttctagtttttctaaagatgtgagtacatgaatgatgagaccccatctcttgttttgtgtcaaaacaattacagatcctggctgcagcaaacaagacattacctcctccatcgccaacggattacatgactgaagtgcggcgaggattgctgatgccaaaagccaacaattgaatggttcttgttcagatgatggagcccatatagactagtgaaatggtgtttgttgagatggcacaagcggtggtatgtcaatgacttttatattgtgtgtgtgtaggataacagatattgcttttgtcaggatcggttgttttctctggtccctgaaagtgtaaaaaacccaaaccagagatttgagtaacaatcacgttaccatctcattttagcttaactggattacaaattcattgctcctttcatctgtcttacaaagtttggttttgaattagacgggaaatagaccgtctagctaatagaagccagttgttacaaaatttatgtgaatccaagtactaaaagtaataacaccaaaaaggcaaatgtatagtagtacatactattatctgtatgtctgaaaaatcccattggtcgatcaatgaataaacacaatgcggcagatgcaatcaataaccagttgacttgaaacttaaactgactagaccgatactggtcgtgaaaaagctaggattcgtagcaagtactccaaaaattaaagagagatttatcattttgtccttttcaatcaagtttattatttttgtctttaaatgatcaaaacatgttaagttagctggtacattgcaatcatttttccacatcttaagccgacgagagacagagaaacagaacgaaaggatttttactctttcttaatgaaacagagctctttatttaccagattagtaataataatgatataaaaaaacgaattctaacgatacaaagaattttaaaattagttgaattctcaactgcttcttcacacacactatctcataaacaagatatatatatatatatatatatatatatatatatacaattcattgtcgtcgtcatcatcatgatccttcttcattagtcatttactttcctctctctttcatctttcagatccagagagagagaaagagaacaaaacatg

SEQ ID NO: 9935 - DNA, 3000 bp, Unknown
  misc_feature (1)..( 3000): cDNA_ID_3034797_gDNA_ID_2096294_Annot_ID_195491 3000 nt of promoter + ATG
gaaatagcaaagtacctgcaacttggaaagctcatccacgaattcgcgcggaaacaagtctgacctagttgaagacaactgtcccagtttgataaacgttggaccaagctgcaatacactctctctcaaccatgaagctgtttctcttcttctgcttttctgattatataacaacaggtgaaattaataagaatcaggaccaacaaaacatcaaccaatgaatcatttaaattagactaaaatgatgaaaggtttacctgtttttcttctgtgaatcctccaacataagcccatttcgaattatcgaacaagatacgaatcctcagggaaataacaaatgaccaaacatcaatactgcgttgaagtgagctataattctcatcagcccagctaaaaccttcatcagaaggaagaaccctaactccttcaaccggtggaggaaggtacgattctgttgttttctttggtgccttaaccaaagttgacgccgcaccattaatgtttctactactaaccaaactcgctccattaacacctttcccagccgatccattcacaccatctttcctcttcaccacctcactcgcaggaaccattttgactgaacgtccattgattccaaccttagagggcaattccgactgtctcatctcaatacgaaatctcttagacttgctgccataacactgagtggcttccccagtgaaatgattctccaaagagctactgaaaccaatagctttggtgactcttgcggtctcaccgccatagcagcagctctgagaagctaataaagccgccatttccacctaatttacaagaaaccaattgaatagacacaatcaaacaacaaaattcaataagctggattcataaaactggaatgcattggagaaaattatgcggcaagcatcatttgtataatctaaagttctaaactataaaagtatgaccaacacaaaatttctagtgatagaactccattaaatcatacttgagcctattcaaaaccatcgagttcaacgacacctctaaattattgatttgataagagaatcacaacgattctcagccatgaaaaagatataaataatcagcgaacattaacacgtactatagcaagaggaacccaattttactacaacccaaacctgttctgaacctgggatacccaaaagtaattaagaaaaacaaaacaaaaaacagagtagaaattaagaaaaatggaacctttatcaaagtcctgaattgggttgactggtgagacaaagatcaacccagacccagaaatttcgtagcaggaatctgtagaatcagctgtattaagtagaggaatttcttggaacagagtcgagagagagagaggtaagaggactaagttgcgtaatggtgtcgtccttatgactaatgagacgtgtgttgttccaccgaattttccaccttcctaccaaaatcaatattgagactttgtgcgtaaataggaaaaaaattggatttgataggacagggaaaataatctttgtaacttttagtgccaaaattaagacaataagagttttggaagatgcgtgtccagcttctacatctcacgtttattgtgtggacagttcgaaagagagtgttgagcatcttttctaacaataaaattaaaaggatataattgctcgttagtaatccacttaaaggggtttaaccaatttaaacggtaaacttttttaagagcaagcaaaacaacaatggttcatttcaaaaaggaaaatgacaaaactacatattaacatatgaacaaaacttgtgacgcttcaccacatagtttggcttctacatgatcggatcataggcagctccaaaaccgaagttccacccacccagactactattggaagtcattactctatcacaaaaccattcgtctagtttcttcttcccaagtatgaaatgttgcatttgcgagttcggctgaaaacgaatatttcttgctcttcagtagcgcctcctgagcaagtaatgacttccattcaccgctcaactctttcctttccttggctctaaggctcctcaacttctgtaacatctgcttctgtgcatagttgcttaaatgctgaaacagtgtcgtctcaagcgcatcctgtaaagcgcacagctcatcagcagcaccatcttcctccttctccttctcattagcctcattctccatatgtttgtcaacattttcagaaggtaatttgtcatcataagagtcgcctttttttgcaaatccatcaccatttccaggttcactgtttgtcactgcttcaactacctccctatccttcccaccagtctcattctccatagttttgtcaacattttcagaaggcaatttgtcattgctcccatcaacacatcaagatttatctttgccccatatcgccatggacaagtcaaaagcttcagaatcttgggggttactaaagctaggcagcaggatgaatcattatgttggaccgttagtcttcttttttttgctttcataaacttgtaaaaaataaataacctcttgtcaacaaatttcatttacatactccaagcccgtgggccaaaaggatcgtacggagccattttttgttggtccaagactccaagcgaagaagactatggacttcttgtattattagccaaaattaaaatttgaagttaggtaacaaatttatggatttaggaaaatacgtttataattgtattttcttatttagacattgcaaatcccatgccgttttcttttgttgttttgtcaatttcatgccgtatgattaaagtttacaatgcattttgtataagacaaatgctttttgataaaagaatattaaggtacaaaaaaagaaaaggaaggtaaaaagattcctttttccctctctttgggccttaaatagagacagagaccgaaagaaagaggagaaacctcacacaaaattggtcctaaacgagtctccttcagtcgtaatttgcagcagagcaacg

SEQ ID NO: 9936 - DNA, 3000 bp, Unknown
  misc_feature (1)..( 3000): cDNA_ID_3034801_gDNA_ID_2096294_Annot_ID_195489 3000 nt of promoter + ATG
ctggatagaccatgtctgagtttcgaggtcgaaaacgtagagctggttgtcaacaggaacacgtggttgaaactcgccaccaaaggcatacattttgtttcccacaagagctatagcatgagagcttcttgctcctggtccggttcctttctgtttaagctgaatgacaaataacacaaaacataaattactcaaatactaaatcttacaatgtttttataatcaacattacaaaaagtattagcagaaatcaatgagaaagaaacaaagagttgagtcagcattcacaaatactagtcaattgaataatgacaaagtcatagtctactaatccaatagtgtctacacaagataaataattcaaatacttatatgtgatgatgattacaaaattaaaccctcctccatcagtaaactgttaatcaacatgatatgaacaactctgccggtgaataatccatagtccattcaataaatgacaaactcatcatccacaaatccaaaattgatcagagaaagcataaactaggagattcgttgtagaaccaaaatgattattgaacctaagtgtataatcacatcagcaatctaacagagaacttggacagatttacagagaataataaacagattccaaaacgaaattagaatttcaaaagccgaaagtctcgtacgattcaataaaaatccgaaaacatgagacaagtaatatccgatgaaacgagattcgtctctaagagaaacacaaaggcgagaaagctgacctgaacccatttgccttccattggagtcgctgccatcgttgctctgctgcaaattacgactgaaggagactcgtttaggaccaattttgtgtgaggtttctcctctttctttcggtctctgtctctatttaaggcccaaagagagggaaaaaggaatctttttaccttccttttctttttttgtaccttaatattcttttatcaaaaagcatttgtcttatacaaaatgcattgtaaactttaatcatacggcatgaaattgacaaaacaacaaaagaaaacggcatgggatttgcaatgtctaaataagaaaatacaattataaacgtattttcctaaatccataaatttgttacctaacttcaaattttaattttggctaataatacaagaagtccatagtcttcttcgcttggagtcttggaccaacaaaaaatggctccgtacgatccttttggcccacgggcttggagtatgtaaatgaaatttgttgacaagaggttatttattttttacaagtttatgaaagcaaaaaaaagaagactaacggtccaacataatgattcatcctgctgcctagctttagtaacccccaagattctgaagcttttgacttgtccatggcgatatggggcaaagataaatcttgatgtgttgatgggagcaatgacaaattgccttctgaaaatgttgacaaaactatggagaatgagactggtgggaaggatagggaggtagttgaagcagtgacaaacagtgaacctggaaatggtgatggatttgcaaaaaaaggcgactcttatgatgacaaattaccttctgaaaatgttgacaaacatatggagaatgaggctaatgagaaggagaaggaggaagatggtgctgctgatgagctgtgcgctttacaggatgcgcttgagacgacactgtttcagcatttaagcaactatgcacagaagcagatgttacagaagttgaggagccttagagccaaggaaaggaaagagttgagcggtgaatggaagtcattacttgctcaggaggcgctactgaagagcaagaaatattcgttttcagccgaactcgcaaatgcaacatttcatacttgggaagaagaaactagacgaatggttttgtgatagagtaatgacttccaatagtagtctgggtgggtggaacttcggttttggagctgcctatgatccgatcatgtagaagccaaactatgtggtgaagcgtcacaagttttgttcatatgttaatatgtagttttgtcattttcctttttgaaatgaaccattgttgttttgcttgctcttaaaaaagtttaccgtttaaattggttaaacccctttaagtggattactaacgagcaattatatccttttaattttattgttagaaaagatgctcaacactctctttcgaactgtccacacaataaacgtgagatgtagaagctggacacgcatcttccaaaactcttattgtcttaattttggcactaaaagttacaaagattattttccctgtcctatcaaatccaatttttttcctatttacgcacaaagtctcaatattgattttggtaggaaggtggaaaattcggtggaacaacacacgtctcattagtcataaggacgacaccattacgcaacttagtcctcttacctctctctctctcgactctgttccaagaaattcctctacttaatacagctgattctacagattcctgctacgaaatttctgggtctgggttgatctttgtctcaccagtcaacccaattcaggactttgataaaggttccatttttcttaatttctactctgttttttgttttgtttttcttaattacttttgggtatcccaggttcagaacaggtttgggttgtagtaaaattgggttcctcttgctatagtacgtgttaatgttcgctgattatttatatctttttcatggctgagaatcgttgtgattctcttatcaaatcaataatttagaggtgtcgttgaactcgatggttttgaataggctcaagtatgatttaatggagttctatcactagaaattttgtgttggtcatacttttatagtttagaactttagattatacaaatgatgcttgccgcataattttctccaatgcattccagttttatgaatccagcttattgaattttgttgtttgattgtgtctattcaattggtttcttgtaaattaggtggaaatg

SEQ ID NO: 9937 - DNA, 3000 bp, Unknown
  misc_feature (1)..( 3000): cDNA_ID_3409314_gDNA_ID_2096294_Annot_ID_195499 3000 nt of promoter + ATG
aaaccaaacaaccaaaaaagaaagaaaacttcaccataacatatgttgcttgttccatatcatttatagttagattgtagcagcaacacaggattcagctctagccttgtcagaatcttccaagactttcttagaggctttaataacaatatgattagtgatgtaatgcttgcgacaaacaggcatatagacatcagctccaccaataagctcagttctggtgtcacaattctttcttaaagtgaagaaagctttatgtccacagacctcacaccttgcagttagcttagtcacagaatcagctattggtataatgtcaagtacagccccaaaactcctcctgcacatagagagatcaattccacattttacagtcaacaaaattgttaaacattgaagtaaaatatcaaaatcacagctttggtactaggatgaagcaccttaaatagtcaccatctaggccagcaacgatcacaattttaccatcatcatcagcgactttgcagcaaaactcataaagatctccaaagaactgagcctcatcaataccaatcacatcaagctgccaatcattttaagagaaaaacacaaattcaatacagatccttcacaattaagacccgaaacaccaaatagagcatcgaatttattaccttgttataagcatctagtccgaatttctcaggaaatgacatgagatctggaagagcccagcaagggaatccaattccatcatgtgtcaccaccgaatcttttgcgtatctcgtatccttactcgatttcagcatcgcaacacttctgcttaaccaaaacacgaaattaagaaatttacggagatagatctaacaattaaaatctacggagatagaaaataaactgtaccttccgtcgctgatctctgacttgattcggcgaaggagagaggtcgatttcccagaaaacataggacccatgataacatgaacagcacctgacccacgacgttccagatcggagagaaaatctccggtgacgtcactgtcgagggttttgatcaaaaaggaagctttgagagtcgccatggcagagacttgagaagaaaagatggtttgtagatgaaaaaagggagaagggttcaatttgcttgtggttttaggtagcgatggtgaatagcttgttgaagatatatatacgcggacatccagaagttgaacaaggaagaaaattgctggagaagatttgtcaaagataagggtttgaaattttgaatgggaggttttttcaaaaaaattacatctttggagggaaacagttttttagagcgaatctttttattttacctctctcttttcataaagcggaacactataaacggaatttaaaaaaaaaaaaactgattttctattggcttattttttttaattaatttccttaatgtatagatcatatgaaatttttaaacatgtgtgtttaggctttgcaaacacattatttaagagaatgataaatatttttaaaaaatatatccacataaaatggtactggtttttggtcatatattccactaatgttttttagaattattgtttaaattagaaagtcgtaaattcgtaatattcgagaaaacaactttctcacttgggtttttatcctacaaacccatcattttgtgtgtgtgcttttgaatgtgggcttaaacccaaaaccctgaggctttttttggccctgagatgaacatgttcacaaccttcttcaagtgttccaatacatacacgttcattgctttttcgtagttgcaatttttatttaatttttcgtatgtagttgcacaccttcatgtctaaagctacaaattgttgaaatgttttttccgatcacctcaattaatgtacaatcgtagctcgttgtattcctaaaaccgaactagaatacattttcatcgccaggttattacaagttaaatcaatttgatcaaaattcaaacatagataaaatgtacaccagtaggttaaaactaaaccaaacgtacacaacaagcctaaattatccaaacaacaacaactctcagttttgctttaaaaattctgtgaataagacatccttaattgcaaatttatttttaattacttctttttaaaaaacttttagtggcaccatcctaattagtaattactttctatataattcttctttaagatacaaactaaaaattccgcaaaaagaaacatctaaacattccaatatattaatatttttttgttatgacaaaagtaaaatttccgtgtaataaatggaagggaaaacgtataaaaagtttagtattgaaaaagagaaaaaaaagaaacaaaccaattatgtaataatgagtataaatatataaatacagacatatcttcttcttcttgcacacccaaaaagcctttgtctttctatctctctaccaaaacttctttctttctctctttttctatatctctagagcgcgttactgcgcgtcgtgagtatgtttttattgacgccattgaaattgggttaaatcggtttgaatcggattgaacaaaaactgtattaataataattcttcctctacttttctctctgattgattccaatcttctttcattttcttcttcttcttcttctggggaaggggcaggttaaaattatgccatctattcaaatcgtgcctatcctcagatcttaactcttttctctacgagattcggcatctgggttttattcttcttggtgggtttttttttattcttcttcttctgatctcagatttcccctgattggtttttttttttgctaaatccgttttatgttttcccgatcaaactctcctggcagattctcggatctgttgttttctagattcaatctgaatttgattttacgtttttgtctttgtaaagatgtttccttttgatcagattttgataatccattgacatctctgattcaagcaaaagctaattaactttgatccgattcctttgtgtgtgtgtgcagagcaaa

SEQ ID NO: 9938 - DNA, 3000 bp, Unknown
  misc_feature (1)..( 3000): cDNA_ID_2996092_gDNA_ID_2096294_Annot_ID_195496 3000 nt of promoter + ATG
cctgtttcgttttcgatttggattacacgaaattcatgtgatatgttgcttctttgggttttgtaaaatgattgctggtgaattgtattgggaattttgtgcagaggaaaggatgaccagagaacatcctcccgagcctcttgatttcttcatctggactgttgaggtatattcaatcaatcattccttctttataagcctttcatgatgatcacttcttcaattcgcatgtttcttggaattgagctcttcattattagacttgttggttgcagaatcatgtttattaaattattcagcctatttttgatctgaattcagcctatttaaccagttacagggttgatttgatatttcttcaggtatgaccctagtttgccttaggcttgttcttgttgtttgatccaattacactgattgatttagtttactatgttacttattttttttgctcttttggtactctgcttgttattacaagaataaatctcaccttaatgattgcaattacatcaggcaagctcgaatttgacgcacctctagctattgaagttccattagtggtcatttagtttactatgttacttgtcgctctagtccaaggaatctgtgtttgttgatgtacatatactccggaagtggttttacctcagggtgtgtagactgcagagtgatgttcgcatatgtcacttgttgatttgctcttcagaaaaggttgaatattggatgaagattagttgatgaaaactcgataacctgtgcctgataccaaaaatagttaagagttagtccactcatatggagaagctggaggttgtgtgttgctgaatggttttgttctatcagatgctattatggattttcttagttatgctcgtgtgtaatggcgagcatcttgtagatgagaagctttgttctttttttcttcaggatgttgggtcttggctcgaggagataaaccttgggggctaccgccagattttcaaagaaaatggtgtcaatggagaatatctagaaagcatgtctgtgtttactaccgagcagatccttcacttcataaggaggcatcacatgaagtggggagacttcatcaccctctgtaaagaactcagaaggattaaaggtactctatcgttctctctataactctcagcttaagttgttgcaggaatttaactatggaaagaaatgtctttttttttacagtggcttgcttgaaaggtgagcagagagttagacggccatggtgggcaccgtcttgtctatccgtagtctttgttaaggcagccaaacgcaaccgacagtctcgtgttgtatctctcaagcttgaatcttgacattacactttggctgtttatgtacgtacttgtctctcttctcttctcttgttttcttttcctttttttttttttttggtttgggtttgtttgtggcacatgcactaggaagaaacaaactcaagtcaaaaaagctgtttggcttggtgaaatcttgcaagcgggaaaaaaattatgcgttttgtactttggtggtgtatacaaagcttgctctcagatgtttaatatatggcttgtgcaatctttatgtgacagataatagtgtgacgaatccaaagtagtaatttgattatatgtaatgtggaaaccgattgaaacccaggcgatattgagaacgtagtaatttgattatatatgttatatgttccaatgattttggacactaataaaattatttaggtcacaaatttaaaaactctatcggtggttaaacattttcagagatagcgtccattcaaacattttcgtggtgcaaattttcggagaaatatggtagagatttggcgtatagctcatctcatgttcctctttggagattagtacgtttagtaccctatcctcttggacgaaatctcttatcgagtatcgagtccactttatcttcacagaagtgagtaagtgacaaacaatgggaagcgaccacaacttctaagagaaaatagatattttatacattctttcttacaatttttttgcagttgaatttatcatctacaaagtgtaaaattatggattgagcaatgcaatttttagaagaaacaattaatggacagagatataaagttttgtaaaaatctttaaaattaataattatctttgaggtttttacaagtttattatatgtccctttccattatttatttttttcgttattgacattgcttacatacagtccattattttaagtttctcttaattttattttatttattagatacacacttatgtgatacatattgatatcatctttaccaaaaatcttgagcttagccaccaacataaagttttgacaataactcgtcatcggatttttcctcagtctatcaaaccttatcaagtctagtcgtctagaaggggaagacatgttcaaacggggaatcagatttatcgtcgttatgtgagtttattttattccatatatggtttctcgctcgatacgtttgatggtacaattcatcatgcgtattctcacttcaactttaatcgaagccttgttcatattgtataatcaaccgttgatacgtgtcaccgcatctggacatatcacattttttgttggatttcttatactcacccctttcgtgatccgatcaaataataaaactgtgtttttggtacatgttcttgttgggatagcgtttgtatgttggtttattttcgtgttagttatcttcttcattgcatacattctaaagcaatatgatttcttatacaagccaataaggttttaatcaggattatccttaattaatgtattcatacttaccgttcacaaaataattatgagaaaaccaaataccggaattacccttcaaatccagaagcttcggctttggcctaaaaaccctactaaaccccaatcgtctctcttcttagctcagagtgctaccgaaatcaaaatccaccattcttttctcttccgagattttagaagtttgcgacg

SEQ ID NO: 9939 - DNA, 3000 bp, Unknown
  misc_feature (1)..( 3000): cDNA_ID_2186625_gDNA_ID_2096294_Annot_ID_195492 3000 nt of promoter + ATG
gaaaagaaaaaatcactttagtcaatcaatttagtttcattttcttttccaattagttaaccgactgattttcaaatcttactttttaattgtttatgctagtcacaatttaaatgtggaaacgatgttagttgattcgcaaaaacagttatcaatatcattgttagttagttcatcggaatatacgtaaattcgttgagttttgccatttaacgctttctatttgctccctccttttgttgttttgtagtatgtaccatatcataattctatgacataatagatgactaccaaattttctctgccagcttgcttgttatgaaatgaaggaggaaacaaatgtgaatagtatcggatttgggagttttacagaaaacaattgaatgtttcaaagccatttttaccaaacccgaagctgagatacacgtgaccaacactgctcacacactcttttgacctttgagcttaatcatggaccaccaatcttctcttttttccaagtccacttaatttcatttgctgacctcatctccattctcatttcctcctcccaaaatatcacaaatccttttgtaacttgttatgtctttcactttaaacacagagatccaaggaacgcctcttttaataatccctagatgagatataatgttactaatactataatggcaaaaatatcacctttactatcacaaagcatggaacattagaacataggaaaaaggattttgattagcttaatctgttctgacttcgtataagattttccacagatacaaatattgttgatcccttgctaacatgtttcatcttgaaactttgattctctgagactcaagagtcaagattcgtcttcgcaggcctctgcggctgaaatctctgaatcaagtttgctcatcagagtctctgtcacatgcttggcaacagagatcatgtcaaggatgacgcttgggtctaagccagacccgcttcgtttggttaacccacatatatggcctgtccgattcacagatatagatacagctgagctcatctgagactcctcttctgctgttgcatcaactatgtaatgcgttcccacctgcaaaaaccaaggacagcatggtaaaagattagcgaaatgtacataagaagatgtcgatgtgaatcaagaaaagtgagattcgattacttttgttaacgtgactatgaccgggacactggaagtgtcaaattgaagatattcctcgtcgctgatgtcaatctctggttgctcatcatctgctacttcagctgaaacattgacttttgggatggccgtgttggttaaagcagcctgcaggagtatagtcaacaagtgcattaaagcatgtgatcagccttgaggaaagatgacttttgggttgcttaaactatcaattggaaacatatcgtaaagctactaaaaccaataacaagacaactacattgagctaatctatatacacttaactaaagacccattccctttcgtttcctatattctctggcctttcctttctcatgattctgattgatgggtatgatttactcactaacattcgtaactaaaacctgagactaagggttaagagagaaaaccaaacacacatcacaagaattaccttaatggcagcacccagggcatccaatagattcccatccgaactaatgacaagaccatcaatataaaggtcccagcaaacttttccttctttgattaaaagcgaagataaatttattccagctcctggtaccaaaacatgaattgctataaacgttacaaacagaaagcgtaacagtgtgcaggtaaaaaaaagcattgcataaacatgattgcagacctgctccacttttgccacccagaagacatctttgaagagccaaagcaagctcagaagacaattcctcacctcctctcccctaagtaacaacatatcacaaagaattagccgcctaaagacttaacacagtagaatttaggagattctgaagaaaagtaatgataaccaaaatctcatgttgaacaattccactagtaagagaaacaccaatagaacgatagaacgggtgtgacaagtgctagatagaaccaaaaccaaacgaaataaaagaaaagctcaccccaaatgtcggttcagctgttggactgcaatcaatgaaaactgcaacctttcctttatcgggttgaagtgaacttggcctcccaatttcagcctgcaattacacaagattactgggtaacatctacaatagcacttcccattcaacaatagaacagtagcagagagaacaaaggaagtacctttacactagcaatcacatcggttccaccaattctaactctcgctgaaccattagcctagagccaacaaaaacaagagaaagaacatatctgttaaacaactgggaagcaacaatgagaagcggacgagctctaggagattacactacctgcggaataacaccggtttcgacgtagataggacggtaagtcaatcttttccgaccatcagttcgaagatcttgagcaatcccacctttaatgaaatgttgttccccaagagaaagccccatcactaatactacacagagaacgaattagatcaactgctgaggaatttctaccggaatgacaaacttcaaggttcacggattggtgctagggtttaagagacagctcaaacaaagtacacatctttatacagcacaatcaaaacccactaatcttctttaccttcccggagaattcaatagaagacacaactctgaagttttccggtgaccctagcggcaactttggattggttaggttaagagagagacgtgaccactgacaactgccgtagggtttaaagatggcgtgaacataattattgacacttgttaagggtaatttagtcatttaccgacttaccattttttcactgctttttagcgttttctcgctcttctggttttttcttcaatctgccgggaagaagtgcgagcttggtgccgatg

SEQ ID NO: 9940 - DNA, 3000 bp, Unknown
  misc_feature (1)..( 3000): cDNA_ID_1398698_gDNA_ID_2096294_Annot_ID_195483 3000 nt of promoter + ATG
aaactagactcctggttttatggtctgccatagaatctcttcacacaacacaaccttttttgtattttcttcttatcgttgataatgttctagaattagggcttttattgggcccagtgcaaataaagtggataatgcataaataatactttttaaacacaaattatgggccttaggattggtccattagaaaaaccttatgatagataaataatgtggcccatcaatgtcacctccatctccatatacatatctctcatcataaacagccgtcaaaacaacatcaatggcaatgcacactgttcgattgtcgccggcgactcaacttcacggcggtatctctagcaatctgtcaccacccaatcgaaaacctaataattccatcgtccgatacggatgcggatcttcgaagcgtttccgtatcgtaacggtcttggcgtcactccgggaaaacgatgcaaacggaagggataactccgtgagagctatggaagtgaagaagatctttgaagactcgcctctgcttcctagtacgaatccccactttcgattcctttgagctgtgtgacagatatcttcttcatttgcagtagacataacgtatatatgtaaatagtagcagctagaatttggatttagtgatgattagttcgtttttgtttgaataatagagccgttatcatcgaaccagctcacggaatctgtctctaatggctcccgcgttcgtgttgcgtatcaggtaactaattcaaaggaactgaattgtttctgagagtcataatgttttgggactttattggctaatgaatgattctccaattagggagtacgaggtgcatacagcgaatcagctgctgagaaggcttatccaaactgtgaagctgttccatgcgaagagtttgacactgcttttgaggtcagaatctcgttcctttactgatcaagactgaaatgatcagtatttcattttcttaagttttggttgccattagtcttgctttgttcttgtttaggcggttgagcggtggcttgttgacagagctgttttaccgattgagaactctttaggtggaagcatccatagaaattatgatcttctgctgcgacacaatttgcatattgtaggcgaagtcaagctagctgttcggcactgtttgttggctaaccacggtgtaaatattgaagatttgagaagggtgcttagccatccacaggtatgccacatacctttgtgcataatcgagttctttttctcttggcactatttaaacccttcttcgttgctttggatcaggctcttgcccaatgtgaaaacacgttaaccaaattggggttggtcagagaagcagtagatgatactgctggcgctgcgaaggtatgttttatgttcctagtatgtttatatattcacactcacaacttacagtggcagctaaataagtttgtgaatttgattcgcagcaaattgcattcgaaaatttaaatgatgcagctgcagttgccagtgaaaaagctgcaaagatatatggtttgaacatagtcgctaaagatatccaggttttaaagactttccgaatgccttttccaatttttcatccatatttttacacttctgctggattatttgattgtgaagttcaatcaatttaggatgactgtgataatgttacaaggtttctaatgctcgcaagagaacccattatccctggaactaacagactctttaaggtgagaaatccagtataacttccatctgcaaaggcaactctaatttctggcaatgtttttttttctctgatggaatgagttactttgattcttgtagacaagtatagttttctcgttagaggaagggcctggagtacttttcaaagcgcttgctgtgtttgcccttcggcaaatcaacctcacaaaggttttgattaacacactcaaaatcttccttcattatgtgcagccttgtttccagtcccttacaatcaattttattgtggtttcgatcagattgaaagccgccctttaaggaaacatcctctccgagcatctggaggactaaagtaatttctctcacaaaaccactgttaagtctataccgtacccagagtgtctgagcagtgatgaaagtgtctctctttctgtgcttgacagatactttgactatcttttctatgtggactttgaagcatctatggctgatgaagttgctcaaaacgcacttaggcatctcgaggtaaagcctttggtcacttgatctgaaaacatgtacatgtgactaagactctggattttgttattggcaggagtttgctacctttttgcgggtactgggaagctacccagtggacactacaatgctctaaacatttcaaacatcttcttggtaaatagttcattggtttgcatttcggatctgagttagtaaaattatatcaagtgaggtgaaatatttgaatagtttgtgacagagatccgcttgatgatatcataatcctggtataaggagctatatccctgaggtgaggtctgagaggagtcaccaccttacaagacattccgctcttgttacaaattctgtttagttttccaaaaaagatcatctttgtttttagtaagaatgtagtcactaagtcagatatcaatgacaaataccaaagaactagtgttttttcgtgtttcatccatacatagatacttatcctgtgtcttttttagaaatttctttttgtatgacgtttcaaaattttgattgactattgttagtggtatatctttgagttaataaacgagatataatctgttttcctgttcacaaaaaaaaaaaaaataaaaaaatcatatatcatccaattttcttttggttcagattttaaaacattgggaaaaatagggactagatgacaaataacaagaaatcagaattttggaaggattaaacaataatcgcttcttgtgcaataagccaaaaacaggattaaacagattcgctcagttctcaaaacg

SEQ ID NO: 9941 - DNA, 3000 bp, Unknown
  misc_feature (1)..( 3000): cDNA_ID_2186596_gDNA_ID_2096294_Annot_ID_195486 3000 nt of promoter + ATG
ggaacgtctcaacctttccaagcagattttgaaatattgattaccataagtcaatcatgctttctgattaggagaatctaggagctaattggtcataaagataagtagaagtacctcacaattatgattaagcatatctgcccatggaactaaggcaaatcttccatccatagaaggcaaccgcacctgtgttagagaagcttaagtctgaattgcagagacaagcacgcagcacacggaaggaaagagaaacgaaataatgcaatattttggttgtgagtggtcattgttcaaacaataaattgttggagacagctatattatgcagaaagtcatgctaagattaaagaacaagtctgttgtttcaaattcaagacatctagatttacatcaattatcaagataatgattgcttatgatacagtagttcttaccaaccgtgagaataggattccaaaagaccacttaaatgtctcatcattgaaaacctgcaaccaagaaatagcacactcatatacatgtggacaaaacaaatttaagctcagataataaaatagaaccaacactagttgtaattacagaagtgcatcttattacatgtccaaatagtaagctgtagcaaaatgggcgtataccagttacctctttagggaaaagttgagggtgtttggaaaatatcctgcttcttagatcttcataactgaggaaaagaaaaaggaaaaagacatgagcagtgtcttgcaagacataatcatcaaccccctagcctacaaacaataagtactagtgactgcatcaatgatttccagcagttgagagaaagaaagaaagaaagaacaatatctcacgttccaacaacattggtgattctttcaattgcccgttctcgaatctgagaagcttccaagtacatatcaagctctgtccgagtcctgaaatagtacaaaaaggctgtagggagtaagaaactgagaccaaagttcagctacagaaacaagtacaaaacttaccagtataaaagcgagtaaggttgtcggggaagagctgagatatagttaaaccatcttgagcttttctgaagacttgcttcacttataagataagtggcgagcaaaggccaatctggaacatcataacgtttcatcacttcaccagcttctgcgttggtccattcctaaaacccaatctccgatattagatattcacattcatgaaagccagatactttaaccttgcattgatctgaacaagaggtgagggattgcttgcaagtgagatcaaggaatataagattagattctttgattccgagtgaaattaggagtgtgaacttacggaatcagcactgatgacgagagaaggaggaacgaagagcaatttctctccttttctgagattctgtgaagcgacgaggcctcgctcaccgatgtcgactctatcaatagccattttctgcggagggagacctgaatcagagagccagttctgaagagaagtagcgttctcaagtgaatcaatctcgcatccccatgatatcttcggagcttcctccatggattgtattgtagtctcaccggccgaaactgagcagtggattccgggacggcatcgggacagcggaagcggtgagaaagagagggtgatgttttgattacgaagtttgtgaagtggagagtaagctgggagtagagtagactgcaagaggcaagcttttgccatcggaaaagagaaaacgatgaagcgagaagacgaatggttgcacttagcagagggggcatgacaaaattaaaagataatgtttttaaattcgaaccaaaattagtttgtggatttacggtttggttcggttttgagtttaatttgatgctaaggaaaaaaaatctaagctgcctatggataatgatattaatattcaaaactttgttatgcgctaatgctaatgggaaaaagcctagtgattagattttgatagaatcagttgatgagatttattgaaaaattgtttccataacagcaatatctggacggtttattagaatttagaagcaatagggacccaaaacacaggaaaattaatgaaaaaattgaagatttgtttatgtaaatgacaatccctagagttgctaattgctattaataatgctaaaagcgtactggacctggtaaatatttggacaaccatataactcattatgtttttgaaatccaatttttaaaatattttaatttggtattgtaaaagaaattaccaaagacaaaaaaaataaacttattcagtaaattaaatatatatgtaattatcatggtggggataataataacgtattataattatttgataatttaaatatttacatagaaaacaataatacgttactgagatgtaaaaatataaataataatatgctaatcattaaatcgctcatctcataatgatatgggtaacatcgtttgagatagttgagatttaatatgatcaagttacaatcaaaacttatcttcttcttattttcttaaatactatgttttatgtttgtcattattatgtagtgtaaatattcagaagatatcctaaatcctaatttaaatatatttgtggacaaaaaaagattgtgacaacaatttggttatcattatttaccaaagattcagattaaaacaaacaaaaaaactcaatattaaaaagctacaaaggaatgcaaaacaaaattgaaaaaagaaaagagagccctacgcttccaaaatcacagtgcgtattattttgctcattcctttctctcgcccccttcctcttttttttttttttttcttgttccttcttctttcttcttctccttcgtcgacccaaactagtttcaaatcccatcctctcgtactgatttatcactcgcctcttcgtatacatatataggtactcagacctcttttggtctaggtccagatttcgattcctgttaaaatatcagaagcgagattttacgtttgatagaagagaggatg

SEQ ID NO: 9942 - DNA, 3000 bp, Unknown
  misc_feature (1)..( 3000): cDNA_ID_3034805_gDNA_ID_2096294_Annot_ID_195487 3000 nt of promoter + ATG
gagcttcctgatttcggaccaacagtacttttatccatcacagcagaatggctgtaaaccaaaaaacacaaaacaaaaatcatgagaaggatcatctatagagtatatccatgctggaaaaaggcccacccatctttaactgagggtgttatacatccacctataagtcacatagaatcaaggagaatgatacataaaaggaattagtactataggatgacaatcaccttgagaccagagctatatctttcgtttttatctcttgagaggttgaagttgatggatcaataacctgctttggaccgttttcttttttgaaagaattctttgcaccagcaacatctgatcagaagtaaacattcaccacacagttcatcaattacagaaaaattaaaaagcaacatgttacagactgccgctagggaactttctctttcacattctttcgctaaacatactaaaagccaatcatgaacacaactagtatgtcctaggaggaaaatcaggaaagaatcaatactgagtaaatataacaaaaagtattgtgaccgcaagtaaccaccttccagagacaactaatgtggcatattaagagatgcgagttcatatgattgtaaaacattgagttcatcagattgttatttaccatttgatgcatgacgagaagagaaattcatccgaccacccctgctaccacggccccctccaccagatctccattgtgattcagcagaatccttgttgttgatgttctgtaccatttcaataacattgtcaatacccatgtcccaaatatatgcggtttaatagacatcctttacacagaaacccatgaagagaccaaaagaactgcaaaaaccccatacctctttcctcttatcacgcttttttttaacctcatggaatggatctgcagagtcataaacaattttttgcattagcacataagattgtatagaaaaacacaacaaaaaaaaacttaaaacatatcctagcaaccatctctaaattacatggtacacaagcaggttacatgaagcactcgaaaagcctgatgcaataccacatctccaaagaatcctattttcataacaatttgttttggtaagatgatgaaaatgtggatttctaagcactagattcatctacaacgcagcagtctttgtttagaactcatacctagcaaaagtattattcctagacaaaccactcagaaaaattctagttagaagctaattctctttgtttcacacatcactagtgtaagtaattgattcccgtatattccaaatcaattcgtgaacctttttttgtgaaaaggaggttacaacacaatatcacataaacaactagagacagcttaaaacttaataggcgaagaaaccgatgatagtgaattcagataaaatctgaaaaaaaaaaatcaaagagcagagaaatcagatgctaaaacctaagttacaggagaaaaccccaaatcgaaaaatacaatctcgatccaatcaaagaagagaaattaggtaaagaaaaaagtgcagagaaggtcgagattataccctgaagaagtaagcgttgagcggtctcatcaggatccatgttacattcatgaagcattgcgataatctcatcctcgctatagttcccagcagtggtctccttaatgttctgaatcatcttccgagtagtagccgaaatcgaaaccctagcgccactgccgaccatcctctcttctatcaaacgtaaaatctcgcttctgatattttaacaggaatcgaaatctggacctagaccaaaagaggtctgagtacctatatatgtatacgaagaggcgagtgataaatcagtacgagaggatgggatttgaaactagtttgggtcgacgaaggagaagaagaaagaagaaggaacaagaaaaaaaaaaaaaaaagaggaagggggcgagagaaaggaatgagcaaaataatacgcactgtgattttggaagcgtagggctctcttttcttttttcaattttgttttgcattcctttgtagctttttaatattgagtttttttgtttgttttaatctgaatctttggtaaataatgataaccaaattgttgtcacaatctttttttgtccacaaatatatttaaattaggatttaggatatcttctgaatatttacactacataataatgacaaacataaaacatagtatttaagaaaataagaagaagataagttttgattgtaacttgatcatattaaatctcaactatctcaaacgatgttacccatatcattatgagatgagcgatttaatgattagcatattattatttatatttttacatctcagtaacgtattattgttttctatgtaaatatttaaattatcaaataattataatacgttattattatccccaccatgataattacatatatatttaatttactgaataagtttattttttttgtctttggtaatttcttttacaataccaaattaaaatattttaaaaattggatttcaaaaacataatgagttatatggttgtccaaatatttaccaggtccagtacgcttttagcattattaatagcaattagcaactctagggattgtcatttacataaacaaatcttcaattttttcattaattttcctgtgttttgggtccctattgcttctaaattctaataaaccgtccagatattgctgttatggaaacaatttttcaataaatctcatcaactgattctatcaaaatctaatcactaggctttttcccattagcattagcgcataacaaagttttgaatattaatatcattatccataggcagcttagattttttttccttagcatcaaattaaactcaaaaccgaaccaaaccgtaaatccacaaactaattttggttcgaatttaaaaacattatcttttaattttgtcatgccccctctgctaagtgcaaccattcgtcttctcgcttcatcgttttctcttttccg

SEQ ID NO: 9943 - DNA, 3000 bp, Unknown
  misc_feature (1)..( 3000): cDNA_ID_2186609_gDNA_ID_2096294_Annot_ID_195488 3000 nt of promoter + ATG
catctctctctctttgtgggaaaattttcactccatctgcttatagtttgctttgtcaattatctaattgtaggaaagtggatcaatggatttggacataacatctccaaaacagttgaaccgaaaagcgtttctgaaacagctagctgtagacttgtccactagtgagcgcaggatactgtaccgtgctcaatacgtaaggaacaactttctagccaatacgatagataagagtctgtggatcgatccatgatattgtggaatctgtgtttttttttttgttttgtttgggtcagattctgaggaggagactgagagatatcagaagtggtgagctgaaggctctacggctcttcagtggacttaggaacttcttcaagtgaatgttgaatgaggacatttcaacagctttaagatggatcaaaggtaggcctcgttgtgcttcaaccaaaaatgtagttttttattacaaaaaaattgaacgttggtgtaggcatggttggatctgtctcactcgtataggaatatattggtccagccatatatgtaatttgatcattttctataaactcaaaacctgaacctaaattgattaattaaggaaacgcatgagagagtaagggtagaaacatgttcttcgtatttgatccgaatcgaactgaaataatcgatccaacaaacaaagataatttgaaaattaagaatatatctgactacaactcataacgaaaaccgtaccaaaactcacactccttgttaccgcaaacaagataatctgatggtacacgtcagaacatttgtttctttagcaaagcaagtaaacattccactgtggcaaagtaaaaaacgagaaacctataaagtcttcctaatgaaacgtactgattttatggagtttccattttcgacataatatgacgtggcaatatctaaatggtttaaagatgttttatctccaatgatataacgccacgtaagcccgctgaccaaataacccaaagagtaagcaagcgacgtcgtttatagtttgatgatcttgtcgggtaacgaaactgccccttgagtcaaaacaggcttcttcgtgtccgattctgaacgagctcgctctttctcatccaattctctccaccgtcttctactccgatcaatcttcaaattttcttaacactcatcgaccagatcgagtttccatcgatctaatcaatcaatcatcagatttgatcttctcaagaaggtaaatccctctcactctctgtgtcaaacctaatcacctcgtaggaatcgaaattggaacaattcaatttggtttggtttggaatctctagtcgattcttcttctaaacgattgaattgcgttttgtgctttgatataattcgaaattattgtggcagatgagcttgaagggtacgatcgtattactagggctcttatggagcttccaggctacgttagggattagattcgtgatagaccgtgaagaatgtttctcccacaaggctgaatatgaaggtgatacgcttcatgtctctttcgtcgtcatcaagtctgactctcaatggcattttaacgaggatggtgtagatcttgtggtatgactttttttcttctaattgaacttttctacattctacattgcaaaatcgtcgaaaatcaatagaattggtattcctaaacaatgcttaggatttccattgttaatgttggtagataatttgaagtatgtattgataaagaatttggttactctttaaagctgttatattgtaccatctggttaatttggtggttgttgttgttgttgatatattttggatgcattttgaatagatacatggcccaacaggcgaacaaattcatgacttcagggagcagataagcgcaaagcatgattttgttgtccaaaaaaaaggggtttacagattctgtttcacaaacaagtctccttatcatgaaaccattgacttcgatgtacagcttggtcactttgcatactacgatcaacacgcaaaggacggtaaggattatctgtttagttttgtttcagtttcgtttggtgatgaggtatttagctgaagatggtttttgtgcagagcatttcactcccttgatggagcaaatatcaaagttagaggaggctctttacaacatccaatttgaacaacattggttagaagctcagaccgatcgtcaagctatcggtaacattttttcctctaaaaaccacatttgttgttctcacttcaatattgagtgatggtttgaatatggttgttccttgtgcagtgaacgagaacatgagcaaaagagcagtacacaaagctttgttcgagtcgtttgcactgattggggcaagttttctccaagtttatcttctgcgtcgcttgtttgaacgcaaactcggcatgtctcgtgtctaaaagtatcgagtttattatgactttgaacttattttgccttaaaatgtaccagggaatctttacttaaaacctttttacagacagatcgtagttcattggaagatttgctttctcccatgttcaagaactaatcctctcgtgatgataattcttttttttctctttattaacagacaacttttccacaagctaggttttcatttcaatagagaaaatagtgattccttaaaaccttttttccctaaaacaaagagaataacaatgtgatcaagctttgaataagacgtgtcaaaagtactcaaaatcccttaactggattcgaactcttatagagaaggttataaaagtggacactagactaagttagttgggcccagagtagatagataaagccagctatcattttcttagtcgtcgtacaagttacctgaaaataaaataaaaacacaaactttcctgaaaaagtcgtctccagttttaagcattgataaatccgacaagaagtccgattttgttccatagcttgcttgtgtttttagtggattgagtcactgaaagagaaatcataaggctttgttgatg

SEQ ID NO: 9944 - DNA, 3000 bp, Unknown
  misc_feature (1)..( 3000): cDNA_ID_2186592_gDNA_ID_2096294_Annot_ID_195485 3000 nt of promoter + ATG
cagctgaataacgagtttgtgttgttgttgtcatcacaggtgatccatgaaacaggggagctcgtggctagttggacaggactgtctttctcaagagacagaatcaagtggagcgcatcaaagacatcaaaagaagaagaaagtccgtggcgtgctctttatggctaatcttcacaggtcaggtctttttcatggcccaacactgctacagtctttgcttggacctgcagtaaatttccctattgtagtagtacccttttgttaaaattcttatgctcagcagaaccaaatccacgtcactctgctttttctaggatatttatttatgaaagaaacagtttctttttttttgggctgacttggttcaaccaaatcttaaactctcagaagcattttgatttaaaggtacatatatttggtcaactcatgggaggatcataacataggagtgggattacttaatataatacaaatgattagagttatgattggtgggagaggcataaaaaaagagagattaaaattggtgtgaagtccataaaaggcactcatgaagtatagtaatagagatagttaatgttatcttaagagaaaataagtgaggtgtcgtcagctctgctaactgctaagccggttgtttaataataggatattgatgaagaagaaggaatacgatgttttgtaccaaagtttttcggatcgtccgagaatcttatcctactgacatttcagcatcatatgttattttttttgtttgttgtttttatatatcttgttcgatctttttagtgcgtcttatcgtcgccttttcgctttcattatcatttgattagatgactactattcacttatttgccaggcagatttgttaatattttaaccaattagggtctttgatcattcgtctttgattggatacatacgagtctggataaagagcaattcattttgatgttttcttaattgagaacgaaacacaatattaactcaccattaactaatactatattatatgagtttaaaaattaacacttgctcaatttcaaaaacaatagttttctgattaacaatgcatcatttcaattcgacttctcatcttgtaattataaactttgaactgaagttatgatcaattatttagtggtactaaatcgtatattcaataggaacttaaattgtaaacatgtgaaaacagtcagacacttaaaaaaatggaggtggggtttcatccaagacttaaccatcattctttcatatttggtctatcatgttttgcttttttatattactcaatttaataaatcgatatcgagtacccaagaaatcgaaataaagaaatgggtttaagtaaaccggtgaacaatattaatatgaggaaagaaaaaggacaaaagagagatctatcatattgatttcattatttttcagcgactttatgattattatttttatgaagaatattggggcaaaggctagtagtacgtagacgtagtgtgaaatatctttctggtctgaaagagttatacagacgtatctaacttggcagatattttttggttttcattcagttctctctcccctcaatgataaatatcattaatttattttatttgttctaccaaaagaagatatttttgttatatacgcccaccgaaaaatgaagaagaagaagatatttttggcttttgtaaggtcaaagcaaacagatttatcaattattattattattatctgagactgagagagagagagagagggagattttctgaattctgattcgtcgaaaagcatcaaaaaagtgaacgcttgagaatccattatggcacaaactagccacttggtaacttccacgtcgcgagtagattatcttcaatactcgcatgcgcgtgagtaaaaaacatacaacctttttttcttttctttctaatagtaatatctttaagaaatatccataaaaattttattgctttcactataaatacgagagggacccacaataccctacacgaacttttttgcactttttcgtctttttaattaataaaaaaaagaaagagaaggaaggaaattaggcacttttgataaatcagattatgtcagaagcgcctacatgtccctttgcggacacacccacccattgtctatccattcatttttttttttcatttcttcctccagagagagagagagaagccacaacaagaagaagaagaagaagaagaagaagaagaagttctggaatagtcatcatcttctctgtttctaggctttgtttatttgtctctaaagtttctggattcaacttctgaagaagatagtagtagtccacaagaaggatcttctttacgtgagttgtttgtttctcttctccctctgtcttttcttttctgattttaataatcccaagtgtgttcttattttcttgctatctgttgtataattggtgttagtgattgattattcattgtatatcgatgaagggttggttttgatttttgttgaattggatcttttgatttggggttttaaaacttgttcggatgatgatgattgggattgatccaaaagttttcgttatttattggaaattcagattttttcgattcagttccatttgaactagtaagtcaaacaaaatctctagatttactgatctggggtttatactttgaagcttgagttgttgttgttttattaatttatttcgattttcagtaatatccatttgtaggttttggtctctgactcttgtttataataaaagctctgtattgagtaaaatctcatgaaagtaggtttcctttcccttttttatccttctcctttggttattaatctcctacaacctttttttagaaattactacctatattcagaaagattccatctatttcttcttcaaggcttgcttttttgaaccaaaagtctctctctttttcatctaataatttgtttacttttttggacagcagaaagttgatttggtcagagccaaggaag

SEQ ID NO: 9945 - DNA, 3000 bp, Unknown
  misc_feature (1)..( 3000): cDNA_ID_2186574_gDNA_ID_2096294_Annot_ID_195480 3000 nt of promoter + ATG
gaagctcgtcaggtactgtttcgttctcagttcttcttttctttagaaaattcatgttgttcttaatcttagttagctcctggcatggaatccattcccaatattgagcctgagctgatttgtgttatatggttttgattggatcgagtaggtttttgatgaagttaaacaatgaaactgtgtctatcgagctgaagaatgggactgtggtccatggaaccatcactggtaagttcttattgttagcttccggtttctttgtagctcttctcatcttttcttctctctcgatttctccgttgctaggtcttatacaagtcgcgatctgttcccttattttcaattggccctaatcgcgtccttgtgatcacatgaataggttgagtaaacacacagttagagccagtagtcataaaggtatatttattgaagtttaagcttgatgatttgggcaggtgttgatgtgagcatgaacactcacttgaagacagtgaagatgagcctgaaggggaaaaacccagtaacacttgatcatcttagcttgaggggtaataatattcgctactacattcttcctgatagcttgaacctcgagactttacttgtggaagacactcctagagttaaacctaagaagcctgttgctggtactgcttcattcatttttggtgtttgtaatattcgtcttcataagctaaaagacttctttatcagtccatttattcgttctctctttctttcttctttagggaaagctgttggacgcggtcgcggacgtggccgtgggcgtggtcgcggcagaggtcgttagatgtagcagcgctctggaacatgttgaaggtttgtgagtttaatttttaggagaatgtacgagttatgtaactagcaactctggcaaaggaaagatttgattgagaaatagtatgattgatgctctagtaaggagttactttgtaatggaattccatggataacaagatttggctttacatgttataagagcatctacaagtagagaatttgtgtgatactgatagctcaagactttttattcatttaacaaatctgactatcaaattgcattaacatgttgacaatcttagtatagaaaaactgctatctcctccgttaatcttccacatgaaacctatctcacatgatcctgcaattgggatcttgattgtaaacgggttccccgatctgattgtagggatcacacgggtagggataggaagatggcacaccatatccatcatgaggccatggttgataacatggctcaggtttttgccatggttgacaacatggctcaggtttcttctcttcaggtttcttctcttcgggtttcttctcttcgggtttcttttcttcttctggctttttgtcaccatccttaggtggttcaactttagctacgctaacaagctccgcaaatgcaacttttttcctgagtgtgttgattagagcaatcatatcgacttcaacaccggtcacctcaatctggttcctgtgatctccctttatttccacagcgttcacgcctataaaccaatgcgataaatctttagattcaacaagaattacaatcatcaagttctctagtgtttgtatcattgttacctttaaactgaaccgcagttttcattgcctttgctcgagttgtgtcatcagtcatagcaattcttatcaggatcttttgctgagtacaataagagaactccttaacatcacaaagagaagtctctctctttcacaagagaatcgaagttattacttgttgttgagtacacaggagacataccttcatgttattgtcttctgagaatccgcgtgatttgtttgatgggagtttgctccgaacttttttgtgtcttcttcgatcacaaattagaggaaatataaataaggatcgattttatatattcatttgttccatgagtcgttgtctcacacaacggaatccgatagtttgaatatcgttgtcaggttcatatcttcggtccttacgtgttttattggttctagttgccgattcgtacgagcttattaccaattttttaattttaaaaagcctaacaaaaatctttatttgattgagtcaaaaaattagatgaaatagttatttgactgggtcaaaataaattgattaaataatggtaaacaacacaaataatatttgtttactacaccgttgcctggtagttttagacatgtatggcaaaagacttaataatttttgagtcgatatgtcaattatgatgattaataagttttgtttgttcatcatccagttgtgcataacaatgaatagaacagatgcgttaaaagtcttggtcttctctagagtacatgtttccctctaacttccttctcaataaaaaaaaagattaacttgactactaatctgtcatccatctgtattaacaaatgttatatgcttgacttgcaatacgtactttcgcaatcatattgcagttttctaacgtaatgaaacaataagcttttagtttatactaatgtgtgttgtctaatgctaatttgactttaatttcttaacacattacacattgatgatgccaattgcagtgatatcagcaacttgcaaccgtttgatccaatgatatatcataggtaattaggtatcatatctcatggagataaacgggtaaataaatataatcttatttgctaaataaaaaataatcaagtttaagttttaacatcttcatatacaatctggtttctgtgatctccctgtattagcaaaaaaaaaacatgatttaaaaaagaatttggaaagaaaagaaaagagcgggaaataaatccaaagatttgaccaagttaaaccaaaacttttttactatctgagaaaaccattcagtttccccaaaataaaataaaaaatcagccttaaatcccgtgtctagggttttctttcgtagctgattgggggctgcaagagtttcgccgaggacgattgagaattttgattttcgaaaa

SEQ ID NO: 9946 - DNA, 3000 bp, Unknown; identical to SEQ ID NO: 9920
  misc_feature (1)..( 3000): cDNA_ID_3034913_gDNA_ID_2096295_Annot_ID_195514 3000 nt of promoter + ATG

SEQ ID NO: 9947 - DNA, 3000 bp, Unknown
  misc_feature (1)..( 3000): cDNA_ID_3034901_gDNA_ID_2096295_Annot_ID_195517 3000 nt of promoter + ATG
attctctaacttgatctcctcctcttagattactcacccgtcatcataagccaataaaaagcaaaatgcataagaattaccaaaagatttgaatttgagaacaacctcggattgtggagaggacccactttgttgacgaacaaagggacatgatcgccggcattataatggttcgacgagcctgatccgattccgatccagaaggtcaatgcaagtaggacttgtagtacagtaagcagaaattgcgccatgaattggcactcttcttctgctgggttccaaaagaaacgaatcaatatgtgcaacaagaagagctccagaagcagtcatcttctaaaatcttaatctaacaacagctcaagaagaaaaaaattccatagctagagagaacacaaagtcacaagacgacgtcgtagaggcacaaagtcaaacctgaatggcttaagccgaactgagtggttttgactagaccatcatcagaaaagtctccaagacggtagtcggatgttagatcgctcaagtaatttttggttttgttggtctcacgttttcagctgcccatttgatttcagtttgggcttttccttatctctaaaggcccaatttcatttaggtttagtttatttgatcattatccttactataaaggcttcgcctttcgagaaatttagggtttcttctgtctgtctcgtcactcaggtttgtgcctcaacgactgcttcacttctagcttgattcttcttcttcgtttatatgtatactgtacattagattattcttgtttctcgagcttctgctatagattttgattcttttttttgttgtctttgtttcgtttccaggatcagatcttagctaaattgagacaagctcaaaatgaggtacttgacgcatctcttacattcactgtttaattagagaacaatacgtctctgaatcgtgattcagagacgtattgttcttctgtcatatgcaataagtttaattagagaacaatacgtctctgaatcgtgattgttttttggatgtgcgttattgatagctttatgatgttaatagtctaggattgacacgaagttgttctgcagttttgcataaatgctctttactaaggcctctaaatttggatgacaaatctaaatcttgcctcataaaaatttaggtgtattaagataagattattttgtatggtagtgtctataatgtgggttgttcatgttgaggttgtcaatgttgtgtatttttgtttgtttagttaatttgcttaactctgttctttgtgggttaatacagtaagcttcagagtgaggccgttcgtgaagccatcactactatcacagggaaatccgaggcaaagaaacgtaactttgtcgagactattgagctccagatcggtctgaagaactatgaccctcaaaaggacaagcgtttcagtggatctgtcaagttaccacatatcccccgtcctaaaatgaagatctgcatgctcggagatgcccagcatgttgaagaggtgatatatcttttcatggaaattgatcattttgtgctctgtttcttgtataatggttttgtgctcatttcatttggtggctctattagtttcatttgatgttgtatatgtcttctgaatgtagatgcatgatgttttcggaatttggtcattgtttatttaggcttcatttcttgcataattaaatatttgcttatttcatcttgtatcttttcgtaggctgagaagatggggttggaaaacatggatgttgagtctctaaaaaagcttaacaagaacaagaaactcgtcaagaagcttgcaaagaaataccatgctttcttggcctctgagtctgtcattaagcagattcctcgtcttcttggtcctggtcttaacaaggcaggcaagttctggctacagctaatattccattgttcttctttacatccgttttgattttggataggttttagtagtctatttcttttgtcaatgtctttttgatacaatgccaatcctttatcctgtgagattatgcttctttgatgattcttaagtaacattcctttgctttactttacacaggaaaattcccaactcttgtgagccaccaggaatccttggagtcaaaggtgaatgaaacaaaggcaacagtgaagttccagctgaagaaggttctgtgcatgggagttgcagttggtaacctttcaatggaagagaagcagatctttcagaatgtgcagatgagcgtcaacttcctcgtctcgctattgaagaagaactggcaaaatgtcaggtgtttgtacctcaagagcacaatgggaccaccacaaagaatcttctgagctttcacctacttaaaattggtggctataagacacttcttcttaccctttcgtttttgtttcagacatatctgttaaacagtgtaagagttgtgctgctactctcctctttagcttttggtttggataatttgaaataactgcagtgattttggttaatggattttgtagcttatattatctttgaattagatgtgcttatttcaaagacgaatcaatccacagatgtgaataaaaacagaaattttcgttttcaatttgaaaattgtcctcgtggactgttccataaccaaattctattgactatgcagtaattgatctttgaattaaaaggatcaacccactgattatactccaattgaataaatattcttctttaatgttgtttataatctcttaagcaagctctaatgatgtatttttgaagcaaactctaatgcttttatggtcagtatatttattctcttaagttttataactaaattaccatttttttttgccaaagcagacaacaaaatagcgaagtgcgttccaaaagttagcgttttcgtctccgtccccaaatctctcagctaccttaaatcagaattctagggttcttccgattagggtaaaatcgaatccagatttcccaaaattctgatctttgatttataaaag

SEQ ID NO: 9948 - DNA, 3000 bp, Unknown
  misc_feature (1)..( 3000): cDNA_ID_3034895_gDNA_ID_2096295_Annot_ID_195520 3000 nt of promoter + ATG
gtggctttttgtgctgtttatgtgacgcggtttgcttctttgctgtcactttctttgaagacttaagcccattggcaagatcaaacgagctcagatcatctagcacatcatcaataccaggaacttgctcgttttctgtctcatctcctactgcagagtcatcggactctgaaccttcgagaatatcctccagttcttgagtgtcttctatgtccggttcatcagcttggggcattccaggtggcattgcataatgtggcagcttacctccaatgtaatctttcagaatcagccttgcagctttcgtttcatccggtagtccactcgaggcaacatagccacgagaagcacagtaactttttaagagctctgcagcatgaggcgggcgggactgacgctcataggttttgggtttaggaagagaaatgttgtacacactctcaattacacggcgagggaccttgtcagccaccacctgaatagcttcacggtgctccgtcatccggtcaatcggaagtacaccagaagcaatcatttcatatcttgagcttgagaacgaagggaagactaaaccagggcaatcgcatagcataagctcatcagagatgatcaaagtctggaaatgctttgtttttcctggggtagaggtgacacctgttcgcttctgacccaccaatgcattgattgtagaactctttccaacatttgggtacccaacaaatccaaccacggcttgatcacgttgatattcaccagtccatgactgtgatgatacggatgctgctctagaattccttactttgacaatctcttgagcctcaaattgcaaacgactcaacagctcgtctctgccatatatcataatgtctggatcatctgtcttctgcaagttatcgggttgtctccattgctctttcaagactttaccttctagggtagctgtagcagctatggctgaccagaaaacaaacagaatgttgttaaggcggaaatattctgcccatttctccctacaagtcaaaagttaaaccaatcggttagaatacaaaaaaggttggaggcaaagtattaaggcacaagaggattggctaacctgacatcagtaggtaaaagatccgccttgttcactagaagcattatttttttatgctcatcaatttcttgagcatatgcctgtgtcacgatgaatcttcaagtaaatatgaatcaggaatacggtgccaagtggagtttcaagctgggagaaaatgcattacctcaagatcagggcagcggtaaaacagtggatctctagcatcaactaccataacaatctgaaaaaaggacaagtataagtaatcaaaactgttttgcaattaactaaaacgcagaaattgaacttattgagaaggttaatacattattgacaaagacttaccaaatcactgcgttcaagcactctccaaagctgtctccagatgtcaaggttcttttcgaatggagtcaacactagcttttcattttcctcaaggctaaaccaaaatacaggagaacatgtaagcatgcgtaacacctataaacttcccaatccaaaagattgattagggtcaaacatctataaactctagtttggtttatatacgaaagatatcttgaacacaactcgattctataaaagttccggctttagcaaacactatcctacatgagataaacttatacacagcacattataccaataacaacaaaactgagattttcagtttccacaacaaaactgggaaatggatacaagaatgagatcttctcagcttatcccatttcgaccttctcagtacgatacaaaggtagaatatttgctcaaaatacatgcattttatcaactacagcatcagcttttaccatttgaacaaaactatgtgacagaagctgcctaaattttatcatcaccaacaaacaatttggtgacagatattgatttgtttataacacaccgaagaagtaaaattaagatggggtagaacaaaaaaagctaacctcacaagcatccggcgccaatttagaaaagcttgtttttcattagcatcaagttcttccactgacatttcaggtgtccacggaggtctggagatgaagatagacaaaaaaaaacgttgtcttagagctatgatagaaaggaagaataaagctaaagagaataaaaaccacataccttcgaggtacttgaagactactggcgtgtaaagcctcctctatcttctgttgctctctccattcttcagctgctataacacttgagctagaatttgtgtctctgtttcaccaaaaacattagagaaacagcacaccataagaacatcaagaggacatgtaattgttctttaatctcattaccatattaaatttatacaaacagaaccacaaatacctaatcaatcaaaggacaataaaaaagaggaatttagaagaagagaagcatacagattgatagacaaaggtgtggaggagctgtgattaatggtgtaaagacgctctgcctcctcagcttgctcaatgatggcgtcgatgtcactgacctcagtcacagattcgagaactttcttctgtagattcttgtagtacttgcctttgtctttggattcttgtatcatatggttgtggtgcttcacgagtgatcgccccaacgacgtcttttcgctcttccccatctctctgttctcaagtaaaccctaaaagtctctaaacccttaaaaatggattcgcggcgcgtttgttatgttgcttcaaaagtgttagggtaaagaaaacgtcagccgccgactacactcgctgcacggagaagctaaatttttttatcaaagcgattttttttactttttattttcttcaaagtaaatactaatttttagttaaacttaagggaaattaaaaatcataacataacccatcattagactcagaggacacgaaggctttagaaaacaaaaggaacaacctttttcccggcaaatgcttccgatg

SEQ ID NO: 9949 - DNA, 3000 bp, Unknown
  misc_feature (1)..( 3000): cDNA_ID_3034887_gDNA_ID_2096295_Annot_ID_195522 3000 nt of promoter + ATG
ggcgccggatgcttgtgaggttagctttttttgttctaccccatcttaattttacttcttcggtgtgttataaacaaatcaatatctgtcaccaaattgtttgttggtgatgataaaatttaggcagcttctgtcacatagttttgttcaaatggtaaaagctgatgctgtagttgataaaatgcatgtattttgagcaaatattctacctttgtatcgtactgagaaggtcgaaatgggataagctgagaagatctcattcttgtatccatttcccagttttgttgtggaaactgaaaatctcagttttgttgttattggtataatgtgctgtgtataagtttatctcatgtaggatagtgtttgctaaagccggaacttttatagaatcgagttgtgttcaagatatctttcgtatataaaccaaactagagtttatagatgtttgaccctaatcaatcttttggattgggaagtttataggtgttacgcatgcttacatgttctcctgtattttggtttagccttgaggaaaatgaaaagctagtgttgactccattcgaaaagaaccttgacatctggagacagctttggagagtgcttgaacgcagtgatttggtaagtctttgtcaataatgtattaaccttctcaataagttcaatttctgcgttttagttaattgcaaaacagttttgattacttatacttgtccttttttcagattgttatggtagttgatgctagagatccactgttttaccgctgccctgatcttgaggtaatgcattttctcccagcttgaaactccacttggcaccgtattcctgattcatatttacttgaagattcatcgtgacacaggcatatgctcaagaaattgatgagcataaaaaaataatgcttctagtgaacaaggcggatcttttacctactgatgtcaggttagccaatcctcttgtgccttaatactttgcctccaaccttttttgtattctaaccgattggtttaacttttgacttgtagggagaaatgggcagaatatttccgccttaacaacattctgtttgttttctggtcagccatagctgctacagctaccctagaaggtaaagtcttgaaagagcaatggagacaacccgataacttgcagaagacagatgatccagacattatgatatatggcagagacgagctgttgagtcgtttgcaatttgaggctcaagagattgtcaaagtaaggaattctagagcagcatccgtatcatcacagtcatggactggtgaatatcaacgtgatcaagccgtggttggatttgttgggtacccaaatgttggaaagagttctacaatcaatgcattggtgggtcagaagcgaacaggtgtcacctctaccccaggaaaaacaaagcatttccagactttgatcatctctgatgagcttatgctatgcgattgccctggtttagtcttcccttcgttctcaagctcaagatatgaaatgattgcttctggtgtacttccgattgaccggatgacggagcaccgtgaagctattcaggtggtggctgacaaggtccctcgccgtgtaattgagagtgtgtacaacatttctcttcctaaacccaaaacctatgagcgtcagtcccgcccgcctcatgctgcagagctcttaaaaagttactgtgcttctcgtggctatgttgcctcgagtggactaccggatgaaacgaaagctgcaaggctgattctgaaagattacattggaggtaagctgccacattatgcaatgccacctggaatgccccaagctgatgaaccggacatagaagacactcaagaactggaggatattctcgaaggttcagagtccgatgactctgcagtaggagatgagacagaaaacgagcaagttcctggtattgatgatgtgctagatgatctgagctcgtttgatcttgccaatgggcttaagtcttcaaagaaagtgacagcaaagaagcaaaccgcgtcacataaacagcacaaaaagccacagaggaaaaaggatcggacttggagggttcaaaacacagaagatggagatggaatgccttctgttaaagttttccagaaaccagctaacacaggtcctcttacgatgcggtgattatcaaattgtagtccatccaagcaaagatggcaaccgaagctacttaaagtttttttttttttttcaaaaaatgtaacagcagttgaacctgtcgcagtagttctcgagtgtcttgatgtttttgtttttatgattaaagtcttattttggggaaaagtagaaaaaagtgacaactcaaatctggtggaaaatggagaattgtttttgccagttggagatacctatcgctttgttttgagaatataatagccataaatagagttttcatgtaactttaaacttttttcttatttggggtttggactcttttgaacaataaatagtgataatgaaactttaaagtttaaacatttcaataaccaattcttgttgctaaatatgtcattaccaaatcgatataaaaccaaagtaaatagaaatgttatagtgatttcggttcgtacgtttggcaatgagttggttcgtgtctctcgttccattggcgtccttgagggttaagactgattaggctttgttgtacttatggagagaggagagagaaacttgagataaacaaaaaaaaaaaattggtttttcctaaatgtgtgaatgtctgcttgctgcatcgttttattaatttccctggaaaataactgtttctgtttgttgtaaacaagcctcgaggatctgaccggtgaatgaaagaaaactagggtttcgattttaccggaatattctccgagagagcggcaagtttaacatcagatatgttgttgatcacagattcgcttttctgcgaattttagctggatcggtctttctttagttagttttttttttttgttttcccacttttgaagctttttgata

SEQ ID NO: 9950 - DNA, 3000 bp, Unknown
  misc_feature (1)..( 3000): cDNA_ID_3034879_gDNA_ID_2096295_Annot_ID_195524 3000 nt of promoter + ATG
taggcatccatggaaacaatatgttgccgttggtgcattactccggcagtgtgcctacaggattgatgccttgaattcatacatcaactcagattttcaggtaatcgctaactttttgttaggtgtttgcatatttaattaaaacaaaatttgaaaatacataaaagaagaaaaactaatatgctattatgctataactatttttgatctaatacaatatatatatctatatatatatatatatatatatttacatgtcgcaaatgcaaacacaaaaataacatcaggttgaaattcttagtctgttaatttgtttatatagtttttttttttagtgtaaacatgtatagtagtatatgtttctggttaacgtgtttctaaccctttgtttatttcttattttttctattagatcccagtggacataaaaaagaaattagaaacaccattaagaagaatgagctcggaatcgggaaactcaatgaaagaaatgtccatttcactaaaacaaatgataaaatcatcttcttctgatatccatgtctcaaactcacaagctgcatgcaaatctctttctactttacttaaatcaggcatcttgaacgatgttgagcctcttcaaatgatctcattgatgacgactgtctccatgctcatagatattgttaacttaaccgaaaagatctcggaatctgtacacgagcttgcatccgctgcaagatttaagaacaagatgaggccgaccgtgctatacgagaagtcggattccggaagcattggtcgtgccatgccaatagattctcatgaagatcatcatgttgtcacagttttacatgacgttgataatgatagatcaaacaatgttgatgattcacgtggagggagttcacaggactcatgtcatcatgttgccataaagattgttgatgataactcaaaccatgaaaaacatgaagatggtgaaatacatgtacatacattaagtaatgggcatcttcagtaagtaattcaactcattatttgaggagcagtcttttgtacccgcaagattatagagacgagaccatcggtatataacatattcgggtatttcattcagatttgaagtttgttacaaatactattgtcgcctttgatcatttttgaactattggtcacacatttaataaagtcttggtcttcgttttcctttgcgttactcttttaaagatttttatatccaactgatcaaaaaatttaaaaatagcatggttttatttttggattatggtgttttagagagctaacctcagtaaataaaagaacatagaccggcgccagataaagacaagtccggcaaaaactctagattgttattttctatgaatataattaattttattccaaacatatatcgtatgaaaaaaaaaatcatttatcattggaggaggcggtgatcaggcgcagtgagaggaggagtcggttaacaaaagtggtcttggccagtgccaaagcgtcattgtaatcgctttcaattctcaaaaccaatacggtaatatgcacaactaatagaatgtttcaggtgacaaattttctcactaaagtcaaactttcatacttgccgatgaagtaacaaacatacagtacgttcaatacattaaggatatatataagaaacaaaagctggaaattgtgtgaatttagctaggttagattatagtataataaagttgccttgtacgattggggtaatggctaatggattccgtacgttgatgccaacttggtattggcaaggctgagtgtgactcggtgcaaaaagcaccagctgctatctaattccgcgttctaaccaatactacattttcatttattattactttttacaatccataaatctctctgctgtggagggttgatataagatccgaaacttctttgttgataaaaaaaaatctaacaatcttccaagttcaaatctcactcaggaaatatgaatgactgaatatttaattagatattatcgaaattgtgattcttgttgacaaaaaaaaacaaatctcataagaagtggtgatgtcagttttcgttgagagaaagagaatttaagtggatatgttcaatatacaaaaaaaaaaaaaaaaaaaaaattggacaatttggtcgaatattaataaggtaggtctaaatattagtgaaagtaacatatgtgaatgcccaaaacggacggatattttactagctttgaaacaaagaaacgatgggacaaaatgacaaattgaatgtctatttatttggagtttgtcatgattattcatgtcaaaaacgcaaactattattaatagactgtttattttattattttcttacactcgccgaaaatgttcagaatcggaaataattagatgtaacgttcctgtaaaaaatgcattgagttttaattttattttattttcttaaagataaaaaatttctgttaaatgaaaaatgaaagagttgtgaattacgtttttttttttaatattgattataaatgtacagctagcaactttaaaaatggttagaaaacaaatgttggatagcactattttatttttacataaagaaaatcttttggacgtggaattttaatagaaatttcggaaataaattaagagaacaatactaaagtatgctactaatagccgcttttaaatatcggataaatcagcaccaaagtagaacttggttacgtaagtactagtctctgcctctaattaaaaatactctgtctccagttaattatatttctcattttcaatttctttaaccctcaacgtacgatatgaagtacaacgcaccactgatttttttcttaaaataataaaataacatttcacgagtcccgaacaggactctctagtctcataatgctcattataaataacgacgatccatccgctcaaaacaacaagtcatctttctacttcttcctctctttctgaaacttatcagaaagttgagtgataatcaaagggtgta

SEQ ID NO: 9951 - DNA, 3000 bp, Unknown
  misc_feature (1)..( 3000): cDNA_ID_3034865_gDNA_ID_2096295_Annot_ID_195528 3000 nt of promoter + ATG
ttgtcaggaattggcatgccgaaaatccatgaatatgaggtttaattttattttcctacaactagacgtcaatgacgtacatacagtcacggagattctcacatgttttctaactgtagattttaatttcttgtgtcatccaggtagagattggtaagtatttgtacgagaaactgtcttccctgcctgatgtgcggatatacggtcccagaccttctgaaagtgttcacaggggtgctctttgttccttcaatgtggagggcttgcacccaactgatttggcaacctttcttgatcagcaggtttgttataattgggagctatctgtcccatcacatactggttttctcttatcttgaacgtattcttttaatatgaggtagtacctcaagtaggataagggcactacctaccacctctttctcttcttagtgggtaatgttaccacttagtggtcaaagcgaatctcagatgcctaccttaggatatcttgtggtagcagcctataattgaggttgatcttctttattccaagatttaggtgaaatctcatgtgtgaacacgagcctggactctgttgataactaggttaaaacaaaacccgtagatcatctaggttacatgatacctgtccaagtacttgatccgagtgattctcatacattagtaatgagttcagctgtaagaagttttaactgatctagattaaacaaattcatcttgatcgttctaatgttaaccgtccacctcaaacccctactttactctctcatcagaatatccatagtgggatgaaaactgaaaacgaatattgtatgttgcagcacggagttgcaataaggtcaggacaccactgcgcacagccactccaccggtatcttggagtgaatgcaagtgcacgcgccagcctctacttttacaacacaaaggatgacgttgacgccttcatcgttgcgctggcagacactgtgagcttcttcaactctttcaaataagtggaacaccttcctgctggatctctcggctggtttgtatggtatattgcttcagaggctacttatttaaatctgctttatatgatcaatgggagtggattttgtttcttcaagtccgaagggcaatttgtgttgtagttagcaatttgtatgaaaaaatagaccgacagtagtcatgaacaatttcaggcctctacttgatcatatttgtacgaatacacacgaaagcaaatgcttcgttgttaatttgtaagtttcataaaaaacaaactcaacatgaagaaaagttactaatatgaatcatcaaaggaaaggtttcgatatgtgctcagttggggtagtcgtcattccctgattcttttgagaccatttggtttctttgaattcattttctcaaatcttcaaaacattcatgaggcatgttgtattattaagacaaggcaaacatgttccaagagtgagaatagaaaaagtttcaaaggcgaaagtctggaaatggatggataatcagcatttcatgttgttcccaagaagatactctggacgagaaagcagcacacgtcttcgttttagattcaggacctttattgagacttacgttcccaccattccatgaacttaacttgggctgccattgtgtccaacttgtagagttgcagtgtgtggttggcgacctcttgcccaaaggtccaaccaaaaacacctcctcctaagaaggacaatgcagcacctgtcgcaccagcagtagtttagaggtgtcaaaagttggaagaaaaataaacagcaatttagtattgagaaacaatgtaagcgccatgagaactgcataaactttcaaaccagtttccaagtattatcaatataggacataaaggtctaattgactcccaaataatcccattatccctgaattgcaagctttgtgtcttcgtttgaagaaacaagtgaggtttataaagagcaaatagttattcacagagagagaaatgtcattaccatgtggactcctggagtatttccaggcaaaagcagcagtagagacagctccaagtgcagctccggtaacaccaaacgtcacagcttccctagccgttttcagctggataggatgaccacaaatacacaatgagtaccaaacgtaagatcttcagtaagaataccaaataccaaaccaacagttcagtttttgctaggttttttatgccatccgacgacgatgcagtgggcttagtcctcttgtatctgtgcttccaaggactaaagccagaaaaacctagcctagtggaactttattatatcaaaaagtaacagaaactttccaatggaaaatcaaatgaagaagaaaaaaataaaccgatgacagcagagtaaaatcgagtaccagccgagtcatagataatggaccaacaatatctatagattccaaaacacagagcgagagaaagatagaaggaaattacggtgggtccatgaacgggatcggaggcaatgaattcctcgacgtcggaggaagaccaagaaggaagaggcgcgtcgcgtttggtgaatctggtgtaattttcgaaaaatgataacctatcactccagaaatccttcaatccattccaatttttcccaacaaatgactccgaatctcccatctttctcagatcgattaatcaatctccttctcactgcaaactttttctctgattgaagacgattattatttgcagaataaataaaactggtctaccgaaaaaatggaaggtcgatccggttcacccggttttcatgtttctttttttaatttaataccgggttgccatcagattagccgatttgcaattgctccttgacttttcttaatatatcgaaaaagagcagcaattgagaaaagttttaaattttcaaccagaaaagtgtactctactgcaactacttcttctctacttctctaccttaaaacttccccaaccattttcttcttcaaatcatcatcatcatccctcgtacaaagaaaatg

SEQ ID NO: 9952 - DNA, 3000 bp, Unknown
  misc_feature (1)..( 3000): cDNA_ID_3034862_gDNA_ID_2096295_Annot_ID_195530 3000 nt of promoter + ATG
aaaaagaaaacacaacaacaatggctcatttgaatccccttgtaactatatctgctactaccaccttgcttgcttgcaaccaccaccaccaccaccaccatttcatgtcctcctcctcacaaaagtttcggccaccaaccctttgtatatttctttttttggttcttcttctttttttattcgatggagatttattatatttatttaatctttctatttatttttttgcttaatgggaaatgggtgtcgtgtatcattacgaattctgatgttatgtaacccatgtgccagcggaagacaaaggcatcaactctctcttatcctaaatttattgtactttgttgagttttgtagttgtttccagctaaacaagcacgtggacgatccttgtaatgaatttgtatgaatgtgatgccttgtacctgtaaatttgattgaaaggctatttaataaacacgaacaaccaaaacggtttgtccaaacaataaagccatcgcatattggaatccggaaagtaaaatctaaaagcaagattgagtaactaaatccggaaagagacgatgaagtgaaagcaaaagaaaatactacttgatagaaaaagggctccattggatcccattggagaggagattacacttatttaaaagaaaatatttgcgtgaaatgaaagcaaatgatgataaagacagtttttgagaacataaataaagttaagatagtgcatgaatattggaagttgctaggtcattctccatggataatgaattataaaatgattcttgacttgaccacaaataaatagtcccttcttttggagtttcttgactagcgaaaatgtggtcaaacatgatagacaattagacatcacatcctgaatggaatccataatctcttgagttaacatgttaatgcatccttaagctttttagcacagtttctatgtcaactcatgtaatgatcattttgattaaccatgttgttgacgatgttctcatcatttcctttcttgtgataatgatttgacgacctttaaattggttaaaattgttgttgacagtattttttgtatataattaatgtaaaagtaaaatccccgtgattggaaattctagaatatgtcaaattatttaagttctttgatacaatacaccttttaaaaacttttgtaataaaagtggttggaaaaaacaatttagataacggatgaacattaattaatcaactttatagatttgtcatttgtgactacaaatattgtagatacaatgaattagtccatcaaatcagattagtatgtataacctaataatctgtagtggagtcggtattgtgtcacctactagatttatatccgtcataatgcatattgttgttgatacaattagatcataaaaacaaaaattgcagttctacgttgaagcatctcggagaacaagtgatactcaactttgagacatcaaaatccgaagtaaaaaactgaacataatacaaactatattcgataaaaaaaggataactcatgatctttactctttttttctttattccctcactgctttaaaatttccactaatactcttttgtttctttgattattattatcctagttatgaaaaagaagaaaacagaatgcatatacatacaaatatgaaagaatatttgattaaaatgatgcaaagagccccataaagacaaaacaaaacaaactagtttttgttgtggaagaagaactttttttactatgaacctctttatcatcatcagcactttcaatatctttaggatgatcgaaattggccgggacgatggtatcaggagcaacttcatcatcaccggactgagaggattcgctaggtccaggtgcagcagcatcatctggtgatgatgaatctggtaagccctgaccatgtgttacattgatcataaaatgctgaccgaatttacattgttcgccatcatagtttcccgagaagaaataattggaaccttctttaacaagaggaacacttattgagacgggaacaggagatgttgctgaaggatttgcagccgaccactctgttgtatcattgttttcattgttgtcgtaatcacaatctttgtatgttttgaaatcatatgtctgaaccaccgaatggttgctatctgtgttgaatactacatattgaaaacaaaacaaacgatataacattttgctaagttattgtagtaacgaaaatggggttgaagaaaaaaatcttactgaggaaatcacccaaagaaaaggatttggaatcggcccatttctgataattagcagagggtctctcttgaatatcgaaccatcccgtggactctcccacagtgtagttcttgtacgcatcagctgataaactcagaagcataaggcacatgatgagtaacacattgacacaagatgaacaagaaggcgacataattcttcttactctcttgtccgtttttcttgattataaattgtgattcgttgattgatctttctttgtaataaagaaaggcataagaaactgtacataaagtaataatgagctcgtcattgactgcatataaaaccaagacatgtgtgagtgtgacatgtggacaattcttggggatgcgaaggaacatgagacgatacgaagtggtcggtccaatcaaatgacaacgcctctttgctcttccccatgtgatctctcactctcacaccttacttttgctgtcttcgcttccctacgtatcattacttctttcataaatatctgtcaactgcctttttctactaaatggaggatattttagataacgtgttttgtagtgtttcaaagtcggttgaaccggtatttaaccggtttgattggaccttaaaaaccaagggcccatttaatggagtaaaaggcctaattcggcccatatctttagatgaaattaatcttttgaccgccgcctgtggtcgaacttgtgactttgaagactcactcttgttcattcgtcttctccaccatg

SEQ ID NO: 9953 - DNA, 3000 bp, Unknown
  misc_feature (1)..( 3000): cDNA_ID_2990070_gDNA_ID_2096295_Annot_ID_195529 3000 nt of promoter + ATG
aagaatgtattagttagttagatataattagttatatataaattgccaaatcaagtccataacaaattagaaacgtggatacacagctttatccttaattttgtttttgttttaattagcttacatgattgcatgtgacacataaatgacaaaaaacaaatttgacataaaccatactttaaaaataataaaattatgtattaatgatgttattggtttaactgatttttattttagaagtctacactttaaagtttaatccctacctccaacatctttaatcctaacaatcctatgaaattgtatatgcttaagcagttaaccctaacactgtgtacccttacgctaatttaaaagattctatgaaagtacttctaattttatattatttttagcaatagaatttcataacattaatttctatgctttataaacatgtttaattctagatatggtataactatatttcttaaattgttaccctaaagtcgtataaatgtgtgtaaaaaaaaaagtcgtataaatggtgaacaattaaattgcaaagatgaaagaacacaaattattcacgtggccagcccagcccagtaattgatagatttgttgtttaagcccagcaattagtatcgaatcgaaccaatattctgaaccgaatacatcatggttacacgaccgacacctataaggttgtcttctttgatgatcaaacctaaagtccgaaaaagaaaaaaaagaaaaaaaacccgaaaaactttagctcattgaaagactaattgactaaagacatggcaaaaaggatactgtatttagtaattgtttgtgtttgaattgattacgtcaaatatagtttgataacgagatgcatattgcaatcccatagccaaactagaaatatacaaatttgaatagaaaaagaaacgaactaaggcaagtcatatacggcaatgaaggacatcaatacacttcccatccaaagcttcccatctttctcctccacttcactcactgccttcaccactttccctttactatcttccaacacctttagcactttcccttcttcactgtacttcacagctacagcatgaggccaaccacctacctgcagcaagtactgaaacttcactgatatcggcagcttcagaaagaacttcctcaccctcgggtaatgcgccatcaagtgtgtgaatatgtttctgtggcagtgcaccgccacccagaaatctccatctttgtttgtgcggatgttgtctgggaacccatgtaatagagctaccacttctgacgttccagctttctcccctttcaaccagtatttccgtaatctgaacaacaacaacaaaaaatgacttagattctgttcacagtattggagtttgtttctagcagaatcattgaaacgatatggaaacaacatgctaatcgttccattttagcttcaatcagaaatgctgattgcagaagttatgccaagtatatatacagacaatgatgtggaagtcagagaggaattaagatgaaggactcaccttccaatagatccttcacaaaagatgaaaaaggagccgtctttgccgagggataatccgttaggaaactggagatttctcacgagagtggtagtctcctttgtttttggattgtatttcaacaccctcccactgtcttcccccgagacaatcaaaagcataaatttcctacaaatagcgcaatcaacatactcaaacaaaagtagtaactagacatcggaagctcattgcaacttcttgtagatcctcaaaagataaacagaattcaacatttaaggctctgaagttatagccgcagtcaaaattttcaatttatgtgcctatgacagatcatttcaatcaatataacatgagttccaaaaagcaacactttatgcaagccactgatcaggagagttagtaaagatcaaaactttaaaaccttacataccttcgttggaagaaagagctgctatcagtaaagtaaacattgccttcatcatcaatgtcaagatcattggtaaatctcaaaggcacaccatcagcctcgtttgtaacagaagttgctaaacctccttccggaccaactttcattatccccaaatacgcatctgcaatgtacaaatccccatttttcttgtcgaatcgaagacctaaaggccgaccacagatatcttcatcctttaagtaatccaaaagcgatggcttaggatcacatagctctgacctaataaaacatcaaagttgagaactttactggaaacgaaatggtcacaaagactcgattgcaatcacaagactcaccgattgttcgaagtatatgcgaaatctgtccaacgagtgccattccaaaagagaattcgaccgtcggcgactccggtataaggaccacgaccttgcggatcgaaagcaatgctctcgggaccttgaacctcgttaagaaacctgatctctgaattctgcaacagattctggcggtctctctcctttggaagtgacgataacggaggcatgtcaatcttgtaagttttgaaatccgggaacttggaaatggagctgtgactgaagggatcgatagcgcaatagatggcaaagacgagaaagatcttcgcgagtatgctcatggccattttctttgtacgagggatgatgatgatgatttgaagaagaaaatggttggggaagttttaaggtagagaagtagagaagaagtagttgcagtagagtacacttttctggttgaaaatttaaaacttttctcaattgctgctctttttcgatatattaagaaaagtcaaggagcaattgcaaatcggctaatctgatggcaacccggtattaaattaaaaaaagaaacatgaaaaccgggtgaaccggatcgaccttccattttttcggtagaccagttttatttattctgcaaataataatcgtcttcaatcagagaaaaagtttgcagtgagaaggagattgattaatcgatctgagaaag

SEQ ID NO: 9954 - DNA, 3000 bp, Unknown
  misc_feature (1)..( 3000): cDNA_ID_1827487_gDNA_ID_2096295_Annot_ID_195536 3000 nt of promoter + ATG
gaagtccacttgataacttccttgtatttgtaggcgaagtatttagaagctttagcctctgagacacttctcacaagcgatgaagcagtagttgtagcagcagcagctgaagcagtcgcccttgcaagagctgctgtcaaagttgccaaagatgcaacattatttaagaacagtaacaacacgaacctattaacttcgtcaacggccgacaaacgctccaagtgggaccagtttactgagaaggaacgtgctggcatattggggcatctagcggtttcggacaatggaattgtgagtgataaaatcactgcatctgcctctaacaaagagtctattggtgatttagaatcagaaaaacaagaagaagttgagcttctggaggagcaaccttcagtgagtttagctgtgagatctacacgtcaaactgaaaggaaagctcggagggcaaaagggttagagaaaactgcatcaggtattccgtctgtgaagactggttcgagccctaaaaagaaacgtcttgttgcgcaggaagttgatcataatgatcctttgcgttatctaagaatgacaacaagcagttccaagcttctcactgtcagagaagaacatgagctgtcggcaggaatacaggtttgtcaccaatattccaaattctaaactaaccacctccctttttctacatcgcgtctgagacatcacaaacactcacccttcgtaggactctagattctaggcgaaaatgatgtctacaaaatctttagatgtttgagaatgacgaaattagtggttagtggtagaatccaagatcgcttctttgtgctttctagccaatatatcatctgaagttctgtgaaagctaattatcctgacatgcttgtcttaaattgaattgtcaccttttttgttcttattatgtagccattcaccaactgtttagtgttgatagaaaatgggaaacgtatgttcagctttggaagaatcaacattacttgtgaacgttatttcttcttctctgtaatttttcttatctttctttattgtggttttgatcacacactttggtttctttgtttaggaccttctgaagttagaaagacttcaaacagagcttacagagcgtagtggacgtcagccaacctttgcgcagtgggcttctgctgctggagtcgatcagaaatcattaaggcaacgtatacatcatggcacactatgcaaagacaaaatgatcaaaagcaacattcgactcgttatttcgattgcaaagaattatcaaggagctgggatgaacctccaagatcttgtccaggtttgagcttttctctccttatttttttttgtaataacacatctgtaagcagtagtgatgaaagtgatagatattgaacaccttgctcaaatattttcgaaatggtcacaggaagggtgcagagggcttgtgaggggagcagagaagtttgatgctacaaagggttttaaattttcgacttacgcgcattggtggatcaagcaagctgtgcggaagtctctctctgatcagtccagaatgataagattgcctgtaagttatcccaaatgtttttcttttttacttgtttaaacaaaaggtttgggattatgcctcaaattttaagggatgattggcagtttcacatggtggaagcaacatatagggtgaaagaggcacgaaagcaactgtacagtgaaaccggtaagcacccaaagaacgaagaaattgcagaggcaacagggctgtcgatgaagagactcatggcggttctactctctcctaaacctccgaggtcgctagaccagaaaatcggaatgaatcaaaacctcaaaccttcggttggtaccacctgacacaacacacaccatacaacatagacttgttgtttgtctaaaaatagtaaataatatgagatgggtttgtaatgtaaaaatatgcaggaagtgatagcagatccagaagcagtaacgtcagaagatatactgataaaggaattcatgaggcaggacttggacaaagtgttggactcgttgggtacaagggagaaacaagtgatacgttggagatttgggatggaggatgggagaatgaagacgttgcaagagataggagagatgatgggagtgagcagggagagagtaagacagatagagtcatctgcattcaggaaactaaagaacaagaagagaaacaaccatttgcagcaatacttggttgcacaatcataattctttttctcttcaatatggaatgttttgtgcatagaacccacccacctgagcataacaagcagtaaattattactttttagcatttacgattcttgtgacaactactaaatcgaaaaaattattttaaaactaaaaagaaattgttgtctgaaaaacataagtgatatacaacaataaataaatatctcttataagaatttgggaaaaaaaaaatccaaagattagagatatttgggtggagaaaacaaccgcctaggacaaaaaaaaattgtgggtagaggaggaggaggaggctttgttcacacaccacacgacggaacattctcttccgagtcttatccaaagcaaaatcatattttgcttaaatatcttcttctccggctctgtctctgtctctcttcttcccgcggagctttcagtttttgtttggtaacatcgtttctctttctcactaactctgatatcatattatcaatttttccttttcaacacccaaaatcacaatctttcagctttattctgtttttccttgcttgagaattgtgttcgattcatgtctacgaactgaaatcacaaattttgccaacgttttatgattcctggttccgtatttttttttttgtaatcaatagttagctcatttcgaataatcaaactcaattttattgttcatgatttgttatctgggataaaagagagtaatgtgctaattatgtatactcaggtattgcttggtgtggggaagattagatagtgtgaaga

SEQ ID NO: 9955 - DNA, 3000 bp, Unknown
  misc_feature (1)..( 3000): cDNA_ID_3075670_gDNA_ID_2096295_Annot_ID_195535 3000 nt of promoter + ATG
gatattatgtaagaaggcagatgcagtgattaaaaatgcgggtgttgtgttgtttaggatgagattctggaagttgctgggaagatatacaaggcagggatgtctcttctagtgattgataccgagaacaagtttgtttcaactggttttgcaaaggagatcgcaagagttgctcaaggttgggtctctgcaattgattttgagatatttttttttgtcatttcaaagcagaaaataatcacattgtgttttgattgttcttcttcctcacaggaaaatattattacttgccaaatgcttcggatgctgtaatctcggccaccactagggatgcactatctgatctgaagaattcttgacctcattttgtctgcaataccttgattctggatcaaagtgtatattctaattgtgcaacacatcagtcactaaacatgaaattataagaaatgaaattttgttttaacatactcttaaaatgaatttccgattttattccgttggtcggtaattgacgactgatatgatgatgcattagtgacagatcactgtttgtattaagaagaagacgatgaagctgcaatattcacaattgatacaagaattaagatagtcggtataatcccggtttgcagtaaaccctactctaatgtctaaaccacatcacaacatcaaatagatggttcggtggtttagttacggcagatacaccggcctgaaccgaataaaagaaaactggacttggctcctggagaagagaagactgtacagctttctgaattccgaaagaaatgaaatctctctgcttcatttctacagctccattgattcgttcgcctccatttctcgatctttctccaacaagcttgaatcgatttacccttaaaattccagcttctctctatgtatctcatccaacaagatgcagcatttcaaacccgtcgagctctgaggaattgttgaattccaatggtggaatgtctagggcatcgattagtgtcttcggaggtacttcccttaacaatctcaagatgcaagtgggcagtccaatttctctgcattcaatcaatccattagcaaagctgagtttgagtgatcaggcatttcttctcttggccttcatcgtttgcacggtaaaaggagtttgctcgtgttttgttttgaccatttttgttgattcattgataaaggtttagactttttgatctcttttgatggtcctctgttacagacttcagtggcttttacaagtcttgtgattacagctattcctacacttgtggtaagtctccacatttgtctcaattcttttgcttcagctatatcctaaccgcatcactaattttaaaactgtttcaagtcattaccaatgaatcaacaaaaatggtcaaaacagatgaacaaagaattgattatttgtaatatgctatcaacaatctgacatataccttttcaaactcagtgagaaactatgacatgatctatgttatgagtgtagtcctctgcttgaaatttctactccacacttgctgttagcaccaactgaaaggataaaaggctaatgagtaacacatgagtacagtcactaacagataaaagattgaactataattgttgaattccacacttgactcttctttatatgtgtcctagatttggttcagctatatgatcatttctatttttggatttggctgaattcaacaaagcttggtggaatttttcagtttaatatgtctgtctctttgttcttggattgatatctattcagtatgtcctatatttacttacacaccttcaggccatgggtagagctgcaacttcctttgcaaagttagctgacacagctcgcaaagaactccctagtacattggcagcggtaaggctctctggcatggaaataagcgatcttactcttgaattgagcgatttaaggttatctctaaagctcttttcttttcttttcttttctggcttttgatcatctcaactctaaaaaaagtgaatgctacatgtttcaaagcaattagttcacaattagttcttccgagtcaccttgttatctgtccggaataagaaactttttctaaatcattattatgcgatgcaaatggtttcagccaagatataacagatgggataaacaaatcagctaaagcggttcaagcagctgaagctggaatcaaacagattggaacacttgcacagcagcaaactctctgtaagcttcttctaagcttttggataatctgtaataaaagctgctgttcatggtggcaacagttcacactggtaaaaaaaaagcggaaaatatgatctgatgatgaacttgatcttgtgattcagcaatgattgaagagagagcaaatttaccagaaatatcactacaacctgttgtggctggtgcagccgaaaagacttctcacgcaatcggcagtgcaaccaagagactaatgaacattataaccggaggaaacaaggatgaagattagacatttagaagttttcacttggagtgtgtttttggtccgtctttgtttgaagggattagtacaaggtaaagtccatttagggaaacagagaatctatgaacaagaagactttttagtaaaatttggtatatttatgaaacctgaagtgtaactgtgtaagacacaaaagaagaaataataacagccacagccattttaagatgtacaacagcagataaaatagtttacataacaagccgacaaaaaaaaaaaactattctattcttacatatgggttgactttgcaaagatggtaatagtgtgattgggattgggccaaagttaataggcccaaaagaagtggaaaattagaagtaatgaatcctttgattgagatagaagctttatcctcttcttcgtcttcatcatccgcgcatcaccagttttttctctctctctacaaatcttcttaacggcctttcatcaatggtcagcagacttagctttcgaatataggctaagaacgagc

SEQ ID NO: 9956 - DNA, 3000 bp, Unknown
  misc_feature (1)..( 3000): cDNA_ID_3034847_gDNA_ID_2096295_Annot_ID_195534 3000 nt of promoter + ATG
tataatttgtagttaactacaaaaatggcagaagaggaaaaggacttccataaacgaagtaaacaaacactaaaaatcttcaacacaccacacacacacacaaaaaaaaaaaaaaaaaaaaaactttttgttattgcgtaaattgtaagataatccagttcggccactgagactattatgtaaatcgtcattgtattcaaagattcaacatttgccaaaagaggtttccgaagttttggtagaaaccaatttgatgcaggtaagaaaaaaaacaccagatctgaaatacaaaacaacaaagaacagaagcgagaaaaagctaaagccggtaaaaccagatcgtagaaacgcaaaagaaaaacaaaaacttgtattagaaaaaatgtaattcaaacatcattcttcaatcaaacatcaatcagatgaagaatccgaaccagcgacgaagagattcagaaattacacaaagagaagaagaacccaaaaaaaacaaaaaaatgaaagagagagagatcttaccaatatgaagagagcagatgagaaatttgttgaggaaatacaaaaaaaacgtaacgccaaatttcaacaaaagtctccaaaccctaaattctcctttcttcggcagcctctctgtctctcacgatctctccttcgccttttctttaaaactttttttttgtttttttttgtatttctctttctcaaatattttttacaattcagtttttttgcgattctcaatactttttggggtaaacaatagtaaaaaaaaaatacaaatttttggtgttgagagaaaaatagggcgagaaaattctataaggtgggtgagagagagatatatgtggatatgagagtcggtttttatataattgcctctcctcttcttctccatagtttcaaaacaacaacgacacatttttatttcattttctatatttcccattttgcccttttcttgttacaagattggttaacctaattaggcaaatttattcaatttttattcatatggactacaaattttctttgaatttcatttagcacgcaaaacttgatttgcgcttccgtggaaatttcctttggacttggaaatttttttttgaaaaatcgaaccaatcaaatttgtaattggagagaaaaagacacatatccgaatgtgtgagcaagcttgttgtcaatactggcaccgacgctgtgtaataataagtgggcagagacaacaaggtacatgtgcatcaatctctatcttacttgtatttattaagactaacgaaaactacatttaaactaaacctaactctagctttttctcatttttttagtttaaccataaaactttgtcgaacgtgtaaagtcagccttcggatttatatatttattccaccgaaaacataatttaaattaacttcttcaaaattttacgtaccaagtaatctatacaaataatgttattatacaaaagcaacgtgttatttttttcaaatcgaaacaatatagccaatccaaatgtttaggagagtaggtagatacacttcccaacaagaacatcacaatatataattaccagtttggagagatcaattttgccttcagctatcattttggtagcgtataagaggctaacaagaagatatgataagctattgaggaccaggttcatggaattgactatgattgccaatctttacaaggaccatatccgtctcttgtttgctccatattcgtggttaaatttgacgatcataataaatgtgagacacatgcatgcatgagatgatggcaagcgtagatcaataaaagtttgacaacacatatactagggacatagataactaccacgatcgagagacgtgtgggagatgcacactcgcacaagcatgcttagcatacgtcttgaaggagacggtataaaactttgtagagcatgtgatctactagtacttccgaagagccatatggagaaggagacttaagcgaaacgtacttacaattctaaaatgagccatgagagcagcctattagtcctcgcatacgctacaagaggagcctgggaccaataatagtataaccattgagaaagtacagtagacatcgactagatcacaataaactttattttatgttgactatttcgtcattgatgatattacttatctttgattattattaaatctctcatttggacgctttaatttgcttggagacgagtcaagaattaagtcaggagaaacagcagcgttgataattctgttttcattttgaatatatatcgtgtttaatttggtttacattaaaaagtcttaattaaacaaaaaagatgattcaaaacctttagttgcatttgcatatttatttttcatatacaaagaagtacagatgattatgccttttgaaaacctagttattacttattgcatagtttattttctgatcaagtaaaaaaagttatgaacacaattcttcttatgaatgactctcaaaattaaggatgttgccttggagatttataggagttagcctacttttcaccttgaggatcaattttatagtcaaagctaataatgtttgtggtctatattagttaccacttgtttactacatccaagcgattgaattcgcatttcccatactcttgacttaattaaaccttgagatttcatgatttattatgcaaaatttaatccttcgctatctatttgttcctaaaagatataaattgaataaaaacgtaactctccaattaataagaaaaacttctttaattatttttctaggttaattaataaatttataaaacaataaatatcatattagaaattcatactaataaattttgagacattttattgaaatcttaatgtggatagtgctgcaatcaggaaaggatgacgagacaaaagatagagaagcaaaagtaagctgataaggtttgatacagtagaaaatactatctcttaacttcttcttcttcttcttcttcttctcctatctttgaaa

SEQ ID NO: 9957 - DNA, 3000 bp, Unknown
  misc_feature (1)..( 3000): cDNA_ID_3034854_gDNA_ID_2096295_Annot_ID_195532 3000 nt of promoter + ATG
tatccacattaagatttcaataaaatgtctcaaaatttattagtatgaatttctaatatgatatttattgttttataaatttattaattaacctagaaaaataattaaagaagtttttcttattaattggagagttacgtttttattcaatttatatcttttaggaacaaatagatagcgaaggattaaattttgcataataaatcatgaaatctcaaggtttaattaagtcaagagtatgggaaatgcgaattcaatcgcttggatgtagtaaacaagtggtaactaatatagaccacaaacattattagctttgactataaaattgatcctcaaggtgaaaagtaggctaactcctataaatctccaaggcaacatccttaattttgagagtcattcataagaagaattgtgttcataactttttttacttgatcagaaaataaactatgcaataagtaataactaggttttcaaaaggcataatcatctgtacttctttgtatatgaaaaataaatatgcaaatgcaactaaaggttttgaatcatcttttttgtttaattaagactttttaatgtaaaccaaattaaacacgatatatattcaaaatgaaaacagaattatcaacgctgctgtttctcctgacttaattcttgactcgtctccaagcaaattaaagcgtccaaatgagagatttaataataatcaaagataagtaatatcatcaatgacgaaatagtcaacataaaataaagtttattgtgatctagtcgatgtctactgtactttctcaatggttatactattattggtcccaggctcctcttgtagcgtatgcgaggactaataggctgctctcatggctcattttagaattgtaagtacgtttcgcttaagtctccttctccatatggctcttcggaagtactagtagatcacatgctctacaaagttttataccgtctccttcaagacgtatgctaagcatgcttgtgcgagtgtgcatctcccacacgtctctcgatcgtggtagttatctatgtccctagtatatgtgttgtcaaacttttattgatctacgcttgccatcatctcatgcatgcatgtgtctcacatttattatgatcgtcaaatttaaccacgaatatggagcaaacaagagacggatatggtccttgtaaagattggcaatcatagtcaattccatgaacctggtcctcaatagcttatcatatcttcttgttagcctcttatacgctaccaaaatgatagctgaaggcaaaattgatctctccaaactggtaattatatattgtgatgttcttgttgggaagtgtatctacctactctcctaaacatttggattggctatattgtttcgatttgaaaaaaataacacgttgcttttgtataataacattatttgtatagattacttggtacgtaaaattttgaagaagttaatttaaattatgttttcggtggaataaatatataaatccgaaggctgactttacacgttcgacaaagttttatggttaaactaaaaaaatgagaaaaagctagagttaggtttagtttaaatgtagttttcgttagtcttaataaatacaagtaagatagagattgatgcacatgtaccttgttgtctctgcccacttattattacacagcgtcggtgccagtattgacaacaagcttgctcacacattcggatatgtgtctttttctctccaattacaaatttgattggttcgatttttcaaaaaaaaatttccaagtccaaaggaaatttccacggaagcgcaaatcaagttttgcgtgctaaatgaaattcaaagaaaatttgtagtccatatgaataaaaattgaataaatttgcctaattaggttaaccaatcttgtaacaagaaaagggcaaaatgggaaatatagaaaatgaaataaaaatgtgtcgttgttgttttgaaactatggagaagaagaggagaggcaattatataaaaaccgactctcatatccacatatatctctctctcacccaccttatagaattttctcgccctatttttctctcaacaccaaaaatttgtattttttttttactattgtttaccccaaaaagtattgagaatcgcaaaaaaactgaattgtaaaaaatatttgagaaagagaaatacaaaaaaaaacaaaaaaaaagttttaaagaaaaggcgaaggagagatcgtgagagacagagaggctgccgaagaaaggagaatttagggtttggagacttttgttgaaatttggcgttacgttttttttgtatttcctcaacaaatttctcatctgctctcttcatattggtaagatctctctctctttcatttttttgttttttttgggttcttcttctctttgtgtaatttctgaatctcttcgtcgctggttcggattcttcatctgattgatgtttgattgaagaatgatgtttgaattacattttttctaatacaagtttttgtttttcttttgcgtttctacgatctggttttaccggctttagctttttctcgcttctgttctttgttgttttgtatttcagatctggtgttttttttcttacctgcatcaaattggtttctaccaaaacttcggaaacctcttttggcaaatgttgaatctttgaatacaatgacgatttacataatagtctcagtggccgaactggattatcttacaatttacgcaataacaaaaagttttttttttttttttttttttgtgtgtgtgtgtggtgtgttgaagatttttagtgtttgtttacttcgtttatggaagtccttttcctcttctgccatttttgtagttaactacaaattatacctactttaggaagatcctcctgctagtagctaaaagatgtagcatttattttattatcactcacttgagctaacttttttcgatctttatttggtggcagtgtctttgaacgcttcatctcctcgtcatg

SEQ ID NO: 9958 - DNA, 3000 bp, Unknown
  misc_feature (1)..( 3000): cDNA_ID_3034876_gDNA_ID_2096295_Annot_ID_195525 3000 nt of promoter + ATG
gctattctctctacagtgatactcacgacaatgccaatcttatttccaagcttgatttgattgtatctggaatatatttataaaatctctttctgcaaaattattattctgtcacaaaaaatttgggttcttctagtctaaacctaactagttgttaaaaaaaaactcaaaaaacaaagtcggatcgtgtgaataagttttcatacaaaagatagtttgatcaacaagtattttgatatatacggtttgacctgattgatttggatctgtgttccaaaaggtcacaagacaacgaggaataacataaactcattcatacgtcccattttcaagttcctctgagaaatggaacaaattcggtgtgatatgttttgattgactccacagcagcaacagcattagcttcttcttcgggataataagcgatcggatcagatagatgcggttctggaatcttcagcaccccttcgagcatggcgtggaggcagtaagctgcatatgttacatgatacccgccttcttgcaccataagcaaccttccatggctgtgctcctctgcaactcccctcattatctgcccaatccttctgtatccattcattgtcaggctttgtctcccgtttggatcaaactgcagatccgacagtaaatagtggttatccgtcagtccatgacattcaaatcccctcacaaactagacaatcagcatccctagcaaatgtttgaaaccaaactaatggatttaagccggagaactttaagagagagtttcctgtgaaccagaaaattcattaacttccatgggccaaaaagtgaacagctctgttagtaacatctgtgctgaatataaattcactaagctcgacaaggggaccactaggtagcgtaataagaaccataaaaaccatatcttcctttattcctctctgaataagaatgcaaactgaagcaaagaatccaaagatataatcttatggtgaattctcgagcaccctagactcttccaatgcaaaaccaatacccaaatccctagacaacccattcctcctttggtcatcttccatttatactgattcgtttatcttttgctgactgaatattagagagatgacatgactaatgcaacagctgcactcttctaactacttatgcagacttatcacagcagagccatattggagcagcatacataagcgatttacttgtaaccaaaacaataattgcgaacaaaaccctgagtaagtgctcagtcagatagtctacacgtatttgggcaaagaaagaacttacagcgctagagtcttgaccaacaacgagaacaaccatatcgggtccaaaccttctaactgcaggaaccaccagctcattcatggcatattcatatccccggtcacccgtgccattcggtaaagggacattcagattgtaacccaatcccacgtcttcaccaagttcatcaatcgaccctttctgcgggtgggacgatccccatgatccatggttcatatggagtgacaccgtaagaaccttatcagatgtataaaacccttcagctgtgccatttccataatgtacatcgatgtcaataaccgcaactcgggaacaagaacccgaattcaatgccagcttgacagcaagagcagcgttgttgaggaagcaatacccatcagcctgagtaggctgtgagtggtgacctggtgggcgtaccagagcatatgcaattttcccatggcaatcaagaatatgttgcattgctgaaagagttgttccagctgcaagaagagcagcttcccacgagcctgggctcatgaaagtacctgcggcaatttcacacctttctcctgatttatctgcctccactagcttctcaatgtactctgtacaaggatcacaatggattacatgagaaagcaataatcacaaatcaaagtcgaattttttaaggttaagatttgtcaaaactaccaaattcagaaacaggtttttataaaagttccttcttttctgcgaaccttagagcgatgtacctgaagtgtgaaacattagaagctccgaaacgattgctggaagaccggtaaaccaattgacatgaggagcgatgggaccgcgtcggagaatcgaaagcatgttcctgacgcgatcggcgttctccgggtgcttctccaatacgtcgaggaatccagggtcgtatccagtgtcgaagacgccttctacggcgtcgtgtcggagcattccttcgtgccagaagacgtctacgcgattggtaaccatcggagaagccggcgacgaagataggcttgagccgtcgtcggaggccaacggtggtgtaataatggaggatgctcacgcgcaacacacgtgttctctaaccattgagataacaaggggtataaatgtcttttccaaataaactcaaggattaagttaatttcggagaagagaaatttcgtgcttattgggcctggactgaacatgctgttaatgacatgttgtactgttttagattggagctttttggatttcgttatcccacatttaattattgtagaacctttattttttgactacaaaaaaaatatattcttcgctctcataaaataaagaaaatataattgaatttatttatgattcatattcgtataaaaaacatttggctacaagtatcatgtacaaaacattcggctagatttagttagaacaagatttgttataaatcataatggcaatataagagattagagcaagaaacatagcaattattatttgagaccagttttgccccatttcttacgatgataaacgactttgaatattcttcagtccactccacactgcgacgacgacttgagaaaaacaacatagagaaaaaaagaaaaatccaaaccttaggggcaatattgtaactaaaccaaacgacactgagtcaacattctgctttgctataaaggcccaagcacaatttttcagtaaccatgatgaagtgagaaattctgaaaaatg

SEQ ID NO: 9959 - DNA, 3000 bp, Unknown
  misc_feature (1)..( 3000): cDNA_ID_3034883_gDNA_ID_2096295_Annot_ID_195523 3000 nt of promoter + ATG
tcccttcagaaaaccaataatctctttcttttctcacaatatttattctgtgcaatgaggtgctgctattgttagaccaagaatatatgatatttttttcttgaaaccaaggaatatagtctagtttgctcccaataatttaccatatgaagaagtgttaattgcttttgcttttcatttttacctgttctgttactcaccaaaacttggcaattgtagcctgaccgtgtcatggagttctgcaacaacaacgatcttcagttgattgtacgagcacacgaatgcgtaatggatggatttgagcgttttgctcaggggcatttgataacgctcttttctgctacaaactattgtggtatgtacatggactcactaagtgccataaccggattttgatattttgatggggttatttctgttttcttaatagtttttatactaaatctcaggtactgcaaacaatgctggggctatcttggtactagggagagatcttgtagtggtacctaagctcattcatccgttacctccagcactttcatcgcctgaaacttcaccagaaagacatatagaagacacatggatgcaggttcatattgcttcatttcattactgaatcttagtccatagttattgacctgaaacattggtacttagcgtagtatgcacttttcgcaggagctgaacgcaaataggccagcgacgccaacccgaggacgcccacaaaattcaaatgaccgaggaggttctctggcttggatgtgaggcagataaagaggcactcgtgcacatacataccgctccaaaaaacacttgtaacatctgcctcctggtgttcctcatgtgtacagaaaaagatgagccatagacgagaaacgatgaggcttgaagatatcagggggtgtgtaaattaagatgttaaaaggttagagaagtcagttttggtggtggtttagtagtgatttgtagagtttatttgtccgggctttagtcctctcgttcatttttattcagtctgctgtttcttctttttttttatcatgtcatatctttcttttttcctcttcaattgtctccgttgttttcgtttgtggtatagttttttggcgagtgggtatgaattcttagaatggtaatggttgattaggtggaggatggtctgatgtcgtggggggggggggcttttgtgtattttaattttattgtcagttcatactttgtaacatttgtgttgattatatgatacgaaaaattttcctggctccttttggttgtctaagctagaccaaaaaagaagagaaaagaaagaacttatgcccttgaaagcgactttgagttggttcatggatcctcgggtgatggactcagtcactcgatttgcttgagattcataaatttatacatgtgctttgtggccttcaaatgaaacactggtgatgtcgatatgatgtgatttggcatcgatgctgtcattggctccaaaaaatcatgttttagcggtgagaacaaaaaaaacaaaatttttggaggatcagatggttgaagttaaaactcgagggtattagatggttaaattttaatattgttttggatataggatggtgattaaaaaaaaaaagttttgattagtgttggtgcaggaattagcatctccgataataccaatttaaaccaaggaataacgtgaataaaatcgagaattcgattgaaccggggtatcccggctagtctgttaatgggcctaagtcatgagctcgccagaagatttaggtcgacagtcaagatcgccataggcggcttctcaggtcgtgtaaagggaaaacttccatttaagagaagaggatctcatgaagaatagaagtaatgaagatttagacctaagataattagaagtttatcatattttggtatgttggacccattgtataaatagggggggggggtcaagccctctaagaggatcatgaccaacctaagacaagagactactattacagagcaaactctagctttttattcaagcaactttgttcttctcctttgattattcgtgagctaagagagaagtgaatttgtctaaatcccttagtacaaattaattgtttgattagagaatcaacaattagttttgaacctgatgatgtattggtcaaacttgtaatcatcgcatctgagtttgaggtcattttttccaactgttgttatacatataaaatatccaaagaataaaagccttgtacgatcggggtattggggtccgtaccaacttgttgacattttttatgtttttggtgtgtggcagactagattgaaacaataatgactaagcaactcagtaagagtcctttttttggactcagtaaaagagtccaagttttctttgaacaacaaaattttgttgaggtgtgtatgcacttggttgggaacaaacaagtagatggcaaagatcattcgaacattggagcccaagtgttgagggcactaatcttgtcgattacagaaacgaaattatttggggaagctgcaagaaaaagtttagttaaatcttttatattccttaatcaaaatgtatcatgcatacactatatacaattcactaaagtatgatagttaaatacctaattaatatcatgatcaactcctaccggttcatctaactaatccagctcagcataaaaaccctcacgcgtcgctccaattaaggggagggcttaactagtgcccaacttactgggctaggttcgactccgtttttttattacattttccttttccatttctttaagactttaaccctgaaatctcgaagtgcaacgcaccactaattttttataaatattaacataacatttcatgagtcctaaacaagagtctctcttggtctttataaatacatcgatccatgtacataaaaacaacaagtcatcttttctttctatctgaaagtaatcagagaatcagaaaacacttgagagagctgagtgaccatcaaaaggtgtt

SEQ ID NO: 9960 - DNA, 3000 bp, Unknown
  misc_feature (1)..( 3000): cDNA_ID_3034891_gDNA_ID_2096295_Annot_ID_195521 3000 nt of promoter + ATG
gactcaaatactgatacaattttacaaaaaggcattcattactagtaagacctacaaaattgttccacaagttgaggagacaagttagaaataccaaacaactttagacaagtatttccacttcgacttagagctcctctcaatcgtgccttttcttcctcatgcatcctcaacagcctaagaatctctcgcacacgagggaaaaatgcaccaggacgaacacaataaggtttaagcacagtaagaagtgcctctgcgtcaacttcaaacctatcaaacttttgtctccgtaaaacaggttctcctgagaaaaatttacgagaaacataatggtcaagcccttccgcgagatttctccacaagtccaagaagtctttcgggttcatgtttagatgaagaacacacagatgccttcttaaattgtccaatgcttctgcgacaccctgagacactgttaaattgctggagctggtaatgacgtcttcgtcccatgaaactgcattgttgtggaagtggtcgctgcaaagattgtcaaattggtggagaaaaactgttataatctccataagccaattggtttccaactcaacaaggcttttcagttcttccccaaaaaagcagccttggcaggaaacttcaggttttctatcaactttgacactggtttcggcagcccacatctctacaaaaaccaaatcatcactccattctcgtagttttgattcaagataccgagcagcattaaccggtccacatgcttgtatcagtgtatcttcagacaaaccataatgagagagatcagtctttttgaactccaataacagaattttgaatatacaccagagaaatctggtggcagtagctcttataaattggatccttggtagaatggccggtagagatagaccatggtctatcaacctccaagtcctattaagaaaagagtctgctactaatggcgctttataatcttctcttgtagatagaacatactttgcagactgtgagttggattcattaccaagtctagttctttcactatcaattacccaagctttctcattcttaatatcctctttactttttctataagcatcctttagctcaatcttcccccaggttttgagccactcaggtttcttacaaaacagtcccattactgatataccttgagaaaacgctgtcgaagagccttcataagatagacaagtatctgtattcacaaaagactgcattcgcttatcaaatgtaaccatctgatcgacaagatggaaccacgatgaaataccttcagatttcatgtgcttctccttgtacatatctataagcccaggaaaaacttttttctctaagaaaccagatagcatttggaccatcgctgaaacccaagcttctttagcactacagcttactaacatagccctatcaatcaaaggctgtaagaaatcgtcaaccccatcagcaaagtctcttgtaactttatagacaagttcaaaaataaactcaggttgctcagcccattttagaaaatgatactccatccgagatgcaaccggtttaactagttcatcggtcgcccaaagtccatcattatcagtttctttggtcatattaagcttctttcgtttttccttctgcgtattatgttgctgtaaaccacagaggagtagaaagctttgggaataagactcttttttatctccttgcatcaagagtagaggattagggatactatcaacctctccatgctcgactttggatgttgcaagttttggtggccagccaagagatgagagaaaagctcggtgatctgcgataatctgtggacgaagaacagacagacttttatctactctactatcaacagaatctacaaggcgacgccaccgtgagtgatgccttgtaacatcaccaagtatttcttcaatctcattcatggtcttaatagcatgactgaatctctcttgcttcaatgcaagatcctgcacgtacaaataaaaagttttaatctttcatatttaccaatcacaactccatatagtacttaacttgtggattgaaaaagctttacttgaagcgtacttcctttgcgtttacttatcggatgaaacacagaatcttcaagatcgccaacaagactttccaactttaaggcagtcactgaaaaattgaatctttcttagctagctcttgatgataatgttcaagaatcaaaaatcgagtcaaactcaccgaaatatttacgccgattctgtatacgacacaattcctctacgacttgctgtaactcccaattcgtttgctttccgacagaatccgtagctacaatgaaaaattggagacaataagaaaactcaatatctttacgtcaccaaaaataaaacacgagggtttggtaacttacggagacagaggaggctctccaggttcaatctcaaatcttcgagtgaaactttagcggaaagtgaggttgagatccaggaaacggcgtgcttcgtgagatccgtccggagatggagaagacggtcgtttagatcagaacagtcgtggtttaaattggacgtcagagtcgaagcgcggaggagcagatcttggaggtctacgaaattaccgtcaataaagcctagtgcgagaccgggaagggtggccgggtttggcaagacgaacgacagtggaagtggatgttccatcggaagcatttgccgggaaaaaggttgttccttttgttttctaaagccttcgtgtcctctgagtctaatgatgggttatgttatgatttttaatttcccttaagtttaactaaaaattagtatttactttgaagaaaataaaaagtaaaaaaaatcgctttgataaaaaaatttagcttctccgtgcagcgagtgtagtcggcggctgacgttttctttaccctaacacttttgaagcaacataacaaacgcgccgcgaatccatttttaagggtttagagacttttagggtttacttgagaacagagag

SEQ ID NO: 9961 - DNA, 3000 bp, Unknown
  misc_feature (1)..( 3000): cDNA_ID_3034899_gDNA_ID_2096295_Annot_ID_195518 3000 nt of promoter + ATG
attgatagggctatgttagtaagctgtagtgctaaagaagcttgggtttcagcgatggtccaaatgctatctggtttcttagagaaaaaagtttttcctgggcttatagatatgtacaaggagaagcacatgaaatctgaaggtatttcatcgtggttccatcttgtcgatcagatggttacatttgataagcgaatgcagtcttttgtgaatacagatacttgtctatcttatgaaggctcttcgacagcgttttctcaaggtatatcagtaatgggactgttttgtaagaaacctgagtggctcaaaacctgggggaagattgagctaaaggatgcttatagaaaaagtaaagaggatattaagaatgagaaagcttgggtaattgatagtgaaagaactagacttggtaatgaatccaactcacagtctgcaaagtatgttctatctacaagagaagattataaagcgccattagtagcagactcttttcttaataggacttggaggttgatagaccatggtctatctctaccggccattctaccaaggatccaatttataagagctactgccaccagatttctctggtgtatattcaaaattctgttattggagttcaaaaagactgatctctctcattatggtttgtctgaagatacactgatacaagcatgtggaccggttaatgctgctcggtatcttgaatcaaaactacgagaatggagtgatgatttggtttttgtagagatgtgggctgccgaaaccagtgtcaaagttgatagaaaacctgaagtttcctgccaaggctgcttttttggggaagaactgaaaagccttgttgagttggaaaccaattggcttatggagattataacagtttttctccaccaatttgacaatctttgcagcgaccacttccacaacaatgcagtttcatgggacgaagacgtcattaccagctccagcaatttaacagtgtctcagggtgtcgcagaagcattggacaatttaagaaggcatctgtgtgttcttcatctaaacatgaacccgaaagacttcttggacttgtggagaaatctcgcggaagggcttgaccattatgtttctcgtaaatttttctcaggagaacctgttttacggagacaaaagtttgataggtttgaagttgacgcagaggcacttcttactgtgcttaaaccttattgtgttcgtcctggtgcatttttccctcgtgtgcgagagattcttaggctgttgaggatgcatgaggaagaaaaggcacgattgagaggagctctaagtcgaagtggaaatacttgtctaaagttgtttggtatttctaacttgtctcctcaacttgtggaacaattttgtaggtcttactagtaatgaatgcctttttgtaaaattgtatcagtatttgagtccatgatcaagaagatgagaagtgcagcagaaattggataaattgaaaactagcaatggtgtgttaaaaatgatacaaccttgcttttgattccgtagaagtacatacccatgactctaaagatcatcttcaataaacaaaaaaaggattaatctggtctggtgaaactaaaagaagaatagataagttaagtgaagtgaagaatcaagagaactcttggatcaagggctcatagaagagtctgtatgcgtccatgacttctaaataccacatggcttcacgatctgggctcaccgacaggtcaaccatcttatgaacctggtttcagtttaaaacaacaatgacaagtttcagtaatcaaagcattgcatgtaaatgcagatgatactttgactcgaacatcacaagagaagatgaatcttaatcactagtgattacaagcatcttcatgccacacctagatatatcatcacaagatttttactaacacattcaaactcaaaacctcttatggaacttaagctccttagtcacctaagcttgtgtcagcctgatctagtgatcataacatctaacattctcacttaactctttaatgtgccaattggcataataaaccaatttgactagtctgcaactctagcgaaactaaaatcacattggagtgatccaatgtgcatatcaaagacctaaagttttcaaattaaccttaagtagaggtatctgcccagtacggacttggtagacaccaacaaccatcacgtacattcctgatttccattgacggagggcaaaatcgttggtgagaccgagctccaaaagaccggttccgtcatcaagtaccagacaattatcgccgcctccaccggagaaggggaccaaaacgccctgcaacgcaagacttgaagtcatcgaaacaggaattaacaatttagctatagacaatgagaggatgatagattgggaacctgtaaccaagcacgttgaaaaagtacaccgcctagggaggcggcgttctgagaaggcgtcggtttagcgtcccggagctgagaacaaagcatcttcaccgccgctaagctgtagtccattttacccgccgatccgactcggctgatcaatttcacaaatgcctttacctcatcgattaccggattaaaccgaaccgaacaaatggtatcggtacagtaatttgattttgatttttggcagatattgggagagggaatattgtgtttgaaaaaaaaaaaatggaattcatggtgttttggctttttgactaattaaaatcattaacatgcaaactaaaagatgtaaaaatctttataaaatacaaacaaaaaaaataaacaaattttgagacaaaaaataaatctggaatcaatcttatccaagaaatagacccacaatatcaaagaaaataatgaggtgtcacaaagctattgattgataacacatcctcgaaatctctctctttgtccacagaataaaaatctatttcttgtgtttgtgttgtatttacttaaaaaaataaaggagatcagtttgggagaaagcagcaaagaagaaaaatg

SEQ ID NO: 9962 - DNA, 3000 bp, Unknown
  misc_feature (1)..( 3000): cDNA_ID_3034909_gDNA_ID_2096295_Annot_ID_195515 3000 nt of promoter + ATG
cttacgactctgaatgacaaaagacagatcaatcattaggtagggaagcaaacatcaaattatgtaatcgaagattgattgagactaacccattggctgagctcaatgttgaattcatagaaagtgacatgagcggctgtgatgaggatttcctcgatgtatggatcgatccgctggagaactgtgagattgaggagcctcgtactgttttggtccagatttgggattatcttcccgttttgagacatcttttataaatcaaagatcagaattttgggaaatctggattcgattttaccctaatcggaagaaccctagaattctgatttaaggtagctgagagatttggggacggagacgaaaacgctaacttttggaacgcacttcgctattttgttgtctgctttggcaaaaaaaaatggtaatttagttataaaacttaagagaataaatatactgaccataaaagcattagagtttgcttcaaaaatacatcattagagcttgcttaagagattataaacaacattaaagaagaatatttattcaattggagtataatcagtgggttgatccttttaattcaaagatcaattactgcatagtcaatagaatttggttatggaacagtccacgaggacaattttcaaattgaaaacgaaaatttctgtttttattcacatctgtggattgattcgtctttgaaataagcacatctaattcaaagataatataagctacaaaatccattaaccaaaatcactgcagttatttcaaattatccaaaccaaaagctaaagaggagagtagcagcacaactcttacactgtttaacagatatgtctgaaacaaaaacgaaagggtaagaagaagtgtcttatagccaccaattttaagtaggtgaaagctcagaagattctttgtggtggtcccattgtgctcttgaggtacaaacacctgacattttgccagttcttcttcaatagcgagacgaggaagttgacgctcatctgcacattctgaaagatctgcttctcttccattgaaaggttaccaactgcaactcccatgcacagaaccttcttcagctggaacttcactgttgcctttgtttcattcacctttgactccaaggattcctggtggctcacaagagttgggaattttcctgtgtaaagtaaagcaaaggaatgttacttaagaatcatcaaagaagcataatctcacaggataaaggattggcattgtatcaaaaagacattgacaaaagaaatagactactaaaacctatccaaaatcaaaacggatgtaaagaagaacaatggaatattagctgtagccagaacttgcctgccttgttaagaccaggaccaagaagacgaggaatctgcttaatgacagactcagaggccaagaaagcatggtatttctttgcaagcttcttgacgagtttcttgttcttgttaagcttttttagagactcaacatccatgttttccaaccccatcttctcagcctacgaaaagatacaagatgaaataagcaaatatttaattatgcaagaaatgaagcctaaataaacaatgaccaaattccgaaaacatcatgcatctacattcagaagacatatacaacatcaaatgaaactaatagagccaccaaatgaaatgagcacaaaaccattatacaagaaacagagcacaaaatgatcaatttccatgaaaagatatatcacctcttcaacatgctgggcatctccgagcatgcagatcttcattttaggacgggggatatgtggtaacttgacagatccactgaaacgcttgtccttttgagggtcatagttcttcagaccgatctggagctcaatagtctcgacaaagttacgtttctttgcctcggatttccctgtgatagtagtgatggcttcacgaacggcctcactctgaagcttactgtattaacccacaaagaacagagttaagcaaattaactaaacaaacaaaaatacacaacattgacaacctcaacatgaacaacccacattatagacactaccatacaaaataatcttatcttaatacacctaaatttttatgaggcaagatttagatttgtcatccaaatttagaggccttagtaaagagcatttatgcaaaactgcagaacaacttcgtgtcaatcctagactattaacatcataaagctatcaataacgcacatccaaaaaacaatcacgattcagagacgtattgttctctaattaaacttattgcatatgacagaagaacaatacgtctctgaatcacgattcagagacgtattgttctctaattaaacagtgaatgtaagagatgcgtcaagtacctcattttgagcttgtctcaatttagctaagatctgatcctggaaacgaaacaaagacaacaaaaaaaagaatcaaaatctatagcagaagctcgagaaacaagaataatctaatgtacagtatacatataaacgaagaagaagaatcaagctagaagtgaagcagtcgttgaggcacaaacctgagtgacgagacagacagaagaaaccctaaatttctcgaaaggcgaagcctttatagtaaggataatgatcaaataaactaaacctaaatgaaattgggcctttagagataaggaaaagcccaaactgaaatcaaatgggcagctgaaaacgtgagaccaacaaaaccaaaaattacttgagcgatctaacatccgactaccgtcttggagacttttctgatgatggtctagtcaaaaccactcagttcggcttaagccattcaggtttgactttgtgcctctacgacgtcgtcttgtgactttgtgttctctctagctatggaatttttttcttcttgagctgttgttagattaagattttagaagatgactgcttctggagctcttcttgttgcacatattgattcgtttcttttggaacccagcagaagaagagtgccaattcatg

SEQ ID NO: 9963 - DNA, 3000 bp, Unknown
  misc_feature (1)..( 3000): cDNA_ID_3034905_gDNA_ID_2096295_Annot_ID_195516 3000 nt of promoter + ATG
ctttggaaattaagtgattattctaaaagcacaatcatgtttcacatttttcctactatgaccgtttcaatctatatactcaaggtaaatatgtatcaggtgatggattctcatcatacatagtcaatcaaatccacatgtttggatagaaaagaacgcagtacagtataagaatacgtacctccaccaccattcatgatcttcaccggatagctgaatgtaggtcaagataataccgacactcgaactcaagaagataagcacaatgaatgtaaaaagcattattccaggcgaggtatatatcttaaatccccacaagcttgcatagagttggtgccattcgagaacaactgcactgaaaggtacaaagcctccaagaaacacctgatacagctttctacggtaccaattctgtggtggaatttctcgggggtttcttttaacagcggatgggggttgaaactctaataatccaaatcggttacctaacactcctcccaacatgagaaatgggatattcaaaagagtgaaaatgagtatgatgatgactattgtgccaaaggggagtgcagctgttgccccataagtaattgccacagtgttgagaaccgaaagtattatgaagaaaggaaccggatagaggatcccagcaagacgaacactccttttctgaaaaaggcaataatgatttaacaaataaggttatacgaacaatgaatctttcgaggtcagaaaaagtagaaagcactagaaaagtcaatcacctgtttatttccctcgaattggctatggaaagaagtagatgtgtaaccagccactattgatgttagagtgtacatgatgacgagagaagtcaacagcattccacgattgtatgggtagagaaaaccggtgaaggccaatgcaaatagagcaataatcctgaagacgaaaaacaagttagaaacaacaataataagaagccaaatgttttttttttggtaagtagaagccaaatgtttatagataatagaagcttacaacagtaataatggaattatagataatagaagcttacaagattagcaactgagtaccagttcctaagattgcacaaagccagctgatgttccgaggacatcgaaatacatcactatgtacgagtttccaacctgcttcctttctctcttcttcatctccgatagagtaactgaaatgcataaaggagaagttaaactcaaaaatgtaaattttatcaccacatccgttaaactacgcaaaacaagaatagtctcctaagaaaaaattgtcaccttcttagttcattcttgagatggcgcatgaagagaaaagatataagtccaattaacaaaacaacaacagttatcgagttgagaaatgagaagaagtgaatcttctggctgataggatgaaacgacgcccgggagtacttattcattcttgtctcagagcgttctgaagtcagattccaagaaaccgagtatgtaaattgaacatcaatctcagtgttctcggatatatcaaccatataactcggatcactaaaactgttgatctcaataactttgtctgcattgtacagaacattgaactttaagtgactgaatatataatacttagtatgcttctccccttgaccaaaataatctccctctacttttccaacaaatccccacaaagggagatcatcgtagtacatttgaaagtagtaatcttgagcaataatatctctgaacctggcaatatcactcgatgttaatctcttccggcacaatacaaaatgagttttgtcctccctaaatttcagcttatataaagagctcattaaacgatcaccattaagaacttccccaagagtttcctgtttctcaatcacaggccctacaaaatataaaacaatcctaaatcaaaagaccgaaactagggacagatacaaatcctaatgtaaaactaaaaggacatcattgagaaacctaacctcgacggcagaacggcaaatcatagtattgataggtctcactgcaaacaaaacaaaacaccaaactttaaaatggggtttaagaaaatgtgccatctttgagttccatggtcaaactaaagctagaacaaaaacatatcttacacattctctaacttgatctcctcctcttagattactcacccgtcatcataagccaataaaaagcaaaatgcataagaattaccaaaagatttgaatttgagaacaacctcggattgtggagaggacccactttgttgacgaacaaagggacatgatcgccggcattataatggttcgacgagcctgatccgattccgatccagaaggtcaatgcaagtaggacttgtagtacagtaagcagaaattgcgccatgaattggcactcttcttctgctgggttccaaaagaaacgaatcaatatgtgcaacaagaagagctccagaagcagtcatcttctaaaatcttaatctaacaacagctcaagaagaaaaaaattccatagctagagagaacacaaagtcacaagacgacgtcgtagaggcacaaagtcaaacctgaatggcttaagccgaactgagtggttttgactagaccatcatcagaaaagtctccaagacggtagtcggatgttagatcgctcaagtaatttttggttttgttggtctcacgttttcagctgcccatttgatttcagtttgggcttttccttatctctaaaggcccaatttcatttaggtttagtttatttgatcattatccttactataaaggcttcgcctttcgagaaatttagggtttcttctgtctgtctcgtcactcaggtttgtgcctcaacgactgcttcacttctagcttgattcttcttcttcgtttatatgtatactgtacattagattattcttgtttctcgagcttctgctatagattttgattcttttttttgttgtctttgtttcgtttccaggatcagatcttagctaaattgagacaagctcaaa

SEQ ID NO: 9964 - DNA, 3000 bp, Unknown
  misc_feature (1)..( 3000): cDNA_ID_3033127_gDNA_ID_2096296_Annot_ID_195551 3000 nt of promoter + ATG
gatggattcgcctcagaattttgacccggttctaggctcaatggtatataagtcagaaccagcttcgctaaactcttctttgagtttgtattcagcggaagcacctgcagttcatccttggagcatctcgaacgaacaagatttcattaaattggtgagggagatggcggaaggtgatccgctattgatggaattggtataatgatgagtcaaaacaagagtaagtagctgcagcgatgaaaggatgtttagaaacagatttaccatttgtgttatacaaaaaaatgcttcattgattttttggttctcttgatgtaatttctccatgtaattcgtgatgtttataactttctcagttaaaatgttttgaagaagaaaggtcacttgcaatcgtgaataataatcactttgaactagacggtgttattgtgacgcttatactatgcgcattgctctgacggcaaaacattgtttcatccaacacacaacaaatggtcaacgaagtgaataaaggtttttttttttggaatacattttatccaagttaaattaatccgttttacttgaaataaaaaaaaatccgtttgaggttgagaaaagaaattaaatattcctatcccacttggagtactgagtcgagtaaccttatcttctatgacccaaaaataaataaaaaatcacgtcgttgtcatctgcttcgaaccggcaacatatattcaaagtatatggattattttgactgcatgagtaatgaaagcgaccaatttctaattttttcttttgagttgtcattgtattgccttcatgatgagttggctttgcttcttaatatatactactacttttcttataacgcatcatttattttccaaaaaataaacgatagtggtatttcgtaaaatattgatgaaacaactctgaggttagcaaaagtatataatattggttgaggttaattggtcggcaccggcgtagatatggtgaccgccatcattctgcacgtacgtaatattctacttcttttcatatgtctaaaaggaatatatagacacacactagaaatataacgataaataccaaataaatgagtatatatatatgagtatatatatatataaaaagatgatcaaaatatcgaataatgttgttccatatatatatgattgttttcaagatttcctatgattgtagtagatcccgtaaaaggattagtgtatttctatgatgatactgaaagttttcatatgcataaaaatgtatccttttaaaagagtttgtttgtgtctattcacatgcgaaatggacccaatgtcgtcgtcttgaaatgatgatgttattaaaattactaataatagtgtgcattttgttataatatgcttcaaactttttctttatccttttatgttcgatctttaacatcgtctgccaagttcaaactcagcatgttttttttttgtttttttcaaaaggctcagcatgatttcttaattgtgaatagtaagagaaaacatgaacaaaccaaattgttgaaactgactgttttcaccaatcacacatttatcatgtatgagaaattccaatattatgccatttaattactctgcaaaaattattgacaaattaaaattcactttatggttaaattaagtttatctctttggtgcattttgtatatatatatatattttataattaatctctctttctgccttaaaaataaatcacagtctcgctcgcgtctttcctcaaacctctctgtctcttcttcttcctcgcctcgtctacgcaataatactactcttatatcacaaaatctccacgaaaggtttgtatagagatgctataacatagcacacatctcctttcaataattcgctttttcctctctctcttctttttcatgttttcttgttcctgatctctctccattacttttttgcccatctctttgtcttcctcagcgctactcgaagatctgtcttttcaggtatgatgggtttgtttggatcagctgatttcgattcaaattaacgttttttggatctctctctggttgtttgtacttgaatctgagtttctcggtctgctttgtacttgctgatctctgctttaaaattgattgttttcttcttttggttctctgattatgtggtcatgcattcatcagcttactttagtatttctcaaaagtaaggctctatccgttgagaaacaagaacgaacaagttgatcatcggattattttctgacccgaaattcagttaaaagtaagctaagacagaattgaagtttgcgttgatctttaaaccaaaacaagtggtggattcgcgagtgtgtaccaatattactgcaaagttggatcactgtttcaagtcttggactttcattgtgaaaatggttgagatccacatggaattgaaggttatatgtagatcattctagagcctgactactgtagtttaattgattacttcgattatttggtggcgggagatgtttgccagaaggaaggtttgattcagtaatcatcgaggctgatcttataagagttatttgcatttcctctgcttctcatgtctagagatgtatattcacaacagagcttatagcgatacatgaaactccgagtgatagccaggctcagttttgaaccccttgaattactttccctgaggaaccattattatgaatgatttccagataataatgaattgtgggagagaactgagtactcagattgttgcagagttaatatattgctcaaacatgcttctacgtaatactgtatattctctcatatatgattgccatttagaaattcaattataaaagctagacctttgtgttgctctttagtgttttttaggctcctatccaagcgccagtttcttcttataaaacaatctcttaccttcttattttttatgcttgctctatgtttttggcaggtcgtttatgtattttctcttgaaggaagagattagccactaatacaaaatg

SEQ ID NO: 9965 - DNA, 3000 bp, Unknown
  misc_feature (1)..( 3000): cDNA_ID_1440840_gDNA_ID_2096296_Annot_ID_195560 3000 nt of promoter + ATG
cgatcataatcgaccaggactactgcgacaaggacaaatgcgaagaccaagtaattgattgatcgattaatatttttttcttcttcttactagacaagcattcactcggattgaaaatgtgaaatatgttatcaggagtcggcagtgcaagtgaaaaacgttgtgtacaagaacatatctggtacgagcgctacggatgtggcgataacgttgaattgcagcgagaagtatccatgtcaagggattgtgcttgagaacgtgaaaataaaaggaggaacagcttcttgcaaaaatgccaatgttaaaaatcaaggcaccgtttctcctaaatgctcttaactgagctaattatgtaatgcacatacacatatttacatagatatgcatatttatatatagcatgtatattgtactacatgcattgcttcttaatacatgtagtaaagatatatgcaaaaatagtcgaaagatttgtttacatataaaatcaccaatatttattgttattgtattttcatgaataaagtaataagattatttgtctaatattttgatttactagtactagaaatgaaaaggaatatgcacaatttcagcattatagtttggtaggcaaaatggagtgagaatagagtttcatagtatatactaaggttcttaattgtgcaaatagttgatacaagtcacatgggccaagtttgtaaatcttaaatcgaaatatgccttcttctttttttgcatgaaaatgctagtaatttataagtgtgtttttcaataagagatgctaaataccaaaattaacctagttttcagtgagcgcttgcattattgtggcctactttactctttagtccattcaataatcaatgtacttacataaaaatgttaaatcccataatcaaccaaaaggaccaaggcatttaagcgaacccttagagcatcctcaatggtagtttttaagcttaagtctcttaaacaaaattgaagtgtaagtatagataaataatatttttaattatgggtttcttaaatttggtgaaaccaagaccaattatctcttaactaagagacaatttgcctagatttcatcaaagttaagagacttatgaatatttaaatcatataaattttttattctttgttaagaaacttgtttaaaatcccccattaaggatgctcttatgttttggcctactttaccaaaagtccattgtattaaatgatttactttttacgtgaatgttcctcttattttgttgctataaggataaagtaaatcttggtgttttttttggttaatgccgttgctctttaatctcaacggatttatttaaagttaaaagttgacaaagaactttgcttttgttctttcttttgaaagacataaataatcataaaacatctgaggaaattccgaaatcaatgtccgtagactaaggtacataacaaaaaaaggaacatgttttcaaaattaatgatattacatagtgttaaagctaaaacgaagaatgtagttttacccttttttttacttcacttcttggtttgctcctcggctgctggcttactccgctcttccgccgttgctggcggtggcggcggtggaggtgaaggagcagcggatacggcaggaatgccggcatcgatgcagctacgacactttctctcgacccaaccttcgatgtcgtggtctccgccgtgagataagtggcgaccgccacaaagccgagcgaaaacgccggctaagacggataaaatggtgatgacggctaagacaacaacgagtgtttctattgaacggtggtccgagttgtgactcggctggtcttgggagggtgggtctatataaatggtggttggtgtggtgctgagttggtcatcgagccttgccgtggctccgaacatgagagagacagtgtgagaagaggaagagagagagtttcaggtgagcttgtgggagcaaaggtttaagacttgattgaagtagagagagtggggttaattatatcgactttaagaaaacaaattactttcattaaaaaaaaaatgttactcctaaaaaaacatctttataacattgaatactaatggtctcattgtaattatgatggtttctttttccttttctatccatgattctatgaacttaattggttcataggcattgaatttaaggatatttatgtatatgtatatatatgtgaaaaacatacaatgagaaaaataaaaaagttttttgcttttgtttttgacgtaaatagtaaaacagtttatatatgaaaaaattaaaattcgcaattcccaatttgtcctcagtgtgtgtaaaaaccaaaaaccacatgcatttggttaaaacgaagaggtgtttgttttgttgtccccattactccttcaatgaccaccaccctctctctctgccacttctactctcccctattgagtcctctttgactcaactaaccattacttactcttacaaaataaatgtgataatcatgactatatatatatatatatatatatataaattcatttttatctgtgaactcactagtaactaatttagatttttacgtggtcttgtctttttatttgtctgttgatttttggcaggtaatatcaatggtggggtttgttcatcttgttctatctctgtatcttcttatttttaaatatgtcaatgtgtcagctcaataatgtttatgcagtgaaaaaattatcaccccaaaaaaatatttttcaagaaacatgcaataactgacacagaaaaaaaaaacgaatcaagaaacagtcattacattacacgaatcatatgttgggccttagtttagtaatgggcttataaacccaataagctcattttagccagaaaaccctaactatctcttctcgtctggagatataagtagaatcattttttgccgccgtttctcgctaacacaccgaaaactgaatcaaatctcctagctcttctacgcaaaatcgagtgcatcgacaatg

SEQ ID NO: 9966 - DNA, 3000 bp, Unknown
  misc_feature (1)..( 3000): cDNA_ID_3034940_gDNA_ID_2096296_Annot_ID_195563 3000 nt of promoter + ATG
cttgagaagatgaggccaatgaaatgatattagagatgacttttcacaagaaataagtacatgttttcgtgaagacatatgagaaatgtcttaataaataaattcttaagacaaatgcctattttgtaattaactcaatttacacaaagccagatgtacaaataaaatcagaaactaaagtcccatttcgttttgtcctggtggtcgactttgtctttgtggtcacagttttgttttcaaaactgtacaatgttttaaataagtatataacggaaactatattggccataaacttttatcaatcccatatagctatagtagtcgagaagaaggaaaattcagacaaaaatataataaacgtcgttattggcttatcgcagcatcaaatctaaacaagtggactaaatatttgtgtcctctatattattgtcatcaagcataagacaccagtcatttgaatatttgatcaacagccttataaaaaataaaaatttacaatcatatctactcgatgagtttgcaactgttcatgatattgatatcctacaaatctgatacccacacaatgtagataaaaatagcatcactgaacatctgttaagtattataatcacaaacatacaagtgaaaagcaatttaactcaaatcattgctttttggtacgtctaataaatatccacctcgtagtagtctcatcgacacgggagacttacgtggctatttttgtattgttgccaaattttattgaaaatcaaacaaatcaatcatgcaaaaggcgtgaggttgaacggtacacgaaggatacacatgtccgatgtcgaccttgtagtaaataacaatatgatttggaaggacactatacatgattacagagttaacattatagtaatcaccgtaatttatcattgattaatcgtcgtattaaagttatatacatagagccaacaaaatttataatcgtatcacacacctaatgataaaagtccaaagtgaaaaaggaatctagacaaggacatggtgaactgatcaatgctaattaaggagatactttagatcttttaacatttgattaaacagagctgacgtggatgagacccacttgcgccgtttcattacaaaaattcacctacgtacgtactttttctttcgtttttctttaataactattttgggggttaaatgcaattattaggaatgactgaataagaggacatcattaaagagcttgattgttttttcttttttttcgttttatctgaatcaataatgaaaaagaaccaagtgttcgaaatgcaaaaaccaacaaaggaaaacgataaaagataatccgtaaaataagtaatgagtcgatatataccaaactctatcttcataatccgtaccgatcgacggacctacgtacagtatatattaggttcgatttaaaacattatcgtaccatgcattattatttattagtgtgtcgttccacgaattatccacaacaggaagtagcttttagtacgaaagagcagccaagtgaattaacccggctcaaaccggtcgtcgagtgttgaccacacacgtggttccagataagcggataaggatcgtgacatcaagtgtgagtatgtgttacggtccgtatcttagcgacgttgttatggtttgctccgcagaggagtcaaactaaaacacaacttgcataatactttctcaattaaagtaaagtaataaacatgtgtctgtttatatcgtgtgtttatagtattgggcggcttcgatagtcgttttgttgaaaagtttatatatattttgaagacggttctaagtactatgaaccatacattttaatggaattgcttcggtcctcggtccatatatacaatatcttcccgaatttatcaatttggtttttacaacatatttcataattatccggcataattacattatgcatgtaaagtttttataagatgtaatagcgcatatagaagaaaaacgacttgttcttttttgatagagaaaaaagaaaaaacgattaagttttgtaacgttctcgttaaagagtgagtatcttacatgactacataatttcatgcatgcattattttaagatattaaagagtaatagtctcgtcgaaattataacattaaaaagtggattattcgcctcgaagatatccgatgtcacaattttgtcttcttttagaacataatgttgaatccgagaatcgaggtatacctgaatatctcgccaatgtgataatgtgatataatcgagatacctgaatacccactgaaccagactcgtgaattgactttgtccttaagtttttcaaatttgatcagcaatacagatatgtcatttcctaggactataaaagatatcaaacaaatattaattaaagatatgtaaaacttatgggtgaatgatcggtgatgtatgtgtatatgttactggcattccataatacacgcgattcaactaggaaaaatatactataaaaagaggcgtatggaactacgttacacgtttcttgtacatttgagcttcgttacgatgatttgtatcaagagtgaaaaataactacgatttattatttacagtttcagaatatgatttgattcgatgtttaatatgatttcttgcacagctagaaacaaccataatttcaacatttcatattagcaattcctccgttaacagccgtttgacatttttaaagtaggctaaaatttgggtaaactgattttttaactaatattttttaattttatattaactacaactattattattattcgtttataaaaatatacgaaattcaatttaaatgctagtagtattttggtatttttaccaaaaaaaaaactgacacaatcgaaagaacgtagtaaaaaacaaagtatattttttttgtaatgagttgtctctgattcagcaataggagagcgacaaaaatatcacgattttttctagcaacttttccatctccacggaaaaagagtaataatatg

SEQ ID NO: 9967 - DNA, 3000 bp, Unknown
  misc_feature (1)..( 3000): cDNA_ID_3034936_gDNA_ID_2096296_Annot_ID_195566 3000 nt of promoter + ATG
ttaatttatttcacggtagaagatgttttggataaaaaatttaaatttttacgcaaaaattaaaattttagaattatatgactttttatattctacagtaattttttactgctcaaactctctttgacttaatactaaattatgttttcaatgtagaaattataaaaacaaaagaaattgattattttctaaaattttgtgcttttagataaaatatcttatatttagaaacagagggagtactataattttattgatttctcttgttttttatttgatttagtcttttcctttttcccataattttgtctttaatcctgaaaaggatttttgaaataagatgttattacgtataattaaaaaaaatgatttgatgaaaattctcaactgattatgagaccgcaccatttgaaaaaaaaatctcaactaattatgagactttaagatctactttaactattatgcaaatggaatatttgtgtttatcaaacaaacagatctaagtgaatataaaacatactcatacgaggattaatcaaagttatgacatggatatgatttctggataacaagccaaaagtggtaaaatttgaaagagatttagacgaataaaacaaaaaggttacagtgagtttaacgtaaagaagaggtcaatatttaattaggttacgccaaatgtgaaaatgagccaataatgtatagacaaggccatatgggattggttagaaacatgggatttgtccccaaaaattcaaacttgtattcaaacaagacatgattttgaccaaaacatcaatccttcaattttgaatactggaaagtggataaggacatcaattgggttttttgtcctcatctcttttgaacattctcttttgcgttattccaatactttgtacaaagacgagtccactatgaccatttgggtaaagaatattaagaatcaatgtataaaccatgctatatgaatttcatcggctatgaattgtcaactcagtttggtctgattcgagctttgaatatgaaggttatcttggtttaaagtattcaattcagtaaaagacaaaagctgaaccgatctaacatttctaaaaataaagcttaacgtcactaaaataattcttattcaaaaaaaatcttaaaggtttaactattattattttcttagtatatgaaatttctcaaataaatattaagagttagttatttacacccaaaaaaattccacagccaacaaatcgaccttacaatacaaaaatacacatgtctaaagagtgtgtggttggtaaaatattggaatccaaacttcaaggaggctcacgaaattatgatcttttggctaattcatttttgaattgaatcccactttttttttggaggttatatgtgtttgaactttcgaaatttgattccatataaagattcattagttttggactcaacaggaatcatgtatatatattggcataggtcctttatgtattagtttggttgtttcgcattttttatactacataggaaaaatagttcaagtcgtacgtcttgcaccaaatttaagacaaaaaaagttaggcctatataaatttgaaaaaccgtgataaaattttggtaactgttgaaaataaaaacatgttcagggatatatggcctaaaaccaaacttttcggatcatgaaaataagattacaggagatgaacaagaaaaaagttaagaacaaatatttcatagaaaacagaattgtataccaaagtgatccaggtaagatttcatttcagtttgatttattactgcctctctctttttttgtaaaccagaaagataatgtccaagactatttgatggatgtataagacaacgtcgtggactaggtcgtggtcttctcgtggatgctaacctaaacgtgtttccgacgtcactaccacatagtgtcaataattttgttagttttcgagtcgtttcctaaaatcaagcgtgcgaaccttttatttctacgttgacaagtttctaacaatcctaattgtttattggtaataccgtatacgtcaatttcactatacgatatgtcaaccaaaagaaaaacacatctagccgtatgacatgatcaaaattcaaaactacttgattgggctctaaagaaaatgtgatcattagtagcccacaacggcccatttttgtgtaatccattacggccttatattggcttgagcttctgctctctctcccttcccttgttacacacacaaactatcattggagcttgattcggagaataaatttaactcaacctctctcccttttttaagaaaaacaaaacaccaatttagggagtaatcagaaaatgacaagaaataatataattagcaatttagtaaaacgaatataatctgatatgcaatttagtacgtggcgtctgtccagtgggatttccgagcacattcatgaagctgacgtgagtagcttcttctcgcgggaatacactaccactcacttaatgccacgtagataatctttgctataacaagacacgtgtcaaaagcactatctccatttttcgtggtcggtcctattttgccgacacttccctcactacgatatatctatttttctatcttcatcagtattttctaattaaagatctctgacgatgctctcaaatattaaaaaaaattgtaccgaatttatgttacagtttcaaaaattaaaacaagcaattaaaataagcaatgtcttgctaaatatcttgaaagacacacgtcttcataaatgtagtggcacatttactggaccaacgtagctttcatggaaaagactttacacttgttataattttgcctctcatgtaaactaaacgttttaattcgttacacgaattattaaaacctaatcattgattatttattcctgaccttgtttcttctccttccatcacctaattataatcagacctaaactagctaattacaacactccactactactactactacaactcttctgatg

SEQ ID NO: 9968 - DNA, 3000 bp, Unknown
  misc_feature (1)..( 3000): cDNA_ID_2164645_gDNA_ID_2096296_Annot_ID_195572 3000 nt of promoter + ATG
catctacagtttctattttttattctttgttaaaaagatagatatatccagtaacatttagtagagtcgcttgatatttgatgggaatgtatttgcatggtatatgtatttgctctggagtcttttgtttcacgcagaaaatttatataaaatacacagagacaagttgtagatgttatattggtaaagggctgcttactagctttctgttttagttagtgttgttcaatttgattgggtttgtaagaagctaatagcattaaaattataagttatggagtactgttttaatgcttctctagctttctgctctttctcttattattagtgttttcctaattgattgggtcatcaggaaactaataatgataaaaatgatgcagtattattcagaaagttatcctcagggatgttcggacaccaagaatggtggtatagagacacagaagtttttcttaaactgtttatgccttttgttgggccgctttgagggaaagaaatttgagagcatactatcagagtatggaatgaagctcgtgcctattcttctacatcaggtatctttcgctattgtttattgaataggggagtgatgacacactttacctgaagttctcttgtagttatattggttgttctgctagttatgctagaattcatttcttatattggcttttatgacttcctgctcaactcataattttgttctgctcaattgattttatgattctaacatatcgtgagaaaattaatcttgaagggttatatatatacacccatgtgatcatcttagtgcttacattcttcctttgtattcgaagcttcgcagtaacaatgaagagatatcagaaggcgttgtggctatatttaaggcagtcttctttaaattacaatctcagtccggagacagcttctctgatacaatgtgcatggacgttgtgataccatcactgcttcaccttcttgatgaaagggatggcgcggccaaagctgttagtgtcctgctggcagactattgttccaagtatgtctattctctttccttttggtactaaatcatgttagtagctttctagttaccagtgacggtacctagtttgtctctgacttaaagaaacattcaccagaaatgcaggtaatagctgtctcagtgaaattctacaacgccttgcttctggaactactgtgcaaaggctgaattctttggatgtgatatcagaagtaatccttatgtcaaaagattcatttccttctcatataccctggtatgcaatcatttatgtttttcgtcccaattttctatttctagcttttctgtatcttctttatttgcattctcatcccctcagaagtcagaatcattttctgctcttatttcaggaaagagattgcggactgcttgttaaagtgccttgatgacgaggaaacatgtatctgtaaacaaacttcagagttgctgaagtcaatcggttggtcttcttttagcctttatccgctattcatttggaagcttttgtttgtggccattattaatttctggtattggcagtcttatgtctcttatgacctctaaatatggcctttcttcatttgataagatgaattttgctgataataatcagtgttttgttaaaaggaggatttctgttaattattcattattcagatgagaaaaacttataaagatccaatttatggggtccaaaacttgttattccatattgcaatggcagttatagttcatattggataacatttattttctgctttcctatataatgaagccaatcaactgaatgatttttgttatcgttttttcttccagagccatcatttgtgctaccgaatttagtaaacctcatttatgcacccaatggaaaagtacaatcatcagctacagaaaccttgcttggggtcctgaaacaccataaggaggattttgatgttatatgtatgttgctgaccagtcttaggtatcgtgctctgtctctttttctcctttccccattgtatacatagttgtttgtttattcccatttaccctaagtgagatgtgagaatacactggattcttaggtcaagtttgtaaaagtaaacttacgaatgctcatacgtgaaaatattgacctgactacctggtttggtttttaattttggttttgcattgtatcaagctaatattgaaaaaggctttctgcttttgatctccacttttctcttgtagtaatatccaagctttggatactgcagaaagtaatggacattccactgaaggtatttggcttcttatttcattaccataggctacatgcgatacagaatctgtgttaaaatttgtcttatatatgtacaatccgaacgtattatataaaattattacaacacttcaaatttaagctggataagaaataaaattactggaatgtgaaacttaaacgatgtgaaatatgaactagtctggctgaattacatagcggacactatcaagttattcttggtcaaggcatgctcatcatcttcttgtactgttacaggtttaacttttgacagtgatcgagtgctaaagctgatcccagagtgggctagaagtgtaagtacaagaatacgtcatgcttgctttgctatctttgaaatcaatccatttttgtttctaaagtgcatgtataggcaccatttacgaactgttggtgcactactgaatagaaaatggtaactgaactattaactctgaaccttcaacacaaactttttcaggcattggttgtcccttttttcccttccagtactatttccttttatctaattgttttcttgtgtatgtgctgggaaactcttcgcatgggaatgaccaaagtgaccaaagcttgtgccagctataattaggcaattagaatatatttctgcctgttgactgaaatcaaattcttacaggtacaaaactggaactcactgatcggacctttgcttgacaagatgttcttggagccatccaatgccatc

SEQ ID NO: 9969 - DNA, 3000 bp, Unknown
  misc_feature (1)..( 3000): cDNA_ID_3034930_gDNA_ID_2096296_Annot_ID_195568 3000 nt of promoter + ATG
atcttacctggatcactttggtatacaattctgttttctatgaaatatttgttcttaacttttttcttgttcatctcctgtaatcttattttcatgatccgaaaagtttggttttaggccatatatccctgaacatgtttttattttcaacagttaccaaaattttatcacggtttttcaaatttatataggcctaactttttttgtcttaaatttggtgcaagacgtacgacttgaactatttttcctatgtagtataaaaaatgcgaaacaaccaaactaatacataaaggacctatgccaatatatatacatgattcctgttgagtccaaaactaatgaatctttatatggaatcaaatttcgaaagttcaaacacatataacctccaaaaaaaaagtgggattcaattcaaaaatgaattagccaaaagatcataatttcgtgagcctccttgaagtttggattccaatattttaccaaccacacactctttagacatgtgtatttttgtattgtaaggtcgatttgttggctgtggaatttttttgggtgtaaataactaactcttaatatttatttgagaaatttcatatactaagaaaataataatagttaaacctttaagattttttttgaataagaattattttagtgacgttaagctttatttttagaaatgttagatcggttcagcttttgtcttttactgaattgaatactttaaaccaagataaccttcatattcaaagctcgaatcagaccaaactgagttgacaattcatagccgatgaaattcatatagcatggtttatacattgattcttaatattctttacccaaatggtcatagtggactcgtctttgtacaaagtattggaataacgcaaaagagaatgttcaaaagagatgaggacaaaaaacccaattgatgtccttatccactttccagtattcaaaattgaaggattgatgttttggtcaaaatcatgtcttgtttgaatacaagtttgaatttttggggacaaatcccatgtttctaaccaatcccatatggccttgtctatacattattggctcattttcacatttggcgtaacctaattaaatattgacctcttctttacgttaaactcactgtaacctttttgttttattcgtctaaatctctttcaaattttaccacttttggcttgttatccagaaatcatatccatgtcataactttgattaatcctcgtatgagtatgttttatattcacttagatctgtttgtttgataaacacaaatattccatttgcataatagttaaagtagatcttaaagtctcataattagttgagatttttttttcaaatggtgcggtctcataatcagttgagaattttcatcaaatcattttttttaattatacgtaataacatcttatttcaaaaatccttttcaggattaaagacaaaattatgggaaaaaggaaaagactaaatcaaataaaaaacaagagaaatcaataaaattatagtactccctctgtttctaaatataagatattttatctaaaagcacaaaattttagaaaataatcaatttcttttgtttttataatttctacattgaaaacataatttagtattaagtcaaagagagtttgagcagtaaaaaattactgtagaatataaaaagtcatataattctaaaattttaatttttgcgtaaaaatttaaattttttatccaaaacatcttctaccgtgaaataaattaaaatggctaaaaatctcataatataaaacaaaggaaatagtaattatcacagaatacaataataattacacataatttacgacaaatcaaaattaattttctttttaattaaaattattgtaatgcatcaaaattaacaaaaataaagaaaaagatacgatgatttttcttgaagttagcaccacctaaatttcagtttgttttatttattaaaacaaaactgagattgacgtggtgaaaatttcataaaaatcttaaatattagataatgtaatttttttttacatatttatatttttaatcatcgaatataaaaatatttggattgattatgttatgctattagttgaatattatcatttttatttaaaatttatacaaataatgaaatattattttcatttagttaattctataatattaataattaaagttattggttaaaataaataaataactgagctatcattgacttaaaagtaaaataacaaatctatttttaattttaagagaaaaaactaaaaaagtgttgactgagtaaatttctgggttccataaatattgatgttttattgtatttaataaaatgatgtttttcatttatttgttattatcttctcttccatacaaagaaatatatgtgaatttcatcccataaattaaagttttctacttaaattattcgtttttattatattgttttctattgaaaataaacattatattaagaattaaataattgtattaacctataaagaacctccgagatttcctagaggtagctttcctcacacaccgtcacggccgcttgtctccaagttgtcttgggactcgtcgacgatgcacacatagtatatttatatattcttctcctagccgaaccagaaatttccagagagataatcaaattcaattgcataaaaactgaatcttgttgttgaaaaagagctctcacaaaacttgtttctcaattctctcctttggccctttttctcacaatctgcggatataaatacgcttcttctcctccgctaattacccaaattcgatcctaaagctctcgtctttcttcagcgttttccggtgttcatattcgaggtaggaaaaaagggctttgctttgtgctgagatctgttgttcatctttctaaagttttgtgtttttattttgatgaatctgctgcatttgtttgactgttttctgcagaaaaaaggttcaaccttttttttgtttgat

SEQ ID NO: 9970 - DNA, 3000 bp, Unknown
  misc_feature (1)..( 3000): cDNA_ID_2109082_gDNA_ID_2096296_Annot_ID_195565 3000 nt of promoter + ATG
caaacggcgaaggtggctaagattaataataggtttaagagacaagacgccgttattaacggttggttgaatgagcaggttcatagagctaactcttggatgaagaaaatcgaggtgactcatttttttctattttacgaatatcttagttagatccgatcgattaagagaacaagatgacttataacatgcttttcttgaaactgtttgcttttacatgtataacaaaataatttagaaaaactatgtaacgttttcaaattgcaaacgataaacgtggacaagcgttttttacaaattataaaatgcatattttatccaaccaaaaaaaaaaaatcaaaatgtaagaattatgggtttatttgaaaaaaaagcagaaacacaaataaacgatagatccttgaatggtggtgatatatcaaatatttgaaatgtgataaagctatccaaaagactgactaaatagacgtcgatgttgtctttggaataatagattatgcgattgatacatatatgtggatgcagaggaaactggaagataggagagcgaaggcgatggagaaaacacaaaacaaagtggcaaaagctcagaggaaggcggaggagaggagagccacggcggaaggtaaacgagggacggaggttgcgagggttcttgaagttgctaatctcatgagagccgttggacgacctccggccaaacgatcattcttctctctttcctagctaagctattactagttttagttacatccaaatgtctcaatatatataggctaccattttctgttgggaatcaatgtgtatataactatatatagaatgtaagagttttaaaggtactgatatattttgtaattgtatgcttttttctttgtctgcaccacataaaaactaataaaatgttatttgtaagccaagaaaattgtttacatgtattgttttgtcattccatctgctgagactgatacgactaaagagttaaagaaaagaaaaaaaaggttcaagctcttacttagtttccagctctgttcatttaattactctctctaccttggcctgtcactcatgtgtttaagagctttaacaaaaatgtaatttaagacgccacaatttactaattcaggctgcaaagctcgaaaccctacgtatttcaggaatggaatttcgaacccactaaaatcttgctcagacgagtctaaaacctttttgcatacaacttgtatgtatttcttaccacactcttacggtgaacaaaacatagaccttatacacacaagtgcaagaaagagagaagtaaagagattttgagatgggctgattaagaaaggcttattttcggtttttgcttctgccataatgggcctacatacccttttttttttttggtagaaatctacataccctttctttgttaactctcctatttatttgtccatcaatatcatagatatattttgttttggtcgttttaacaaacaagactcagtctttggtaaatgatcaaatactaaagaaaatagagtgtactgtataaaacccctcatttcttgcctaattatatattgcacttaactctcttttttagtaacggtaatctaagtaaacaaattacaaattgaatcattgacttggtaggagtaagacaaacactcgtgtaaggaaaggaatgtccatcaggagctttgatattaatttagaggcatttgataaagtatcttaccacattcatactccgttgactttgctaattattttatatataaactaactctaaagtaaaattttaagtatttatgttacttttaaatacaggtttcgacccaattgcacatatatctgtaatctgaacaattattaaattagttgacaaaaaaataaaaataaatttatttctatatcagttaaattttgataaatcaaaatgcgtttatcgatttgttggtagaagttttatagtgcaaaaccaaaatcatcaacttgacagaaaaagcaaataactttgagtaattacatatgttggttgttttgtatcgaagtcaaaaaaattagttagttgggtccgacgaaagtgattaaaaagagtcaaaatcgccgtgtttgaccttttaattataaaaaaaaaacagaacataaaataaaggtggccgcttatttatgaacccaaacacgagcgtatttacggtttcacccttaacttttttttatttccaaggcgcttagtttaagaacgtgtcacagactccgctttctgtttaatccatgaggtaaaattcctgaaacacccctgtcttcgtaattatttgtatgattcatttcacagatatatatttatttggtgctagaattttgttagacattctataaaaataaagagttttctaaaattaaaatgaacaaaaatattctaaaaataaaaaaaattctgcaggagtttgaaaaaaaacaattggtggacatttaactatttaagccttaattttttttgtcggcatttaagccttaacttaagatcacatatattcaccaaaaataattaaaatcacatataggggtaatattgtcaatagtaatttggtaaagctgaaggcattttgatttcacattagagtaatgtaatagtaagaaacattctttgaaaattaaaaatttaaagtgaaaaaaagaaacagacaaaaaaagaaaaaaaaacaatcatagagcagctggagaagaagggagggaagaagattctcttgaccttccttccatcatcatctctctctctctctctgtaattaatttttcgcaattttaattttcgaacaaatgatttgacgttcttcttggtattcacgcgttgaaaatttccaccctttcatatattgttcttcacctccttcgtttttttctcatccatctcttccagaattctcttaaagtttcctactttcctggaatttcgtcctcaatctctcaagtttcatcggttttgatttgggtttgatcggaaaagtcatg

SEQ ID NO: 9971 - DNA, 3000 bp, Unknown
  misc_feature (1)..( 3000): cDNA_ID_2105059_gDNA_ID_2096296_Annot_ID_195562 3000 nt of promoter + ATG
tagtttcgttctaataatatagtaccttaaaacaaataatttgctcctaaattcctaattaactatttttcggctttcctctcaaatgaaactgtgagtttttttagtgttggccaacctcaagtccccaattagaaatagtcgttgaagtaattatccaaaattaaatcctggttatttggtctatttggaaccaaagcctaatgattttatttttagaatattttttctgataaagagggtaattatatatatatttagaattgttggcgctttacaaatctaaagtcgtcttagccaaacaattcgaaaaccgacactcttacaagttacaatacctaaaaaatcagaagaagttccaggtagagtacgtaatttaaagggtcaatacgaataatgatgacaagtcagttatatgatgatcataaactttttgacgccttacatactattcgcaccaacgaaattaacagatactagtactattatatattttgaacaatgaaatgtgtatggattagtacgtcatcatctcgtctcttcaaacttcattttgttgtacgacaatccatatatgagctaactaatatttgtgttccatattttacttgtttggtgtaaaaaaaacgcatatacgaatattttactctgtttttttcttcatctagctattttttttttgttgatatttttccatggaacgtaacatagtgcaacattaatttcaaaaaattaaaaaaccccaaaacattagttagctcataaatacacgatcaacccaattcgaagcacggaatcccaaagaattcaaacgtacatgtcttttccatctttttcagtgtttaagtttatctttctttgctcttttacctacaccaagtagtaatattttaaaaatgaaatagtgaaatagtgacatccacgaaaacgatgtgcaagttgaatcgtaaccattaattaagaaaaatacaagagataaattcaaagaaggaagcaataactaaggccaagttataacaatgactagataaatttccaaagacatgactctcgaccatacctttaggtctctcaagcaaactacgcacatgcctttaacttctgcctatttttacaccatacgcgcatctacatattaacactagtatatacaaatatttgtattaattaattggtaattacaaaacaattagataaagtataataaggataagtacgtgatcttttgtgcttattaatcgataggaatatatgtatgggcatcaagtcttcaccattgttcatgatgtcccatgcattgtagtatttttgtaggtttctttaagccgcaacccggttggccgctagtttctttgaaattatactaaaagacacctttgaaatcatagaaaacaatgcttgacatggtttcaataacaaaatactaaactttaaataattgacatattagtaaatcataagattcataactaaatttccaaagtaacttggtatttttatttttattttggaagaaaattggtattttcattatgataaattaatgtatggttttaattaactaattaatgaaccatatataccaaatttcacgagacgtgttgtactaactactaaagacttttgagactaatatttttcatcatttgggagttgaatgcaaagttgttcccgataaacttttcagttgattttcaagcaaattagatcttgttggcgttattatttaccataccatttcaatcattacattaggtatttgccgtttacgtatttacacttcttatttgaatttggtactttggcacatttacacttcttacgtatatatcatcctaactttcttcgaaagtaaatgaattttaactatttcaaataagtattgataactgaccatgaccctagttaattaaaagtccacaacatagcaatatgcactttttcgacatgaacttaatgagttcattctaatctcacgagtacgcctaacaatttaatttcggtataccaattcatgttggtttaatgattagtaatttattagaggatggaaatcaggtgtcaaactatttcgttacaattttaatcatgtctggttaaggaattatgattaacattttagatagcaaaaatattcagattttcacatatccaagacaataatccagataagtcctctgtctttttttttcttaaactctcatgttagttacaacttacaagtctatgacgtcgtttgtgggaacttttgaaaaataatgagaaacgcatgtagtttaatactcgatgctcggaactatgtgagttttaaaataaacatgccaattttcaaagaaaaatatgagatttaatatgcgaaatgcgatacaaagaaatatgatgaatacagtatattgttttctgcagattttcctaaacgatgatatcatcagagcctcatagacacagacaaaaacagaagaaccaagaaataacaaaaggaacccaaaactttgagagacacaggacacaacgacgttttcttgtcacttttgctgatttttgttttctattcttttctaacttttgatataatacatcacgcattgcttagctcagtaattacacatgatgaaatgttactgtgaatagtatatgatgatgaaaattaactctttttctaatttacagaaaaaaatacgtaactaattaaactgtgaaactctcaatgtaaaattaaaacaattaaaaaaaaaataggggggagaggaggtaaggcttgaagcttaaagtgatgttttcgtatcaatctcaatttctctccatacctccaagtacgccattaaaactttaataaacctaacttttttcctccttcaattcgtctataaatacttacaccctcccacttcttcaatttcatattacacaatcccaaacaagacaggcaaacattctcatctcactcacaagaaaacagcacacattcttttttctgcaaaaccgatcaaaatcgaaatg

SEQ ID NO: 9972 - DNA, 3000 bp, Unknown
  misc_feature (1)..( 3000): cDNA_ID_3034944_gDNA_ID_2096296_Annot_ID_195558 3000 nt of promoter + ATG
caaattcagtagttgatttgaatctagactaatcgtcatttcgaaagaattagatgctaaatgattgaaaagattcatttgttttatctgaatccggagaggaagcttatatcaaatcttttgaactttttttttgaaaatttattgaaggtgtattgtctggatcatcgtagctatatgaaacacgattgtccaaaaggaaacagaggagatgtcactgtggttatttgtccattatgtgctaaaggagttagattaaaccctgacgaagatcccaacatcacctgggagaaacatgttaatacagactgtgatccatctaactacgaaaaagctgtcaagaagaagaaatgtcctgttcctagatgcagagaactcttgacattctccaatactattaaatgtcgagattgtagcatcgatcattgtttgaaacatcggtttggacctgatcatagttgttctggacccaagaagcctgaatcgagtttctcattcatgggtttcttgagtacaaacacaaaagaagctcctgcatcatcatcatcttcttcgagatggtctagtcttttcgcttctgcggaagcaagtattagtagactcggtaacgatataagccagaagttacagtttgcgagtggcaatgatggcaattcagagaaaacgcaagagaggaatggaaaacagaattgtggcaaagttacggttgatgtttgtcccaaatgtagtagagggtttcgtgatccggtggatctattgaagcatatcgataaggatcatcgtggcacttctaaagcctagaagaaaggaagtggttttatatttgtgtgatttgtatcattctttgtaacacagccaggaagaaagaaatttccatattcttttgagctcggtttttgttttgtcgaattggttttcctggtctaggagataactgaatttggaaaatccctctcaaatcttaattaagaaaatataatttcttttaaaataaataattgattggataatacttcgaagtatgtgttgggcttcgggccgaaaataacgggacttggaaggcacacaatctgagaatttgctatataagagggcgagacaggtagggtttggagcacagctttgcttttgagttcgggaaccactttgccctgacctgtcaggttctctctctttaataaattttgattgtgtagattcttcctttggacttgatatattttgctctttctctctgtttagcatatattatcatccgatttaggtattgactataatatatgtttatgtttattcttttcgtaagagcagttaattacagttagaaatccagtcatggtggtgggtgcggtagcaagatatgtgaaatcgatgtggtcaactcccgagggtgttacagatctaatcatggcaatgggattaccattcgtaggtttgattatttacgaacaggaaaagcaacttgctatcatcagagagcacaagaaggttttaggacgatttttgggaggaatggtcatagttagagaggagtgatcggtcctagataatccaaaaaagggtgtttttcttttactaaaggtttttatattattctccataaatgtttccatgaaacaagataactcttttgtataaagagattaattgattttaatttaagagatgatttatgtctacaagatactcaaagatatcctatggataggatttatctgtttcaaaatttctatgattcactgtttgttttaataaactatttgacaaccaaaagtagaacaatattggcttcatcggccacaaagtacctaaactcaagacagatatagaagtgtgtaaaatccttcaatttatggcttctcaccaaaaagtagctttgaccccggaatcaatgtcgtaaattaaatacacataatctattatcactttgctgattgatctggatttaagcaagggtttttgaaagcataagtaaccattggttaaatccatagaatctgacaagtgataatagtgatctcgcaagctaacctaataatcaaaaccacttcttaggctgttcttgttgccaaaaaaaacaaaacgtctatgcccatatcgtgctaccttcaacgcagaattagcaatttcctaaaaatttgggaaacattgtactattatagctccttgcatgttttgactgtaaaaagacaaaccaaaacaaacatgtgctgtgacaaaaagaattaccaaattaaatagagatgatgatcactgaccttcggaatcaaccttgtggagaagaagcccgagagagtttgtaggttaaataaaagttacagtgcatcggacgatattaattacccatgaaaataaagttagggtttagaagttagagaaaaagtgtctctctgtatctttgacttacgatgatatacagtagagggactgcactaacattcgacacttacgatgtcgacaaatagaaaccagttgttactgatgccttcaaaagtacatagaatatgacaagtgataatagtcgcttcactaattagcctaataatcaaattatcaaaagcattcctgaatagtaatccatataacacattcatcttaatataaaaactaatatcttcacatccttctaaaattaattaatctctattttagtatttagtttcattgaatatatccggatgtgatctttacaaattacaattatcaaatggcattgaccacgtgggctaagttttgttgatgctgcgttatgacccgttggatcacactggataatttctgtgagcgaagacttgacttttctcaccgttggatcttacctaggatagacacacggttgataaatagttctgcgtagactgtacctcactggataagttatactcagctccattgttcctgcttgcttcttcttagcaaaaaaagaaaaagaaagacgttagtagagacattcataagagctaagcctacgaaacaatcctaagtaatcgaacggagatg

SEQ ID NO: 9973 - DNA, 3000 bp, Unknown
  misc_feature (1)..( 3000): cDNA_ID_3034956_gDNA_ID_2096296_Annot_ID_195553 3000 nt of promoter + ATG
aatttggcaactgatgtggctgtcggaagcgctttagttgacatgtacgcaaaatgcgggtgcctacagatgtcgagaaaagtgtttgatcagattccacaaaaaaatgttattacttggaatgtgattataatggcttacgggatgcatggaaacggtcaagaagccatagatctgctaagaatgatgatggttcagggagtaaaaccaaacgaggttacattcatctcagtatttgcagcttgtagccactcaggcatggtggatgaaggattaaggatattctatgttatgaaacccgactacggggttgaaccaagctcagatcattatgcttgtgttgtagatttgcttggaagggctggtagaattaaagaagcatatcaactcatgaatatgatgcctcgtgatttcaacaaagctggagcatggagtagcctccttggtgccagtcggattcacaataacctagaaattggagaaattgctgctcaaaatctcattcaactggaaccaaatgtagctagtcactatgtgttacttgccaatatttattcatcagcaggcctctgggataaagcaacagaggtaagaagaaatatgaaagagcaaggcgtgagaaaagaacctggatgtagctggattgagcatggcgatgaagtacataaatttgtagccggtgactcatctcacccgcaaagcgaaaagctcagtggatatctcgagacattgtgggagagaatgagaaaagaaggatatgtacctgacacatcttgtgtactccacaatgtagaggaagatgaaaaagagattctgctttgtggacacagtgagaagctagcaattgcgtttgggatacttaacacatcacccggtacaattattagggtggctaaaaacctcagggtttgtaatgattgtcatcttgcaaccaagtttatctcaaagattgttgatagagaaatcatcttgagagatgttaggaggtttcatcgtttcaagaatggaacttgctcctgtggagactattggtgaaagataagctccataaaactctcttttttcttcattgtatatcttgtaagtgttgattcttgtataagttatacagtataacacacagttgaacacactgatcttaacaaaattattagtattaaatgtacttattggtctctgtagtcattaagaaaataaattagataatttaataaactaatcagcctttagttaatatgtaccttttccatcatgtgatggtttctctggtcctacagatctgctctttagttgttgtctctttgtacatagaaggatagatgagtgatgtgggcattgttgtagtgtttcagtaatcaaaacgtaaagaacaaacaaaggaaaaaaaaaaaattactaagaaattcccaaaagaggaagacattgacctcgcagctcaacgaacgacttcgctttcgcagtttgcattgaattgaagcataagcaacctccaaattccgacaacaaccgatttcctgcagagagagtctctctttgtttgccctggataggaaacctacactactctttgtgatttgattttgttatctgaattcagagtcttgcttctgggttttggtctgggttttggaggtttagtgcttgaatctgatgttggttcaagatcgtgtggctcctaagccaccaaaatctcggatcagagaacttcctagtcgggaccgattcgctgaacccaaaatcctagatttctcttcatgggtttccgacaatgtctacagaatcgtaatcatcttcctcttcatcgtcaccgtcgctgctttcttcttcctctacaacaccaccgacactgcttctctcctctgtttccaatcccaatcaactcaatctcttcaatctctcactcgccctcaaatcaactggaactcgatccaaatcgtctccgacaaaacctcaccttacgctagtttccgtacagagaaatggatcgttgtgtcggtgacaaagcacccaacagaggagctcaaaggtttggtcaagattaaaggatggcaagttctagcgatcggaaactctttaacacctaaagattggaatctcaaaggtgcgatttttctatctctagatgctcaagctgagcttaattaccggattttggatcatttgccttatgattccttcgtacgcaaaagtgtcggttacttgtttgcgatccagcatggtgcaaagaagatctttgatgcagatgatcgtggtgaagtgattgatggagatcttgggaaacattttgatgtagagttagttggagaagacgctaggcaagaaccaatcttacagtatagtcacgaaaacccgaatcgaactgtggtgaatccgtatatccatttcgggcaacgatcggtttggcctagaggtttgccattagagaatgtaggtgagatcaatcatgaagagtattacactgaggtttttggtggtaaacagtttattcagcaagggatttccaacggtttgccggatgttgattccgtgtattattccactaggaagacgactttcgaaccgtttgatatcagattcgatgagcattctcctaaagtggcgttgcctcaaggtatgatggtgcctgtgaattcgtttaacacattgtaccattcctctgcgttttgggggttaatgcttcctgtttcggttagttccatggcttcagatgtgattagaggttactggggacaaaggcttttatgggagcttggtggttatgttgctgtttatccaccaactgttcaccggtatgatagagtcgaagcttaccctttctctgatgagaaagatctccatatcaatgtcggtcgtttgatcaaattcttgcttgcttggagatcaaataagcataggttcttcgagacgattcttgatttgagctttgttatggctgaacaagggttttggactgagctagatgtgaaattcacagctgcttggctccaggatttgcttatg

SEQ ID NO: 9974 - DNA, 3000 bp, Unknown
  misc_feature (1)..( 3000): cDNA_ID_3034948_gDNA_ID_2096296_Annot_ID_195557 3000 nt of promoter + ATG
tcttatgcgtttcttgtaagacaagttaaaatatgttattctgaagaacgaaataaaactagagtaaggtgataagccttcgtagtttgttattatatcagaaaactgtttatcaactgtacttctatgtttcagcttattatgctcaggttgctggtcttcactatagattaagtctttcggacaatggttttgaggtgtgttttgtacaaggatgctgacgtttccttgtgtaattttctcaatgagtttcatgtttgactaacagtttctcatttccagctctctcttgttggctttagtcaaaaattgaggatagagaaactagatgctctttcttttttgaaagctgaagacttggcgaatttcgtcccaatgttgttgtcgaggacatttgttgagtgctatattgcaggtgtcaacattattcctgttgtagatatatacacaaacacaacattcatataccaaaacgacattttatacttgaatctgtattagaaaacagagttttatcgtttaagctctgttgattgtagcttttgtctgacaaagatattgataaagactttttacctacttcaattgtcaaattgtggaattgttgaacctaacagatctttttggctcagttgttgaattgtgaaatctattacaattttgtttaatcatagcaaatcagttcttgagtattatttgtttaaccgttgtgacagagtgaagatgctgttagctccagaatctttgggtgtggttcaacgaatgataggtttgtgctctaattgttgatatgttcttaagaatcccactcttataataaaagatcctatccacatcaaagtatcgatcatatggatataaatcatctcctagattttttaaaagagtttaatggaacacatttatggagaataatataaaaacctagtaaaagaaaaacatccctttagagcacccacattggtcatttttttgtgggtgtctttaaatataaaactagtaaaaaaatataaaacaaatgaagagtatctttaatttttgatttgtgtttctaggaagacatttgagacaccaaaaagaagagatgtctttgattttattattaatctatactaaagacacatatcaaaagctatgctatgaggatgctcttagaataatctaggtccgattactcctctctcagtataatcattcctcccaaaaattgtcctaaaaccttgttgtgctctctgataataaatagcaagttgctatttaagatcatccgcattgcataactaacaaaaatgtcctcccatattaattcaattattaaaatgtgcagggtgattttaaatgagagacccctttcccaaaatgtctcaattgaaacaaatttagacattttgaaaaggatgtctctcatttaaaaacatccaaacatttgaataattatattttggagggaagacatctaccctaaaatatccaatgtggatggtgtaaagccacctccattgcacaagtaatatgagtgtttatagatattaaatgaataaaataaaaaggtctgtgtctttaaattgaagacatcctcttatatctatgtaatgtagatgctctaacacccgcacgagttgaccacaacgatttcacatatcttgctaccgcaaccaccatgactgaatctctaattgtaattaactgctcttacgaaaaaaataaacatatataatcaattcctaaatcggatgataatatgctaaacacacagagatcaaagaatatcagttccaaaggaagaatcttcataagaaaatcataatattgatctctttatagtcaatccctaaatcggatgttaaatatgctagacagaaagagagagataaagaaacgaacaattgcaataaaatcactaatcaccaacacaatttttctctactcttacgtgttattaggctactgcttcagaacaatttattgggccaatactttaagtaaggaaaataaagtaaagaaacccaaaaaggtcattttcattcattttttctatcacacaatttagaatacatgcacaggagacttggagttattgaatcacagattcacagtacttatattcaatagtatcagcatgtataagtaaactgtggaaaaactaaactggagttttcatagatatatacacacaatcatataccaaaatatgaacttttattcatctggtttgttagaaaatagagcttttaagatatttaattataaataaatcgtggaaccaaatttacacaattttttaaatccatccagaaagaccatatattaaaattttaaatatggaagtttaataaacaatatagagattacacatatttaacgaggaatcgatacaaacaaatatattagatcacttcatgaaaacaaatacaagatagactagagtttctatataagttttactaagagatcaacacaacacaaccttaacacctatgatataaaatcacatagagaaaaaaaagagagagtcaaattaccactttattaagacttttcaaggaaaacattatgacaaatttgcaatttgtaattaataaaaagaataatcaaatcataactgaaatgagattcttagaattaaggattctacaattattatgtgatgaaaacttatggcataaattgaagtctaaatctgtatgattttattttgtcaaaaaaaaaaagtataaaccaacgttggcattgaccacgtgggtcaacaagtcttggacatatgcgagcgaagacccagcggagacttcagctatcgccgttggatctgtatcagtatcacttggggaaatatagaccgttgataatgagtcagacgtagacttatataacacaccagtaatttcttgtcagctcccctccctctcccttagtccctttctgaagtttagaaaaagaaaaagaaagacgttatttggattatatagcaaaagattcagctaaagtaatccaacagcgatg

SEQ ID NO: 9975 - DNA, 3000 bp, Unknown
  misc_feature (1)..( 3000): cDNA_ID_2186672_gDNA_ID_2096298_Annot_ID_195588 3000 nt of promoter + ATG
gcgttggttagtggaacaatggtgtctttaagtacaagtaaagttaacacccaatttctttatagggtcatttttccatatattttcatgtttttttttgtttttttctttcttctgtatctctctatatataatttcttttgatttatctttagacattgactatacttctaagtttagatatataaatacgttgtaaaaaaatatgataacatgcatatttcatactactttgattctcacccatataaatttatattcaaaaagggctcaattatggagtttgtagaaataaatgacattattcttaatttcttaattttgaaaagaaatctaatagcaatacatatttaaaaaaacagaatcagaatatatttctaaagaattttttttttttggtacgattaaatttatgaaccccgtaacaaatatttcttgttccaccaatgctaatgatctgctgtccaattggtcactaagtgatttaaaaaactatacagaatactttctagagatagttgatcaaaataatcatacatgagaataaaatattataagttatccatcaattattatcataaataatcatttcactaccgtcaaatttgtaaaattgagcctcacgcaacaaggagttcaattgtatcaatttaaagtaatgtatgtggccgtgaaaacgtttataatatactataagaattttaatgtaatttttctgaatttatatgattaatctttattctccagagttaaaaagtaaaattttaaaacttgatgagttagatggttcttttgtacaaaaccctagaatcatcgttatattaccacatttttggtcttaagacgcatattttgcggaaaatctcaattccacatttttgcaaaaaaaaaacaagattctgtagttttagtgaaaaattacagcataaaacacagaattacacaacttttttgagaaaatattattctacaattttcaggccaaaacataaaatttacaatatggctgaaatctcacaactttaggtagaagatgcaaattcaagattcgtttattttgttgtaagacaatcttataatttccgctagctatagaaacgctataaacatatctcaataatgtggatacataccttcttgatcttcttcagcttgaacaaggttagaaatagcgaaagttgcaataattagtacgaccaacaaaaccgaatggggaaactccatatcctcttactttccaagcaaaatcaagaaagacacggtcccaagttctgaaccataaatgaagtttatataagcaatggcgccacacaattcctttagacatttcaagtaaaagccgtaccaagacaataatcctcaaaaaaacgtgaggacatgtcagtttctacaaatagaagtttaactgtagatttaagtttcttggaaagtttctaatgggaaatatattttttatttattagtttattagtcagaaaatgttcaacttgttcattaaatttaaagaccctatcaatggagaggatagtcgattttaccaaccaacacggctagtgccgaaatatttaaagtgagatatgccttccgttgacttgaattgttccgatcgatgtttaaatctgtctagactctagagggtgtccactccgatttcactttggttcaagattgaagttaacttgtttatgaattaggatgttagcatgcgacatccagatgatattcattttaactggtttaacatatatatgcatttgaatgttgcacttggattcgaaattaattgttttgagagtgattttctgcctaccaaacgagaccactacaacacatcaatcaagaaaattggccgagatttttctatagaaagatggcaaaatcctcggcctcccgaaaatacaaatatgccgtctgtttcggcggctcggcccgtataatagtgttttcgggagacaagtcctagaaccacttctcataaccttccaatagagagaccacttccaaatcaccagaagcagacaaagtaatttaatctacttgtacggagtaacggggggatgtccgcatcataaacatgcggagcacgccctctcgaccaaggtgatatccagtcagagaccaaacatattgcccaggccccaatacagtcagatcacttcactatactgctaactaaaagcactttgtaatcgttgacctaggtcctacgacaagtcgacaagatgtaatggcatcaacctaggccaggtaacgcttctctaaaaaatattcctctcgccatatcaaagagcttagaaagggtaaccaaatccttggaggatgatcgaatcaaaagagaatgattatgggatctaggattggaatcccattcaaaaactgttttctaattgaatgtgtagactatttgatcgatttcggataacaacttgacgcacacctttgcataaaaatcacaaaaaaacttttacatgtttgaaaatggtatatattcaagtctatgaccacccgaaagtcaactccctcttaacgtttcttcatgcgtcatggttatgaatattaaacctcaaaatattttgcagattgacaagttcaatggaaaagagtctagttaagcaagttgtgttttgtaaattaaggaattagcaaatccatttgattgtgccaatcaaaatctctactcaaggttgtgataagacctggtcgtatacgcatgtacggcatgcatgaagacttttcgcgtacttttaaaatatattaatcttgtgacgttggatgtttcactagaagacatcattgctcactccttcatttggttttcttgaaacaactattaactccatattcactcattttctcatatcgttgactttagcttggtttaattggtgtccatattagagaagcttaatttgtgtgtccttacatttagtatataagtgaaacgtaagtatataattgtgtcgatccttttctgcgtgtattgtgatcggaggaatcatg

SEQ ID NO: 9976 - DNA, 3000 bp, Unknown
  misc_feature (1)..( 3000): cDNA_ID_2186712_gDNA_ID_2096298_Annot_ID_195603 3000 nt of promoter + ATG
ctttctttttttgttttaaattttaaaacagaaagtaattactatttttaaaaatattaattaattagatgctaaatatgttaattattgacgtggcagcttccgattggttgtcttaaaaaatgataattaattagatgctaaatatgttaattattgatgttgcagctcccgattggtgttctaaatcctatgtggatggctttaaaaacaaatagtttcaacttttatatagtataaattgagcaaattttaataaaatatttatttttattctaaatatttaacggactcaatatttattttccctataaaaactgtcacatatcatcacttgtacacaaagttgagttgtagctcgatttgtttctccacaaaaacaaaatttcaactctatttaacacgcgaaacttcgaaatatcaaaacacaccgaatcacgaaatcagtatttttattcgttaaccatctaacccggtaacaaacaatctaaaccaacactaaactaaattaaagattgaaaacaaaaaaaaaaacaaattaaagaactcaaaaatttggaggtcggattaaattccatcgcattaaaccgacactactacactcactaaaacgatccatattttgtgtgaatgcaaaattaactctttttgttaatgatgtgttctatctttaatattagtcggccactttgaacaaaaataatatttcgcaattctattggctggaagcgaaaaaagtaaagaagacacgtccgtagcagatccctccactcccatgtgttcccttgatgaacaatgaaacatcgatgcttaccaaaaaaaaaaaaaaaatccccagtttccatcttttttgaaccttctcgatataaagctctctattcaattcccatctctatcttcttcctcttcatcttcctcttctctcagatcactggaagctctagctcgatttctcacaatccgccatgaactcacaagcttgtcttcttcttcagaaacagcttaaaggtacacacaaacactcgcgaatctcaacgaatctgtttcttctacgaatttggtgttgaattctctcttattgaatccgatttgattttttggtttcagatctttgtaagcatcctgtagatggattctctgctggtttagttgatgagaagaatatattcgaatggagcgtaactattattggacctcctgatactctctagtacgttccttttgatccatgagatttcatcagcttccattgagatttcgctataatctatgttccggatttgatgattcatgtggatttgagcttagaatggatcgatttgtcggttttgaagcgaattggttaatgctggattagattggagtagtgttcttgtggaattgaaatgaattgctttgtttatatggagatttacttagtcttgtcacattaacaaaaggattaagcataagttatggaactttgtaaatgcagtgaaggaggatttttctatgccattatgtcattcccacaaaactatcctaatagcccacctacggtgcggtttacttcagatatttggcatcctaacggttagttctttctctcggttatgcgctcattagctcattgatcttgtttgagtagctaaggttttgtgaaaatgttcgtcttgtggtctgcagtttatcccgatggccgcgtttgtatatctattctacatcctcctggtgatgatccaagtggatatgagcttgcaagtgagcgttggacgcctgttcacacagtacgttttacaatgatccaacattctccttgtatgatatctgagaagcttcttcttataaccaagaatgatgtcaattagatttgatgagtggaaataacattgctgatttcaggttgagagtatcatgttgagtattatatcaatgctctctggtcccaacgacgaatctccagcaaacgttgaggctgctgtgagtgttttctattgattagctatgaactcatcagattaacactgtctcattggatttacatatagtttatgtaccagagcttgctcgttaaccattctccttgtggggtttcctcttgcagaaagaatggagagagaagagagatgagttcaagaagaaagtgagccgttgtgtcagaaagtctcaagaaatgttttgatcaaagaaacactttcacactccaacaccatcttctatggagttcaaaagctcatttatcttatcgaaaaaaattccctttgaaaaactgtccaaacactacttgtaataaacccgtcttgcatcttttaatcgcgttcctcaacgtgaaatgaagtgtttggtcgaaaaaaatgttgttcttgaaaaaaactgacattaaaagttatactattcttcatagaagctttgtttttgtctgtcgaagctttgtttttcagtgtgtttacttccttgatttggacgctaaaactccacgccgttcctacgttctcctcagaaacttcgtacagttttcggcttctagtaaaaatatttaaacaaacagcatgatgtttgtttcttgggtccacgtatttaaaaggcccgtgacgttgtcgctcctggaccgttgatttacctatcaatcgctatcaaaacagttgggagagtacacgtgtccaacaccgtgttgttcttgtttcctttttttctgtttcgctttatgaacttcggagagaagacgaaatctcgctcgctttcgccgccgtgaaatttgattctccgatcactacaacgattccgatctgtcctccgttgatttcgatcctggttcgttttgttcatagctttataagaattctctgattccgtttatccgttctcttatatatgcaaattttgtttgcagattttgatattgtttcgacatgaaattggtgtgatctcgtttcgagtttcgtggcgtatttgcttattttaagtgtgtggaatcgatttttaatgggggataattctggtagaagtagaaactctatgatg

SEQ ID NO: 9977 - DNA, 3000 bp, Unknown
  misc_feature (1)..( 3000): cDNA_ID_3035010_gDNA_ID_2096298_Annot_ID_195590 3000 nt of promoter + ATG
aagaaaatagaaaatcttaaaaaagtaaacaaatttacatatactaatttatatatctatatatttataaacaattaacatttattcaacaaaaggaaaattaacaaatttgtctttaactaatgtaatcataagtgaaaatagaacattttgagagaaatagcttagcttataagatttaacttttcaattatttttaatgagaatattttcatttattaattttaactcatttaatattaatttgcttgatgtaaaattaacttacgagattacggcatatataaaacatatattttcaacaatgtttggtttctaaatatttttgtagatttctatttttttattaattattagccctaggcgtttgggtattcgggtcgggtatttcgggttcgggttttcgggcttagaagtttagaacccgttcgggtaatttaagatttcgggtcgggttcggttcgggttcgagtttatttatatattgaaatatcaaattttgtctgcaaatctattaaattacttgaaaattttaaaaattcccaaaacaacacgagtagttttgcttgaatatatcttaaaatacacaaaaatatctaaaatatccaaaaaatcctaatattttctatatataagtataaatataactaatatatatttatatttgagatatgtttggatacttattcgggtttgggttcgggtttttcgggttttgaagtttagacctgttcgggtatttgaaaattttgggttcgggttcggatcgggttttttggatcggttcttcggttttgggtattatgcctaggcctattaattatgttttgttaattgttaattatttttaatactaactaggatatagatttgatgtcataaatattatattgatatgaaaatgttatcactcaatatgaagtgtgtagaatttaaatcgagtttattatgatgacatagatagttaaattgtattacaaaattgaatggtgtaagatagaaatttattttttctttttcttttctagatactaaattaaatatagaataatggtcgcttactttttagaattcaaatatcattgataagattgagtgtatataattaaaatagaatgcataagactgaaattttgtttaaaccaataattattaaattaaatatcaaaaaaatatatagattgctatacaatattcaaatactatcgataaaaatttatttttgtatcttatacccgcctaaacaggcgggccttatctagttgtatatatttgcaaagaagtcttgtttatgtggatgctgtacttgtgctttttgttttgttcttttgtgagacaagtgctccaatttttattactattgtgatctcgtaaatttgaatttattgtttcaaatttggtgttaccttccacatttttgggctacttcttctttagcctcaaaaaaagaaaaactaataatgttattcattagttaatcaactgccgcacaattgtaaatttggacctccgataagtattacacttgggaatcaaatcacatacctaatgtagaagttttaatgaaatcatggtcaaccactagaccaaggagacttccacaaatatttctgttatgtgacaaatagttgactatttttgtaaggaaatgaaagaaaggttaaattgtcatgttatatgccatattgacttttcctagatgctaataacctaaaaatggaaattaaaaaaaaaatctttacagtgtttcctttttcttgacttcttgacccaaacaaacagtcaaatcattcaaaactattagagattatattattgtacattttttaatgaattggtatgtctaaccaggctatgctcagcctgccagagtaggtcttgagtcgtcatactgcacaagacccaaacccttcatataagtttccggccatttagtattagagtgtgggattccaacctaaaaccaattggcaataggtggagaagtccatatcttatatataccacttaagatcctactcaacttccgatgtgggacattgtccctaatacgccccctcgagatgatggctcttctagccattgatttcgatatgtttgggcatggatcggcgggccaagtattgggccggaccgatgtggatcgggttgagtatgtgcggatcgggctttgataccatattagagtgtgggcttccaacctaaaaccaattggcaataggtggagaggcccatatcttatatataccacttaagatcctacgcaacttccgatgtgggacattgtccctaatatttagtggcatgacatgcgggttgtgtcatctttaattttttcttaaagaactcgatcgagttctctcaggtaactcaagtgtcgtaaaagttaatagtgtgggactagatcttatgctgaatattgttaatttgttctcatgatgacttagcacgtctttcaacttccgctgggaggccgttctcatgaaagattggagagtggagaccctgtctcaattgtttgctgagactgttaaactgtcacccacatgtcagttagtgataggtggatacaacattgcttccaatgaacattattttcttttgctaaaatgaaatttctgactagtggaaagcacataaaagcaaatttttgatatttgcaatatcgtcctgacctaaaacattttctagtgaccatgtgtttaaaaataatcaaagacaagttggatgataaaagaaaatttttaaagacaagttgaatatttttggccaagaaactagcaaatatttaaagacaagtcgaaaacatctttactcattcgtcaaattgaatttctttttgtagaaattaggacatctcctcacgatttcagaggattgacatgttaaggtgttttacttgagaagtccaaaggagttttgtggcctaattgcttataaacttcgtttatggttcaggaaattgggtcagtttttatttcgtttgggaaataagaaaat

SEQ ID NO: 9978 - DNA, 3000 bp, Unknown
  misc_feature (1)..( 3000): cDNA_ID_3035006_gDNA_ID_2096298_Annot_ID_195591 3000 nt of promoter + ATG
tttaattatctgctagtagttgtatcgactaacattgttaccatttaaactcgtagtctattgtttgtgaacttttttaaaaacgttaactaaaatgatatagtatttagccgaaacgagattatcctgatactaatggtagcggatagaagcttatcgcgatacgggttgttaccaaaaagtgtttattagttttgattctttgtgtaaaacagaagaagacaacttgtggtatcgtcgttattatttttcttatctaatagaagttatatcgactaacattgttaccatttaaattcataggctattgtttgcggattagttataaaaagctacaaacaaatatgctcgcgtttaggggataagagattttcgtgatttattattataacgtgttactagctttgattcttgttgtaaaacacaaagggacaacatgtggcatcgtagttattatcttaattatctactagtagttatatcgactaatattgttactatttaaactcgtagtctattgattgtggactttctttataaagttaacggaaatatcatcgtgtttagtagatacgagattatcgcgagaccacatagtttctatttaaactcatggtttattgtttgaggattatttttaaaggccatacatatcaataatgattacaatatctttatatttttaatgtcggcgggagatatcttccaggatatctttaccatgcaacatctatgctataactatattttggttttataggggaattttcgtcagaaattatgttggagaaaagagatgattaattactcagttttaataataaaaataattttaaagttttttttgaattttttgttggtcaacgccggagtcaattaatcgatttaccggaattgtatgtcaatcgtgttaaccacatgacgttgtatagtttatatatgtggccatacaatatatttatttcatgtagctgagtatacaatagtgtagttgaaatgtgtgaatatgcattctcctatacttcatgtagttagcaaactttttttctagatattaatatagctcaaaatatatatatgtatatataatatgtctcacacatggcccatatcgtgacaagttctatagtaactatttacacttattttcctttttatttttgagcaatattatttttcttttgggcctattcaagtggttgactagtaatcaacgagaaatagttacatatatgttgcccacaaatagtagttacaaaaaagtgtctgcgaagatcattttgtgtgagtgactatgaacaaattgtccatgagcaataattgtagacaaattgtctacaatgttcatttgtaggctagatgtctaagattaatagttagggtaatattaatagatagccaaataaaacatacaaattaagaaagtagcagagagaaagttttatgttgcaaaataaccatagacccacgttgtcggaagaaatgaaataacaaagctacccttcatttgttgtaagatgaacagtaaacgaaacacatctgtgtaatttttcaaaatagcatgtaacattaaaattttacatgttatatttagtttaaaaacatgctatttcaaaaaacgtcatgaatgtttaagaaaaaacattgttatgaaatttttttacatgaacagaatcttaaaaaaaaaaattatatgtgattttaataaaaaccatgtattactaaaaaataagaatatatttttaaagaaatcacgtgtgatcttaataaaaaacgtgtattactagaaaatatcatgataagaaaatatattaaactgaatagaatgttttttccaaaaaataccatgtgtttttatgagtactatataataagagaaaataacaagataaaaagaggatattatgttatcgcatgtatttcagaaaaaaccatgttacaaagaatatttatgtaataacatgtgttctccaacatatttccgataaggtattgtgactcaaggttattttgtacattctttttgaatccatagtcatttattataaattctctagtagttattgataagtttaccacaagtggataagttgtagacttgtagcctcgtaggcaacaccgaggactagtggacaagttattcaccacatatcttctcagtatgttgtttcgacaatggacaacacttcaagtccgccaaatttattttcaatatgttgtttcgaatatagacaataatgacatattgtatacgagtagcaattgtagactaattatctacgaatattagttgtccaccgtaaatgcaacccaacatgtcctcaaatattttcttaaaaactaatactacaattatataaagcaaaaaggcatcaacgaggagaatgacataatgtcgagggtatttttgtcttcttatacaattcttaaaattatgtttggcatattaaaaaggagaatcaatttggcatgtgatattttccgcaaatgttacgttgtagttaaagttgcattttaaaccaaatttcctaatttgtatctaaatccgaaaccttttggagactatttcatcatttgactttgcttacatgaaatgatgcaaactattggagtacctactgacccaagggcttctgacacctttttgaacgacttaaatatcggaaccataagtcaatgaccaatagaacggccacttccgtctctctttcttataatttcttcacccgtcaagttgataagttctttaaataaacaagacaagttgaatatttctgaccaaaagaataacaaatagaaagtgttgccaactaaaaaccgtatttttctcatttgtgaactgactttcctttgtagtacaaaaacatgttctcacgttttcacatttccgagacgtgacttggtaagctctttttcttgaaatgtccaaatgagttttgtgcggacaatgcttataaactccggttagggttcatatttttcttgtgaatttaagaaaat

SEQ ID NO: 9979 - DNA, 3000 bp, Unknown
  misc_feature (1)..( 3000): cDNA_ID_3034994_gDNA_ID_2096298_Annot_ID_195597 3000 nt of promoter + ATG
tttaattttggacgcctgataaatcaacctttctgctcattcgtaatcagaatcattttggtccttttataatatggctctaaaccattgtccaatttttctaagcgatgtgggacattgtacacatattatttcttcatcggttgaataatatatgttcgtttaaaaaaatttgaattacattatatgcagaaaaaatataatattttattaactataaattataacatgttatatatttataaaaaaaaatatttataagtataacaaaataaataaagtagaagatcaaataaaagtgaaagaagaattatatatttatgtttaaattaggtaaaaatattttaggaaattagttaaggtaaataacaaatatgcttagtttagagatattatttattttaaatttggtaattaaatcattaatttcgtttttgaattattagttcttaggtaacttttccaaaaattaatgttatccaagatccgaacagaattaaacatgttatccaggatccgaacagagttaaacctggtaaaacccacccatttgaattaattgttgaattatggctcaaatcttcaacattatcttcaaaaaactgctacaaaaatgtatatatagatacggaaaaacggtctatttctccacgagaactatgacatcatgccagatagagcccgatctatgaccacgatccagatgaccccgaaaagataattctcgatctatatctccatgaatctatagttcaaaacctatatcaaccccataagcataattttcacctatttacccacaaccattggttttgttcggtttactatttctataaccaactaatgaaaacactaaaccagaataaacctaatttaaccgagtatcactaaataaataaacaaattaattaattaattgaattattatgaaacagtaacaacacgatgacgttcttcttcctttcaatggtgatggtgatggtgatgttggctccagtgatggtggctatagatatattttccagtttttccccttttcttcttatccctcatctccgctcagatctgctgcttaagcaaagcttcatcgactttgattaaactcgaattgagaccttcccacattattccacccattgaaatcacttgcttcattttgtagaagattaataacgttgaatcagccattgtcgacttgatggtttgtgttgattgttttctgttttttgtaattaccagattgattttaagatgagcaattgaaagaacagtaatagaattggataaaacttatttaataattgagatgttgattttgtttaattgggttgttcttttgtgaattgtaaaattcatgcggaagctcacctcgatcttctctttcttagccatattcttagcaacgattccagttttcaggtcaatgtcgatgttaacgttattagcaatgagaatgcgtttaaaatgctttgttgaatatctcttcattagttacgacaaatttgtatgtggattcaaaataaatctaacacccatcgtaacaatcaaagagagataaactattttttcaaataaacataatctggaattttatagggaagaagagagaagacaagacgacagcaattttgttatttctttttttattattaatttttttttttaagaaggtttgacatataaagtggtttggtatcggtttgagtggatttttatcgggtttggtcagcaaaccgattaaacccaaatatatggggaaatagatgaaaactatcaattttggggagataaaagatcgagaagtatctgttcggggacatctggattgtggtcatagttcgggctctatctagcatgatgtcatagttatcgtgggaaaataccgtttttccatagattatcagggggaatgttatgaataatagatattatatggatgttcattaagagcccattagaatattctagaaatctttacattatttggttaccctaatatgtatctcctatatatatcctcttgttactcatgaataatacacaacaacaattcctaaacctaattgttctataacattgagtacttttagtaagaaaaaaaagaagagattatttgtgtcagattgacttatgctagatactaattaattcaccttacaacttaattttaacgtcaaaaagtgttattcttgctaatttcacttaagatttttaagtttatcattgtttgcaacatatttttttttgttaaagggttttaattgtctgcagcatattgaaattataagttgcaaaatcggaaagtagaaagaattcaaagtgtatgttaaggaaaaaaaagaaaaaacatcgcaagtgttacactagattaaattcatctcatttggagaaaagatcctaacgaacggcgaacccagtatctccacctaagatatttatcactagaccaaaaccacgttggttgactcgacaaacaatcaaacttgtctcaaattggatattacatagaaggtcaggaggattaccaatctgaagaaatgaaggagatgattcggtcacgaatgggacaacaattattcataaatatccaggtaagagtttcatgctttggtatactagtttatactaatgaaccagtggctttgaaactctggtttgattgtaaatttgactggactataagcatttttgtgttgataactagtacgaataaacaaggcaagttgaataaaaaatactgcccactagcaattaggaaacatatttattcatcagtcaattgcatttcctttgtagaacaaatccattatttgataatcgcataggtgtgacctgttttacatgatttcaagaggcttgactttatttttttaaagagaaaagctgaggcatgacttggcaattagctctttcacttaaaatgtccaaatgagttttgtctacacaatacttataagctttttgttagtgttcagatttttcttgggaatttaagagtaa

SEQ ID NO: 9980 - DNA, 3000 bp, Unknown
  misc_feature (1)..( 3000): cDNA_ID_3035002_gDNA_ID_2096298_Annot_ID_195592 3000 nt of promoter + ATG
caaagacacacacagattgaatagaacctcctggcaaggagatccatgcgtccctcaactgttttcgtgggccggtctaagttgcattgacacgaatgtatctaccccaccaagaatcatttccctgtaagacctctataacacaatcactctttagacttgtgagaaaaacttgtctaactaaacttatacttgtttatttttcttcttgtttggacttatacacagaaacttgtcttcaagtgggttaacaggaaacatagcaactggaattcaaaatctgaccaaactgcaaaagctgtaagtatgaccatttaaagaaaaatgttatatacgtccgttacctttcttattgatttcttacaaacttcagggacttgtcaaataacaatttgacaggagtagtgcccgaatttctagctaacatgaaatcgttgctgttcatgtaagtttcccaaaaggttttggtggtttttttcccatggatcatcttcacctaagtatgtagatttctctggttttaacagagacttgaggaagaacaaactgaatggttcaataccaaagactctacttgatagaaaaaagaaaggactacaattattgtaagaaggaaattcatccacgcacattttaattcaagatccattgccttgttaaattcatcaaaacactaaaagatcgatatattatttttgtagtgttgatggcgatgatgataagggcgatgataataagtgtttatccggttcatgtgtcccaaaaatgaaattcccattgatgattgttgcattagcggtttctgcggttgtggtcattgcagtggtaatgattctcatttttctgttcagaaagaaaaagaaatcaagtttaggtatttgcatagactcaccaaatattaactaacaaactatacaatataaattaaaatgtcactgatattgttgtttctctacatatatctatccccttttcttgttatgccacaaataggtattacgtcagctgctatatctgaagaatcgattgagacgaaaaggagaaggtttacctattctgaagttgtggaaatgacaaaaaacttccaaaaaactctaggtgaaggagggttcggaaccgtgtattatggtaatttgaatggttcagagcaagtagcggttaaagtactctcgcaatcatcatcacagggctataaacacttcaaggcagaggtatgatatgccataaatcgtctatagaatcgcacaaaatttaaaagaaatcatgatctatatagatatatatttagcatcacgttaagcaaacatattttgtcattgttggtctataggtcgaacttcttttaagagttcaccacataaatttggtgagtcttgttggatattgcgatgaaagaaatcacttggccctcatctacgaatgcatgtccaatggagacttaaaagatcatttgtcaggtgaaagatgtatatatgcaaatataaatatatatatatatatatatatatatatatatatatatatatattatataaaattcataggacggttaattttgacaatctaatacaggaaaaaagggtaacgctgttttgaaatggagtactagactacgaatagctgtcgatgctgcgctaggttcgtactaactcaaaacagttccagtgacttgtcattttatatcaattagttactaattgtatgcatttgatacatctgttacaaacttctcatgatgaattatttccatcaatttttactcactggaatttctgacatgatcaactaacaacatgaatgagtctcctgcacaggattggaatacttgcattatggatgtcgaccatcgatagtgcatagagatgtcaaaagtaccaatatactgctggatgatcagctcatggccaaaattgctgattttgggctttcaagatcattcaaactcggagaagaatcacaggcttccacggttgttgctggtactcttggataccttgatcccgagtaagtactattagttcactcccatgataaatatgtgtgtaatttatgtctacattcatcttcatcgtttatatagaggtatacatataaatcctacttcatctctttgttttccagatattatagaacatgtcggttggctgagatgagtgatgtatacagtttcggtattttactactagagataatcacaaaccaaaatgtgattgaccatgcccgcgaaaaggctcacattacagaatgggtaggacttgtgcttaagggaggagatgttactaggattgttgatcctaaccttgacggtgaatataactctcgttcagtttggagagctcttgaattggctatgtcatgcgccaacccttcttcagaacatcgaccaatcatgtcccaggttgttatcgatctaaaagagtgtttaaatactgaaaactcaatgaaaataaagaaaaatgacacggacaatgatggttctctggaactgagctcgagtgatactgaggcggtcccttgtgcaaggtagtatttacatagacgctttgcctacgttgatgtgtttctgttggaagtgatcaagtcatgcatcatcttactttattgttttagaagagtcatatattatatagttaagtaactgattaatgtatattcgtatcacacatcgaagagatacgaatataattgttaactacaaaacaattacatgtgtgtatgtgtctctacattacgttgtcttctagagacgtgttccttagtgaaagtgtgtcatataaacctataaatacagtttgtatatctaataaaagtgtgtggttttcgttttataaaaacaaagtgaaatatagagtaagacaaaacagagtaaaatctgtgttgaccgatccttaacaactttgagagttcaaagttctacatggtatcagagctatggagacaacaatgcagcaagttattccaatcttcaatggtgaatcgtatggcttttgaaaaatcaag

SEQ ID NO: 9981 - DNA, 3000 bp, Unknown
  misc_feature (1)..( 3000): cDNA_ID_3035014_gDNA_ID_2096298_Annot_ID_195589 3000 nt of promoter + ATG
tggatctccgagaagtgcatgtacaagtagatttgatcatcaggattctccaaacgccaaaccattgtcagtgctgcatcaagatttgtaggcgttgcggccatcttaagagcaacttgtggtggatcatagtgatttttattggacacatttgaagttgttgaaatttgattccattcgggttgaatatatggaacccacgaacgatcataaacatctttcgggtacctatcacaactcacaaattttctcttagtattggtaacaataaattctttatcatttaaatgcatagatcatgtacatataatattttaagatatatagactagttatgatttgaagttgaatacgtaccgaagaagaacggtggcattgctaagatacatgcgaaaataatatttcaaggaaccagatttagcgatgtaagtatcattcgccaaaggtcgtaattccaaagctgatatcattggtatagttgcccctgtcttaacaagacaaatttgcaaagagtttgatcttggaatgtgaatgatctccttcactgtaccatctggcactatttgcaaatctattgttgtccacttattaggaccgatatgcatatcgaattcagggctaacattaagcccgtcaaaatttccatagaaaaatgtagctctaataaggtagttcctcccttcttccacccttagatcatagcagtttcgtattccatctggaaagtatcgtagggttgcatactgttttaaattttccgattcaagatttttcgggattctaccggtctttccactttggatgaaattctcgtctgatgagaactgtattccggtttccgattctatgtaaggtggctcatttagaggtaagccacaatctaaactgataaaacctgttcagaatgaaacatatgagtggtggtcatgcgtgggtgtatagccgggggaaagagtaacgtacggtaaaataaaagtggtaagacttactatggccggctctatagagatgcctaacgaaaactttctaaaaagtgatgttactaagtttgttcgggcgaactaaaaatcatgttgtattctcctgagttatcttatagtttactaataatctttctatagaaacttagacgtacataccttcttgattttgtccttcagcaaaacgaatgatgaggaaaactccaaaccaaaacagcgacagaaaaacccaacaaagattcttcatgattcctccgatcacaatacacgcagaaaaggatcgacacaattatatacttacgtttcacttatatactaaatgtaaggacacacaaattaagcttctctaatatggacaccaattaaaccaagctaaagtcaacgatatgagaaaatgagtgaatatggagttaatagttgtttcaagaaaaccaaatgaaggagtgagcaatgatgtcttctagtgaaacatccaacgtcacaagattaatatattttaaaagtacgcgaaaagtcttcatgcatgccgtacatgcgtatacgaccaggtcttatcacaaccttgagtagagattttgattggcacaatcaaatggatttgctaattccttaatttacaaaacacaacttgcttaactagactcttttccattgaacttgtcaatctgcaaaatattttgaggtttaatattcataaccatgacgcatgaagaaacgttaagagggagttgactttcgggtggtcatagacttgaatatataccattttcaaacatgtaaaagtttttttgtgatttttatgcaaaggtgtgcgtcaagttgttatccgaaatcgatcaaatagtctacacattcaattagaaaacagtttttgaatgggattccaatcctagatcccataatcattctcttttgattcgatcatcctccaaggatttggttaccctttctaagctctttgatatggcgagaggaatattttttagagaagcgttacctggcctaggttgatgccattacatcttgtcgacttgtcgtaggacctaggtcaacgattacaaagtgcttttagttagcagtatagtgaagtgatctgactgtattggggcctgggcaatatgtttggtctctgactggatatcaccttggtcgagagggcgtgctccgcatgtttatgatgcggacatccccccgttactccgtacaagtagattaaattactttgtctgcttctggtgatttggaagtggtctctctattggaaggttatgagaagtggttctaggacttgtctcccgaaaacactattatacgggccgagccgccgaaacagacggcatatttgtattttcgggaggccgaggattttgccatctttctatagaaaaatctcggccaattttcttgattgatgtgttgtagtggtctcgtttggtaggcagaaaatcactctcaaaacaattaatttcgaatccaagtgcaacattcaaatgcatatatatgttaaaccagttaaaatgaatatcatctggatgtcgcatgctaacatcctaattcataaacaagttaacttcaatcttgaaccaaagtgaaatcggagtggacaccctctagagtctagacagatttaaacatcgatcggaacaattcaagtcaacggaaggcatatctcactttaaatatttcggcactagccgtgttggttggtaaaatcgactatcctctccattgatagggtctttaaatttaatgaacaagttgaacattttctgactaataaactaataaataaaaaatatatttcccattagaaactttccaagaaacttaaatctacagttaaacttctatttgtagaaactgacatgtcctcacgtttttttgaggattattgtcttggtacggcttttacttgaaatgtctaaaggaattgtgtggcgccattgcttatataaacttcatttatggttcagaacttgggaccgtgtctttcttgattttgcttggaaagtaagaggat

SEQ ID NO: 9982 - DNA, 3000 bp, Unknown
  misc_feature (1)..( 3000): cDNA_ID_2186749_gDNA_ID_2096299_Annot_ID_195618 3000 nt of promoter + ATG
ttgcgagaacatgttttgttaagttgtgttttgatcttagggtttagttgagtaatgagctttgtgagattgattagattgagaaaatgtctgaattgattctttgttttagtctcgtgttgtgttggtctttggtctttgatattttgatgttctttgcagccacaatctattgcaatgtgtttgaagagccttgtcgtctaggtctctactctacttgttgtttgcgagaacaactgcttgtggctgcaaagtatcgtgtctgtcattgtgtaagtttagttctagatctttgcagccacaatctatgttctgctctatatgatctgtttgtactttgcagccacaatttatgttttgctagtctttggtctgatatttagatattttctgccatataataactgcttgtttttcttgtgtttggaggtttactcgggacacaaactcacgacttgttaggaatatcactagagtgtttacaaacaagtttgatggtccctactacagctggacatgtgtgcctcaagagagacaagagaaatacttcctcgagtttgctgttaactgttctttcagcccttcttttatatagttgattacacttcttttttttactgacattaccttttctatttgtagaaaacacaccattgggatcctttgatcacagggactgttcagttttacttcaacgagatctgtttaaggcgaatgaaaggcatggttagcactgtaagaactagtcgaaagaaacctaaatggattgggaaaactctatggaaggaaatgactgcgtactgggacactgaagaagctcaggaaagaagtcaaatctattcaaatgcccgtatgtctgaccgtaatggtctaggtcctcacatacacttcttagggtctaagtcatatcatcaaatccgggacgaattggcaagtcttctctctgtttactcctttgcaactttaactcgatgtttcaatgtacttttctatgacttgttttttttttcattacaggaagaccaattgggcaaaactgtcagtattggtgacgttttcatcaaaacacatacaaaacctgatgggacgtatgttgatcgaaaggcagagaagatttcagagttatatcagaagaatttgcagctgaggcagtctgagctcgaggctgaagcttctgctgtttcagatggcacttcgcgggtacgggagctcacagctgaggaatgtacaaccatatttcttcaggtaacgttttatgtttcccaatttagtgtttttgagttgtctttttcagtctctaatctcagcttttatcatactatgcagtccactgagagggattcgagaggcgttccttatggagtaggaagcctcaaagagtctcttgtcaatggcaagcggaagcaagcaggtgactcaacttcttttgtggctttgcaagaacaattacttgaagctcaacgcaagatagaagagcaggtctcttgcattcagaggcgtgaagctgagaattcccaagctgcagatgagcagaagaagaagcttgagcacttgtccttagaggagaagtttttgcgcgaaaatgatcctcggttcctcaatttcctcgaatctcattcagctaaggagacaaccacagatcctatctcaccctctccagctgcctctccctcttcatctgcttcataggtctgaatcttaactccttcctcaagactcaatatcaaggctcaaagtttttatatgtgtacttgtgttgcttgtgcttatgctgaacaaaattctaagttgtagtgaatcgaacatgtttctgtaatttgggttttgtacttttctgaaatgacaataaatttgttttcatgcttcttgtatgtgtttatgcttattgtaaagttttgttttctcaggaaggtttcaatctttataacaatcatatagatgttctaataacaacaatagtcgcaaatttagtcatcaaaaatgtaaccaagcagtcgtttatttataacaattcagtcacaaaaatttccgactaagtgctattttagtcgcaaatcagtcttaaaaatagtgacaacgtagtcgtaaattttaacgactaattaccaacaacgactaaataaccctcaagttaatcgttaatttgtcgtctaatagtcgctaaatttagtgacaacgtagtcgtaaattttaacgactaattgcctacaacgactaaataaccctcaagttattcgttaatttgtcgtctaatagtcgcgaaatttaacgactaaaatgtctctaaaaaagcgattacccaaacttagtcgtaactttgtcgctcttttgcgactaaaatacgattacgttatttagcgactctcgattagcgactaattttaatagtcgtttatttgtcgtaaataggagtttaacgactacagagtaactaatactgtagtcggtaaatgacaattttcttgtagtgactggattatcagccactgtaaatgcgggttactattagtttataagaattatgttttgggtttttatgtgtgtttaaactatatttgagctagttagacttacttaactctttagcattttcgctatccttaaagtgtgtcaataagaaaagaaaacttattaaagcaatatttttacaagttatacctatcaaattttggagtgcatgcaaatgagatttcgaagataggattcgatcggtcagttgcatatgtgatcgtaatataatgatggccattggccaacggacccgacaacgtgacctgtttttacattattgatcctttctctctagttttcgaataaaaaaaagactagtattaatttgatattttccaattgaacattaagaacgtggagccaagtggctgtggttaatacatatatgtatgattatatggtagtggcatcgcttactataagataagctaaacaaagaaaaaacttttatatttcctatccaaagaaagactagagagtggtagagaa

SEQ ID NO: 9983 - DNA, 3000 bp, Unknown
  misc_feature (1)..( 3000): cDNA_ID_3035045_gDNA_ID_2096299_Annot_ID_195643 3000 nt of promoter + ATG
gattctctccggcttaattttgctacgacgatacaaaaccaccgcaaactgccgcatctgagtctggttagctgaaaaccgataaaggagggatcttggaggaagacgaagagaaaaaaaccaatacaatagatttctctaactgaatgtcccggtttttattaaaccgtttcttcggatttccagtttagattaaccagcgcgtgtcttccggttcgaattggaaatgtcagtttctcttcattcagttgaaaagttcattagctaatgaacaaagtcacaaacacaattgcttaggaatatttatttgtatacaaagatataataaacataaacagtcccaaattcgatgattttctctattaacttgatcgctgttctctgatttaactgatccatcaaaccaatatcaaattctgacttaactttcatatgtaaccgatccaacaattggtatcagaaacaacaacactagcattttcttttgctgaagaaccacactagcatgatatcttctagattttctacgtggagaagaacaatcattcatgtagccacttatcaggaatcttttgtgtttggagactacaaagtaaagcctcttcacatattaattattatctaaatctcaaaacaaaacctacctaatgtagctaaaattaccaactcttatgtgagccaatacaaaacaaacagagaaacaagtttttctttgagtgttatttgagttaatgtcactttcttctcgaccatatatatttctcattagcaagcgaaaatgaacgatactacgttgtacataaaactatgattcttaaatcgtataccaaccctttgatgcaataatttcaccaagatggagaatcatacgtgttgcaacttttgaaggaaatctatagtaagtcaataccaactctttggactttgatgcaataaccaagattggaaaaccacttttgaagaaatttgttatatttggagactacaagtataatcccaactcttatatatgtgagataaaaaaacaaaccagctacaagaaacacgtttttattgaagttactgtcactttcttcctactaccaaatgtcacataaaacaaagaaatgggatttaaataataattttgggtctgttaataagagatgtttcgagatgaaaggagagaaagagagagagattaagcaatggagaagaaaatggaagcaaagagaaggatagtgttagttccaattccagcacaaggtcatgtaactccactgatgcaacttgggaaagtacttaactcgaagggcttctcaattacagttgttgagggacatttcaatcaagtaagctcttcttctcaacacttccctggttttcagtttgtcaccataaaagaaagcttaccagagtctgaattcgagaaactcggaggaatcgagtctatgataacgctcaacaaaacaagcgaggcaagcttcaaggactgtataagtcagttgttgctacaacaaggcaatgatattgcatgtatcatttacgacgagtacatgtacttctgtggagctgcagctaaggagttcagcattcctagtgtcatattcagcactcaaagtgctgcaaattacgtttcacgttgtgtaattagctaactcaatgcagacaagttcttgcttgacatggaaggtaaccaaaacaagcttaataaccaatcttgaaatgatcactcttttaacttaaccttggtatttgtttttttcaactttgcagatcctgatatgcaagacaaggtggtggaaaatttgtatccattacgatacaaagacctaccgacttcaggaatggggccactagatcgattttttgagctctgtagggaagtagccaacaaaagaacagcttcagctgttatcatcaacacggtgagctgtctagagagctcgtctctgtcatggctggaacaaaaagtaggaatttctgtgtatccattaggccctcttcacatgacagattcatcaccttctagtttacttgaagaggacaggagctgcattgaatggctgaacaagcagaaaccaaagtcagtgatatacataagcataggaacacttggtcaaatggaaaccaaggaagttttggagatgtcttgggggttgtgtaatagcaaccaaccatttctatgggttatccgagcgggttctatccttggcactaacggaatagagtcattgccagaggatgtcaataaaatggtctctgaaagaggatacattgtgaaacgagcaccgcagatagaagtacttggacatcctgcagtgggaggcttctggagccactgtggatggaactcaatactcgagagcattggagaaggagttccaatgatttgcaagccctttcatggcgagcaaaagttgaatgcaatgtatatagaaagtgtttggagaatagggtttcaggtggaaggtaaagtggatagaggagaggttgagagagctgtgaagaggttgatcgtggatgacgaaggtgcggggatgcgagagagagcccttgttctgaaagagaagatcaaagcctctgtcagtagtggaggcgcctcatacaacgcattggaagatattgtcaattacttgaagacaaagcaaagatgttgaacttcatgtaatattaattgaattgttgcaaaatttgcaaagtgtggtttcttttgtatcactcttggcagtttgctcaatatagaattgttgcatcacaataaacatcttttcttttgtctttgattactactctctctaacaaaataaagagatgtaactacttgcgtacaccatcgaccacatgcttcacatgtgcgcaaagagagctaacaaaacattatacggatgaattagtgtccacaagcgagaatctgatatttatatatataaaacgttcaaagaagatgagaagcagagtaatctataagcccggagcttagagagctacttattagttttcttgtaggttttggaaatg

SEQ ID NO: 9984 - DNA, 3000 bp, Unknown
  misc_feature (1)..( 3000): cDNA_ID_2186844_gDNA_ID_2096299_Annot_ID_195647 3000 nt of promoter + ATG
agtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaaatggagaaaagggtagagaagagaaggattgtgttagttccggttgctgcacaaggacatgtaaccccaatgatgcagcttgggaaagcccttcaatcaaagggcttcttaattactgttgctcagagacagttcaatcaaataggctcatcattgcaacactttcctggttttgactttgtcaccataccagaaagcttacctcagtctgaatctaagaaactaggaccagctgagtatcttatgaatctcaacaaaacaagcgaggcaagcttcaaggagtgtataagtcagttatcgatgcaacaaggcaatgatatagcatgtatcatctatgacaagcttatgtacttctgtgaagcagcagctaaggagtttaagattcctagtgttatcttcagcactagcagtgctacaattcaagtttgctactgtgttttaagtgaactcagtgccgagaagttcttgatcgacatgaaaggttcccaaaatagcttaatgacccatttcgaaagcagtcggttcactcattacataatttttgttttcttactttgcagatcctgaaaagcaagataaggtgttggaaggtttgcatcctttaaggtacaaagacctaccaacttcaggatttggaccattagagccacttttggagatgtgtagggaagtagttaacaaaagaacagcttccgctgttatcatcaacacggcgagctgtctagagagcttgtctctgtcatggctgcaacaagaacttggaattccagtgtatccattaggccctcttcacattacagcttcatcgccgggacctagtttactgcaagaggacatgagctgcattgaatggctgaacaagcagaaaccaaggtcagtcatatacataagcttgggaaccaaagctcacatggagaccaaggagatgttagagatggcctggggattgttgaatagcaaccaacctttcttatgggtcatccgacctggctctgttgcaggcttcgagtggatagagttattaccagaggaagtcattaagatggtaacagaaagaggatacatagcgaaatgggcaccgcagatagaagtacttggacatcctgcagtgggaggattctggagccactgtggatggaactcaacactcgagagtattgtggaaggagtcccaatgatttgcaggcctttacaaggcgaacaaaagttaaatgcgatgtatatagaaagtgtttggaaaatagggattcaacttgaaggtgaagtggaaagggaaggtgtagagagagctgtgaagaggttgatcatagatgaagaaggtgcagccatgagggagagggctcttgatttaaaagagaagctcaatgcctcggtaagaagtggaggctcctcatacaacgcactggatgagcttgtcaagttcttgaatacagagtgaagatgcttaacttcatatattacaaaagaacttcgattataagaaaactccaatagaaatgtttacattctttggaatattaatttttgtcttccgttaaagttcataattatcaaaatttaaaacttgaacaatttttgtgttttatgaaaactagaaaacagtctttccacattaaattcacaatattctaatttgtgtgattcaaactagagatgaattttgtatggatatatgtctttgaatttgttgttttgaagaaggacacgaaattgaatacttcctctgtttcatattagttgtaatttaagatttttacacacatattaagaaatcataaaaatctcatttaatctacctcttttatataaaaacatcatttattataaccaattcaaccaataaaaaaatatataattaaatataattagttaaatggtattaaataaataaaaacccttaaactacatttatatagaaacagagggagtatcaatttttttttttaaatgtcgattcaaaatctttagtagactacaaaattgtttagtagactacaatttttagataactttgtctatcattttcccacttgtttagtataggagcatttttgtcagttcaaaccacattaattcaaaattatgacagtttggaaaaaaataaaaatttatggcattattggtaagtttattggtcaaagtggcaaccaaaacttttggtcaagtgacatttttggtaagttttttggtcaaagtggcaaccaaaaatattattcaacatgcaacccaaacttttgaagaaaatttattatatatggagactacaagtaaaaagcctcaagacaaaacctacccaacgtggttaaaaccaccaactcttatatgagacaaaagagaaacacacttttcttggagtgtttccactttattacttcattcagaaagactagttgtcacacaaggaacacgagagtcgagagagtaatatatatatagagagatagagcttaagcaatggagaaaatg

SEQ ID NO: 9985 - DNA, 2516 bp, Unknown
  misc_feature (1)..( 2516): cDNA_ID_2687434_gDNA_ID_2096299_Annot_ID_195648 3000 nt of promoter + ATG
cgagtaaactcttcgcagaagttccctggttttcaatttatcaccataccagattctgaactcgaggcaaatggaccagtcgggtctctaacacagctcaacaaaattatggaggcaagcttcaaggactgtataaggcagttgttgaaacaacaaggcaatgatattgcatgtatcatctacgacgagttcatgtatttttgtggagccgtagctgaggagttgaagcttcccaatttcatcttcagtactcaaactgctacacataaagtttgctgcaatgttttaagcaaacttaatgccaagaagtacttgatcgacatggaaggtatacaaaaactagcttattacccattatgcttactctccttatgttcaacataattttgttttgactttgcagagcatgacgtgcaaaacaaggtagtggaaaatatgcatccattaagatacaaagacttaccaactgcaacatttggagaactagaaccttttttggagctctgtagagatgtagtcaacaaaagaacagcctctgctgttatcatcaacaccgtgacctgtctagagagctcgtctctcacaaggctgcaacaagaactccaaattccggtgtatccattaggccctcttcacattacagattcatcgacaggatttactgtgctgcaagaggataggagctgcgttgaatggctgaacaagcagaaaccaaggtctgtcatatacataagtttaggaagcatggttctcatggaaaccaaggagatgttagagatggcttggggaatgttgaatagcaaccaacctttcttatgggtcatccgacctggatctgtctcaggctccgaggggatagagtcattgccagaggaagtcagtaagatggttttagagaaaggatacattgtgaaatgggcaccacaaatagaagtactaggacatccctcagtgggaggcttttggagccactgtggatggaactcaacactcgagagcattgtggaaggagttccaatgatttgcaggccttatcaaggcgagcagatgttaaatgcaatatatctagagagtgtatggagaatagggattcaggtaggaggtgaactggaaagaggagccgtcgagagagctgtgaagaggttgattgtggataaagaaggtgcaagcatgagggagagaacccttgttttaaaagagaagctcaaagcctctattagaggtggaggctcctcatgcaatgcattagatgagcttgtcaagcacttgaagacagagtgaagaattagaatgcaatgatttttttgttaaatggtttttttaaagagttaatgatgcatatttttcaaagtagatgattttctatgcgcaaataaaaaagttattggaaccagaggaaagatccaagcttttcaaattcaaggaacgtcattgttctaattcgtatttaacattcccaattatgtatagatcatcacaaaaattctatattgaccaaaatatgcgtttactctttcgaaaatgttagcttcttccttcgttgaaagttattgctttcaaaagatatatgaagaatacttaaaatggtatagcaaccctttgatgcaataattgaaaccaagattggagaaccatgcatttagccacttttgagaaaattttattatatttggagactagaaagtaaaacctcttagcatttttgttattattatctaaatctcaagacaaaacctacccaatggtgctcaaaaccaccaactcctatatctatctatatgagacaaaacaaaataaaacaagtttttcttggaattaatgtcatactctcagtaaatataaatgggattttaaccaaaaaaatactttttagtcaacagatttttaataataatttagatcacttatttagagttgttcagcaatgatgttatactaaccaataatcatggatgatgaagatgcaggtatgacttatgagtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaaatg

SEQ ID NO: 9986 - DNA, 3000 bp, Unknown
  misc_feature (1)..( 3000): cDNA_ID_2186836_gDNA_ID_2096299_Annot_ID_195645 3000 nt of promoter + ATG
aaacgtcattttcagcaccacaagtgccacggcttttgtttgccgctctgcattcgacaaactttatgcaaacagtatcctgactcccttgaaaggtactcttgaattctctgtcttctattcttgctggtttctataatctgtaacagcatggttcttgacctttttgcagaacccaaaggacaacaaaacgagctagtgccagagtttcatcccctgagatgcaaagactttccggtttcacattgggcatcattagaaagcatgatggagctgtataggaatacagttgacaaacggacagcttcctcggtgataatcaacacagcgagctgtctagagagctcatctctgtctcgtctgcagcaacagctacaaattccagtttatcctataggccctcttcacctggtggcatcagcttctacgagtcttcttgaagagaacaagagctgtattgaatggttgaacaaacaaaagaaaaactctgtgatattcgtaagcttgggaagcttagctttgatggaaatcaatgaggtgatagaaactgctttgggattggatagtagcaagcaacagttcttgtgggtcattcggccagggtcagtacgtggttcggaatggatagagaacttgcctaaggagtttagtaagataatttcgggtcgaggttacattgtgaaatgggctccacagaaggaagtactttctcatcctgcagtaggaggattttggagccattgcggatggaactcgacactagagagcatcggggaaggagttccaatgatttgcaagccgttttccagtgatcaaatggtgaatgcgagatacttggagtgtgtatggaaaattgggattcaagttgagggtgatctagacagaggagcggtcgagagagctgtgaggaggttaatggtggaggaagaaggggaggggatgaggaagagagctatcagtttgaaagagcaacttagagcctctgttataagtggaggttcttcacacaactcgctagaggagtttgtacactacatgaggactctatgaagacttttgtctttactaaaacaccaaaacttcaagattcctctttcaactattccaagttgtttttagagaaagtatcatatcctaaaatatctaagtgatgccaagatgtatttggataaatgaatgaacaaagccatttcattgtgttcgctaacatcaacaacttgaatcaccataaatctcattaccagaaaaatgaccataacgtcttgtctaactctagaaactaataagatatataaacataaaagaacaaaagaaatggatcaactcacttctttaatatgctttgaaatctgttgccaaatcaaccatcttccccgaatcacaacttgccagaactttgccatgccattgcagaagatagtgaggaatctcctctcgaaaaatctctgtactttacagtatctttgctgtaacagaaaatttcaaatggtcatttttgatgctcactttctcccaaccacataatgtttagagtaagatctaactaatgtaaattaaacaatgtactaattcacataccggctcatactacactcctacggtaagtcttcccatcttgcttacaagccatgcactctttttctgaattgtggagttaaaagatcattgttgtgaacaaaagtaaacaaatggaaattgcagaggagctccaggtgcttaccaatgagaagaagaccagaatctctaagcggtaaattggtttatccatatctcaaatccatgattccatcttcactacagaatcaaaatatcatcatgttcacattgttacattatatgaaaacatcaaatctaagtacaatgatagacgacaacacagttcctgcaaccatggaactcaaattgaatatgcaatgactcttggttaaagacagagcctttgggatattacatacataaacatataacttaagcactaattcatgaatttacatgttatatatgtatgatgacgaagttccaattccaagaaagatcaaaaactacaaagttacctcttttacttctggcggagtcgttgacggagattcactccggctcgttcttgctgcgacggtcgaaaaccacagaaaattgtcgcaggtgggtctggttagtgtaaaaaccgataaaggagggattttgacattttgttttggaggaggaagacgaggagatttcttgaaccgaatgtcccggtttttctaaaaccacttctcagactcccggttcatattaaccagcgcgtgcgtgtcgtctggttttcatcatgaccaacggtcaagatcaaaaggatcgccttttttagtagatggtgttcgatgaaatgctcgttagagacgttaaagttgtagtgacaacaaattagtgtttatcattttcagaatcggtataatggaaatgtcagtttcttcattcatttgaaattgtgacaagatccaactccatcatttcaccacgcaataactaaactgttagggacaaaacgcaacatgaatgaatcaatgtacacaagtgtgagaacctgatattcctatcattgaattgtatggaacatgccaaacttagagagtaaagtgtacgtgttctattttgtaatgcaaatatgatgcaattcaaatcaaacacgagtttatctcctttggcacgtttctcaatatagattgctgcaccagaaaaagacaattttttctgtttgaagcctcttttgacatgaagcgaaatgcggcaagagaaccaagaagacaatagcatttttgcttttctttggttaccactctctaacaagataaagaaatgtaacaccatccaccacatgattcacatgttgtgacgaagagagccaacaaaacgttcgagagtcagatactttatatatcggttaccgaagtgatcgaaaccgcgaaccacgaagctgagcaggatacttttaattagtagttcatgcaggttttgggaatg

SEQ ID NO: 9987 - DNA, 3000 bp, Unknown
  misc_feature (1)..( 3000): cDNA_ID_1442222_gDNA_ID_2096299_Annot_ID_195641 3000 nt of promoter + ATG
tggctgaaacctatgtcagcaagaaacattggaaagacttttgcttttgttaaaatgtcactttcttccttttgttggacgttcattggtatgtggctctccaatcactcgtaaggtcatcatatgaggaatacttgattgtattaaaatggcttcttctgaaacatttgattggtttataaatttttaaaataaagtttgtgtctgacgccatctctcacagaaataaacaattcactctcttgattaccactttaagaagtctgcagacaaataaaacaaagggacttacctcttacaagatagaaaaatgagtatatgaaatttgtctgcagtcttctcttggtttagcttctacatgatactttgtatgatcctctcctgaacagatgcaatttgggactttgcggtggaaaactccgcaaaagataagaaattttgtagacaccaagaacctgtaacaacaatcaaatatgatcaagacctgcaaaagatgcagaacccaaacataaaagagaaactgctcattctacctaaaagcttgcacaggtaatatcttgtctagatcaaaaaacatcacaagactttcccaatgaggaaaccaaaaccaaaataacatgacactatcacttctgcaaaaagagtacacaagaaaatgtcgagccacatgacacatatgctctcttggatttgacataactcacagtgttagttacctagtcccgaagagaaaattaaacacatggttttcaaaaccaccatataattccgaagatgaatcaaacatgatctggattacattaagtctcaagtcacatgagagcaattttgatacttaattctcaataacatttcaacatagcacaagaatctcaaaatcaaattcaacttagttgattatattaactctgtcaacatcaccaaacaagtgattattaagactttattgtataccatttatagtaaaagacagaaacttgatgaaaatttcgatcaaatcgagtaagaattataactgtactgtacttaaaaaaacagaaacttgacaataattatcagttccacgagcaataacaagctcacctatctcttcctcccccattgaatccatctatagactctttttaattctcatttgcgcttccacctccaacagaaggataagaagccatggatccaaacttattctgctgcatcatataaggatttgactcaaacgcaccatttccaccagctccatgatgatgacgatgattctgatgataaggatcatgattatgattttgatgatgatatccttgcatacccatatgatgtgcataaactggcatctgcatcatctgttgcgttccatacgcccccggaatcggcactccaacattaccgctgctaccgccaccgccaccgatatcttggaagctctgtggaggaacaggtgttgaagagaagagcttatccgaagcagagggaccttcattagtcaatccctgcatccttttgaggtaaagcctatacttttgaagatgagacgcaacgttctcacgagttaatccttcaacgttcatcagctgcataatcgtcttcggaacagcgtttttgatccctaagtgagctacaacgtcaacgaatctcttgtgtagctgcggtgtccacactaaacgcggtcgtttaagtgttttcccagatagatcttcagttcctgaatctccttcttccgccgccatcgccgaatccggatccacaccgccaccgtcatctccatcaccgtttgatgtcttttgcttcttcgaatccgatccaggactgctagatccaactcgatcttcctcctccacgttattattcgacgacgaggtatttggacctgaagatccaccacgtagcgacgagagcgtcgtctccgatgcacgattcacatcctgaatcgtacggcttctctccggtgtgatactaaacgccatcgccaaattcggtggaatcagagagtaagaaagagatgctagatcttcgtcgcttggtaatcccatctcccattcagaaaccctatctccgtcgccggaaacatcgtaatcgctcatttgtacttcctctcccatttcaaactctctaatttctcgaaattcagttagagattgagctcttcgaagctcaaaatcgataaaaattcaaatctgagatcggagaagaagagaagtttggtttgtgaagatgatgagcaaacaatttttttttttttttttttcagaagtgaaacaatttcgaaaaagagaagattatcacttgttttatatttttcttttccaggaaaaagcgcaatattttaattccaacgtggacgagttagctagatattttagatcttctaaatatcttttcaaaccgacctaaccaatctcttttcaacacgtcatcagttcacattatgtatcaatagttacgatctaggtgattgaaattgaaattaccaaactaggcacgtaagatggagccacgtggagtgaaaagagccaagtcagctatttgtgagggtttttcagtaaattactaccgacttagcaagttgtgtttgcgggcctagagagaaagtgggcaaaaccggtgggttcggccagctggagagtgaaaagaggagaaagattcggtgatgagtatctacagtactgacacgcaatgtgatctttccaccgttggattgttgttttagatatttatagaagcatataaagatcaatctaacggcacagattggctggcacctaacttttaagaaaatgaaaataattattgtggaaaggctcagagaggtttagttactctgtttagcttcttcaacgtcacgggttcgatgccccaacttcacaaactgacgaaacgttatcttcttctcaaatttctgattctctgagatttccccaatttttcatcttcttcgagtgattagtacagattagggttttattcgttattattgtctatattactccttgattgtggtcgatg

SEQ ID NO: 9988 - DNA, 3000 bp, Unknown
  misc_feature (1)..( 3000): cDNA_ID_2186763_gDNA_ID_2096299_Annot_ID_195622 3000 nt of promoter + ATG
cagaacttcaggacaccggaaacgctctgccccgatggttatcacttgaccgtctggcagctcgaagctcttctccacagatgagctggttttggaagtctcaagctcttgctcatagtccaaggcaatgtacgagagcttctccttcatgtctctgacaatctcacgctcagcagttgtggtgaatgagtaaccacgctctgtcaggattttcatgaggtggtcggttaggtcacgacctgcaagatcaagacgcaggattgcgtgtggaagtgcataaccctcgtagattggtaccgtgtggctcacaccatctccagagtccaaaacaatacctaaccaacaaaataaaaacaatgagagcaaatgaaatcgaaccaaagtgaactttatttaaaccaaacggtaaaatttgagtgtagtaatgtactgaccagtagtacggccactagcatagagggagagaacagcttgaatggcaacatacatagcaggagtgttgaatgtttcaaacatgatctgtgtcatcttctcacggttagccttcggattaagcggcgcttcggttagcaaaaccggatgctcttccggggcaacacgcagctcattgtagaaagtgtgatgccaaatcttctccatatcatcccagttgttgacaataccatgctcaattggatacttgagagtcaagataccacgtttcgactgtgcctcgtctccgacgtatgcatccttttgtcccattccaaccatcactcccgtgtgacgtggacggccaacgatacttgggaatacagctctaggagcatcatcacctgcaaaaccagcctacacgcacatagttgaattgcttaacttatggcacataataacattcacaaatcttgtttctctaaagctttttgattaccttgaccattccagtcccgttatcgcaaacgagcggctgaatatcttcaccgtccgccatttttcaatctctagctgattacatcaacataagaaacatagcaaattcaaaggaaacaccaataattaatgccaatctcataactaaatctaaaacaataaaatgtaaccattaaatctaattcgttacgtataccataatcaaacgcattagcgttacatttatattggttttgcctccttgtgatcaaaattttgacatcaaataaacaaaaaaaataacatgtacctgatgaatttacgtagatctagaagaaaagaaagaggttgtggaatcgtgccctgaaattgggtttcaaaaatttctggaaaacagaagcaactttggcccttaatatcgttcatacacgggtctgagccgttagttttcttcattgagaccaatatctcagcctctatagacacgtgtccatctatttttaggttggagaattaagaaaacaccagcctaacctgaaaatacggtttaggctctgttttaccggaagaatcgggtcaccgaacaagcatgagtggtaatgagcccatttgggcctaagaaaaaggttaaaaggccattttctttagattattcaattttagacaatcagtgaaatttcagtaacatttccttctagtttctagtaatttatgtgttcaaccgaaatttcagtgctatgtaaaagagtgctatccaaactataattaagaaaaagggtaaaagatcttagtgggtgaggtatggaaattgctgaaaaagttctgggaagaatgagagtaatgatgataacggtaattgacaaatgtgataatgatgatagggatatgtgcaagtaaaataatcaagcatgtgcataagattcattatttgacatgagactttattatgtgtttttgcttattatagtttcttacaaaacaaatgaagaaagtagtgaacaacatacaacaatactaaataacagtgtgattgttgaagaaatagtttccatttaatatttaaaactaggcttccaaggccttgacaaatttcattagagaaggatttatttttaattagtggaatatatgatcaagaaaataaattgacattttggtatagattagggacattggagacagaggggttgattttgagattgaattttgacttttctgtgtatttagcttttagccaccaattaaagcaaacattcattcattttgtcatgttgatcgctgcacttatctaactagagtattattcccttttcgaggtacccagaggattaagcattttttttaaaaaaagagcctaatactttacctaataacaagaaacatgtagagtagaaacaagtaaaaaaaagtttaaaagaagaaggattagatcaaaagaaataactattttaggataatttcgttgtccagttgaactatttttaatttttctttttaaaatattttcttgcatgattagagagatagaggtataaaacctttttaattcttcaattatcactaaatccaaaattataaatgcattaacaattttgttcttctatgacaccccaaaaatgtcaccaactacagcaaaaaagtgaccactatatccgtaaaaattcgtatattcaatccgtgaaaatataatagttgaaaaatattcaaaatttcacaagaaaattagtaattttatagagaaataatttaaatgataatataatatattaatgtaaaaaataaaacaaacacaatcgtaaccggtcccgcggcttcgtggtcgaatttacctttgttccggtttagttcttaagccgagagaatcgtacaagttgcaataagctaaagccgtcagctaaacgacgccgttttcgaaaagtcctcgtcttctctctcacacaatctctctttctcagaaatctctctctttcgcactttctgcaaatggttctcttcttcctttaagctcaatctcgccactggagtctcaatcgggaaagatctccatcttctccggaggaaaaacggatccgtaaatcgtgaatttttaaacagagaagaatcaattcaatg

SEQ ID NO: 9989 - DNA, 3000 bp, Unknown
  misc_feature (1)..( 3000): cDNA_ID_2109031_gDNA_ID_2096299_Annot_ID_195631 3000 nt of promoter + ATG
taatctataaattagaagttgaagagcttacattaattatttagtggacatagggcaaatgttaaagtgatgatgtgtcaatcatatggaaagagttggccaactttcatatatatgattggagtgaatcgaatctacatcattcatcaaccaaaaaataatctagaaaaatatatatcataatttctaactaaactaaacaaaaacgctcgttgttatattttagctttttaaatataataaagctcgtattgacaaagctaacggataaacccttattattttgactggttaattgttatctcaaagaaaaagtatttaacatcctgactttaaatttagaaaagttcatcgactatttgtgatgtcccttcaaaaagattaaaaaaccataacaaaagttaaatgtttctctgggttgtacaaatgttagatgttaactggaccagatcacatataatataagaaaatgaacctgattaattctctttactgagctaaattttttactgacaagtctatcaaattttaccatcatacttaaatcctcaaaaacacataaactatacagtacttttttcttattacgtatttactattctatgcatgaaattgcgtaaatgtttggttgtatgcatattagaatattctttttatttttctctccaacagatttaatattgaacggtggtgttcgtatgatataaattcaaaaccacccaccttttatcctttcgaactttttcgagataggataagatgacataattattttatttgtaatttaggaaaaggggtaggcctttttttttttctttcaaattaatgattgtggggctaaaaaaaataatttgtgtccaacacaggatataatattttgaaacttgaacgtaaatgttgacttttgatttttttttcttctcagcttttgttaaatttaaactcgttcccttatcagatttattaaaatggtgagtgacgaaaaaaaaaaaaatggtgagtgaaacgttagagaaatcgacgtatgaaatgaaattatgagagtgtacagagaaatatttgaacaatacttagagctgacaacaaattcaaacactgaattagttcttgaagacaaactcgctctttgctatagttgaggagaagaatcccacatactcaattatagatcgagaacgaatctttacgttttagttttcttgtcacatttactatgtaaaatggttcatattattattaaattttcatttattttcaaaataaattttttacaaatatatatatattttaatatgatgttaaaggtttttgtacataaattaccttttaattttgtttggtttatttagaaatcaaaatgtaatttattatctacctaaaaacacggttctttcagtataaaaatttacagaatataaatcattaaaagcaaataactaattagtattgtattaaaaattaaacacttatctaataatacaaaacttttgttctaaaacatgaaaacggaagaagtatgtttcttttaaaactatgaaattcatataccatattcagttttatttaatatcatttaatatgaatcgactacctcataattatacaatatagcaaactagggaccatcttatcttttacgtgattcctaaaacataaatatttatgggaatgttgcccaaaaaaaaaaatatatatatatatatatttatgggaattttatcattttcttcctattaagaaaaacctcaaaaataaaaatattaaaatacaaaaggaaaacataaaagcacaaacgaatattccaaatataaactaaaaataatactcataaacccaaaaatacatttttcctttcccgaaattcttttttttgttaatattattatcatgacaagacgaaatttactcaaaaggctacgaaccaaagccatgtgatgactacatcagtaccacgtgtcaagatctaaggacttaacgagttacgagtgtgtcgtgggccatcgaccatggaaaagcaacgagtctttaggtgaatgttttacttgctataaccggtaacaacgggtctggtaataccggtagctccggtggttggttgagttatatggctatgggggtttaagcaagaaagacgtggtcgtgttcttcttataagggtttttgtttataatttggtaatcgaaaaagagagatttgataaaatcctttgtgttgaaggaaaaaaaaatcatataggtaacgtttgatacaagtaaaaaaaaaaaatttccatcactttcttgggtaaaaaaaacatgggttagaggaaaaactggggaaaagattttagattaagtgcgtaaagaattctgattccttcgtctccgatctctcatttttctggagaaattgtcaaaaatttcagatatctatattgtcttggaactgaagattcatcgaaaggtgagaaagatttaaactttttttgatggtttttgtgttctcgattttgtcaaaagtttttgtgtttgtttgatcatcgagaaacttagtaaaaattcattttttatgtgaatttagatttggaattttcaaattcaagttcttttggtttggatcttaaaagggtttttgttatctttttgaacttatcatcatcttcgattgaaatttttcgttttcttatatgatcagaatcatctcattcatcgatctgtgaactccgatctgagaatttgaaagtgtctctctttttgttctaagttgatctgtttatcctttaattcaaagatcgaagcttttttataattgaattacgttttgtgttcttcaattcggatcttgtgtttattagggttttagaatggtttatcagatttgatttgatattaccgatctgtgattcttgaattgaattgagtcttcttatggttcttgtttcttatatactacagattggtgagttttattcgctgcttatcgcttgtggcaatcacatcatctgtgttatgcatccaagta

SEQ ID NO: 9990 - DNA, 3000 bp, Unknown
  misc_feature (1)..( 3000): cDNA_ID_3035052_gDNA_ID_2096299_Annot_ID_195633 3000 nt of
tctgtgtgtctgtccatgcgagtcttaattactttctagcaaatctgtcggttagtgatgaatgtaacatgatatgtgaagattcgattaaattatattagcaactttgcaatccctctaaactaacaacaaaaacgatcaaatatagccttaaattaatttctttaattattactagtgagttttgttctccaacaactattatattcttctatattacttttcacttgaacaaatatactataggttgcctgatttttcagtcaaacacttattgcattctcaaaatttctcccaaacttttttgctctgaaaattcaccatcaacttacatttttcataaaattcctacatgtacttttggattcattcctacaactacgcctccaattaaatcggtgattaaaccatacttaaccatataatcgcgtttaggcaaccacgtttaagattgcccatataatcactcagcaacccattaccaaaacgacgtcgtatttgtcctgcaattgatttgggcttaaccgaatcaaaatcgatttgggcctgaatcaaaacagcccaaaggcaaaaccacgtcgtttcattcttcttctaatttaactcaatggattcgcgatttggggattttgagaactagggttcttgagagaaatttgtgttcgagttcaaattatgtcttactggtttgagaattcaaataaagatatgcaggttagtgagttactgtatcagagcgatttggatgatcctgatttcaccgttccagagagtgagagcaatgtcgacggaggaagttgtagcggggatgagggaaacgacgataatgattatacgaattttaagaaaaatgtaagttgatggtgaaattttcagagcagaaaagtttgggggggggggggaggggaacaaggctgaaaatcaggcaatccatataactttagttttaaaaaaattggtaatgttaaattagaaattcaaagaaaaatcgtttttacacaatgtgcaatgtttgtatagaaatgtttgaaaattttaaaatttagaaagaaacttcagactcttccgcctctagctccttgatgcaaaccaaatttgaaagcaattgtcgtaacgccggtctccgcttgcttggattgaggagagcttgtttctgatgtgctttatatctatagcatccaaaacttttgtttaaaaaactagactacatgaagattgttgtgatctttgatgatataaaatacaattatatttctctttacattgatatatagaagaatatattagttgcatcatatatatatatatatatatatatatattgtacgtaaaaaaaaattgaaatttgtaataaaaattgaatttttttaatactttgacataagtcatctttttaccaatcggttaaaacttttttgatatacatgtctattaatttatgtttgaaattttaccaaccctaagtgttatttggatcatgaacataaaaaatattgattgttgttgtttgaatatttgaaccatatatagacagattaaattgatatttattgcatctaaaacttttgttcattgtgatttgaagatattaaatacaattacttctctttacattgaaattactctttttgacatatcactatgtttcttccttctactttgagattgtccaaggacaagatggaaaaggaacatgctaaacagggggaaaatacgaaggatccatatgaacaatgtggtcaatggtcatctaacaataatttagttggatcaaagacatgtatataaagagacaataaattttgggaccaatgacaaatacctaaagaacatttaatgttttatgaaagaaaaaaaaaacactttggaccaatttcatatccacatgtgagcatgtgagttcttacaagacatggcctatgaagacttctcagttcccactactcacattcatcttagtacacctatcactgtccattcaactatatgaaaacttagttttacgaaaagtattacaatttctgttttagttaaagatatatattggaaaacccaaaaagaaaaactaaagagaatggactactttgcacacgatgcacgaccagagatagttttcttttcctatattattgaagattttttaatatctcaacgtttattcaaatttgagacatgatgttaagtaagttaacagagcatgttaacaaagttaattttcttttaacagacctgtgaattgaaaacgatagcatttcctctcacaataaacaacatcgttttgtcgtaattgttcaataaaatcccgagtgtcaaattatatgaaaatttaggatcatggattttgctcgatttagagatataagattgaatttaaggatttcgttcatccgttacgacaaaaagacgtcattttgttattatagaaaacaatgtcgttttcagttaacatgtatattgacaaaaaattaacttcgttaacgggatatgttaacctatttaaccaacgaaagtttgttatttttgaaaaatagaagtttgatatttatttcgtttcatcgagagttaaagatccaaatcaactttttcaataagttggggattttaattacatttttcatttctaaaaaacaattaatttagcaattttttaatttgtagaaaaggctttttaaatctcatgcttaattgaggcccataagcccaatagtattttattttcagttttcacataaagaaaagaagacaaaaattctatcttcttcttcgcggctctgaatccgccattgaagttattttcaagccctcctcaattttcgtttttgttcaatattaatttgtaagagatctttacgcttcagtttctgaaagaactttgcgcttctgattttgcaaaattggaagagagtgcttccgttgcgcttttgaagcgtgaaatcgtgtgtcttttgacgcttccatgctacataacgctagttgtgagattgtgtttggaaaaagatg

SEQ ID NO: 9991 - DNA, 3000 bp, Unknown
  misc_feature (1)..( 3000): cDNA_ID_2186752_gDNA_ID_2096299_Annot_ID_195619 3000 nt of promoter + ATG
agtgcatgcaaatgagatttcgaagataggattcgatcggtcagttgcatatgtgatcgtaatataatgatggccattggccaacggacccgacaacgtgacctgtttttacattattgatcctttctctctagttttcgaataaaaaaaagactagtattaatttgatattttccaattgaacattaagaacgtggagccaagtggctgtggttaatacatatatgtatgattatatggtagtggcatcgcttactataagataagctaaacaaagaaaaaacttttatatttcctatccaaagaaagactagagagtggtagagaaatggagaataaaactgaggaagaggtatcaatcatcaaagtttcttcccttacttgcatcgatctcgacaactctgatcttcatcaatcagctgttttactcaagcaggtctacgtccatttatttttcttaaaactgattacagtatgaacattataccttccgcgaaaaaacattattaattcggtcattatgtgttatatatatattcttgttccaggcatgtctcgatagtggatttttctatgtcataaatcatggtataagtgaggaactcaaggatgaggctttcgagcacagcaagaagttcttcgctcttcctttggaagagaagatgaaagtcttgagaaacgaaaagtatcgaggctatgcaccattccatgattctctcttagaccctgaaaaccaagtccgaggtctgtcagatcagctttcgcttgcttaggctaaaagttttgttgttcatgtatatctcactcttgttgtaatgtgatggggtttaggggactacaaagagggttttaccattgggttcgaaggtagcaaagatggtccccattgggataaaccattccatagccccaatatttggcctaaccctggttagtttttaccgtctcattgtttgttaatttatgctttgatctttaaataaactctaatgttttttgtagacgttttgcccggatggcgggagaccatggagaaatattatcaagaagcattgtaagtgtcatgtttgtttagaaaatatttaaatagggaaatcaagtgggaaaatttgctaatgacttaaaggataaaaatttagttggaaattaggtggaaagtttgatttaaaacaacttgactctttttctcccaatgaatgtgacatctctctctccacattagttataaacaaaaatattccacatatagaattccctcagagcatccacattggacatacctttgtaggtgtttcaaaagtaaattaagattaaatttaaagacatcttctattttgggggtctgaaatgtctttctaaatactctattacacatttaaagacacaccttcttgtttcttctattatttttaactagatgaattctcacggtacgcgtgggtttgttttaaaaattgttaataaaaatatgttaattgttttaatcgctaatttatgtttatttttttgtttattattgtataactaatagaattagactcataatagtatttacgtttcgacagttgttccaaataccaccacctcagtgataatttaagtgagtgtatatttaatgttatgtatatcgatattgtgaacttgagttgtatctaatgttttcattttttaatttccgtataggttatacatgatgatggttttgtatcctatttatggtacttgtcccttggtaaacatttactgatgttgtttgaaacacatataaaaataaattggttatgatgttgtcccgtggtaaacaatgtctgtttgaatatttatagagcttatagtagtgaaagcttgtaatcccataagctgggagtgtgaatatgttttagtgaaataaattgtgcatctatttaaaagacagttacagctgcttgttccttgattcagttctgtgtagcttctactgtggcatccattctggcagttacaaggtataaaacgttttttctaaataaatatgatgtacagaaagggagactacattgttggatttagaagcattaagccatcattgaaatggggccgacctattagtattgcactctaatagattctaaaacacatatggcccatctggcatgagctattttgtttactctatttgacacttataattagaagctgatgtgtaaaaaataaaagctgaatcatattaatgaaatgtttttattggaagattagaaagctgatgtgtcatctccagaaaagcttaaaatgctgacgtggcaaaatgatggagagagttgagcttctttcatatatatgatttaaagacatcttcatacaatctccattgcacataaaaatgagggtatttaatttgaaataagattataaaaagaaaacaatagacatttttagttagagagagtctagatagagacatttgaatactctctctcttgtatggttcttcccgtgtcaactttttatttgtttttaaattttaaataattaaactaaataaaaagtattattattaaattttaaagatacacttatcattagttaaccaatgcagatgctctcaaagtatcaccaatgaagatggtctaaacgacttcagttacttttggtctaaattttttgttatattgcttttttggtcacaaatatcagaccattaattaaggggatggtaaaaaaaaatatcatagcattgagtaacaatgatatatcactaattttcctttattcgtcattgtatttatagttaaaacttaaatacgaaaaaaagaaaaacgttaggcaaatatttagaattctgaactctagtatcatgtcaaaacttatggatatgcatcttaaaattaattgacaatactatactaggtgccatacatatattttctgtggaactcttaaggaacaaagtttttcaaactgtatacttatgatgagcccttctacatgatcaggagggtttgtaagtctattgcgaaaata

SEQ ID NO: 9992 - DNA, 3000 bp, Unknown
  misc_feature (1)..( 3000): cDNA_ID_2186993_gDNA_ID_2096300_Annot_ID_195663 3000 nt of promoter + ATG
tcacaaatagaatttgtgtcacaaaatacgtacatgctatatagtgttcataacccaaactcataccagttagatatttaatttgatgtcaagtttggtttcaaattattttatatagtactcataatccaaattatttttgttggataatttgttttgaatgaaaaatgtattagtttacattatttcaaaagtttgttcaataatatattatggatttatttaaaaaaaaatcaggttgaaaaaaagaaaaaagaaaaccaaaatatttcaaaataagtatgtacaatttattgtttatatatttctaaatgtaaagcataattataattattttaaattaatcagaatttatttaaaaatactaacaatcaatagtatttttgtaatattttacccttcgtaaggttgtttattttcaatgattcccaattaatagtatagatgtttaagaactacaacacgaaatttgttcaccaaaacaaaaaatatgcaacattaggactttcaaaaaattattcatcctaatactattttcgtctaaatatactttgctttcctaaaataattgtctacaataaaaaagttataaattaatatttaataaattctaattttatatgcggctattataatatttgacgttactccataaaacaaaaagaattcaaaatatgctatgtatatatattggaaagaaaaagaacactagaaagagaaaaacaaatatagttagagagatcaaatttgtatgtattgacttaaaattaggctaagtagaccaagttgatcatttcagaataatgtctctttagattctattttatgacttaagcatgtgttttacttgccttatagatgacctgaacatgttaagaaactatttctcatatatttagggttttgtacatcaacatatttatataagaataagagacgagactctagtttttttcaattaagacattacctaaaacagagtaatcaaatattatgagataaatgtgaatcgtaatcgtatcactaacacgccccctcaagatggagaggcttgtgacactccaatcatcaacacatctgctaattggtcctttgtgttgatatgaactactcggagagcaccttgttgaacttaaccacggatgaaatgataatctatagcaatatgcttcatctttgagtgtaagaccggattagcacaaaggaagatatttttgacgttgtcgcagtacacaacaagtggtgtgttgaaagtaattccaagttatgtgaaaatattacatatatacccaacttagttcagaggccgtgtttgcgacaaccctatactctacttctatagatgatcttgccaccccttccgtttcttggttgtccaagatattgggtttcgtcgtcctaggtagatgtgaaattccggatgaaccaagaatcgtattccccaaactaagaaccactgagtatcactttattagaaatctgattaagaagtttacaactaccttaattggttttacacaagatctaaactactatatcttgtcacctgagatttctctaaacacacaagagtatatcacaagaacacactctttgatctctctagaattccaatcagactaaaccttagtctctaacaatgaaaagcgttgcactagctttttcactcacaatcatggccaactctagcaagcaccttagcacctctatttatatcatcgaggtctttggtcttctaggttagtcttcaagatcttggatcactccagatctttgcgtgaatatcttctttccaaaccgaactcattctgttgtgatctccacgtcattcgttcatttggcggtatatccacgtcagcatcaattacttgatcttcactttaatcttctgaaacagcttccagtttgttccagcaatcaacactccttctggtttgacctgactgaaggtgcactaacaagatgtacgagtacataatcgtctgaatctcaccgcaatctgcatttgaatatgcatgaagaatgagtttgttgtttgccgagaaaaagaggccatgagtgggtgtcccatcaaggtagctagcttagaattcttttagcagcatgtcaatgatcttccgttggacgatgcataatttgtgataaacgattgaccgcataggcaatatcaaatttggtgaaggcaatgtactgcaagcttccaattaattactgcaacgaatgtcacaaagctctcataccatgtaaaaaatgtctttctaatatatttagggttatgtacatcaacatatttatacaagaataagaataagagaggagactctagattattctaattacaagcattacattaaacagagcaatcaaatattatgcgatcaatgtgaatcgtgattgtatcactaacattatatatgacttttgtaatgactagttgtgttgttggtttatatctgattcaaaatctgaagttggtttggttaagtcaattgaagattgaagcagtcggttatctctggttaagggatttctgattaaaccggaaattgaagaagagaagtcaaagactctaactgcagtggagggtttgactattatataaagagtaacagagtctgttacgattatcatcttcttcatctgttttcttctttgaagttttcttgtatcgagagagagagaacttgagagaatcaccattgttgtaagctcggtttgagctgtactcttcataaagcttagtggatttgccggattgattcggctccggatgtaggcttgatcacactgatcttgctgaaccgggtaaacaaatcgtgtgtctttgttcttcgttttctgttctctgatcttgcataagttgagatcgatcattcgcaacatcatttcgatcgttcttaacgctgaattgaatctaatcggagctcaatttcgtaacaaagtggtatcagagccttggtttctgaattgaggaggtttgatgcttcgatagcgttaatg

SEQ ID NO: 9993 - DNA, 3000 bp, Unknown
  misc_feature (1)..( 3000): cDNA_ID_3035102_gDNA_ID_2096300_Annot_ID_195687 3000 nt of promoter + ATG
ctacaatgtgatcaagaaatctctctcagaggttcttgttcattactaccctgtcgccggaaggctgacgatcagtccggaagggaagatcgccgtcaattgcaccggagaaggtgtagtggttgtggaagctgaggctaactgtgggatagatacgatcaaagaggccatctcagagaatagaatggagacgctcgagaaacttgtttacgacgttccaggtgcccggaatattcttgagattccaccggtagtagttcaggtgaggttttgatcgatctcttgcgtactaattactatatttttcgattagcttttacataaacttaggttttgcgggaaaataatgtatttacaatgacggcgacatgcttatagacagcagcaaactagagtagcaaatatcctacataatgttcgggagtaatttgcttattttagccacttgataattgatataaatgatcgcatttaatgtcagaaatgagtttaactttttgagtatcaatcacatgtgattgtccaaaatgtagatttatgggagttttgcttgagaaattcaattatacttatttatatgatatatgacaaaatacttttttgtttgtaatagtaaaatcttaatataaaaaaaaaaatcttaatataaaaatataatccaaaaaaatacaactatatatgtaaatatctaaatcatagtttattttaataacaatctccctgaatatcattgggaaaaatgtcaaaaaaatcacgaactttcaaatttgggatgatttaatcttgaactccacggaagacaaataaatcgtaaagtttttgttgactttcaaaataaataacaaagtttttgttgacttgccatttgagtcatgtcgttaaataggttaacagaattattttacggcgttaatatctcgtgtatctgctctgttagaacaaaacgacatcgtttattgcagagacaaaggaacgtcgttttgtttgttgaaacaaatttaaaccctaaatccccaaatcgatttattatctgcgattttgaggtcaaggtgggtctgtgattttgagataatgaaatcgatttggggatttagggtttaaatttgtttcaagacaaaacgacgatgttttgtctctgcaataaacgacgttgttttgttctaacagagcaaataaacgagacattaacgccgtaaattttttctgttaacctatttaacgacatgactcaaatggcaagtcaacaaacactttgtcatttatttcgaaagtcaacaaaaactttacgatttatttatcttccgtgaagttcaaaattaaatcgtcccaaatttgaaagacatttttcccgaatatcatttatgaattatgatacaatgttactaaaaaaatcatttttatgtctcatgcatgtagtaacgaacacacactaatatagtaacaaatgatcagacgttactcttaaaaactagagtggtcatcatgttcaaactttaaggtacattagaccatctaattagaaccatgcgtaattagtattgttaagtaaccaaaagaaataacgacgatcaatagtaagttttttttttttgtgtgtgtaaccaataggtagtacttaagttaaatgtatattatttcattcctatttctttaaattggtatcgattcattctaaaatgttgcatggattttttttaacatctttagataaagttttatgttccgttttttttttcaggtgacaaatttcaaatgtgggggttttgtcctaggactaggcatgagccacaacatgttcgatggagtcgccgctgcggagttcctcaactcgtggtgcgagatggccaagggtcttcctttatccgtcccaccattcttggaccgtacgattctccggtcacgaaaccctcccaaaatcgagttcccacacaatgaattcgacgaaattgaagatatttccgacaccggaaaaatctacgatgaagaaaaactcatctacaaatcatttcttttcgaacccgaaaagcttgagaagctcaagatcatggcgattgaagaaaataacaataataaggtatcaacatttcaagccttaaccgggtttctttggaaatcaagatgcgaagctctacggtttaaaccggaccaacgggttaagcttctgtttgcggcggatggacggtcaagattcatcccacgtctcccgcaaggatattgcgggaacgggattgtgttaaccggtttggtgacatcatcgggagaattagttgggaaccctctttctcactcggtgggtttggtcaagagactggtggagctggttacggacggcttcatgcggtcggctatggactacttcgaggtgaaccggacacggccgagtatgaacgcgacacttttgattacatcctggtcaaaattgacattgcataaactggatttcggttggggagaaccggttttctctggaccggttggtttaccagggagggaagtgatcttgttcttaccaagtggtgatgatatgaagagtatcaatgtgtttcttggccttcctacttcagctatggaagtgtttgaagagcttatgaagatctgaaaaagaacatacattttcataatcaaattatgatatattctaccaaattataagcaaaggaaaattataatctagtcattatttatacatgttatatttgaattcacgtttgtatccattacaaaaatttatgtaattcgcagaaaatatatatatgtcaaattaagttatcggaccggatcgggtcaaagaaaccggattggttaacaaagtcaaacaaacaaatattgacttgagtttcagattccagtaaaatcaaaccggatcgggtctgaatttaaaccaccgggtcggctccatctaaaatctgaagatcatctccgccttatcttgttgactatctctgtactacttacgagcgcaagtgagagagtaacagagaaacgtagagatatagcaaa

SEQ ID NO: 9994 - DNA, 3000 bp, Unknown
  misc_feature (1)..( 3000): cDNA_ID_2187026_gDNA_ID_2096300_Annot_ID_195674 3000 nt of promoter + ATG
agcaagaaaccagtatgaaagataagtaacgtcgacaagttagtgcaaaaatggccgtgtggttttcctaggctagaaacagaaatgagtctcttacatgagaaagaccttggtcagtagcctttgcaaaccgggattcttgctttaaaactaccatactgtcatgggtatttccactgcatagcagagaattctacacatgtaaatatcagttttatgctagagcttaaggaaacaaattaagggaagcgagatccaatatcacctgcatgttataggaaatccgtccagatctctgatatcgcccgtccgtcatcgttaatcggacgcacatgctgcaccaatggaaaataatactctttttcaccaaagcaaaaaacagcaaagagaaaaatattgtactacaatgtctgaagaaggtaatgtccgggtacctcaaactttacgctggttgtgctgctccattttgaactcgctggctcactcaagtctaaaccaacagccaatttagaaagatttacacctccactccctgaccgagaaaagttgtcaactggggtgccatgaacccctatctctggcgaaagagaatgctgtaccaggttgaaaaaaattgaatgtatttaacatagcataatttggaaaattcactttctaagatagcttcaccgatcagttgagtacctgtatgaagaagcactgttgcggacgccattcaggtctaggtctcctaaaagccaccagtacattggaatcatacaaccctttatcccatgaaacatcaagcttctcgcttcctcgaaacaaatttggatgtttgatacagaggctgcaacaaacagacccaaatgaacactcaaacagaaaagaaagatatgaccatttcagttctgcagattatatgaacaccaacactattaagtcacaaaacttgcctgccaatcactaaagaaagaggactgctagtgactgaatatgtgtttcatatggtggcggcgtggcgcctccagcaaatataattgcttcttcgattgctaaatgcagtggcgtagccaaattcactatgttctttttgttaaaaaaagtttagctccgaagatgtgaacgctgatcataatgcaaatcataaacttagcaaaaaaaaaaaagttataatataccttcgattcaaaacctttgtaattcagtactatgggtgagagagattaaatatatttttagaatgggttagaagacaaacttaaaaagcttatgttcaattgacaaatatatactatgaatgtgttcacacgaccaaatctagttggttgcatgaggtatcagttcacttactcacgagcccagtggtgaacttgtggtggggggcgattctttccagtctcttgtttttgtcttctatttttttggcttcactctttttcttgatatcatttttcctacacatttttccttttgttttgtaataaggtcttgattaagagcgaagaaatgaaattgttcctcaacatctttctaatgcgtttttacgtaattatttaatttacaaaaaattcgaaataatttcgttattccgttgttttgtgaatcacaaaataaactatatatggtaaactaacaatttttagagcatgcacatagttgatacactatgagtatcattaacaatattttaatattaattttaatgtttatttattatttgagattttttatgatactggtaataaattgtttccagtggtgataccgatattggtatcattaaaaaaaaaaatatttgcaaaatcaaaaaataaatttataaaaatatagagttacaaaattactgtaaaattatgtcgcataatcacgaaaagttggcaaaattactcacttgcggaaaatgtagctacttagctaaaacagtagaaagactatcggagagaaaaatgtttttttttttccagaaaaaaacgaatttcacagacgaatcataagcctccacgtcatccgatactgggtatcaaaagaatcactgcactgatacagtatcaggcctaaatctattgtttgatatattaaaaattattttgtgactcttgatactctaattatatcacctatgtacatggtctaaaaacactaaacttgaggcagaaaaactaaaaatactaaagaaatttggagaatgaaaaagcactaagcattggttcttcctttaactcccaaattccaattattttttcctaatggaagatcagtggggcaccttagacaaaagtaactaccatgatgatgatttattgttcaattattttaagtatattaatactactttccgatactcttggtacagagaatttatacaatactccttaaaaaaaactcagatataaagttataaacatttgtatggattgtggatccaatttatgtttttaaagttatgatatacatttgtcaagatctctcacaactagtaaactatttagaactctaggaatccacttgtaacactaaaatctacaagaaaacaacatcaaccctgaggtcatctacgtggttttctcaagaccaactcttcacgacttcacgtgcatatatatttccaagttttataatatagctacaaataataaaatcagccaaaattcaagaatttcattgaccgagtaaatctctgcgtttttagttactttttctcagtgagaacagaatcttcttctacatatcgagcccacctaaatcaaagcagtagtagtggaaacaaataaagcagtaaatagacaccacagcttttttgttcttgctctctacacttcacatttacccaaaatctttataatactatatatttaaaactttttatctttttgtattttggttacaaagagacaattatctctccactgtctttatgttcttctttcatgtaaccaatctaaggcaaaacaaaaccacagacacaaattctacaccaaaagcttaaccagatttttcccaagaaaaaacccatccatg

SEQ ID NO: 9995 - DNA, 3000 bp, Unknown
  misc_feature (1)..( 3000): cDNA_ID_2187047_gDNA_ID_2096300_Annot_ID_195680 3000 nt of promoter + ATG
gaatacaatcgtcacaaattttatttgtaagaaaaacatcataaaaattgaatcaaatatatctattaaccattttcgttacaaatagttaaaacaaaaaaaaaagtttaaaaaaaactctcaataacagactaacatcgtcataatttgtgactaacatatcgacttaattttagtaactcattattacataactacagtctcaaatggtcacaagtgatgactaaaaatttgttgcatattcgtaacaatattactcaaaactaatggtattttgtgactatcataatgctccaattccatcacccactataatatattagtttcaaatagtcccaaactattactaaaaaaaatcatcggatatggttaaaattataaactaaaaacataacctcaaaacactattctttattaaattattgtcataaacatacatatttcttataataatatatatcttagttataaattataattcatctccattcttacaacacaatcacaaatttgacgataactagcagagaatgtaaggatttgacgattactctcatatgataacctctatacagatgatttcaggctctctggaaaggtaagattcaattattatttttctgtaaacgtgattataaaagggtaaagccctgttcttttcattgtcgctgcatcagcgatcggcgaccaagaattataactgagttgagacacgtgtctatggtgagtaacaccggcaacaccattaaaacagtcgcagcgactccttttcaccattccaactgtcgctcatttttccagcgacaacggcgatacccgtggaagtgatcgcatcgactcttttttaattattctccatttatgtggaaattctggtcgcttaaagctatcgcagcgattttaaaccgaacagggcctaagccgtttttctagaaaacggttcaaatagcttgacaaaatgctaattgtgtatcacacctatactcgtgataatttatataaaaataatttcattcatatgttaatataaatgacatgtttacttagtctatatcaaaattatagaacaaatttcgagaaacagaagaagagaagaagccatgaagctaactagtacagtcacaaaaggacgacaccgtttcgaaattgggccagagacaaaactaaactggatcttaaatcagcccaagccgttaactataaatttgttacattagtcacggactcacgtgtcacgtccttcgaaaacaacgtatccgcacgtgacatcgccaccggcctttttttttttttttcacaccgcacgaggaagtttaggtttcttcaaaatcacaaaaccaaacaacaacaaccaaaaaaaaaaaactcaaaccattttctctctaacttctctgtcatttctctctctagtggcaaagtatggcggattggggacctgttgtagtcgctgtgatactgttcgtgcttttgactccgggacttctctttcagattccggcgagaggtcgtgttgttgaatttggtaatatgcagactagtggagcgtcgattctcgtccacaccatcattttcttcggtcttataaccatcttcaccatcgccattcgtctccatatctataccggttaatttcaccgtaccggattcgtaacttcccccggttgtctagttttatggtttgttttggattttgtttcttctctgtgtcttgtcaaaacgttatgaatttgtgaatctgaatatgcattaagttaatttcaaaattcgctatgtttgattctcggtttggtttaaatctggttatggcgttgatttgaatttgatggtaggcactaggcagttagccttagtttggtttattggtattcgagttcaaattggaattgagtactaaaatgctctgttactcatttctgcatcttgagttcttatggatttgcttacgaaatgttcaattttgtttggtctggttcggttcgttctgaaacgaatgtcgagagtcttttgcttgactcgaaacttgccttgtgtcagcgtgtaggggtttgtaagaataaaatgggctttaaaattaagttattaatgggccaacacatgatccaccaagaagaagtgatccggttgcatcttagattctcatgtgatgtgattgaacgttgaaagtgcacagaagtagacctgtttaaagatgtttcacactttcactgcgtactatgtaactagtggagtcagtcccgtcatgcgtatgagtaaagcgcgtcgataccacgggaacacacaaaaacatgtcaccctagtaaaaactgtgttcgttagctcattgtaaattgcagtatatggcataaacaattgtttctacaaattccaagaatgtaagaatcaagacaataaaatgtgactatatcaagaacttaactaaagtttcatccacttaaatgaaaaagttgatttggatagaacaaaagacgtaatattcgatgtgttctctctctctcccatctttacttttattgactttttattttcactttaatgtgtgatgtaaaaataaaaagtaattatttgttcaaccctaggtgaaataaaggacgacccaaaacaagtgacgagagagcagagagagcttcttcttccggacactgaacagtgagagcacccatctccaacctcttcctgtaagtttccccaactactctgtttcttaaatgttctgcgttctttaaaacaaagtatagaagatttaggttgtaagatcgatctcgtttgatttcaaactcactatctgaaactctttgattacaaacccatcttcataatctctgtaaaaatcaaacatgcaattcacttaatggtgcaaaaaccccagaagagggaaaaaggaatcaaatttagtttataaaagcagtggaattgagttgcattgttgaaatattcaaaagcaagatcagatttttgataaagaatttcacttttgattgcaacttataatcaaggaacaag

SEQ ID NO: 9996 - DNA, 3000 bp, Unknown
  misc_feature (1)..( 3000): cDNA_ID_3035110_gDNA_ID_2096300_Annot_ID_195682 3000 nt of promoter + ATG
gaggaaacaggaattgcttgtgcagaacctgagacaacttgtagaagagaagaaaaaagacatgaaggagattgaggagctttgttcagttaagtcagaggaacttaatcagttgatggaagagaaggagaagaatcagcaaaagcattaccgtgagctgaatgctatacaagaaagaacaatgagtcacattcaaaagatagttgatgatcatgagaaattgaagaggctgttggagtcagagaggaagaaactcgaaatcaaatgtaatgagttggcaaagcgcgaagtgcacaatggaaccgagagaatgaaattgtctgaagatcttgaacaggtatccatttactctctgtatctctcttttcaagatatatgttcaagaaataattggtttttttctcttatcagaatgcatctaagaatagctctcttgaactagctgccatggaacaacaaaaggcagacgaggaagttaaaaaacttgctgaagaccaaagggttagtgactttcttcttctttgtaaaaatggttgggcttattttcgtgattactgagaaaattctgtacctaacagaggcaaaaggaggagcttcatgagaaaatcataagactagaaagacagagagatcagaaacaagcgattgagctagaagttgagcagttgaaaggacagctcaatgtgatgaagcacatggcatcagatggcgatgctgaagttgtgaaagaggtggacatcatcttcaaagatttaggtgagaaggaagcacaactcgcagatctcgataaatttaaccaaactcttatccttagagagcgcaggaccaacgatgagcttcaagaagctcataaagaattggtaaacgtatgtatcattcaaagtgttgttcttttcaatcacatcgaaaagctatgagaaagcttgacattttactaaaatcttggttttgtttgtttcatgtgccttcatagattatgaaagaatggaacacaaatatcggtgttaagagaatgggagagctcgtgacgaaaccattcgtggatgcaatgcagcagaagtattgtcagcaagatgtggaggaccgagcagttgaagttctccaactttgggaacactatctcaaagattcagattggcatccattcaagcgggtcaagctcgaaaatgaagatagagaagtggtaagaccgccttcttgactctgtttgttatgttgaatctctctgaaagattaaaaagcttttttggtgttgttgttaattgtgtttaggaagtgatagatgatagagacgaaaagctgagggagctaaaggcagatttgggagatggtccttacaatgcggtcacgaaagctttgttggagataaacgagtataacccgagtggaaggtatattacaacagagctatggaacttcaaagcagataagaaggctacacttgaagaaggtgtcacttgtttacttgatcaatgggaaaaggcgaaacgcaagcgtggaatggcttagaggtttaaccatttttgataaccgaacaaaaatatgttttcatttgcaattgttatttgctaatataggatttcgattgatggtttgcagctgcaagatgatggacatgggactgaataaaaagccgatgcggtttttagttgcagagaaatgtgtttggtttgaccaaactttggtggattctgtttgtttttcttctcagaacttagtgaataattgacacaactttgatgtcttgcatcggttcttttcattgtaacatttgtaggagtttggccgctttggacaataagaaataaaaatatcattgtaatataattcacatgtaaaacaactagatttggcctctcttctgtctcatatcttaagcatgtcatttagaaccttttattgtaaaaacaaactttgtcatgagttactttttgtagtcaaatttgatattgaccccttccttattatgctaacactgttttcatcttataaccctataaatctaagtttcgtgaatatagccaaaatcatctacatcattgcaaagaaccttaaaggagaaagaagaaaaccggcttgagagagatggaaaacaactcaggagctattctctttgtgatcttagctatgaccattgttcttcaagtgaggccagggttctctcaagcactccctacgatccccggacttttcccaccgggtcttcctattgatatcataaaatgttggtcatctctctttaacgtccaaggatgtgtacaagaaatctacaaatcgatattttctggtcagtttgctagcattgaagccccatgttgtaaaacgttttcagctatagatacaaactgttggccacatatgtttccattgaacccattcttccctcctattctcaagaacaactgcgagcgtattgctacgactccatcatcaacacacaagtgaaggctacacacaaatgttgcgagccagttgttagcttcgaggtttaagaagttcttttatcgatttgagagatcacaatgcccaataatccaaaattctccttgcagtaatttttttttttttgtaatctttagcttaaaataaacaaagctaagctttttgatgtactcgtatgtgtttgccatgtagtttgttaaaagagtggttataacataaacaaaattttgtttgcgtttatatatgaaaatattgttcttacactatggaataaaacatatttcagcatttaaaatttgtaaaaacgacgaacacgaacgcatatcaataccataccaaaaagattatatcgtacatgaaacttgttgcagacaatggcatgactaatgggcctctattaacttagcccataaggcccaataaaactttccaaatagtttcatttttcagattttgaagaatctcccgacgactcctctctgtctcctcctccgggaagctttctgtctctctctctctctctctacacaagaccttgaagaatccgattccataaca

SEQ ID NO: 9997 - DNA, 3000 bp, Unknown
  misc_feature (1)..( 3000): cDNA_ID_2187067_gDNA_ID_2096300_Annot_ID_195686 3000 nt of promoter + ATG
caatcccgaaagaaaggtaaaaaagaacccacaagaaaagaactgcatgtagtggtgaccaaaattctgaaggaagtagacttcaatacggtgagacttcaaaagtttgagaatttacagattataaagcgtatacaaaacctttgaactcaaagacattttgaattttgtttccaaacaggcaactctatctgatattctacggaagcttggtatgtttctgtaaagcttttctcttattctcaatccataatagttatcgtcttccaaatcttcaggaaacgtttatcattgaaacattcttttcctgcttgtgataatactagggagccattttggaattgatcttatgcatagaaaagcagaggtgaaggatatcattacagatgccattaacgaaatgagtgatgatgatgatgagaaagaggaagacacagaggatgaaggtgagaaagagggaaaggactagttttgtctttcttctctttcctacaataagaaaaagaaaacataaccgaagagacggtttaacttaaccttccatgtgtgaatcataggattgtttgtatgtttggtgtaatgtgtaatctgttaggctcatgtagtatcaggtaatgtggttggatactttctggattagaattaatttgagatgtatttgtaaggacttgcaatctttcttcactttagcagcacacaagtgacatggataaatattgttgtgtttcaaaagaggaaaagaagggtcgtccaagagatcagctccaagtcgatcagagagccaataattcctctcaagacacgcccacgaatgaattcacaagtaatctctcgtgttatgggatctattgcacttatttttgattttaagagtcatgttaacttttgtgtcatgtttattttaccaccctataattagcatgttcgtttcgtcaccactggcggttgcggcagcacaccattgacggttcagcaaaacgtttatcataaacattttatttagctcctcaagaagttaaaacgtttatcatgaacatttcagtccctgatcttcttctccatctccaacccatgtttggaaaccatgtgtgcggttctctcaagcttagttctgcactcttctcacgcatttaaaaagttaaaacttcttgaggagctaaataacacaataaaaccacacaatcgacggttcagcagcacaaacaaatagttgaagcgtatgtgacaacaaatatgcttcatatagtgtgcatggtttggttttattgtgttacttattattatacccttattgaacacccgtattttttttttattaataattttgaattgtaacgcttatatctttaagattcttatttttatcatttatacagttttatattatcactttaaataaatctaaataatttttatgtaagttttgaattgatttgagttggagtcgaacaaaaaatcatttgtattaattaaacaaactttattaagtcaattctgaacatttacaaataagccccagttttatagtttgtcatattacctgatgcaattttggtgatgaactaaatgcacgataataagcttttcaccatgaatttttatttttattttagtactttaattgtgtttttaatttattaatcatgtttaaattttatattttatcagatgattattgtgttacttgatttacaagatatttattagtttagaatgccaaagttttttaaattgttttaataattattaatttatgattcataattaatcttatggtcatcattcaataatttgtcttgaaccacatgttttttttacaccgatcaacattatcttgaaccgtttgtaagtttagcgtcttcctatttgtgtagctgttaagtttccaacttttcttaatatatactaattgtacgactggatactttttggatttgagttcatttttgtagatgtctttgtaaggatttttgagcttgcttcttttttggggtctctctatactagtttacaattccacttaaaagagacacaatgatagaaagtaaacagagaagacagtttatcctgcatggaaagtaaacaatgacaacaaacaaaattggatgaaaccactgatttatattatgagatcatctaaaaataaagaaactattttgacccaaaaaaaagttctactaaaattgtaattcatacttataagtgagatcacctgatgtcattgtttccagctatgcttacccgtgtttcaccttcattgtttctagctttgatttccaagtgaatcacctgatgtcatttacagatcccgagtctttctttatactctaccctgcaagtgcaaatctcacacatataatatattaccaattgaaacttcatactccgacgtccgaatatgtgatcaaattattagaggaatgatcaaaaaatgatttttgaacctaatattaaaatttctcttacatatagaaaacatccaactttgacaaatccatgtaatggacccgtaggccgtaacatcaaatatggttagatatcactcttatcgatcaaccaaccaattaccccataaatatatgtatttattcaatcagccgtccataccggtcttaaagtattgaagtagccagttctttagtggtccttattatgttttcgatcacctccttatctctgtagctacataatcttcccttgttaaatacctaaaccctattctccacttaacctccctaaagaacctatatttcacgttatattcttggctctttcacttttcccataaattctgtgcaaaaactcgagtgggccttaagctttatctaccttatctctccagctatacacttgctactcaagataccgctaaccctaatctctactagacccccttaggacttaaaaccctatatatcaaggtctactctctgttttctcgctttctttattcgagccattccatacgtttttcgatttctttcattgaaaaccattgaa

SEQ ID NO: 9998 - DNA, 3000 bp, Unknown
  misc_feature (1)..( 3000): cDNA_ID_2187036_gDNA_ID_2096300_Annot_ID_195677 3000 nt of promoter + ATG
aagtcaaatgttgaacgtggtggtttttgctttcgctacgtatttctcgacggtattgactaaattcaaagtattgttggtactctcaaaatagagatcaatcacagactttatgtctttgttcttcgagaaatcataattgctttctttaatgatcttgaccacatcttggcttgagacagctaaaaagtcgatgatcttaatgattgagtcctccttggatggttttccagtcttgcttcctcgaccggtgaccgtttaatttccatcaatttgtccattcgttcgcgaagcgcagaaatataggatctgagctttggatcttctttgcaagcggatttgcaagaactcaggacacgatcagagataaattcaaccaacgccgccattgatattatgctggagctagcctggaaaggaagaaaattaaagacaaagatttcagaatattttgcatacaccaagtgtaagtaaatatcactgaaaattagcagcttaacaagggtccatttgttaagactaattcaattccgtgaatataaccttgtgaatacttaaatacaaggaagatataacaaatatcaaaatgagatgacgttgaagaaagagaaattacttgaacttggttacgaatcttgctcaagacaggagaatgttgtgtctctgatctacaactattacgtaatatataagcaaaaaaaaaaaaaacctaaagtcagtcaaccttgaaagtacgtggagaaaacagttgattttatcaacgcggacagaaaattcaacggtttacgattttattagaattcaacattgtaaataaatgtgtggcatagactcaatcttgttgtcacatcggtttagaagcatcataaagagcatgtttatcaatgaacttcataaaatatcattagcattagttatttaataatttaaactttgagaaattaacggtgtcaaatagatcactgagtgatccaaatcaaagaaaaatgatccccaaaattaactttttaattgatttaagtctatgatactttataatatcatgggtaaacatgctctcttgaatcgaatcttccatgacgacagaataagaaacaactttgtttttggctgttatatatatatatatttatcgataaattaaatttaagaaataatttgccaaataacaataattggaacaataataaaacaagtaaccaaaacctcgaagatttaatcttggaaattacaaggaaaaacatttgattttgtatggacagaaaatgcaatatggagcagaaactgcgaggattcacttggaaattacgaggagaaacatccgattttgtatcgacagaaaatgcaatgtggttaaggttgtaacctcaaatcagaagtcaagccaaccttgtaagttgtaaatgtctgggaaataatcacaatcttctagcaaatcgaatctttcttcttcttttaatcttacagtatttagaaagaaaaaaagaaaacaacaacaactctgtttttggtcgttagtttcatttttgtcgcggtaataaaacggttagtttctattatttagtttattttttgtagttaaaaagtttatcttattactggataaaaaaaaagtttatcttattcacaaaacgaatagacttcctttttttttgaaatttttataaatactctaaattttattaaaaatttgaaaactacattcactgttatactattttgaaaactacattcaataaccataataatctttttatttatttataaattatttaaataaattaactaaaaataaattaaataattgataacttaactaaaattcgtaattatttaatttaataataaataattaacaaaattaatatactatatttaaagtaatcactatctcgtttaattttttttatataagttgataatagtatttagatttattaattattcaagaataagtaattcaaaattatataatttatatttattaaagtaaaaatctgtgtacatatatttttgatattttttgttagtcttattttattctatatagatttatttttaaggttgatattttgaactatcgaattatttttcacttttgttgatttaatttttgtctccgtcgactagatttaaaacagttgacttatgttatggccagttgatttataacatagtaaatcttttgaactgttgacttacttttttttgtttatcaatttttaatttaatgtgtagacttgtttattcaccgtagacttactttattctacgttgtcttatcataaaatctatttataaaatgtcgagttaaattttatttttgtcaattaaatttatttcttttgatttattttaaaatagtctacttatattttgttaattgtttttttatgtagtcaaatttttgaaagtgtttacttatttttttgtttgttgaattataattttttttcgtcgatttttttattcttagtaaacttatttcatctaaaatagcaacaaaactgattctttgccaaacatttacaaggtccacttgactattggatttaagtacatttatactcataccaatattaaattttcttctccacattatgagacgtgacaagatctacattatttccgcgttgcttcaaggttgactgacttttcattttgttgctatataacgattatccagtagctaatacttgtagatcggtgacacaacattctctaatcttgagcaagattcttatccaaagttgagctaatttttctattccttcaacccaatctcaacttgatcatctcatggaccttgcctttaaatattattactatgttatattcacacggtattataataaatctcaaacaacttaagcttgattgctaatttttatgatgctaactttaaacttgatgtatgcaaaaactatcttgcctttaaattttcttgattttgttttgttttgttttcctttctagattagctccaatataatatcaatg

SEQ ID NO: 9999 - DNA, 3000 bp, Unknown
  misc_feature (1)..( 3000): cDNA_ID_1397812_gDNA_ID_2096300_Annot_ID_195671 3000 nt of promoter + ATG
acgaatacagaacaaacaaaactcatgggacgaatagatataataaagatacaaggagacagaagcgtgtcgatagcagaagcaatggagacagcaaagcactaatcttttgagacaataagccaaaaaaaaaaactagctgaaattcatcctaaagtcttccactatctgatctataaccaatctacttctatatccaccaatatgattacaaattattgaggaatgaaccaagaatgtggtctagtcaaaatgatctttaaaggaattaacagaactattgaatcaatgactatatgtcaagtaacataaccaaaatgtagatatataatgcgagatcaattacctcgtaaagaaagtactacactaagaagatccaacgatgatgttgttgattgggatgaaaacgagcttcacgaagaatccaacgaatcccatcaccacaaatccaatcgccgtacgcacagctactttcgtgaattctgataaccaattcaattacaaatgatatcaaaatttcagaaaaccctaatctacagatcaaaaatcggaaatgagatttttttgagaaaaggcgttacccttgcgatcgggtttgtgacagcgctggacgagacgaacactgctcttagcgaaatctctgagaggatcgattgcggaatcaatggcttccatgacttctttttagatcggaattggtaatcgaaattagggtttcagcaggttcgtttaaggatgaaaattgggttttatttttgacatttggttttatactttagttccgttgactttcgcctccaccataatttctccaattcagatttgattcggtctgaacacaaagtccggtttggtttcttatttgtcttaatatcgattactttccatctataaaatatttttctacaacatcttaagaattataattgagtgatgttgatgctactattttaagtttagaaaataaacactaaaaagacaaatgtctcactcatcaaagtaaaactcttgaaaagtgcaagagctctgaaatttgagaacgaagacaagactccttgtttttttttgtttttttttgctaaaaatttaaatattcattattacaatgaaaatttcggttacataataaatggtaaccaaatcatggttccatgacaaaaaaggataaaaagcatggaagcataccaagactccttgttactacgtcaatctcttttatacgttttcagccaagattccggattatgaaagaatcttgggattctaacactttttctttttttgcttgaaagaggtttacaaattttaacactttttttttgttgaggattttagagtgaaacacatgttttgaactgtcttcaactgaacaattcatgttaggcgtctatataaccgtcggttattcacgaggtaactacacatgaacatgataaatttactctctcttttcattaaaaaaaagttgtacaacttaattacttatgtcatgaaaatagtatatacgtaaaagtagattatttttgtggttttccttttttttactataacaataaataattctatgttacctaaattttcttaggtagtataatggatcaaattgatatggagtaaacaaaagaaaaacttaaataatctggtctataatttgaagcgcttcaagccttcaacatcaatccgagtacgaacaataatatgagatttcatcaaaatattatcctggaaacgatttttcatttatatgcgattatattgttaatgaaagttggaaatacataatctagacacgtaaatgtcgtattgatcatgttgtgaaatgagctgtcgccttggtggcactttttggcattctctatttctctttccacatttaccacaatgtatccaaataggcaaatatataagcttagagagttggctgcacgtttttgctaaacttgataaatgagtcaatacaaccaatatagccaccatccatatctacaaatctacacttatcatctaaacttgaagaatatttgttattttatcactaaccacaaaagacaagactcgttacttaagttaaatgatagtgacatgattaagagaatattagctattaggtcggaaataagagaaataagactggtagtggtatggttatgtaaattatcagtacatgtatataacacttgtccaaataatggctttcacattacaagtcattctttccctgagactactgcaagaaacaaacacggaattctcgtgataaacggattagtacgaaggaaaaagtaaaatgcagtaaccaatttttatatttcaaaaaacaaggcattttggatgcaatgaaatatttagatatataaatttgactagtgacaacaatttaaagttgttagatttctcaaatccaaaaaaaaggaaataaataaataaatagtttatggctattcaaattgtgtattattttttctattggttaaaatctataaaagattttttttttattacttcttaaatttatgtttatagccaaaacatctaataaaatgggacagagaataataactaggaattcaaacacattatcaatgattagcagaataaaagtttggaacatctaaacctaatgactttatacttcccctttttagagtttactttgtatggaaaactttgtaagctaacaaacaaaagtattgaaatcgtgaaaaatagtaaagctttttgagctgcaatatttgatgcgttgaaacgagttggaaacagctttcactacactaaaaacaaacttaatctcaaaatttagatggattaaactcaaaactttttaattaattgaataggattttaggatgatgcagtgaatatagactatttggtgaaaaaatacaacgtaacgtacgtggctgctctaagcctatataacatagcccaagagagtcgtgttctaatgtgattaagtaaagtgagggagaagcaacgagagatagagatagagagatcaag

SEQ ID NO: 10000 - DNA, 3000 bp, Unknown
  misc_feature (1)..( 3000): cDNA_ID_2714365_gDNA_ID_2213359_Annot_ID_131816 3000 nt of promoter + ATG
aaatgtgcagtttcggttatgtgtttagctgtgaagaaagaacaagttgttcaaagcgtggagagtgttaacgggacgatttttccgaagaaatcaaaaaatcttatcatgagcgaaggaagagatgaagatgaggactatgggaagattatttgtccaggttgtgggatttttatgcaggacaatgatccagatttacccggatattatcagaagagaaaggtcattgcgaataacttggaaggtgatgaacatgtggaaaatgatgagcttgctgggtttgaaatggttgatgatgatgctgatgaggaggaggaaggggaagatgatgaaatggatgatgagatcaagaatgcaatagaaggtagcaactctgaaagtgagagtgggtttgaatgggaatcagatgagtgggaagaaaagaaggaagtgaatgatgttgaattggatgttttgctccggctggtgttggatatggtaatgtcactgaggagaaggagaagaagaaacgggtttccaaaacagagaggaagaagatagctagagaggaggcaaagaaagacaattatgatgatgtgactgtgtgtgctcgttgccattctctgaggaattatggccaggtgaagaatcaggctgcagagaatctcttacccgattttgatttcgataggttgatctcaactagactgatcaaaccgatgagtaactccagcactacagttgtagtcatggttgttgattgtgtagactttgatggttcgtttcccaaacgagctgccaagtctctgtttcaagtgcttcaaaaagctgaaaatgatcctaagggtagcaaaaacctcccaaaacttgtacttgttgcaacaaaagtagacttacttcctacacagatttcaccagctcggttagaccgatgggtgcgccaccgtgccaaggctggaggagcacctaagctaagtggggtttatatggttagtgctcgcaaagatattggtgttaagaatctgttagcttacattaaagagttggctggtccaagaggaaatgtgtgggttattggagctcagaacgcggggaaatctactttgattaatgccttatccaagaaagatggtgcaaaggtcacgaggctcacggaagctccagttcctggaacaactcttggaatattgaaaattggcggaatattgtctgcaaaggctaagatgtatgacactcccggccttttgcatccctaccttatgtccctgagattgaattcagaggagcggaaaatggtagagataaggaaggaagttcaacctcggagttacagagtcaaggcaagctatgtcttacttatttttaagcctttggttttggaattgatgacttaatctctaatgttctaaaccctggagcttctttttaccagtacactgttccaagaagaatttacttgaactgttatacagcttcaagtagaagaatttcttattgcaagaagtaagctgattttgttgaatctttcatttgcaggcaggacagtctgttcacattggtggcctggtcaggctagacctcgtttctgcttcagttgaaacaatatacattacaatatgggcatcacatagtgtttcattgcatctaggaaaaacagagaatgccgaagaaatattcaagggccattccggtttacgccttcaggtaagtaaagcttgtttcttgcgcatctcctcttttccgcaacatcagaatgtaacggagaacccattttacttttatgtatagccaccaattggagagaacagagcgtctgaattgggaacatgggaagagaaggagattcaggtgtcgggaaatagctgggacgtgaaaagcatagacatttcagtggctggtcttggctggttatccctgggcctcaaaggtgcagcaacactagcattgtggacttatcaggggattgatgtaaccttgagagaaccattggttattgaccgcgcaccatatcttgagcggcctggcttctggttgccaaaagccatcaccgaagtgcttggaacacattctagtaagcttgttgatgctcgtaggaggaagaagcaacaagacagcacagattttctctctgatagtgttgcttagtataacctgtatcgacttattattagctttcatcagtgtagtcattttggaaagtttatattggtttatgtattttaaaacaattttaaatccacatcgactatttatttatttcaattcattttaaaaaattcatatgattttagtggattatcaaataagcaaagtacttttaagattttgtgtgtttgtatgttttaactaagaaatcttcaagcatttaataacatcctcagcttttttccaaagtacagtattaataaaaatctattttagaaataaattctacagtttatttctagacatagttgagaatttagacaaatccactatattgtaacaaaaagaacaaagtgtgtagtgttggttgaattcaaatttgtttaatccagtgaacctcgttattaagaaaagcccggcccatagtgaaaaatatctatctcttccccttgtcgccgttggtctcgtcgccggaatgtatctttcttccggttgcagaaccaagtttcgactctagacttccttctctcctgaaacacgaggttcgtcttttcgtgattagatttaagttgaattgaagaatttctagggttcagatttgtgttatgaatctcggttcatctttccgatcgccaattgccttgtagaagttgatactactcatcgtctcttcttcgatgcgagtatttttctggggttttactttacttacatagttctctagttcacatttgaagttgtgtcttcttagatcgataaattactctcttttattttggaattttctcgtattatgttcactttttcaaattcttgttgatatgttgttctctttcgtttggcattttgggaattgtgtggcagagagctgaaatg

SEQ ID NO: 10001 - DNA, 3000 bp, Unknown
  misc_feature (1)..( 3000): cDNA_ID_3033147_gDNA_ID_2213359_Annot_ID_180736 3000 nt of promoter + ATG
cgaacacacttttaagcaatactgatctctccattgtcaccaccgagcacaagaatggttctttcgatgattccttgtcccttaatcttggaaattcgtcaaaacctcgcttggatccagtctctatagccaccgccaagctgatgaatgggtcctccaatgatttcttgtcccttggaacttcacagaattcagagacgattactgcttcttccgatgaattcttgttctctgatcttggacatttgcagaaatttagcttcgatcccctctcaatggcctccaccaagccgaataaagctctgtccatcgtctccatcgaagctatttccaatgggtaccgttttttcttttcttagtagacaagaagcttctttttcaaagaagttttttaaatatcgcttcatccattattacaggttgaaacttcctgcgacaatcaaggtaattaagcctttcgttcgtctctggaggtatagttagtaacttagtatacacagataagtttgaattggtgtgtttcttgatctgcagggtcaggctaatgagatctttaaggtagtggagagttatgccagaggaaaggaacgaaacgtcctttttgctgcttgtatctacattgcttgtcgagacaatgatatgactcggactatgcgtggtatatatatttgaaacctgaaagattcttgttcctttcttggtgtagcttctgccattgtagctgaatcagctttttcaaaaccatttgtgtagaaatatctagatttgccaataaagcctcaatttcggatattagtgagacagttgggttcatagctgagaaactggagatcaacaaaaattggtatatgagtatcgaaactgcgaactttatagtgagtttgtgcattaagcttttgttgcattgaacaaatagtcagtagctctagtttactgacattgtattcatctgcagaagcggttttgttctatatttagattggataaagaagcagttgaagctgctctagaagctgcggaaagttatgattatatgactaatgggtaacttacattatctgagcagttcctggaatttagtggatgagtaagctctaagcagatgtatgatgcagcagacttaaaacccatatatttctacttattgcagttgcagccgtagggctcctgtatcagttgcagcaggaatcgtatatgtcattgctcgactttcttatgagaagcatctgctcaaaggtcacatttaaatctcaatctatatagcagcccttaaagcaaagtctgatcagctcttctctttctctaacatattgacacataatgagttgcaggtctaatagaagccactggagttgcagaaaacacgataaaaggaacatacggggacttgtatccaaatctgccaacaatagtacccacgtggtttgccaatgcaaatgacctgaaaaaccttggagctccttagatctttatgtgcgaggatacaaacaatctcactcaaagaagctttcgtctttccctttttcttttttcctgagcccttataagattcttcctagaaccctttacacataatacctcatgaatacgcatcatcaaagttactccaagtgtatgtaaactctcagtttgattcgactttttcaaaagaatacaagatcattccggttttttgttacattttatgataagacagggaggtctatagaactgaaggaaaagaaactggcacggccctgagcgatatgacagaatgttaatggtgcagctatgcgcttttgcaggactttaatatcttctttgcttggtggagagtccctgttaaagaatatgagtatatttagtaagacgcatagtgaaaaacttgcattcatagtcgaacttcaaactaacaaaaacgcttaccccgagaagcaagccacaaagcttggttcaccaggagaagacttcttgaaccggctgtttggtagatacacgtcaaacaccgcttttgcatcacaaatctgcatatctcccaagagtttagttacagtatcattgtctgcaggacattcaccagcacaagctgactcttcttcaccattcggtcttgcagcatcctttaacgtccaagaaactccatgcctacctaggatgtaacctagacccttcaagtatctataaacctcgtagttttcccaagagcaacgcttttctcctctgcaattttctcatacaagtccttcaatgggatcactatgtcatcctcattacctaagatctgtaactctccaatttcactcaaatacctgcaaagggaagaagaataaacgaaaaaggaagagactttcatcagatctttggtaaagactgatctaaaaaacttgtaaaatatttagtttgccacatacagagcctcttctatgaagcaatatgtctttccactacgaatgattccagttgtcgtccaaagttttccccttttaacctcaacttccgccattcctagttcagtaatccaacgagccttggaagatcctactctacattttgcaaacacaaaaaacaaaaagagaaactgagtctaagattagttgacttagcagtttatgatttgggcaaaagtaaatctaaattcacctgaactgtaacttgggcactgaaccaccagaatgaaactcttcgtcatcatcgtttggaaaaccaccttcgttttcgctcgaagaagaagcttcccagtctttttcctccataagcttaaagtatgagatgttcaaggaggcaattcgtcgaacagttggtgtacagctaaataggtcgtgccgtgtcgtgtgtcttctttctcttttcctttggttttgaattttattgtaccgaatcgacaaataaggaatcaagacccgaaccaattaaaccggtttgagtaagtggagaaaaaaactgattttaaaatgttcgaatcctaaacccttgacattcttctgctgagttctcctgaagctcaaactctcaataagtatg

SEQ ID NO: 10002 - DNA, 3000 bp, Unknown
  misc_feature (1)..( 3000): cDNA_ID_2714310_gDNA_ID_2213359_Annot_ID_180734 3000 nt of promoter + ATG
agatccaggcgattttgcagatcctggttcgtctgatttgttgttgttaagctcagatacgagatcatcgatcgggagatttggatcaagacgacgagctttagccaggaatttcaaagcgcgaggtcgatctccagcttccatagcacttttgcagattttcaagcacttcaacgcatcgtctttgtttccatccatgttcaccctcacgaaatcagaacaagcgagccctagaaaacaagagattgagagaagaatcaggaggagtgaaaacagagagtgtagaagacgcaaatctcaatcatgagactgtacgaaattagggtttctgctcaccgatcggatttcagattcgaagaatttacaagatgactaatgggaaggtaacaacaattttgttgttagagagataagacacaattccgattaaatctgggattagcgtaccaatgtcggtacgacgtaaacgacaaatactagttccggttctggaaaattgtttgagcaatttggtctggttttgttccggttacaaacttgttaatgcatataatcaaaccggtcccgattcggttcagtaatttatgggaaattgttacaaatcgattgttgtggagagatgaggtcttgacgagccctaatgcatctttcagattctaggtcattagcaaaacttttgtcttaaagctgtatagtctacactctgttggtaatttgtatgataagtcattaggtagttttaggtttcatcattccttacctacaagatgcattgaagtaattacttaatatcaagtgggactattgaagacctaaccaactttcttatgtactatattgtatcaagaaggcccaagatcaatagtacacaagcttgagagtctttaaagctgtgagttgtttactccatgtgctcttatcttcttctcattttttttccttctgcaatcataatgtagtgaaatgatcataatctgcttagagaatttaatgccatgactcagatgagaagtagaaagattgtttcatctttcattagttattttgcgctaacatttgatatcttcatattcattttcgaaatccgcacatctggacagaaatatgtattatcttataaatggttatgaaatagttgtcaacgtaaaagaattgttagaatgctacctaaataacgttgtgcttcttgattgtgtcaactgttaaacactaacaaacaactaatcacgattgcgttttttaaattatgaatagagtggtgaggtttttttttttgtttgtgggctggaaaacccataaaattaaaaggctagtttctattcttgtaatattaagacttggcttatagttttccttgttgttaaataaagacttttgctcatgaggagacactgggtcaaacatgggtgacaagtgaagccaatgggcagctagggattccctattaatatattaaatgcatgtttctgaccatggagccaaccttttattacattaataatttaagttcacatcatataacgtcatatatgtatatgttatactcggttgatcaaaaaaaaaaaagtatgtgttataattgaccagctttctgaattctctatagtttattatatataagagcatgattgttcacaagtctaaagatgtgtctgtatggatctataattcttcttaatgtgaattctttaaaggctaccagatttgtgatcaacatgtattctttttggtcaacttgtttaaaccgcatttatacataaagctaggtttaaacttttccgaatagtaaaccaatagattaaaggctctcaacaatgttttttttggctatctagcatttgtttaatagcaaataaatcattttaaaatggatttgcatacaaagaaacaaaaagtctttgaatatttggtgaggaaaggtgtaataattaatattattaagagttgataatgggattaattaatactattagaaggcagcgcagcctcataaagtggcgataccttaaaacagagcaacttggatggcttttgctatttgtggatccacgcacattcgaatcaacgatgtacatactttatacgttttattgttagtgttttttttgttaaatactttataagattatgtcttataatcttttcagattagacactagatttcgttaatcttttgttacaactgcaacgaaaaatcccggtctacctctacatatttataacattgctatatttgtaaatttgattaacattacagaaacaactataacattaacagtcatgtaacactaattgtaaaatacatgtaacatttgcatggaaatgaagagagcataaacttaggtaaataaacacaaaattatgtaggaaaaaagtagctaagaacattaatcatacatgctaaaaataccgtttcattgaaatatatgtgtaattctgcgattagtatagtatttacaatcttgtaattaatgtcacatgctctgcgaattagtaacactacataaaaattacgaaaaacagaaatacagaaaaatatatcaaaaggtatatttatttatagaaaacttgatacaacaaaacctaataaaattaggcagatttatcgggtcggatctttgaacatggattaaattctcttaaataccacaacaacaaaacaatacgtacatacgaaaacccacgaaaagaggacgcaagacaagactttcttcaaagttggattgcgtcaaaataatcaaaaaacgaaccaacagatgcgaaaaggcggcccggcccgataacccgagtaaaccgggtttggagttttgtaacactacataaaaattgctcagcaacctcacacacaacaacaaactcccacgtttgacagagaatagaggacgaaggagccttcactctcctctctctctcttcaccttccttcgcgccggcgaagattattattctctgttttttaagagaaaagtaaacggagagagagattttttgaaagtaatg

SEQ ID NO: 10003 - DNA, 3000 bp, Unknown
  misc_feature (1)..( 3000): cDNA_ID_2714316_gDNA_ID_2213359_Annot_ID_180731 3000 nt of promoter + ATG
aatgctgatttggttggaaaatgttccaatctgtggatccaacatttcaaatagaacaactccataataatctttttcaaagtaaaaggtgaactcagagcaagaaaaagaaaataattccagtcaaccgaaggtgagttttatcaaggaaaggcttccacagcaaaattttgactagcgagttgcttgcgcctgtgtgtgttccaagagctgattcactaacttgtatgttcgtcctgataagcctttggtgtggtttatcaactgctcatgcctgcataaagcggaaacaagattagattgtagaatacgaatgatatcatagatttaagcttattctacttacacgttgggctgagtaggctccatgattacagttcctgactcagaatcaatcttggcatcaagctttgaggtgcggattaggttcacaatccatctctcggcctcctcatagttcagattcaatttttcagcaagtaccctgacaagggaaatataggctcgacatgagtacaaagttaaaccacaagaccgcaacaattcttctcaacttaaatagctggatatggcaattttcatgtgttgggaaagataaggaatagagaaaattccaaacattgagcaatccggagagcagagttatgtgtaaacatatacaaccaaatgtgagaacttaccccatgtcaatcctttgatgaattttgcaataggtttcaaagacgaataggcgggcattttcaagaaattcatctctcagtggtacagttgaaaagtttccatcctcaactcgcttgccaaggaatggatcattcacaatgacctacatcatgttaaaatgtcagagtattgattgcacagttctgcacaaacaaaaatatctatacatgtggatgagttacctcttcacactctttcatcttcttttgagccccatcaaagtcataattgacaaacacacatgccaggaactcgataattggatctttgtaggagtagtgctcttgctgaatgaccttaatgaattctttcaattgtggtcttctccttttgttgacaatgaaagcagttgccaagtagcgcagcaagtgtggagcactagtttggatggcattcagatacctgaaaaagtaaatcaaattagtatacagaactgcagcatgaaaacaaagtgaattatttttcagcaaatgcccatacacaaagcacaatcttaagaataggtctggatgaaaagaaggagaagactctaaaactagtgactgctaattacttgtaggcacatcaggactaacattaactataaacaaagttctacacacaaacaccacctatacataacttcatcgcatctagatcatgcttatcttaaaacgcaaggaaatagatggtgatgaaaggtataaagaagagatgcagataacagagaggtagaggcttacttgtcttggttaaaaagatcaatgatctgtgtccttccattatcatggttaaaaaagatatacagaccccaatgcatcaaccaaatcctgttctgcacctggtttaacggcgatgaaaaactctgaaaaaacaaatggtagttagcatatatactctcacatctatattgatttcaaaggtcgcaaactagaagaagttttaaatactaacctttgagtcaataatctctttgagacggttaagctcttcaagagcaatatcccagttttgcatcaatatttcagatgcgagctttccccacaaggcactcaaactcctctcaaggttagagcacagggtcctgtactggtaaagataatcagcagcaccagaatagttgccacattcaaactgaaacttggcgtactggtacaaagcctcaatctggtctggaccaatctgataagacaccaagccatataagatttgtgttccacaatacacaaacaaaaccaaatctggataacatttcacaaaattaaacaacttaatcatccaaatcacaacctggtagcgttccttgagcatttggagattgtactgcttgtcagctcttagctcctgcacagcgttagggttcaaaagaaaagacacgagtggtgcagcagcctcctccaaagatttgagcctagcgacaacctctgttcttctctccaccatttctatcaccacaaatttcaacattcatcatcaaacaaacaaaccagtacacaaaaacgcaaattcacagacatatccagagaggaatacacaagaataccttgaggagcgtcttcagtgtggtagagactcttgtgaatatccatggcgtaatcaaccatgttcgtctggttcaaaagctggattttagacttcaggatctgctcatcagggtaaagctgacgctcttgaaggaactcgaatataggaaacaccaagtgtctgtccaggttaggcgctattagtggcgtcaggtcatagttctgtttgctttcctccatcgtcgctaatctctcaatctccgccgcttcccgcactggcaaaatcttcttaagacggcagagatgaagtttcagagacgacgaggtaaaaaatcctgtatattgaaattagggttttctcgaatatgagctttcaatatttataaattcgcccctttacttcttatatattgttgtttaccccacaaggtatttttatctccaaaacgataacttagccgtcgttatctgatcggccggtaccggaggggttaagaaaaaataataattaaatgttttttgtggagaggcgcacggtaagaagctttattcgtttggcgtatgttagtagtctggacttctttctgtaccgcctgtgtccactaacttgcgcatgttcgtctttaacctttcgccctcttcctctatcatactggattagggttcttcttcgagacgaactctttttctttctcgtgacgaatgtttctgtctagaagcttttaaggattaagactctccaaaattttgacgccgtgttattctcttcccgtctctc

SEQ ID NO: 10004 - DNA, 3000 bp, Unknown
  misc_feature (1)..( 3000): cDNA_ID_3033123_gDNA_ID_2213359_Annot_ID_180727 3000 nt of promoter + ATG
tattcaaatgattagatatgttttatgattaacaacaatgaaaaaaaatagagtcactaaattttagtaacacattaattctcttttttatttttgctaagaatgtaaataattcattagaaataaaaaatattaggattaacatgtagtaaagtctaaggtttttagttctatgacaaaagaaggaacacattaattctctcatgaaatatttagtaacacattaattctctcatgaattatgccacatgtgatgaatgtattaaatattggattgatatttaacaggtggacaagtcggcgtttgctatggaagaaacggcaacaacctcccttcaccagcagaaaccattgcgctcttcaaacagaaaaacatccaacgagttaggctatacagtccggaccacgacgttctagccgccctacgtggctccaacatcgaggtaacgctgggtcttcccaactcttacctacagagcgtggcctcgagccaatcacaagctaacgcgtgggtacaaacctacgtcatgaactacgcgaatggcgtcaggttccgttacatatctgttgggaatgaagttaaaatctccgactcttacgcacagttcctagtccctgccatggaaaacattgaccgggcggttttagcagccggactcggtggtcgtatcaaggtataatcattactcatatatatcgattacgtattttcataagataaatattctttttagcattaatcaaaatttcattttaagttcaacatttgcgaacttatcttattaaaaataggagatattcaatgttttagtgtaaatttggttaagaacttaattgcgttttattctttttatctttatataacaaaaattgtaagtttcaactctgttttattataattgtacggaatttaacaggtatccacatcggtagacatgggagtgctccgagagtcttatccaccatcgaaaggttcgtttaggggagatgttatggtggtaatggaaccaatcatacgtttcttggtaagcaagaactctcctttactcttaaacctctacacttacttcagctacgcgggcaatgtaggccaaatccggctcgattacgctctcttcacggctccttcaggaatcgtttcggaccctcctagatcttaccaaaacctatttgatgcgatgctcgatgcgatgtactcggctctagagaaatcgggtggcgcatcattggaaatagttgtggcggagactggatggccaacgggaggaggaaccgatacaaacatagagaatgcgagaatttataacaataatttgattaagcatgtgaagaatgggacaccgaagagaccagggaaagaaatcgagacatatttatttgccatttatgacgagaatcaaaagccgactcctccttatgttgagaagttttggggattgttctatcccaacaagcagcctaagtatgatattaacttttattgagccgaaccaatattctatcaagggaatggtatatttatatttgaaaactaatatagatattggtactatcattcattatacaataaataaagtttgagggactgtaatgacttatcatttacaagtaatgacttcattaaaacaagactttactgttaacgtgttggtaattgtaatgcctttatcaataacaagtaaaattatacttcctgtctttaaaactgaagtcgtgtgtaatcagactcttaaaatttatacaaaattagttatctcaacttacctaggtttaaatagtttcttacagcatagcaggttagaaaatgagtaagaacaaaaagaattagtacaaatttcagaccacaagggttaaattatgaagggccgtgttttgcgtagttgtgtagtgatatatattcaaaaccgaggaattttcttataaacgtctatttcggtttttgcccaaacaagaaggtataattcggttggacgacaaaaatagacgctgtattgttgatggagtagatatttattattttcgataaatagtatctctttttaacgttacaacaatttctttcacatcctaatatttgtattttgatattttcttctctataagaaaataaacaagagaaatttcacattcatcgtggattttctatgcaccttgtgttttactgaaccaaattaattaattgaaagaaaaattttcacaattcttttctttttggtttaatggttgatacagaaatccaaaaaggtcaaatggttcatcatgaagggggaaaacgacaatataaaatcacaagcttagggtagaaattaaataaattaatacgaacgtgttttacaaggttgagaccatgaaaaacaagatcgtcaactgtaaccattaaatacgtccttagacccacaagccaatttcaattctggttagatgcatgatttgtgttcacagtggttcttggaaccatccatggcaccttaaacattttagtcactaaagtcgtttcaatcttgaaatttactgtgaacaaaagtcatctaaccataattgaacttggcttgtgggtctaacgacgtattaattggttcacgctagcttgacgtacgattaacggccaatattaccatgatccaacctattaccaaaagaaaattataattaacaatcaaacaaccatttcgatttaaatattttaaaaccaaattggtttgggcgattcatcatattaaacacgtgtgtcttgagctagttaaaccctattgatagctacttgtgtagaaaactcatattgttagacttttcaaagcgtatatttagagagttatttgtgaattataatggtgattaaggtgaaacataacaaaacagatgatattgatagatcatttgatttcattcattgactgacttgcacagttgcaccccaggcttggctctataaattaggcggtaaatggaatgattaaaacatatcatttttcacagaatcatagaaaaatcaagaaaatg

SEQ ID NO: 10005 - DNA, 3000 bp, Unknown
  misc_feature (1)..( 3000): cDNA_ID_3033154_gDNA_ID_2213359_Annot_ID_180725 3000 nt of promoter + ATG
ataataatcagtgttgaccacttgttagtatcacacagtatacttatatggctttccatagatctgctgtaatttcttgaattactgattgaaagtagcgattacctgcttattgttcctgtagacagtaaatgaagcttacctgcttatcctaatatacaagatggtaaactagacctttccctgtcaccaaatcttttagctcaatgtactaagggatagtaggccacgacaccagttgttaaacttgtaaacacaccaaccacacaaggcctccactcctaacgagaccacctgagaacgtgtcatttatgaagcagaatcaagacccaaacaataaatacatgaaaatggaggaaaaagaagttgaaagttcaaaatatataaaaagactttagcaggcaactcctgaacttaactttgagcgtcacagagtaccataaacacaagtggtggatcttttgctgctcttattgattgtgtggcaacatgttcctctactggctctctgtgataatctctttattcgagagcagtggaatacggatgttttctcagctgtatagcttagagaagccggtatttcagctattcctatcaacgcttctaactacaaaagactgcacaatctttaagagaatttagcttgtggcgaactagaagagagccaagaagaagcatttctaacaaacaaaagctaatgtcgagtacgacgactaaaagcgatcaagctcataactttttaatagcaatcatcgtagccaaatcgagaagaagaaatctatgtctctgattgaggttatactcgagcagtttacctgcggaccaaacttaaacgatcgggtctcgtagtgaaattggcggtatgtgaaggagaaaacaagcaagctttgagcagccatcggtaaaatttcggtttagttggtttaggctccgattgccgtttaggtttcaaatgggctcacattaagtctcaaattctttgttgggctcattcattttaggcccagtggtattagtttgttgtatctaggcttctagcacctagggtcgtatatgtatatgttgatttcttttatcccaaattttcgattgtccattttcatatgatatacttctgattccatttcactacaagtactgtacattgaataatcaaaaatgtaatatagtattttttagctaagcttccgtatttgttttaaactatttttagatgttatatgtttgacacgtcaaaccactgattatgcttattattattttggtaggttaaatcactgattatttccgtataataaatttgttagaatttatgaagcatgattttagttgtaatgatattgattacaagtaagaaatatgtcacttttaatgtaactaggtaccagttttgacgtagcaatatttaaattaggtttatagttgttttttttctactttcactttatgcttatggttcgttaatataggcataaaatgaaccctccataactatgcaaattaaaagaatgaaccaaaaattattataaagataacagtatgtaacatctccgactggtttttgaaatggttgacaaatacatgtgcctaagaaattccacgttaaaaccatgcatgacaaattgctcatggattgtttgttttctgccaattattgccttgatatgttaaaaaagcgaattagcagaagaacaaaatgccatgtaggttctctttatcttcttactgtgtttttaatcctaaaatgtatttgtgttcgtttacttgttaaactgtgacttaaaagaacaagttgggctgattatttcttctggctgcatggactcacagtggaacttcggtttgccattcgagagatgaaagagaaaaactaccgtgtggtggtagcacacaaccaaacactacatggattcgagtattgttaattactaggagaaaatgcaaatcaggttatcgtttggaataaccttgttcaaggaggagttatataaaccaagaaaagattcaacaacagttggttatcttcaaatgggcaaactttgaaaaaacaattattgagtaaatgtaactagttgttttgatcaatacaaaaacattaatttctagaatatttttgtcaataaagtaccataaatgtaaaccaagctaaatgggttggtccacttgcagttagatgattcttgcttatttacataaatatcgtcaaaaaatttagttgtacgcttattgtttgattatttagatattttgagataatgtaataagggacgtatctactatctacgcagaaaaaaacagcattgcagctgcccatatgcgtgaaatgaggctggccattgcaatgcattacttaggttgatagtaaatttagaatgagtgatgaaacatttcaacttattacactaaaaactggaaaaatgccaaaagctccatatgcgggaaatgaggccatcatcaccattggcttgtaccatgactccaaaacgcgaggacttaaagcttcgatatctatctaaactatttatgaatggttcacagaattcataacccgcatttggtctggaagattagtgattcataatcctgattattataaaagaaatttcaattaatatcttaagatagtttgatatccggcctatatatttttcaaaaatgttatattattcattgaatatttaagagtggatattttattttggggctctggaggattcgttccaattaactcgaagattttagtgtctagctagctagttaggcctattgaaagctacgtgtatagaaaactcacattcttagacttttcaaagcataggtttagagagatattcatgaacggtgatttaatgtataacattccaaaactatgatgatatgacgcgatgactttgtttcattcattgacttgaatccctccattccttctataaattagtgcaaaatgctacgattttagtatataaagttgcaagcttaacattaatcatgaagatg

SEQ ID NO: 10006 - DNA, 3000 bp, Unknown
  misc_feature (1)..( 3000): cDNA_ID_3033158_gDNA_ID_2213359_Annot_ID_180724 3000 nt of promoter + ATG
ctacaatgttgacaatgagctcaagcgtccgatcctcattaacgctgggcttagcttggttggattctttgtcacactcaagttgattcctgtagctgctagatacgttctgaggcgtaatatgtttggttttgatatcaacaaaagaggcactcctcaaggagaagttagagtgtatgtttttccttcttagatttgtctttgtttagttctcagattagtgttcagcgtttttctagaaatggatgtctcttagatttgattttttgtataggaggaaaactatgagatgtctcattttctgattgatgttctatggatgtttacgcttgatttgatctcaggggacttaaagtcttttgatgtgcttattttcagcaatcttatttctttgtaggcctgagtcattgggaattgttgtcggtattgtcttcttgatagtggcgattgtatttcagttctttaatttcactgaagattcggtggtaagtgtcctggtctcaaaagctcaagcttgatcatttatttattgtgaactatgaacttggtagctcttggctcatttactttgaatgcaatttatcaatctggctaaatgactcggtgcagtggcttgtggagtataatgcagcactggcgtctatttgcttcatgatattgcttggatttgtagatgacgtccttgatgtgccttggagagtgtaggtgcagttctcattttgttggattaaaaattcatgatttagttttgttttcttattaactcttgtcaatttgcaggaaacttctcttgccatcttttgcaacccttccactgttgatggcttatgctggacatacaactatcgtcataccgaaacctttagtttcttatattggcttggaagtgtttgatctaggtacaattcatcttgtatatagtgttaaaccatcaatagctattttgaaattcatttccttagttgtatatttatcgtggcaggacgtatatataagttatatatggcgctactggctgtcttttgcacaaattctattaacattcacgctggtttgaatggccttgaaatcggtcaaaccgtagttattgcagctgctgtaagttctgctgtcaaaatgcgtcgcaatgcttcatttttttggtcccatttttccttctgttggtttctcgtaagtaaagttatgataaatctcagtaacttgtagattctgatacacaacgttatgcaaatcggagcatctgttgatactgagtatcatcaagctcatgccttctcaatctatcttactcagccattgatggcaacatccttggcaatgcttgcctacaattggtaatctttggatctttcaagtcattttctcttaaatcaatcaggtaaactagcaaagcagaatgctttctctaaccacgttcatgtcccctctttggtgatgttaggtacccttctgcagtttttgttggagacacttacacagtctttgctggaatgactatggcagttgttggcattctcggtcacttcaggtatacttctaaccataccgtccttattgcaatgtacttagattcatcatttacatttaacttatgtgtgagccttcaattaactaactacttatgaaactttgctttttgcagtgaaaccctgttaatcttttttcttcctcaagtgttgaactttttactgtcacttccgcaggtttgatacctttctccatctcacactttctgttacttttcaatacatttgaaagcatctaacttgctattgtataactcttcagcttgctggcattgtcaaatgtccacgacatcgtctccccaagtaagctattttttgtccatttttcataagaggcaaagccaacaagtaaacaacacatgactcttcctctctcttttttaaaccaggtatgatcctgctacgggactgttaacaggaacaaaagatgggacactcgtgaacgtctacttgaggatttttggtaggaaaacagaaaagtctctatgtattcatcttcttgttttccaggtaaacttgttaatgcccatattatcatctctaaatacaagttggtttattctgagagagagaaatcacaagattggtgttttgtgtgttctattgcaggctcttgcttgcgcattttgtttcatgcttaggcattttctagctggttggtacaaataaatctctgcaacatgaagaaactctaaacctgttcctcttttcatctctctctctgccttcacaaatcatacaaacacagaacttgttttgcttcatgtccaacaatctactagaatcatcgttttagttcacttatatagagagttttcatctaaaggcgagtgtatctcaacaatataaagccaatgaaatgaatcagaacaaatttgtcttggaatttaaatttaactacaaatgctgatcttattttgataactttgattaataaactaaataatttttagattaaagttttgctaatatagcatgcattaaatgaagtgtccatttacatatatttttgaattttaaaaatgcgcttttaatattagacagactactgtcgtactagaataataaagaatgtaataaaaaaatagaaggagaatcggaaaagaaacccacttatagaatgccatgtgtcaaaacataacaagcgaagtatgtttatatagtaagaaaactcttttgccctaaatatcccaaattgtcatatgttctttccttatgtggctctctcttctctttctctttctctttcctttttctctttcgatcaacaaaaccacatctctgaactgaaccaatttctcttctcccccttccggttatcggattaccagatctcgtttcccgcgatctagtttattctttgaaaaaggtaaatgttcaatttttttattttattcaaaatctcccctggattcaggagatgatgatttgaaattgacgatgatgtttgtgtgtaaaagtgatagaagcagaa

SEQ ID NO: 10007 - DNA, 3000 bp, Unknown
  misc_feature (1)..( 3000): cDNA_ID_2714361_gDNA_ID_2213359_Annot_ID_131817 3000 nt of promoter + ATG
atcacgttaaattaatgaattattatgagttcacatattcttggattgatatgtatcatatatagtttttagtattttaattttatgtttctaaacacacaactggtctagtgaattttgttatattatatactaagagatgtagttttgaatatttccaagagtattacaatgtagtcaaaagtcgataactttaaattcaaatacttaaatgcccatagaaaactttggtaaacaataaattagatttttttttaatacgaatccaacgagcttttaatttattaaagtaattagctgaggaaatgcatttaagtctaagccaaactgataaaaataattagtcttcggataacgtaaagtaattagatttactagatatttgatagtaatgaaagtttctgcccaactctacaacatattatagagttttctgccaaaccttttactttttcataacaaaaggctaatcaaaatacctccataatgtaatcaacgtgacacgatgacatcccttctcagctatgtttgtacacaactttctcgaatctgataattaaaacaagagtttcatggttttcgttttattggtaataaccgtttcaaaatttatcaaaagtctagtttgaagtattcatggtgatattgtagagtatagcacatagtcaccaattcttatctttgtttgatggttagaatcatatatggttctggacaagaaggttatatatatacacacacaagcaaccatttgttgctttttggatacaaaacaaaaagcaattaaagtaccaattgattaagcctaaatcgcatcaattgatcttctcatgctaatatgagctccaaggagtggtccaatgtttccatccaagaccgatttcaggtccagaatctctaaaccggtttttctatcaaccaccatcttgtgacccttagagacataactcctggtttcttcccgcggttccaaaatgttcttgctgtcgattttatttacatccgaaaccttttgctcttttgctatcacaagtagcttcgccttcaaccggtttagagctttgatcctgtttgcaaaccggtttctttctcctgcatcaaaaacctcatgttatataatctgcataaaatgcagtaaaccaaagtgtaacaactaacaacacactcaagaatacctgaagattgtagtgttactccactcggaatatggtggatacaaaccatattctcagctattttgtgatcctcttttgcaggatacgatacaatcaaatcaccttcctttacttcaaaatcaggagatgctctcaagaatagtggtatgatatcaacagtcgctgaacattcctggcgcaaagaaaacctcttttaattctttcccgggccatgataatggacacgaaagtgattagttacgagaaagagagttataacttataatgtatacctcattagaagtggaacttatgataaggcggtgcacacctcgctcacctaagagataaccataagcaaactcgaattcaaactctatcgtggctgaacttacgccacttttattactcaataaactacatttctcagccacccgcgcgttttggcctagcctttctgcccatttgatatacatacttacaacttgctctgtccatatctgcaaatcctcaaaatatgtttaagaacaaacagaaactaagttacaagcaaagagttggaaactgtaagtgccttgagaatgatgaaactgacctgagattttgcgcctggagatccagatttgataatcatacaagcgccttcagcgtcatattgatccctaagaagcttagacatctcatagtgatgcaacgatctacttacatcgagtgatgaatcataggcttgctcaaagagactgtaatctatagcatccatctcacccaattgtatgatcagcttagcttcttcagcctaaataacaaaacacaattaaaaactaaatctctttcatacaaaaaaaaaacaagaagatttgttagagtaaacaaaaagaaccttgtatttgaggtctttgagggaatcgactgctttagctcgatcagctaatttgagaagaatctcatcagatttagcgggatcatcccataaatcaaagtaacgcattgtttcttcttgctttatccactgctcttcttcaagctcaagagcatccggtgcaaacatctcagccttaagaacaacatctttaatcttcttctttagtgaaaacaatcctgagacaaaattttcaaaatctcaacaaatatataccaactttccaaaatcataaagctctcaactttaatctgtatagaacaaatttcctaaaaccagttccaaatttactattttgcttctcctaaaaactcaacagagacatacccaattgcttgtagacggtgtccatgtcatccatggaactagaggctcgaacagagaaaatcagaaatcgagatgatgttctcttcctgtaaaagcgtcgccatgagcagcatccaccaataatctttgccgccattttatttcaccggagctccgactaaaatataaaatggggtttaagcttcgtttcttgtccgcgtaatgggtcaccacaaccttatcctttaagactctgttttaaaatttgagtctcgaatgtcttccacgtaattctccttcattctcataaagtttagtcacatagacacaaagcgaatcaacaaaaccgaatttgcaaaacttatacgaatcattagataaattatttgctggggtaatcagtgttttacgctatgtctcgttgtcgacgtttcatctgagtttggagggtatttacgtaattatatgtagggtttaaggtgaaaaattgaagtcaggctcgagccaatacgctgcgttttgattctctctgactaatcctgtcgacggagttgcttatcccggcaaattttcggcgcgatatcatcccaattcagaagtgacacgctctcaaacgaaatg

SEQ ID NO: 10008 - DNA, 3000 bp, Unknown; identical to SEQ ID NO: 10006
  misc_feature (1)..( 3000): cDNA_ID_2714342_gDNA_ID_2213359_Annot_ID_131822 3000 nt of promoter + ATG

SEQ ID NO: 10009 - DNA, 3000 bp, Unknown; identical to SEQ ID NO: 10004
  misc_feature (1)..( 3000): cDNA_ID_3033123_gDNA_ID_2213359_Annot_ID_131825 3000 nt of promoter + ATG

SEQ ID NO: 10010 - DNA, 3000 bp, Unknown
  misc_feature (1)..( 3000): cDNA_ID_2714324_gDNA_ID_2213359_Annot_ID_131827 3000 nt of promoter + ATG
cataatttaacccttgtggtctgaaatttgtactaattctttttgttcttactcattttctaacctgctatgctgtaagaaactatttaaacctaggtaagttgagataactaattttgtataaattttaagagtctgattacacacgacttcagttttaaagacaggaagtataattttacttgttattgataaaggcattacaattaccaacacgttaacagtaaagtcttgttttaatgaagtcattacttgtaaatgataagtcattacagtccctcaaactttatttattgtataatgaatgatagtaccaatatctatattagttttcaaatataaatataccattcccttgatagaatattggttcggctcaataaaagttaatatcatacttaggctgcttgttgggatagaacaatccccaaaacttctcaacataaggaggagtcggcttttgattctcgtcataaatggcaaataaatatgtctcgatttctttccctggtctcttcggtgtcccattcttcacatgcttaatcaaattattgttataaattctcgcattctctatgtttgtatcggttcctcctcccgttggccatccagtctccgccacaactatttccaatgatgcgccacccgatttctctagagccgagtacatcgcatcgagcatcgcatcaaataggttttggtaagatctaggagggtccgaaacgattcctgaaggagccgtgaagagagcgtaatcgagccggatttggcctacattgcccgcgtagctgaagtaagtgtagaggtttaagagtaaaggagagttcttgcttaccaagaaacgtatgattggttccattaccaccataacatctcccctaaacgaacctttcgatggtggataagactctcggagcactcccatgtctaccgatgtggatacctgttaaattccgtacaattataataaaacagagttgaaacttacaatttttgttatataaagataaaaagaataaaacgcaattaagttcttaaccaaatttacactaaaacattgaatatctcctatttttaataagataagttcgcaaatgttgaacttaaaatgaaattttgattaatgctaaaaagaatatttatcttatgaaaatacgtaatcgatatatatgagtaatgattataccttgatacgaccaccgagtccggctgctaaaaccgcccggtcaatgttttccatggcagggactaggaactgtgcgtaagagtcggagattttaacttcattcccaacagatatgtaacggaacctgacgccattcgcgtagttcatgacgtaggtttgtacccacgcgttagcttgtgattggctcgaggccacgctctgtaggtaagagttgggaagacccagcgttacctcgatgttggagccacgtagggcggctagaacgtcgtggtccggactgtatagcctaactcgttggatgtttttctgtttgaagagcgcaatggtttctgctggtgaagggaggttgttgccgtttcttccatagcaaacgccgacttgtccacctgttaaatatcaatccaatatttaatacattcatcacatgtggcataattcatgagagaattaatgtgttactaaatatttcatgagagaattaatgtgttccttcttttgtcatagaactaaaaaccttagactttactacatgttaatcctaatattttttatttctaatgaattatttacattcttagcaaaaataaaaaagagaattaatgtgttactaaaatttagtgactctattttttttcattgttgttaatcataaaacatatctaatcatttgaatatttgttttcaacttttattttcaagtatttgaaacatcagtataagtggtaaattataatttcaatatttaaataattttgttttaaagctaaaaataatagttaaaaaggtctcaaaagttcaagatattgacatggtttgattactctatgtcagggtgatattataatataatcacacatgttatattttctatatacataatgaaataaagaggtattaagtgacctgttggatttgtattgacgaagaatagaccgagaagaagggtcaaggacgccaagaatcggagatccatcgtcgttaggtgaagaaagagatgatttgtagaaaattaagagcgaggtggaaatcatttactgttatgacattgatcctagctagcataaacaatatatatagtaaattctagagaaagaacattaatatataaccaaatgtaaaatgtcaatatgaaactaaaattaatacacggaattaggcaacaagataaaataatgagttggtaatctctgaataattaatacaatggtgtaatatatggtaagctacataatcagagacagagagagacatttgtctttcttgactcttcataagtgcactcacaagtcaaacaacgcgtgtgatttatgagggcttagccgttaaaggtgtggttgaaatcaagtaaagaactttaattcagacaaaatcaaatgctggttgggctaaccaaaactactagtaatactaatggtctttaaacgaaatgagcccaataaagaacctgagacaaatctgagcccacttgaaagctaaaagccgcctaaaaaggaaacctaagcttaaaccagctaaaccgaaataattaaatggattcgttttttctcatctccgatccctaaagtcaaagattaaaccacactaaaccgaaattgtcatatgcgcgtaatttcttcgcaacattttgaccgaacaacttcaaaatcaaacgagcggacggtcaagattgtccgatcagtatcgtctttttagtcagtcagtcctgaacgccggctagatcaaccactccatctctcgtgctgaccacgctccgattctccatttctttcccttttgacttttcacttccaatttttcggtatcagatctggacg

SEQ ID NO: 10011 - DNA, 3000 bp, Unknown
  misc_feature (1)..( 3000): cDNA_ID_2714320_gDNA_ID_2213359_Annot_ID_131828 3000 nt of promoter + ATG
aagctcagtctgtttaataaggaaattgagcctttgttgctgcctttttgactctcgctgctcctgttcacgtttaaaagcctctgcagcttccttttcttgctttttcctctcttctgcctgtcaacattatcaaattattccaagtgcaccgttcaaaagagcatcagctgaagaatgatattaaaaaattccaagtctacaacataatttcatccatttctatagccaagtttatagagttgtgactattgttcaagtccttattctatgagaaaaggcaaataaacccgtgcaaaaagcatgtattattaaaaaaattggcaacagaatctgtaacccaatctagttggcaggctggtatactacaaagtcaaaaggagaatagaaattgtaccatctgcttgtcatatcgcttccagaatagcagcatgtctctggatatcttcctagtgcgaattggtgcagttcttgggattttgtatgatctacccaccttcattctcacctgtgaactcaaagtaatcaaatgagagatctaatcaaaaatgaaatctaagtccgcgattaacaacttagttttcgggattatgttgttaatcgccgacatgtaatttggttcttcttttataaaatttctaccagatgaccaaaaaaaatctaaaatgaaaggaaagagaatatccgtctaggaaaggaaatataataaagactaatatgagagtcaatttcaattacctctctttggcaaccatctgcaaacctcttggcatcaattgatagtttacgatgaaaagtagtgaaaattctatggtgttttgctatatctcttctgacaatattgatccaggcttttctaattttatccctttctgttttctcaatgactgcaggatcattctttgctttcagcttcttcggtagacttcgtttaacaatctgaagaaaggatacataaaacaatgtcggaacaaaaagataatgttgttaataaagccatgaatgagccatgaatgagccatgaaggattcaaaactatgattcataaaatactgccacagaatccaaacctcgtatgtatcccccttctccagaatcttcacgtaatggacctgtaaaacaccaccctcagacagaattgtccgtgcagtacttccagcagatccttctggaatggcagaattcattgcagcttctgacaccttgaggctaaaatttggggtggagtttgaaggtgacagggccttcattctagcttgaagagattcatattgaggtcgaggctcacccattccattacggcttcttactccagaccttttatcacttgccatcagttctgctaatgatctcagatccagagttcctttcaagtaaaattcttccacatgaatgtctgaaaagctcggtaagtttaatgatgccaccagcttgtcataacttggggggattttgtagatgacaccatcaccaatgtccaaatacgaaggttcatatgctatcctgcaaatgatgcaaaattcaacgtgtcaatctaggaaacccaacaccgtaagttatctaagcggattacacagggttacacggatcccatggaacatgaaaaaacatatgatcaacatacttgggtgtaatatcacgatcatggtagcttcctcgcctatgtggggtcacatcagctgcaaaatttggagagttgtccatgtcatagaacctcccatggtaatcattccctggtttcctacctctgtaactgcccacattgctctttagcaccggaaaacccatcagatgaggaggattcccttgagtctccttggacctatttttgaatttttgtacatgctccccaagcattgatcggtagtgctcctcagtaacatgttgattgtagagatcatcatcgtcctctgcatcctcagcttctgtccaccgctttctcttcttggagctcgcattcattctcgatttagacccattgctgtagtttgccactaccccacctttaaccattaccaaccatatagacagaacacagataaacgtcacttaaaactatcacagtaggtggcaaaagtaattccataaaaccaattaaaaactgtaccttgagtgcttctactttcatcctggctactactcccataataatcaacttcatcttcaggtttcggaattctaaacttcatcaacggctgcaagaatgaagaatttagccacaaaacccacactgaatttcaacagtaaaacaaaaacacactgtagaaacaaggagaagctatacaattgcaagatttccaatcaccaaaactacattcatcacagtcacatgatcatcatccaacaagtacaaaccatcaatttcaaggaaatcacaaaaaaattgagacctaacagacctcgagatcgaatagattcgcgtaaggagagtccttcggtggtcgtcttgaaggatccatgagagacgggaagagaataacacggcgtcaaaattttggagagtcttaatccttaaaagcttctagacagaaacattcgtcacgagaaagaaaaagagttcgtctcgaagaagaaccctaatccagtatgatagaggaagagggcgaaaggttaaagacgaacatgcgcaagttagtggacacaggcggtacagaaagaagtccagactactaacatacgccaaacgaataaagcttcttaccgtgcgcctctccacaaaaaacatttaattattattttttcttaacccctccggtaccggccgatcagataacgacggctaagttatcgttttggagataaaaataccttgtggggtaaacaacaatatataagaagtaaaggggcgaatttataaatattgaaagctcatattcgagaaaaccctaatttcaatatacaggattttttacctcgtcgtctctgaaacttcatctctgccgtcttaagaagattttgccagtgcgggaagcggcggagattgagagattagcgacgatg

SEQ ID NO: 10012 - DNA, 3000 bp, Unknown; identical to SEQ ID NO: 10003
  misc_feature (1)..( 3000): cDNA_ID_2714316_gDNA_ID_2213359_Annot_ID_131829 3000 nt of promoter + ATG

SEQ ID NO: 10013 - DNA, 3000 bp, Unknown; identical to SEQ ID NO: 10002
  misc_feature (1)..( 3000): cDNA_ID_2714310_gDNA_ID_2213359_Annot_ID_131832 3000 nt of promoter + ATG

SEQ ID NO: 10014 - DNA, 3000 bp, Unknown; identical to SEQ ID NO: 10001
  misc_feature (1)..( 3000): cDNA_ID_2714302_gDNA_ID_2213359_Annot_ID_131834 3000 nt of promoter + ATG

SEQ ID NO: 10015 - DNA, 3000 bp, Unknown
  misc_feature (1)..( 3000): cDNA_ID_2704602_gDNA_ID_2213619_Annot_ID_131929 3000 nt of promoter + ATG
catgagccttgatcgattcaagacacttgagatccgacagtctccagactttgagagtcttatcccacgatccagagtagattatcccagcgtgtaccgcaaggcacgaaatgctatcggcgtgttcaatccagagacgcttatggttcctcctcgtctgaacgtaattgctctgtttcataaacttccccagatagtctttagtcgtgggaagtgtatcaacaagcctgaaagcattctcagagtttctccgagaaactttccaaactctgattctactatcttgatgcgccgtgaacactttgcttcccacgctgaccaaagccttcacagacccatcaccttgtccgaatttcgcaaagatcttgagatcaggctgttgccaaacgatgatatcttttccctgagacgcactcagcaagaactcaccacagagcgctaaggaagaaacagagccgacatgagcagagagaacagcgagtggcttgtacgcgccggtgataggcggacggagagtgttgaggacgaagcttttggtggacgcagatgggctgagagaaccgtcggagtcgttgctgttgcttgtggttgaggaagaagatgaagacatcaagactccttcttggattgatctcaccatcgtatcaagagattcaagatttcgtttctattttggaacagagaaaccaacaaaattggagcgtttgaggaaatgttaaaaagagtatttatttttaaaaaggaggagaaggtgcaacggctacattgacaggtggcgtagcctcctttttttgccttttgcttatcatttgcgcattttcattaattcgtgatatatggctcatggaatcttataatatatgaaaccacttcaggagccttaaatttaatgtgtgcatatcatagtaacggattgatcattgttctcttgtttgaccagtgatgttaattggaccatatgtggatactgtaacgttaaggattatgaaaatcaagatatagatatatgtatttttcaagtatacgatataccaaattagttacgacaaaatgcgaatgagttggtagtaatgagtaaacctcaaaatactgttttttttttgtcaacaaacttatgttattatacttggatgacttaaataagctaaaccgaaaaacattgtttaacctcaaaatacttatttaattagttggtagcatcgttacatattataattacgactacgagttagattctcaaataatattcccaaatggatatatttacatcgattgatgcatgcttatttgtagtgatcgtcccttatgtatattatgtttttattttattttttgaacatagtataatattggtgggagaagacaaaaataagggagctctgccatctaatacgggaatcaagatatctgttttacatcaaacaaagactagtgtgatgaaatgaaagttaagttaacaacaataaaaaacaaaattagctgaaaatgtaatcaaatgagagatccgaatccgatctccgctaagtaaagcgtagtgggagcgtaaattcgcgtgagtctgattctgaatcgtatcatacataccaaatcaaacattaacgtttatgatcttacttacccatatcttatttcttaatttgtttggttgtttgtaaatgagaaatacactatgataagagaagaagatctaaatgaggcatagatctctagataccaaaacagataacgccaccaactaacatccaattaaggatatataacacggcatctccctctttagtaagcttacgaccaaagtagtgtgactagtgcggaacatttttgcagttaatactacttagcctcaattcttaattatgaccgtatgggacagggtaggtaggcacaaagcggatattgtttttaatatatttgcatcgaatttggtttgttggatcgataatcttttaatatgtatccgcttttgaactagtctattctccgattgtagaatgaaacatctatccgaaattctaatttgtagtattagtgatttgttttgtttttaacagtattttaatatttgtttaaatttgtaaacttatggttatccagactttttgaatcattcaaaagtggaaaacagatcgaatggaagtatagaacactacaatatattttcatatttttcttagccgtaagccactaatattggatggacataaacataagagaccccacaatatttatcagattaagcctttattcacattacaatgtttcgttctcaacttctcatcataacgtgaataaaagtaggagttagaattagaacacaacatctctaacaaatctcttatctgcattgctttggagagacatgtttgtacaagaagaaaaatgtttatggtcagtccgtttttttcatattgattaccttttaaatcccatttggtattaaaaaaaacccacttctaagatatgtttcgctttttatggtaacaagacatataacttttcaaagttactgaatggaattcttgacagaagttgttaggacactaaataatggaaaatcaaaatcaagggttacattagagacacgcgtacatcaattatttcttaaaatgcaacttggtgtacgacttttaattcttgagtcctcaaacccgagcattactccaccctttcttttcgcaataatcaagatcctaatttaattccctataagtattttttctaataactatgaaaataaagaaaaataagcgttgaagtcataagtttgaacaaagacgcgtgacctggaatcgtgctcaagaaaaaatatcacaactaatgaaaacgcaaggtcatgagtattgaccttgaccgggcaagagcctagagccaagaggtgatgtgtacttaaatgtgatagatgctcccttcttcttctctcatcactaacaaattaagagaagctgatcatcagattgaatcaaagacagactttgacttttctttgtgatcgaagatatg

SEQ ID NO: 10016 - DNA, 3000 bp, Unknown
  misc_feature (1)..( 3000): cDNA_ID_2704594_gDNA_ID_2213619_Annot_ID_131931 3000 nt of promoter + ATG
tgccgacagtaggttcagggaggaagatgtgtccaattacttcaggtaatttccaacaaaacacattgaacttttatttggtctgaatgtatgttcttgtatgtgacataagatgttgttatggtggttatagtacttttggaccagttcaagatgtgaggataccatatcagcaaaagagaatgtttggttttgtgacatttgtgtaccctgagactgttaagagcattctcgccaaagggaatcctcactttgtgtgtgattccagagttcttgtcaagccttacaaggagaaaggcaaagtccctgacaaatacaggtacttatattgctagtattagtaactcttatactttggcctgattgttccttgaatcccttgtgtttactgcggtttgttgtgcagaactaaccaaacaacagagcgagaactgtccccaacaggccttgattctagccctagggacgttctaggtaaacaaacactaaagcacttgtctcttttggttttactgaagaaccctttacttgcagccatactgatttgcttgttgtgcaggagggagagggttttataacaacactcaagatgtgttgtggaggagtaagtttgaagaagagattcttgaacttcagagcagaaggctgatgaatctgcagcttcttgacgtcaagaagcatttccaactcaattcccctaccaacattcactctccgaatcctttcagccaatcacttatatctccacgcccattgtccgtgatcaagagagagtatgatggaggagagaaagggaaaggaagttctaaagaaggatctgatgatgatacaatgaatctaccagagaggtaggtttatatacaagagttctctgcaaggaaactgttttgtgtattttaagctgaagctttttggggtgttttaggttggaggatagcttgccagatagtccgtttgcatcgcccgctcatcatttgcttctgtttgctgattctgctgacaataacggatcggatctgtggtcgccttcttctgataatgatgataattctactccttctacactctccgactccttcaactctttcaactaccaaatgccaaggtccctagattcaaccacactttatgttttactccttctacacactttaatttctggtatcaagttgatggtatctaacattgcgttcatgaatcttctcaataggttaccggcgattggaatgttacccggtaggggtggaccaacctgtcgtgttgggatataaacaggtaaaaagagttaatggatggtgaaacacaaaataacaatcttgttaggttaatagtttgtttgttgtggttgttgtttttgttacaggaagtgaagtaagaaaagaaaaaaactgataaaatagagagacccttaataaccaaaaagatgcagaggtgtaaaaaataaaaagcaggaaatttgatgtaagagataggagaagagaaagaaggaagattgttgtaccatttctctagttttaatgtgttatgtgatgatggaccacacaagatgatgtaatatgatatgatatgatatatataatataggacaagaagtgtaatctctctaaagatatacaaaagaaaagagagattatcatttgagtttgaaaagtcaatatgttcttgtccgtgctagttattaccctctcactctaactactctccaacttgggaatccagagatatcagcttttggtgattttttcttcaactataatttttgatttctaggttatgcatctttgtccttaataaatgcaactttggtgaggtggaaagtgtaaaaagagtaggtgatatatccatggttattaccgtgatttaaggcaaagaaaagaagaatgttatgaacgtatggtcgtattattgcatgtaaagactaaagttgtgatcgatatccaaattgtgtgtccttaatgacttagcaaaagcaaggacagtggtgtgtgtggtggtgagacacgcgcgagagagtgagtgccaaaaacttaacacacaacattacaaaaatagtttgtaacttgtggtctacttacaactatgtctcttctattatgtgaaagttggaaagaaggtgttttaattcatcatatcaccaccctatgatcaaacgaatgtgaaggccaagctcttttgaggctaatgatacaaatatatgatatgatatgtgtgtacacaacgattttcaagcttcttataaattgatcctttttggggactagggtgatagttttagtattggctattcgttgtaaagctagaagcttaagtatgcatgtcgcttccgagattccgcttaatgcttatttttctggtcacaaaacaactaaaattattgtacagtataaaacaagaagaataaaaacaacttcgaaataggaaaacaggaggaagaaaataatgggatcccacgagccaacacacaggccatgtggtgtggggatatatatttcagaagttgtgttttgtggagacatgtccacatatatacttccaatatcggttttacaaatatttatacatatgtataaattagatgatacgtgagacgtcaactagttttatggctaactaattaatcctaccatctactcaaaacaattttctaaaacatttgccagtttcattacatcttttgcattaaattctctaaaagtgagcaaaaatgtttttaccgttccttagagacaaaggcactctcataattcacatccgtacaaataggtagtggcaattaatattgaggacagtgatgaaataaatcgatggtagggatctttgaccattggtattggtttcaaagaaagaggcacaacacacacttggacttggtcgattcattaaaaatcgaaccccaacacaactgcaattaaatggaaacgaagagagagctcaatcatcgaagcgtgagagtcacgaccaacgagaagcgagtggatgtctggaagagtggaagcaatg

SEQ ID NO: 10017 - DNA, 3000 bp, Unknown
  misc_feature (1)..( 3000): cDNA_ID_2704544_gDNA_ID_2213619_Annot_ID_131932 3000 nt of promoter + ATG
acttcagagccaagaaatggtggaaactgaattgatcagactccgggctcttctggtagagatgcaggggaaaattgaagttgaactttgtagtttctcgtttcagaaacaatgcaacggttctggttttgtgttcaaagaaggtgatttctcctactatttggtttactagttgaaattggttgtcaacaatctgatacgttgatgaaaaatttagcattaagaggaagaactagtaaatagctaatgaaatttgagctactgaaattttattgaacaatacgaaacgctaaagaactagtttcatttatttggttatcgtcttagtaaaaatcacattttcgaataatgaaaacgtaaactaatagtaaaccattcatcaccatcatttttatacaaaagtgacctagacctaatcttgacacaattttggatctcgtgtaatcacacagatggatgcaacttagcaacaagtaatatgatgtgtgaagcggcaagagtggagtgcgaggagggccaaacacttcatgatcctattcaatcttttgttcctcaaccaccaccattctcacgttaagcgtttacgggctgtggtattgtgtgtatatatatacatatgggtttaattaggggcatagaggtcggattccaatatagttaacatatacacagattggtaacttattctacatatgtctattttaagggtaccaaaacatcttgatgtggaattgattttgaaatgaagaggaggatgattgtagatttgtagttgtatgtatatatgatgataattgtgggcttagaagatctttgggggtccatttatagattctctatatgtgggtatggtgaatacccaaaccaataatagataaggacttaaggtatgcatcatacatgcatgtgtatatcataaatttcaaatgcaaatgaattccattggtgtggaatagactgccccaatcattatttttttttttcaattcgcctcaaacatttgcgcataataatcattctcccccatgtaaaatttacatgcgaatcaaatatttctggatgagtcaatgataaggccgcaatgttagatttttggggtaaattatttagcaaagagtatatatactttataatattgaaaacacataatcatagagtgaagtgttaggtgcctcggctcttgtgactagactagaccactgcttttgacacccaaaaaataactattataatcattgctttcctttgtgggtcattcttcttttataaaaaggtcctttcgaaattttaaattttcaaaaaataataattcttttttaaccctacattaatttagaacaatcatgtcttttcatctttaatcctaccctctcatgaatattttattaaagcaaaaaaaaacatactcaatactttgaatatgtgaaactacgtgtgtaagattttttctagataattagttatgttgcttcaaataagaaacctatggaattggtcaacacatttgacaataaatcatatgcccatgagattaattaagacagattttaataatgaaatggtttttatttaatttcatgtgatcgaagcatgcaataatgattgaatgaaataaaattcaagtgtctctcaccaaacaaataaaaggacaataaaagcagagattaagctgagcaaattgacaatttggatatgacatgctttttatgtttccctaattactcaaatttatctttaaatgacaataaaattctgccgtttcattttaaaataagcaagttgaagaataagaaaaccaggtagtttatttaattttgtaatcaaaccaaaagcttagctatacttaaaaatgtgtccctaccaaaataaaatgatgaaaaatgagaaagagacagtaggagagagtggagaccccagcgatacagctggtctgcatatcaatcaccggcgcgtgaccaacacatcccaacggaaggcgcgtgtatctttcctgtccgaatgaacaaaaaaaaaaaaatggggttgtgtcagagaacgtgcaatgcaaccatcttttgtttttaatttgctttttaaaaacagtttattacacaatctctctgtgttttttctatctctctctttcttcttccactcgtgaaagaaagaccagagagttttctcctgatccacacaacaacaacaacacagagatcccaaatccggaagatatcttcttctctcataactcagtttactcagattcactgaaacatacaattaagtgtacgtacttcttctctttatctttctctcttaaatttgatgataagaagaatctaataatatgatgacatctttcttcatctactattcccaaaggagcagtaaccgtcagtctctcacctgcagcaaaattcactcttctgctaataatgttctccacagagattcatctattgatcattttgactttttcaggtaaagtaaatttttatttctcttttcggtctagtaaagttttactcaaacatagaaagttacgattttttttttgttttgttttccatggaaaaattctcggcatgcaaaaacttttttttttttcctaaaaaagtatttaccttttcctttttttctccaactctttttcttaaagtgttaattttttttcttcttgtaagcacgcgagcgagaagaaaacaaaaaaatgaatagagtagtaactttttatactatttctcttttaaaatttttggtatttactggtgtttcgcaggaaccagagatgaaaaattatagttaaggttagtagtagtagataggtttaataaatttgtagttaagtaacccaaaaaaataacattaaactaaaatccaacactagaaaccagagagaccctcttaacgacaacaacctctctgtacacaagacaacaaacactctctacaaaaacactactctttccttcttcttctctctactctattctaattctaaagagagagagaaaagctatg

SEQ ID NO: 10018 - DNA, 3000 bp, Unknown
  misc_feature (1)..( 3000): cDNA_ID_2704585_gDNA_ID_2213619_Annot_ID_131935 3000 nt of promoter + ATG
acttcttgattagatctttctccttaagtgaaagcacattttcgcgactaatagaattgaagtgacttgtgtcacttgacaaaccaactcctcggttgtggcttggaaaatgtgtttggctactacaatggatttgtgatgttagagacacgtgtgtgaaatttggaaacaaaataatcactttaaaattaaatgttgtaaaatttgaggaatcataacatgaatatcatattaattactctttagtttattgttccaaattggtcgattaatgctcttgttcgtggaatttacatttttctccaatgtagctgaaatatcgtaaactttacaaagtcgtacatatgattgtacttagtgtttaccttagtctcaccaatatccaagtcaatcaagaagtaagtctaattaagtagttctctttggtgattaattagagtcgtttttaagtttggaatcgatttagatttttttctaaattggtttctgaacatgcatcttgcttcactctttcggtatattgatcatttaaatcatgttttaggactccaataaactcctgattcctgaatgtactaattattgtctattataaggtttatgaaatcacttggacgttggtattgtagtttgatgattttttttttgaatgtaatgtcaaattatattcaaagagaaaaatatacgtttgtacaacatgtgattcgagtgtttgaatgaaagaatttaaaagaattgcttcgagtagtttgatgattttagactacgagttatctcagaatacgagttaggagttgaatttgaagaaacaagagagatgaaaggtttagaaaatgaatgacagcattttgtagatatacgtctgtcttcatacaactatttttaccttcttttttttttccttttttttcgtcaactgtttttaccttacagtggagttttaagacgatcagtttttttgttcttgttagaaaaaacagtttagttttttcaattaacactaagacaacatatttaaaaacactctactttgggtttcttccataagtagtagaaaaaaaaacaaaactatatataattggatcaatgatatggttcatacgcatgtcttgtgtatatgagtcaatatcgagaataggtgttttgcacgaagaaatggtgtcaatgatgaaaagttccaactctacaaagagatgctaaaaaacttgtgatatgagaaagttatgcactagtgcaaaaggctttacatggcatgtttttagaacaagcggtagttatgaatatgatgatccagtcaaataccatatgcaaccatgatgttacagtatatgctttattatgttaaatgaataaattgaccaacccataagagaaaaaacaatggcttcaaagcgaagcacttgattttaaacaaataaaaaatcattccacgggtcgaccacccaccgtctcgaccatcatacacgggtttccaatgcttaactcatcccaccgtcgtgacctaaccgacttagtcaaccccgtgagccacccaaccacttcctccatccccggccgtttctctctacacgttctcacacacttagccgccactaaccccaaatgattcctcacacttacatcaatcggtggtccgattctcggatcataaatcccaccgattttgcctctttttatcatcggaatcgcccaatctactataaacgacggcgaatatctaacgtcgattgcttttcttccgctgattatctctaacaacaagatcccgaagctaaacacatcagttttcgtgcttaatctatcagccgttacgtaatctggatctaagtaacccattgttcctgcaggtggtgttgatttcactttttgatcatcaacattgcatctgatcgctaatccgaaatcgcctagcttcgcgtttagattcttatccatcaatacgtttgctgattttatatctctgtgtatgatcggtgtctcttgagaatgtagaagatgtacggcttttgcaatctgaagagcgattttgattctcttactccagctcgaaatcgcaccggagtttaaaacggtatctgagtgaatcacgtcgtataagcttccgtttcccatgaattcaacaacgagaagtggttctttggagttatcggcgctaaaacctaagagattcacaaacctagggctacggattctggagagaatctcgaattcgttgtggaactcacggctgatttctcgagatttcgaaggtctcttgaccgcgatgtgacgtgaaccgatgacagctttgtaaacgcttccatggcttccacgtccgaggagattgttgatgtcgaaacctcctgtggctgattcgagatcgcgatggaggaaacgacgaagtctaggacggtcttcaatgggagattcgggaggagcagaagctttgctggaggtggatccggaggttgatgcggcagatgaaacggcgattgcgacggcggatccagctttgcaggagagataacccattgaatcgagggaagaagaagatgaaagtgaaagggaaaggtgtacgtggagtttaatggcgtgagtcgtgagaagtcatttttgtaaattaaggcacatttgattagactcaaggaagtggaggggtcgtgtttctaattaattatgccttttcctaaatatttcaaatccacccttatagtttttaaaaattctatttcgtactgataaataataatagtttcaatttacaccctaattttagttgacgtaaataagattaatcattcaattggtcccgcttctgccacctggcactttaatgttttagcgcgatagaaggtgacgatggatgagatgacgtgtaataatataattggctgaacacgttgttaaggagtagttactttcgtatataaattctgaaaacataaatggtaaagtcgcaaaacgggaaaaagcttaaacctttatttactgattaagtctaccgccgggaagacaaagatg

SEQ ID NO: 10019 - DNA, 3000 bp, Unknown
  misc_feature (1)..( 3000): cDNA_ID_2714528_gDNA_ID_2213619_Annot_ID_131938 3000 nt of promoter + ATG
aaaggacaaagatctaattcagcagctccccggacaaccttctgacgttactttcaaacagtacggtggttatgtggccgtaaacaaaccagccggtcggtttttgtactattatttcgttgaaaccatcaaacccggtaacactactcctcttgtgatctggttcaacggaggtatgtacatatagagaacatgtattccctctagaaactcctttacttggaactagttatatattttatttttttacaggaccgggctgctcatctctaggtggggcatttaaagagcttggtccattccgcgtacatagcgacggcaaaactcttttccgcaatccttattcatggaacaacggtacctagctataatttctaaaaatatattattagaaaccaacaaggtatattctcaagacatattgagatcaactaagtatgctattacatatggaattgcagaggcgaacgtgttgttcttagaaacgccggtagggacagggttctcatactcaaactctccaataaatgggaaacaaggagacaaggcaacagcagaggataactacatgttcttggtgaattggcttgaaaggtttccggaatataaaggaagagacatttacatcgccggtcagagttacgctggccactatgttccccaacttgcccaaatcatccttcaccgtaacaaccagaccttaatcaacctgcgtggcattttgattggtaatccatcacttaacagggagatccaggatgatttcggctacaaatttatgtttagtcatggtttgatatcccaacagcaaatggacaattataataaattctgcacggactccgacttatatgattgggacaagtgccatttggcgtcccaaaaaatagaagctcaaaaaacacacttggacatttacaacatatacgctccattgtgcctaaactccacattgagcagcgaacccaagaaatgcaccacaataatgaaggctgatccgtgcagtgggaactatttgaaggcgtatcttaacataaaagaggttcaagaagcgatacatgccaacaccacgaaaataccgtatgagtggacctcttgcaatacgaaactactttgggaatggaacgaaaaagataggtatgtctcattgacacctatccttcaggagctgatggggaagggtgtccgagtcatgctgtacaatggagacgtggacctggtgattccatttacatctacattggccgtggtgaagacgatgaatctgacggttgtaaaggaatggcgtccgtggtttaccggaggacatgtgggagggttcacagaggattacaaagggaacttaacctttgtaactgtgaaaggagcaggtcatagtgttcctacggaccaacctatacatgctcttaatatctttacaagctttatccgtaacactccactccctcaaacagcctgatttctaacttgtaccacccctataaacttaataggacactttggtccattgattgaatgatctaatgataagtatgatgtgtatgcgtctgtgatacaacactcaacaaattatacttaagttaattattgtcaaggaaataaaatttcgaaattatcaagcataaatttaatacagcagtagccactttacataaacaaagttcaatcccaaaaatgcattgtttctcttccaaacataacttgttcaaatctataacattcctgttgttttactgatcatcattccaagttagcagatgaatattcccatttccttgatattctcttaataggccaaaattgtgtcataatgtctctagttagattcggttgcttatctcttgtaatgcaacgcttctctcggaacggcattgtcgaattctccggtgaccaataatctgattgcaccagcagggaatctgttattttgatctgatccttcaattggctgtgagagtgagaacaatggacgatgattatactagagagatgatggatctcaagaccttagacactcgaaccctagagaagaaagatgttctcgctaagatccgggtaacttttttatagggttcctgcttccagatctttggttagtggatctaatgtctttgatatattctcgatgatgtatacatttggaatcatgtgaattctcgtacttagaaattgagtctggtgaaaaagttataatcttaattggattctttaacgttttgtgtgactactgtaaatttggtcactctttgtgtgttgatatgtattgaatctccatcaacattcgtgtcttactgtcttgtggtactacaaggtcttgctgtcacgtgagtaaccagagggtccagagaggaggacgggagagatgcccccataattattttctgaatcgcgacttcaacttaagtttttcgattagtcaagaaacgtaactacacatttgatagcattattacgtctccaatagtaaagtcctctattgctacttcacacgaaaaaaatgtttgtggatctcttgaagtaactagctaaatcgtgaggatattgagctggaaattgtctaagatttgagaattattagacggtttctaaacgctcaaaagggacttgaagaaattcgacttttttttattggaacctaggcaactatatcattatttacaaagaattagtttcatttgatttataagtttgttacagttaaacctcgaaaatataacgatagataatggctgctaaaaaaagataaaaaaaaatgtggattcaatgtttgataagaaaaaaatattgttatattttatctacggaggacaggtagttattatgttctggccttgtcggatttgttgttaagtttctacaaaaggttaaatgggttattaaaatagttgtcaaaagccaaaataaaacctataaaaatgctgccattcatattccaaaccattcgtctccatttcttttcaaatccttctcctaattctcataggattccaaaataagaga

SEQ ID NO: 10020 - DNA, 3000 bp, Unknown
  misc_feature (1)..( 3000): cDNA_ID_2714525_gDNA_ID_2213619_Annot_ID_131939 3000 nt of promoter + ATG
aatccattgtaggagcggaatacatgtttcaaaacgtttggaggggtcaaagcaaggagatggtaagtcaggtgatacgagcttcaatgtgcttcgtcgcgtgctttcgccaaaggagaaagatctaatcaagaagctccccggacaaccttccggcgttagttttagacagtatggcggttatgtgcccgtaaacgaaccatccagtcggtttttgtactattattttgtggaagccatcaaacccaatacatctactcctctggtcatctggttcaacggaggtacacatagagaatatagattctctacaaacttttttttttttattggactcttctacaacgtgaaaagatataagtcttctaccatctataaacaaacttttttataaaaatacaggaccggcctgctcatctctaggtggggcatttctagagcttggtcccttccgcgtacatagcggcggcagaaaacttttccgcaatccttattcatggaacaacggtactttttaaaaactttattaattagaaaatttagtgtgttttcacaagatatatatgatgcatgagatcaattaagtatacgattacgtatggaattgcagaggcgaacgtgttgttcttagaatcgcctgtaacgacaggtttctcgtactcgagtaatccaattgatttggaggaattgggggagaaaggggacaaggcaacagcagaggataactacattttcttgatgaattggctagaaaggtttcccgaatataaaggaagagacatttacatcgccggtcagagttacgctggccactatgttccccaacttgctcagatcatcattcaccgtaacaagaaaaccttagtcaacctacgaggaattttgatcggtaatccatcacttctcacatcgatccaggatccatacggctacgaatttatgttaagtcatggtttgatgtcccaacaacaaatggacaattataatcaattctgcctaagagatgacttatatgataatgacaagtgcgcactttcggtaaaaacaatcgatgatgcaaaaaagcacttggacacttacaacatatacgctcctgtgtgtctaaactccacgttgagcaggatatccaagaaatgcaccacagttttggaggttgatccgtgcagtaaggactacttgaaggcttatcttaacagaaaaaaggttcaaaaagcgatacatgccaacaccaccaaattaccgtatgagtggacctcttgcaataacgaactgactgagaattggagcgaaaatgatagagacaccccgatgatacctatcctccacgagctgatgggcgagggtgtccgagtcatgatctacaatggagacgtggacctggagattccatttgcatctacattagccgtggtgaaggagatgaatctaacggttgtaaaggaatttcgtccctggtttacgggaggacagctgggagggttcacagaggattacaaagggaacttaacctttgtaactgtgaaaggagcaggtcatagtgttcctacggaccaacctatacatgctcttaatatctttaccagctttatccgtaacactccactccctcacacagcctgatttctaacttgtaccacctcgattgactgaacaatatacgttggtctataaacttaataagacactttggtccagttattgaatgatctaaagatggttatgatatgttttgtatatgtatataaaccaatttacaatgttgtttacgtcgtacgtctaaataatcaatgattaagttctaaatggacatacatatgcgtgtgtgatacaacacaacaaattataatgaagtttgttaagcaaccaaaatgtcgaaattgtcgagcataagatcaatacaacagtagtcacatacacaattcttaagcccataatgcgttgtttctcttccaaaaacaatttagaatttcaatattcaatattcaatatcttttatacatttcgttgcttttattgtttcactgctgttttactgaatgtcatttgaagttatttacgtttttccacaactgcaaaattgtgaagtttttcatgtgagatttcagagataggaggactgatagggagtgagtgagaccacatgagactttacagatgattttttttcttttttcaatttcaaaataaggtaaggattttgggggttttgaagaaattttcgttgttttggtaaagcacatgtttgaattaggtaatattttttaaatggggtatatattaaatgacaatattttaaaaacaacatcttattcaggcaagataaaagttcatgtagttttcttccgaaaaaggttggtgtccttattagaaaatttcccataaaattaataataagttcatgatttattatttatataaaatttagctatgcaccaatatgtagctttgtaatctatatacatattcctgcctaccaaaaaaaaatctatatacatattccttttttatatatatttcttctcaaaataactggcattatcaccaatacagatttttccaaagttgtgtgagatctgtaaatttggtcactctttttgttgatatgtatattgaatttgatcattcgtgtcttgcagttaaacaaggtcatggcggaagtctaaaataaagagttttccgtctttgttttcttaaataaaagaaaaaattagttacaaaaatagagaattctgttttgccaaattttaggaaacaatttttctgaaaactttttgttttggtttaacttttaagggttacaaaaattgaaaaaagcaaagcttgtttggagtagttacagagggaaattaattgttaagttgttacaaaaggttatgtgtgattaaaatagttgtcaataaccaaaaatgtatccataaaatcagttcattcattgtctcaattctttcatacaaacttcattctgctttctttcataaagatccaatcaaacataattga

SEQ ID NO: 10021 - DNA, 3000 bp, Unknown
  misc_feature (1)..( 3000): cDNA_ID_2714521_gDNA_ID_2213619_Annot_ID_131940 3000 nt of promoter + ATG
tgtgtgagatctgtaaatttggtcactctttttgttgatatgtatattgaatttgatcattcgtgtcttgcagttaaacaaggtcatggcggaagtctaaaataaagagttttccgtctttgttttcttaaataaaagaaaaaattagttacaaaaatagagaattctgttttgccaaattttaggaaacaatttttctgaaaactttttgttttggtttaacttttaagggttacaaaaattgaaaaaagcaaagcttgtttggagtagttacagagggaaattaattgttaagttgttacaaaaggttatgtgtgattaaaatagttgtcaataaccaaaaatgtatccataaaatcagttcattcattgtctcaattctttcatacaaacttcattctgctttctttcataaagatccaatcaaacataattgaatgggagaactacaagactggtcggtaaccacttgtctcctccttttattgtttcaagcgtcacaaatccattgcacgagccaaacacatgttttaaaccgtcttttgtaccgctcgaagcgagggtttggttcgtcggttgacacgaaccatttaaatgccatccgtcacttaagcgtgtcttcaccccaaaacaccagcggtgttaaccaacaagagcaaaaggagagagatctaattgagaatctgcccggacagccttcagttagttttagacaatatggcggttatgtgaccgtgaatgagtcagcaggtcgatccttgtactattatttcgtggaagccaccaaaaccaaaaagtctttaccccttgttctatggctaaacggaggtatgtatctaccatctagttctacttttttttgttttttcctattcgttgagaaatcatacaagtaacaaaattgatgaattttgtccacaaaacataaacattcatacacaattatatatatatctatttttaaaatatgcaggacctggttgttcctccctatatggggcatttcaagagcttggtccattccgcatatatggcgacggcaaaacactctataccaatccttattcatggaacaacggtacaaaccttcttcttatggaatctttcgtctatcttcttttttttggatagtactatatttattattagaatctcccgcaaaatttaaaagtattatttacgtgtggattcgcagtggcgaacatattattcttagaatctccagtaggaacgggattctcgtacacgaacacagagtcggatttggagaatcccggggacatgaaagcagcagctgataaatacatcttcttggtgaaatggctggagaggtttccggaatataaaggaagagaattttacattgctggtgagagttacgccgggcactatgttccacaactcgcacaaaccatccttgttcataacaagaaccaaaacttcatcaacctacgtggcattttgattggtaacccgactctgaacgacatagtcgaaacaacgggttcgtttgattatttagtaagccatgctttactctcacaagatagtctccttagctacaaggaaaactgcgcaactgacactccaaaaatggaggtggattgcatcgcattgagtatgaaaatcgacgacgacataaaaaaaatgaacctatacaacatattgactcctacgtgcataaacgccacgttgaccccgttgactaaccaatccaaagaatgcaccactgtgctgcagtatgaaccgtgcggaatgcaatacatagcagcttacttaaaccgggaagacgttcagcgttccatgcacgtcacgaaattgccgcacacgtggatgctatgtaatgaagccacaggattcaattggaaccagacggattattctgcatcgatgctacctattctcaaagagctgatgaaacatgatcaacttcgagtctgggtgtacactggcgacacggatacggtgattccgttgacagttacaatgcacgctctgaagatgatgaatctaacggctgttacggactggcttccgtggtttagtgaaggacaggtgggaggtttcacagaggaatacaaaggcaattttagatacgccacagtgataggagctggtcatgaagttcctctttacaaacctaaggctgctcttactctttttaaacattttatccgcaactctcctctccctcttaccccttgatcatctatacactttgtaacaacaccacaacactcttttttcttttttctttttcacattcatgtaattattatataggtaaatgttaattgtgattttcttggataatctgcaaaactaacagaaaaaaacggatttaaaatttaagtaactaaccaaaaaaattgcgtattttgtatatcataaattttttggatcgttaagtagatctttctactttcacatgcatgaacataaggtgccaacaacaagctagatataacatttttttaccgattattccgacatggtgaaaatggtgtttccccttataaaatagccaaacttttttgtttatttggagtaagtttataaccacaaagatgaattttatttatttattttcatgtttgatttgcgacgaatgttaaaacatataatttaacactaaaaatttgtactgaactgcaatacattacatatataaacaatattttctaaaaattggctcatttattgtaattctattcagttctagaaaagaactcgtagactcaacgactagtaattttaataaaattacgttaatttcgtattttttcttttttcttttgtcatcagatattatttagggccaatcttttaggaatcgcgtcatatttcgttaatttcgttcaatagcgcaaaaaaaggtttcgatatctaaattattgatacagttcaaatcataataaattcggaattcagggtttaataaatttcggtttacatagatgaataatcggttcagttgagagtcgtgttttgtttaaaaaa

SEQ ID NO: 10022 - DNA, 3000 bp, Unknown
  misc_feature (1)..( 3000): cDNA_ID_1007273_gDNA_ID_2213619_Annot_ID_131941 3000 nt of promoter + ATG
catgcctgtaaaaatttaaacatgaacaaagataggtttgatactgatgcataaaaataatccttcacactctgcgcaaagacaagggagaatcatgtcgaggtttagagtgccaaaaagcctaaaatttacagtttgagcagccaagtgaacccatcacgtagaaagaagagagtattggatatgcatatctatgtcagtatgtacagaacggaaacaacaaaagacatcaagcatactggacctacgttcatcattggatatgacctaagtttattttacaaatagccaaagaccgccatggaagcgcatatgaccgaccctctgttatctacaccaaagtttatgactgcccaaaagcggcaagcaaaacacccaaaggaagacaaagttggcatttcacttcaaatatcatccttggcaagtaagccataatttccggaataatttctcctaggcacacagcagaaaatcagttcaaactgcaagtttatatatttagaagcaatatactgaaggcttgtatagcaattggagatcatcggcgatgatattacatacatcaccatcgagtcagcatactaactaaactctcatgcaaaaatgaccacttcttatactgtcaattaaattactttagtttgactaaggacatggagcttaccttttgcagaacgataacctgtagatgaattagaagtagtgccataaggaactcctgaaaaaggctctattttgttaaaaaagagtaactagagacgtataggtccagaaagcatttaatcttcttgcctcacatatgacataaccatgattactacatgatatttgtcagattaccactattatgcattactagaagcttttctagataacttagtggaatattccataaatagtacagtaatgattatcaagattaagtaatcaattttggtcaatatatcaccatctagatctccacctgcttactcttaggcctatcgaataaatgttctcagtagtggccagaagttgaaatctgaaacttttatccattcactatgatacaaatgaagttgaaaacatcaacactcaacataatctaagttttcgggcaacaacattcaacaagctgaagacaattatttatctattcatctgaaagaggatgatgaaaatcaaaattatagatgactagaggagcaattagcatcaattgataaggggaaatcatacacatacttgagtaattaaaatcaggaagtatagaggccataactatagagtttgaaataagggcttatatcaatgaattagtttaaatcatctgagaggcacactcaaagtggttaactatagacactaaaagtccccaaaaacctgaattcttcctacatcaccacatgaagtagatagacgtccatgaatttaaccaattatagaagactattacattaggactcaccatcatggtcgaacaccacctgcatggacacagttaattaagtcagtaggggctatccaacattaagaaaactacaagaacttcattcgatcatcacagatataaagaaatgcgatgttaaatggataatggaatttaccgccacatgggatgggagaaatttcaaaacatcaatcagctgaaaatgagaacacaatgaaacaaggtaagaagtcgaatgcgaaagttataacaagaaagataaactttagccttaaggaaacataattatacgcaaccatgattacttggtcagccatcgttaatgctacaagaagcttttctcaaccatcagatttaagtacagtaaaaatgaacatctggagaacaatactcaagatatcacttacaagagaaagagatgaaaatattgttaaaacccagtccgcatttccatcagcatgagccagatgaccatgattcaaccttgctgcacatgcccaatcaaatgtcaataagtgtgagatcgggaggaaaaaaaattaacatttgatgtacacatgagtagcagaattacctaaaagcttataataagccctgtatataatcgatgtcccatcaataagcatcactctgccatttgaagaagcagcagtactagctactctttcttctgacttgaaaggatattttatcgactgtggcgtaacatcttcacttatagaagtcaatgtgctgccactagctgcttcatttgagaattcagaaacagctacggaactgcaatagtactgtgtaccacaaatgtttatatcaacattagaacgaaataataagtatccttcagagatcaattttgagtttatagtaaacagaaatgtcgcgaaagaaacattcaattgattcagaaaatctgtatatcaaactaatcagagccatgattcagatgtagactacataacaagagtaaaaaccacatctaaatagctcagaattgaacgatacaagtacaagtatcaccttcgcagagcgtgcaagggaaggagagatgagagaacagttccgattacacaagtttccaacactccgaggaaaacagagattcctccatagaaaacgggagtgatgatacagatgcagcgtcatgacgtcactgaaagtactgtcatgaagaagaagagcgtttaaccttagcggaggaaacacattcaccatgaatcaaaaccaaaaatcgaagaagcgagcgagaatccgaaagcaatcgaagaaaggattttgaaagaaccttccaaaaatgagaaagggtttttacaaggacgacgaagaaggaggattttaccgctttctgcgtatccgtgtcttcctcggaacaaaatcttctgcctcccaaaaatttagcagagttgaatttagaaaactccaaattgggcccaataattaatcagcccatataaataaaggccttaagagcccattatataggcttttgattgttgttcttcttcttcttctattacaacaaaaacccttcgacagaagagaaaaccctagctagaaacgacgatccaaagatg

SEQ ID NO: 10023 - DNA, 3000 bp, Unknown
  misc_feature (1)..( 3000): cDNA_ID_2714517_gDNA_ID_2213619_Annot_ID_131942 3000 nt of promoter + ATG
gccggaagatgcaccatctcggttccgactctcccagtagctccacgtcacttgatcgtccagctgagatagatgtggaggattttgcgatgaagcatcacaagatggcattgttaaggggtcgaatcgaaattgagcgatgggaagctcattctcaccggtgaggcaatttttccattgggattgtttttcaatgttccagagattttgtttactcttgccatgtttctaatgttctctatgtcagggtttctcagtgtcgaatgaagaaaggtttgcttcttactggtgtcggtgataaggttaggattttttttagtatacaattcgattaggtattgtatgtgttatctaagtagcactggctaagttaatctgactactttgatcaggttatgcgcctctggtcattaaaaagctacaaatgcatggaagaatactcccttcctgatgcttcttccttgattgacttcgattttgatgagagtaaggtaaaccttctctaaaggtcatggatattacttaaactgggaatgagctaaaaatggatttaatgatcaatgatgatacagaaacctcagtcaagtcactgacatgaatttctgaaaccaccagtatagcagtataatctgtttccatgtcacagtttgcctcacctgttgtagctgaatatttccttttggctaaatcttgctattttctatagaaattggaagttgtatctctagcatgggagtattttgattctgttgttgttgttgttgttgagattgttggcttggttggtacccgcattagcatatggaggagaaatggacaaagaagcatttttccatctcgtgcaggcacctttcctaaaggcctttgtatgcggtatgtcagaagatactctcctgatatcaagttcctgagaacctatctgtttctatagaaagatcaactgatattccatgttactgacaaaagtcggtgtgatacttcaacatggctacctagcccctctgcccctgtaaggttgttggcttctctatccacactgataagttgtatgttttctttttcaaccagttacattgacccagaagctgtagttggatgcgaggatggaacagctcgtgtatttgatatgtacagtaagacatgttcacagatcattaggtaagctatgtattatgtgtctgttgtgttatggaacaacacagtgaaactggaaaagaacggtttttcattatcaaaattgtttacaatttcttttgagaaagctaaatcacaattttcctatcagattggttaataactatgtatgtaattgcaggactcagggtgggccaataacatgcttatctctaagcgataatcaactatttcttagtgggtcgtcactcgggagagtaacagtatctgaccctttgatggatcaaccagtggccactcttaaatccacgataactgcaggaggtaaactcaaactcaatgtcagattgcatctccagtgacatttcttaaagcaacctccattctctacaggtatacagacaatctgttttaaccaaggcactaatctcgccttcattggaacaactggtggatatgtttcatgctgggacctcaggtatgttaaaatagtcgtctaaggtttttttcaaagatgcaagttttaattcactatcttaagacgttataaccaactattatctaacaggaaaatggatagattgtgggaaaaacgagtgagtcctaatgtcgtgtactcaatacaacagctaaggaatgacacatcggttatggtagctggtggaatagacggtgtgctgcgtatgattgatcagaagagtggaagggttttatctagagttataatggacgataaattctccacaacatcaacaaggaacaaccaagtggtgatagagaaaagaagaggaaaaagagtttctcaagacatggagattgataaaatcgaaaggaaagttcggcctcaaatcagttgcatagcaatggggatgaagaagatggtaacggctcacaatggtaaatgcataagtgtatggaagttcaatctctcgtaaagtaacaataaacttgtttgtaagtgacgaaattggtaacaatagcattataaatgattgatttaaagacaaaaccgattggattgtgtaagagctacaaaagttgaaacactggaaacaaaaaaagaagggtttgttgtctatttggcggatttcttggatggctcaggttgagattcagctttgatgatattgagttgaccaccttctttacaagctgcattagttgctttcacttcattgcaatggtttatgaatttcgtaagctcctgctccacacaacaccaaccaataactcacaattaaagatccaatcgattcagaatttagggagattgaagaatatagaaattacccgatcagtgtccatctctttcgtcatctttgttggtttcacatttctcttccctggaacaagaagatgataaaatctgagaaatcaaaatcgaaagggatttgtgtgaagtaaaaaaaaagtgaatacctttgcgagtttgaatggatttgccatggcgattaggagcaatagtcttcctcttctgttggcccttgaactgattgctcttctgcgtcatctttggatcgtcgtttctagctagggttttctcttctgtcgaagggtttttgttgtaatagaagaagaagaagaacaacaatcaaaagcctatataatgggctcttaaggcctttatttatatgggctgattaattattgggcccaatttggagttttctaaattcaactctgctaaatttttgggaggcagaagattttgttccgaggaagacacggatacgcagaaagcggtaaaatcctccttcttcgtcgtccttgtaaaaaccctttctcatttttggaaggttctttcaaaatcctttcttcgattgctttcggattctcgctcgcttcttcgatttttggttttgattc

SEQ ID NO: 10024 - DNA, 3000 bp, Unknown
  misc_feature (1)..( 3000): cDNA_ID_2704578_gDNA_ID_2213619_Annot_ID_131945 3000 nt of promoter + ATG
gattgaaatgaatgagttagaaaaaattctgatgtgacaataaaaaggaaaaaggggaataatgacgtcagcaaaatggggacacgtgaaattatttttaaaattatttgggacaatcgacacagttgctctatcgctatttgtttacgtggggctgttctctctctatttatataataatgagatacggttttttcagcaaccagattttaaagttatctgattaaatctaataataggatagagatagagtcacagagacatgttgttgactttatgacattattttattctttgcttatccactcagtcatcatttatctcaccagtcagacataatgtgttgttgttgtgaatttgtagatgcttccgactatacctgattacctggccattcagaatcggtttggatcaaaaaatttgggttttcggtttagaaatcgaaacaaaccgaattagttgaaacgaaccgaatagaaattcggccaatttggttttgcattggcgtgtaccttgtgactacatgtgtgtgtgttagatgagatctatccacccatttttcaaatcatttttgtcgttaagctatcaagattctgatattttcctgctcacttttgattcccaaaacaaaaaactttcttcaattattctattcatcttctcatggcggctctctccaccaccttctactaccacccactctgcactaaccaccgtacaaagagacaagcctcaagcagacacggagttagatctatgagagtgatgtcttgtcggaagcagaaattaccagaagagaatgaaggagtgatccagagaacattgagaaggatgatttcagaggctgggaagattgggaagaatctgaagccagagaagaagaaaggagacgtcaaggacctgatgcttatgagtctctcttttgctgtttatgtttatatctctcaactattggtttgtgcttacttctcctggcaacatctcagcttccccaaatcttcatggtagtagctaagctagctcctccttgtaaattctgcacaaatcagtaataagataagaaattcaattccgacataggagaattgagagttgtgatctttcactttggtcttatataattgaattgttaagcttctcatacctctttatctgctttaactccggcagaaaaggcaaaccaaccattgcgataacactatcaaccagttaaggctctttgttttagagccgaaaggagatgcaagagcctcgggcagagtcgctgagtatgccttgaaaaccaaaactttgaccgtaattgttagaaagaaagagagattcctaaccatttcgtattggcctcctccaatttatcctccttaaacagagagccccatccattttccttctgtgtgctgcaccaaacctttcctccatagtcatatcactgcgagcttttccctgtacaatccaacctctaagtcagctataagcaaagagcttgggataaaagcttggttgtggagtgttcaggtaaggaaacaagaatcagcaaatgatcttaaagaaaaaacgttcctcctttgtttcatcaaatccaacaacttcagcgtcatctaacaattccgctatagatggaacattgggaaaaagaagagtttccatctctcctatatgctaaattcccagcaaacatgcaagagcgcacgttcaccagacttgatgctggaaacaccaatagctaaaccggccattacttgtatctctgttcatagaggacatttcactccttagtttttaatcttgtttaaagctctgtatactaacataaacatgcatgaatcagctttaaagcaacaaaagaaagaaaggaaaactcaatttctttcctcccaaatattctttttcattaggttcacatgaaacgcaagatttaagacctcagctttactatcaactttaggtaggtaagactacctaccattttgagaaggctcacaatgcaaaaatggaactcaccatccttgactgattcggtttcagctccagcaaaccaaagtgtttctaataaacttggccgtgcattgaaccacggagttccaaaatcaatgtctgtttaaatcattggccccagaatttgaactacacacagagtcacagacattcattacgatggttgaatgaaatggtcttgactaagaagtaagaacaactatgcacaattgagaaactattagctcgatttccagaaactatcactatcgtaatataaaagtcccaggatcgaccaaatcggacgagaaagactcaatgaagaaaccccataaaaacatggtcgaagtcagtataaacaaaatcaagagtttggtcgtcgttgtggatttggaggagaggagagtgagcttacagagtatgagaagcgagaagctcaggggaagtgtgactcgtcgtcgtcgtcttcgaagtcactcacgaccatcgagagatctgatgattttggtaaaatatcaaaaaaggacttcaacttttcacttaagtcaaaacaagcccctataaataaattctgttatttaagccttgaggcttgagctgcgtctttgttgttcactaggagagttatttgagcggataatttactaaaactgaatgtccatctcccaaacaaacattttacgttttcatgttatataaaagaatactatatcgttagctagaatattgtagttaaatattaaagtagtgtattttacattttgtctgaactttgtcatctttgtttcatgaatggtcaatggtgaataatggggagagaaggaacgtgaataaagggatccacaagtgtctccaccattttctgagtaaaaacaatcacatcctttcattttcaaacccctaaaccaaattgtaaagtcagaaaaaaagaaaaaaagaaacacacatacaaatcgaaaagcttttcttcatctcccacgttacaataagccctaagaacgaataaggcaactacagagagaaaag

SEQ ID NO: 10025 - DNA, 3000 bp, Unknown
  misc_feature (1)..( 3000): cDNA_ID_2704574_gDNA_ID_2213619_Annot_ID_131951 3000 nt of promoter + ATG
aagtatgtatttccttgtttcggagctgtttaacgtttctggattctctcttttatacacatactatgttggtacttgggttttattggcggtgttttttgaccttatgtatcttgtgtccatttttccaaccagatttctttttgacgagaactgtgcggactacaagtactatgtattcaggctggctgaagaggaaaaattaatttcacaaaccaaggattctggtgtacttcacagtggtaagtattagacaccatataattattttcagaatatgcttagccaagcatgtgcaaggaatatttggctcatttctttttactctccgaaaaatttctatcctacaatacgaatttatatgtgttctgtagtgtgagtgataatgtgaggctgctcttcctgctaccatattcttagcttcgatttccttcatttgtctttccaggtgatgcaggctcgcgaacgtccacagcagcaatccctttgcaaaagccagcttatcaacaaacaggatatcagatccctgcctcagctctctatgatactcctgtggaacctggagcttcttctagatctgctcaggcatcaattacaagacccagcgacagtatgttcattagccttatatcgatctaggttccttcctattactgatatctagttttgattgtgggttatatatgtctgatctgcaggtgactcctttagtgggccgaggggtgcagaccctctatcaatgatggagttttacatgaagaaggctgcccaagaagagaaaatgagacgtcctaggcagtcaaaagacgaaatgcctccaccagcttcccttcaaggcccatctggtgagaatgaatcctagtgctatttatggttttaggcagctgtaaggtcttatcgctcaaccatgtttgatttcagaaacttcctccacagaccctggaaagagaggtcatcacatgggtgattatatcccacttgaggagctagataagttcctttcaaagtgcaatgacgcagctgcacaaaaagccacaaaggaggctgctgagaaagcgaagatccaagcagataatgttggacataaactcttgtcaaaaatgggttggaaagaaggtgcttacttgcatcactctatctgtaaattggtgcccttgtttctttctgtatcttgtgcctttatggagacaaagagcttagaaaattggaggagtggattacaggtgaaggtataggaagctccagaaagggtatggcagaccctataatggcaggcgatgtaaagacaaacaacttgggagttggtgcttccgctccaggagaagtcaagcctgaggatgatatatacgagcagtacaagaagcggatgatgctgggttacaaacacagacccaatccactggtattttatccatctttagctccattctttttgtgatagcacttcttttactcaccatctgtctcaattgtactacagggaaatcccaggaaggcgtattactaaggatcaaatcaatgtgttatgcgcaattattatctttggttcacctcagcaccgtctgagctttgcttttctattataaagaatgttcaagcttttagattactgatatattgaagtgttggtatgcattgaatttgcgtttcagtgtgcaaatagatctctttgacagacatatcagttgaaatacaatggatttgttattgctaatgactgagattttgattcgattgtcataactttattaatgttttggaagtctgggacataatacactaagcagcaaggttattaaagagaaaggtaaatgaaaaaagaaaagaaaagaaagatgatatgtccttcctagttgatgatatcgcagggagggaaattagcagagcatctctgagggagctgaagagccatggagcggtcaatgccagagagtggaggtccattggcaaggaggcaaagacaaggacgaccaagtgtgacaacggcagagcaacatatctcggtcggtgggatcgggctaaaaggagcaactgctgctctacatggtatgagctgtaccagcgcggagaaaaatgtcctgctgcatcctcccacttcctcctcgggcaacattggtggtggaggtggttgttgcaggccctcttgctgcgctgcaacaatggtaagaacggttatggtcatgagcagcgtcattgccaacccaactctcatagctttcatcatcatgtaaacagcgatggtaatgagatgacgcaacaacgagatgctgctggtttatataccataccatataatgaaaggggtaacaatgtcatgccgtttcacacctctctcctacctcacaaccaaatagcctcacgattactccgtgtgtgtgtctccactgtccagagctttaatcttcgatcaaactcacaaaaattataacatatcaccggttcctcctagctacaaatattaaacccataataataatattgtggtcagtgattattctcacctactgtgggtatctaaaaacttgcttaaaattctgatgatttgcaataaatttcgcatctttcccgctttaaaaaagcccaaacaaagcccattagaaacccaaaaaggagggattggtttgttattctctgtatctctctcctagtattcagctctaacacatagagaggagtcagaatatcatcagccgcctctttcacttcaaccctccttaaacctcatctctttcctactccgccgctctctccgtcgtctctcccgttactccatttctctcgacccctccaggtaattccttttcagatcctctactagaccctttacttattttagtgaattggtctttctccatttccatctatcccttacgtatctgtgactttttccccccttttggattgtattcctcatcttcctctgtttccgtcaaatgaatgatctttctgaaattcaatcacttttgtatcgtttctgaatctttcctctaataggtgaaa

SEQ ID NO: 10026 - DNA, 3000 bp, Unknown
  misc_feature (1)..( 3000): cDNA_ID_2704570_gDNA_ID_2213619_Annot_ID_131952 3000 nt of promoter + ATG
cagtttgagttgcccgagctatcaagaactaccgctaaaaaagtatctgttcttcgtaatctttgccaaaaggtaaataattatagacacattttcattcagaatttatttaccagggaatcctgattatgtcagttcataattgttattaatcacttcatttccctgttaacaggttggtgtcagtattgctgctcgcaaatacgacttcagtgcaaacacgccttttgagacgtcagatattttggatcttcggcccgtaattaagcactccgtccctgtatgctctgaggctaaagatcttgttgagatggggaaggtccaactggctgaggtaccttttgttatttcacactagctaacttttgcttgctaatttttgccaatatgtttgtactggataagatcaggagaaccttattgtgatatggattggcattcaactcttcaataagcatctcgttttagtttgcgaaagttgcattatgaatggttcttggtttagttttttatgtatgaaaatgattaaacttttgtagggcatgcttagtgaatcctacacgttcttttcagaggcattttcgatacttcaacaggtaagtaatctgtatacgcatctcgtcctgtcaaaataatttaacaccgaagtagctcatcatattctgattttaggtgactggtccaatgcacagggaagttgcaaactgctgcaggtatgcgtccgactgattttttgtttttctggaaaaatatccatgggctttcgttttagttgccttaagttttttgtcgtcttttgcttttcaggtacctggctatggttttgtaccatgcaggagatatggctggggccataatgcagcaacacaaggaactcattattaatgagcgatgccttggtttggaccatcctgatactgcccataggtatcaactatctttcttttatattaatgtactgtgatattgtactctcagctattgacttgcttcaaatgttttgatactgcagctatggcaatatggctcttttctaccatggactgaatcagacagaacttgctctacaaaacatgggtcgagccttgcttctacttggcctttcatctggccctgaccatccagatgttgcagctacatttataaatgttgccatgatgtatcaagacatgggcaaaatggacacagctctacgttatcttcaagaggctttgaagaaaaatgagagacttcttggtcctgaacacattcagactgcagtatgctaccacgctcttgccattgcgttcaactgtatgggtgcattcaagctctcacaccaggtactaaaactttcgtaaagtcttctagatcccacctttcgactctgttcttgtcaacatgagaactatatgtctcacctttcgacttaattgttctgttcttgtcagcatgagaagaaaacatacgacatacttgttaaacaattgggagacgatgattctaggacacgagactctctaaattggatgaagacgtttaagatgcgtgagcttcaggtttggtgcactgataatgactgaggagaacctcatttatctagtatacattttgtttggatttctcaaattttctggttgggttttgaatcagatgactgcacaaaagcagaaaggacaggcagctaatgcagccaacacgcaaaaggctatcgatctcctaaaggtatacttgcagctttagatttcggcatattttgctgaaaaggaataactcctctatctttgatgttgtagagttgaaataataatgaaatcgttttcctgattggtatacaataggcacatccagacctgatacatgcgttccaaaacgcagctgctactgggaggacaaatgcactgaactctgctgtccttggggagactcaaccacggggcagaggttttgatgaaagagcagctcgtgctgcagctgaagttaggaagaaagcagctgcaaaggggctactggttcgcccccagggtggtgttccagttcaagccatgccaccgctctctcagctccaaaacatgatcaataccgccacagtttcgtctgagaaaggtggagaaaacggggaggcaaaggtacaagagaagaaagaatcctctgaaaatgggaaaacagaaaacctggctcctgcaggattaggtgctggtttaacatctttggataagaagaagcaaaaagccaaaaaataagaaacagtaggatcttgaaggaaaatggtgctcaaagaaagtgcacgattctaagtagtgaagttggtttttgtctctggaagtcgataaaccacttgctgatttcattacatgacaacaacgcttttgtacgttaagctttgtttttcttcccattatgtcacaacgatttgggtaagtcccgcttccaggcatgtctggcttttttcttttttcttttcccctcacttttctgcgggtgtaattttataccacaaaaacgtcattgattttctagtaactccaataagctcacagttcacgcttatacctaaccttgcagccttactatttttttgtgctctatacaaaaatcttttacttggcttcttgtgtctctagagtctagactttagagggacactagattgaactcgactaacaacgaagaatcatggagtggatacatcaatttcgatcaaccattaatgatcatcacatacttcatttatgttcatcttccatcaatgatgaagatgaacagtggcctgtagtgatgttgtcactggccaaaacagtggtcaggcgtaacccgaacaagtacctaagtgtatatcaacccatttaagtttaagtctgcggcgtgagagacgggtaaatgggtaatgtttctaggcccaaattataggccttaataaggcccaattatccacacaggttagaagtgaggacggctaatggataatgttgacgacactcgcaacttcttccttatcgacacctacactctcctgctaca

SEQ ID NO: 10027 - DNA, 3000 bp, Unknown; identical to SEQ ID NO: 9730
  misc_feature (1)..( 3000): cDNA_ID_1379940_gDNA_ID_2213619_Annot_ID_131953 3000 nt of promoter + ATG

SEQ ID NO: 10028 - DNA, 3000 bp, Unknown; identical to SEQ ID NO: 9740
  misc_feature (1)..( 3000): cDNA_ID_2704562_gDNA_ID_2213619_Annot_ID_131955 3000 nt of promoter + ATG

SEQ ID NO: 10029 - DNA, 3000 bp, Unknown
  misc_feature (1)..( 3000): cDNA_ID_2714503_gDNA_ID_2213619_Annot_ID_131957 3000 nt of promoter + ATG
acgtaatctgaatattaagaaaaaggataaatatgaaaagatatgatgtaaatatgtaatcgatgcatactcttaattatgcaatgtaattctttttttgtgacattaatacattatatatcctttatcttataaaacacaagtcacttggcaaatcatgttttgacatgtggcaaatttatcaaaaacaaaatccacaatgtaaaacaaaaatgaatttttcgacaaaactcaaaataaaattaaatgtgaaaacagtgtacaaaattaaaacattatcgtcaattttcccacgatcactctcaaaagaaaataaaaatcaacccacatattctccatactcccacaatttctttttcttctattcaaactatgtaactcttttttttcaattaaaacattcaaactaactattgggaaacaaagacagatacgatctcaaacctatatatacaaatctcggtatcatctttctattgttgatattggtttttaaaagaaggttgagagtaaaatcatttaggagcgagaccttctttgtaacaagagtcttcaatctctaatcagttcatataaggcaatatggccagcgtatgttatatttcttttattttattgattgcgtttagatgagtatattaatgctttctgtttttgaattatcttttattatgtatgtttaatatctttttgcttcatagatcaaccactaaaaataaacaagcaaacttgatcgatagaggataaaacacaaacaaagtagaagacttgagcaagaaaaacaccaatggcaaagtagtaggaggttgaagacgaagtagaagtgtacaacattaagacataaatgatatcatctatgtattgagtcaacttcactctggtaacttttttttgtctatgactataatctatgtttgtattgagtctttgaataccatatgtaattttttattttatagcttttgtatgtattctagaaagcattgaagttggaagctaattctctatatttggaagactaataattttgtgatatcaacttcaattctccattatatatcaaattatcatctgaaaaaataaaatccacaaatacatgaaacgatatatttttccctacacgattatatactaatctatttataaaattaatttttcatgtataaatatcgataatatgtaacatatcataacatttaaattcaaaaaaagaatgtatcataacattaattttcggtgctatgcaccgggtataatactagttacaaataaagtataaaaggaattaaacttttatatagataattaacacaaacaaaatattagagacgatttcaaataaattatgaggatatagatgagaaaaatactatatagaataacaatagtaagaaattaaaaataaataaatcaatttgtacatataaattagaaagaaaaatatagataaataattaaacaatattaatagtatcacataggtcaattaaaattttatatacaatagttaaagagtattatatctcaaaactaagttttgatactgcgtagaacaaatcatgtttcaagcaaaaatgatcaaattcctatgatgctggaaatgcttgacgatccacatgagactggctatgtgcatgtatggagaaaaacgtgttgttcgacaacgcgtgcatgccttcttccacctaagtgacgacgcatcacaaaaagttatctagtagtgttaatagttcatgttccatctgccgaaattacacacaatataacgtattcgattatttgttatccaacaacttaaacgattcgaccaactcactcaaccttttgtcactagttccagtcatatatttcttataaatactcgttcactacatctgtacagatcgaaagaatctcttgatatattacaacacacccataattcataaagactagctcatatacctttgatatatgagatttgatctatatgtcgttctccttaactagatatcgctaattgggcttgcattcaacaagcaacatatatcgcttattacattcgacgatactcagcttctacatcttaagtctctctttttttctgagctcaccatcaagtataagaacacaattctacctcttatttgtctactcccaattttttgtttttggtttttcactattctgacatcttatcgtattatgattaacgttaagaatgtcgtctcgaaaatcacctacctagctattgtttcaagattcgactcccatgcgcgtcccatcaagaacaaaccatccagaagcatcaacctccaactattagagaataatgtcccattcgcccctcgctggtcaaatcgcttccatttgattcacataagtccaacaacaacgatgatctctggtgtactactaccaaaactcaaccttgagacagattctcaaaatactatatgttctattaactattttaacttgaatcaagttgataattgtagagagaaattttttgttcacttcttattaatttgtaaaacatttattttaaaacccattaccgttaagctttgatacaatgatacatgttattttctgattaaaaatggttataaacttgaacggtataagactttagtgtatagagaacaatttagagaatctgtatttatgtaaccgcgacctttcggaaacgtagaaggtggtcgcacaaacaaaccaatcaaacccttaatcgatggcactcttttaatgtctaataaacttcggttcgtcactcgaccggacaattaaatatgtgattaaaagtgtgaatttccggttcggtagagattactggtatttgttaatccgggccggaccgggccgtatctgaattatgaacactttcctaatgtcatagaatcgttcgtgccgtcgtcgctgcgatctgaccaaaatcaaaagtgttacgattcggtatcatcgtctctctcatttgtgattttgtcaaaccctgctctcttttctccaagtgctctc

SEQ ID NO: 10030 - DNA, 3000 bp, Unknown; identical to SEQ ID NO: 10026
  misc_feature (1)..( 3000): cDNA_ID_2992057_gDNA_ID_2213619_Annot_ID_180904 3000 nt of promoter + ATG

SEQ ID NO: 10031 - DNA, 3000 bp, Unknown; identical to SEQ ID NO: 10025
  misc_feature (1)..( 3000): cDNA_ID_3033900_gDNA_ID_2213619_Annot_ID_180903 3000 nt of promoter + ATG

SEQ ID NO: 10032 - DNA, 3000 bp, Unknown
  misc_feature (1)..( 3000): cDNA_ID_3410146_gDNA_ID_2213619_Annot_ID_180898 3000 nt of promoter + ATG
ccatcaagctttctctttatgttttgttatttaagctatcatcaaagtaagatctttactctctttctttttcgtttgatgcaaatgcagactaacagggtgaaaagtacgaccggtgcattgatcatatttatcattgtcttcacggtggtctactccccattcgtggtcatggacatcatcaaacgcgctagaaagcgggtgcctgtgcacatcatggcgcttcaatggctcgatccaacaactgaacttcggatcttgattggtctccacggtccccacaacattggttctacgctcaacgttatggagatctgccatggtggccgtgagccgggttccatattctatgcgactgacatggtggagttgactgatgagattgcagccacgctgaagaagggcggaggagccggtcagagtaatgattcagtgacggtaacggataggtcggtgacggaaatgagagagagtataacggcagctgtgaatgggtacggagagctccgcaatggacaaggtgtgacagtgcggcggatgctggcgttgtccacgtttgtgaccatggcccatgacgtctgcggtttggctgatgaacttatggtttccattataattctaccgttccataaacggctgaatcctgatggtactctcgatgctggtcatgctgggttccgtcatgtgaaccgcaaggtaattgttccatctcagtaatactctgtttctttcagttctcagagagataatttggcatttgtgtgtgcagattctgaagaacgcaccatgttcagtaggaattcttgtggataggtcgttcgggcaaacagaagaggcatggagaccaggagcgtccatgggcattgctataatattcataggtggcagagacgaccgagaggcactagccttcgctgcacaagtggctcgacatcctgctgtgaaattaaaggttatacgtttcttggaagacaagagctctcaaaacgcacaaaaacgaagcagcatcctgaacagagcgagtgtggtagatcaagaggaggaaatgaagcttgatgatgaatgttttgctgagttctacgaaagatacatagctggaggtggaagagtgtcttacatggagaagcatctcaccaactcctctgagactttcacagctcttaaatcactagatggagagtatgggctggtgattgtaggaagaggagggggaagagcgagcagtgggttaaccaccggcctcaacgactggcagcaatgtccagagcttggtcccataggtgacgttctttcaggatcagatttctcacacaacacatcaatgttaattattcagcagcagcgtactcggggtcagctagaagggcttcatgatgacttcactatactgtgaatatctgtacaaatgcactttacttagtagcttgggaagagtagtagcttcaccatcacaactcttaaagagactttgtacaatagttcaaacattaagcggtttatgtagatagaatggtaaaaagaagaggtaatctaagcattacttcatagcatcctgaaatggtgttgaaacatagagttaaaagaagttacaggccgatttgtttttgatttatacaaagcataactagggaaaatttcccaagctcattattagtcttgattggtgcttagcaaaagacaatgtaaaacgttttccccgatgtgctgatggagaactccaagttccttaaaactgattcgaaaacttggccacctctgcctgaaaacacagaagggtataccataagaccaggtacatcaaacaacatcaatagcatttgatattcgtctagcttattaaccacataatcagataagtatatccgaagagagaaacttatgtacctcaaactggttcttcaagtagtcgagctccttgtccaagtcattgatggcctggttgtatgcttgcattggggaagactggcttgttgtgtgaatctacatacagaaaccactttcacaattaaacaacaacatacaagatctttctataagtccttaagcaaccagtaatcccagaggaaactgttaacactagaagcttaaaccaagaaatattcacggtttccaaacaaccatacactacttttaagttcctaaaccaatcttttggatcctaaggtcaatcaatgaactgaaaaaaacgcagaggatagcattgttctttccaattcaaagcaacaggctctacagtagaagcaactgaaaaacttggaacttaccctcactatgattttgtacttaagaggatgaggaagttggtatccagcaaacaagacattctcgtcgcgatgaagttgcctaaaacaaaaatttcagaacagagctgacaaaaattagggctttcttctttctgagaaaagagttgcaaaatcaacaaaaagacgtacatgcggacaatgtttccaatcgtatggtcttctctctcaaccgtgaaggaagcagcattgatgatcttcgtatccctatcataagaaaccctagaacatagaaatcgagagggtttagcacatgtaagaggactatcgagtatgatttcgagtgatagaaacttcaattacttcttggtgccttcagggacgacgaatcgctcatatcgttcgggagcattcatggcttaatcggagatttcaagcttcgctctctttttcgccgcagagagacagtcaagagttcttcagtttctttctggcaaacaaaatataatacgacgtcgtttttcataaaagaaaaaagatcgaatctccacgtgttatattattattggtgtatacagtttgggtcggatcgggccgataaaacataatatttccgtttaaggacctctaggtttatattatttacacaataaaggacgagtgatttaattcagaaacctaacaaaaaattcaggaaaaaaagaaaagaagtcagatccctaaaaatcgaacccgaaagcgtaaaacttgaaaaccgact

SEQ ID NO: 10033 - DNA, 3000 bp, Unknown; identical to SEQ ID NO: 10023
  misc_feature (1)..( 3000): cDNA_ID_3033924_gDNA_ID_2213619_Annot_ID_180892 3000 nt of promoter + ATG

SEQ ID NO: 10034 - DNA, 3000 bp, Unknown; identical to SEQ ID NO: 10021
  misc_feature (1)..( 3000): cDNA_ID_3033930_gDNA_ID_2213619_Annot_ID_180890 3000 nt of promoter + ATG

SEQ ID NO: 10035 - DNA, 3000 bp, Unknown; identical to SEQ ID NO: 10018
  misc_feature (1)..( 3000): cDNA_ID_2704585_gDNA_ID_2213619_Annot_ID_180886 3000 nt of promoter + ATG

SEQ ID NO: 10036 - DNA, 3000 bp, Unknown; identical to SEQ ID NO: 10017
  misc_feature (1)..( 3000): cDNA_ID_3033943_gDNA_ID_2213619_Annot_ID_180883 3000 nt of promoter + ATG

SEQ ID NO: 10037 - DNA, 3000 bp, Unknown
  misc_feature (1)..( 3000): cDNA_ID_3033947_gDNA_ID_2213619_Annot_ID_180882 3000 nt of promoter + ATG
agaagcttggaagatggagacctgaaaggattgatctttctgctatggcttgtccagcttcaagacagatctatctgacattccctgccgacagtaggttcagggaggaagatgtgtccaattacttcaggtaatttccaacaaaacacattgaacttttatttggtctgaatgtatgttcttgtatgtgacataagatgttgttatggtggttatagtacttttggaccagttcaagatgtgaggataccatatcagcaaaagagaatgtttggttttgtgacatttgtgtaccctgagactgttaagagcattctcgccaaagggaatcctcactttgtgtgtgattccagagttcttgtcaagccttacaaggagaaaggcaaagtccctgacaaatacaggtacttatattgctagtattagtaactcttatactttggcctgattgttccttgaatcccttgtgtttactgcggtttgttgtgcagaactaaccaaacaacagagcgagaactgtccccaacaggccttgattctagccctagggacgttctaggtaaacaaacactaaagcacttgtctcttttggttttactgaagaaccctttacttgcagccatactgatttgcttgttgtgcaggagggagagggttttataacaacactcaagatgtgttgtggaggagtaagtttgaagaagagattcttgaacttcagagcagaaggctgatgaatctgcagcttcttgacgtcaagaagcatttccaactcaattcccctaccaacattcactctccgaatcctttcagccaatcacttatatctccacgcccattgtccgtgatcaagagagagtatgatggaggagagaaagggaaaggaagttctaaagaaggatctgatgatgatacaatgaatctaccagagaggtaggtttatatacaagagttctctgcaaggaaactgttttgtgtattttaagctgaagctttttggggtgttttaggttggaggatagcttgccagatagtccgtttgcatcgcccgctcatcatttgcttctgtttgctgattctgctgacaataacggatcggatctgtggtcgccttcttctgataatgatgataattctactccttctacactctccgactccttcaactctttcaactaccaaatgccaaggtccctagattcaaccacactttatgttttactccttctacacactttaatttctggtatcaagttgatggtatctaacattgcgttcatgaatcttctcaataggttaccggcgattggaatgttacccggtaggggtggaccaacctgtcgtgttgggatataaacaggtaaaaagagttaatggatggtgaaacacaaaataacaatcttgttaggttaatagtttgtttgttgtggttgttgtttttgttacaggaagtgaagtaagaaaagaaaaaaactgataaaatagagagacccttaataaccaaaaagatgcagaggtgtaaaaaataaaaagcaggaaatttgatgtaagagataggagaagagaaagaaggaagattgttgtaccatttctctagttttaatgtgttatgtgatgatggaccacacaagatgatgtaatatgatatgatatgatatatataatataggacaagaagtgtaatctctctaaagatatacaaaagaaaagagagattatcatttgagtttgaaaagtcaatatgttcttgtccgtgctagttattaccctctcactctaactactctccaacttgggaatccagagatatcagcttttggtgattttttcttcaactataatttttgatttctaggttatgcatctttgtccttaataaatgcaactttggtgaggtggaaagtgtaaaaagagtaggtgatatatccatggttattaccgtgatttaaggcaaagaaaagaagaatgttatgaacgtatggtcgtattattgcatgtaaagactaaagttgtgatcgatatccaaattgtgtgtccttaatgacttagcaaaagcaaggacagtggtgtgtgtggtggtgagacacgcgcgagagagtgagtgccaaaaacttaacacacaacattacaaaaatagtttgtaacttgtggtctacttacaactatgtctcttctattatgtgaaagttggaaagaaggtgttttaattcatcatatcaccaccctatgatcaaacgaatgtgaaggccaagctcttttgaggctaatgatacaaatatatgatatgatatgtgtgtacacaacgattttcaagcttcttataaattgatcctttttggggactagggtgatagttttagtattggctattcgttgtaaagctagaagcttaagtatgcatgtcgcttccgagattccgcttaatgcttatttttctggtcacaaaacaactaaaattattgtacagtataaaacaagaagaataaaaacaacttcgaaataggaaaacaggaggaagaaaataatgggatcccacgagccaacacacaggccatgtggtgtggggatatatatttcagaagttgtgttttgtggagacatgtccacatatatacttccaatatcggttttacaaatatttatacatatgtataaattagatgatacgtgagacgtcaactagttttatggctaactaattaatcctaccatctactcaaaacaattttctaaaacatttgccagtttcattacatcttttgcattaaattctctaaaagtgagcaaaaatgtttttaccgttccttagagacaaaggcactctcataattcacatccgtacaaataggtagtggcaattaatattgaggacagtgatgaaataaatcgatggtagggatctttgaccattggtattggtttcaaagaaagaggcacaacacacacttggacttggtcgattcattaaaaatcgaaccccaacacaactgcaattaaatg

SEQ ID NO: 10038 - DNA, 3000 bp, Unknown; identical to SEQ ID NO: 9734
  misc_feature (1)..( 3000): cDNA_ID_2026998_gDNA_ID_2213619_Annot_ID_180910 3000 nt of promoter + ATG

SEQ ID NO: 10039 - DNA, 3000 bp, Unknown
  misc_feature (1)..( 3000): cDNA_ID_3033892_gDNA_ID_2213619_Annot_ID_180909 3000 nt of promoter + ATG
agaagcaaccatcaaaggagaccccgtctaaatcctcctccacatcgaagccttctgtgacacagtcagataataattatgaagattttccaaatagtcaaattcgcaaggtaaattaacatatttattactctctatgtagaatgatgaaatatgtcctgctgcattctgttttactttccccacttggcagattatagcaaaacgtttattggaatcaaaacagaagataccccatttgtatttacaatcaggttggtgactcacaacctttgtattttctttgtgtattttatttgctgtttaagcattttattttgcctgcagatgttgtattggatcctcttcttgcatttagaaaagaacttcaaggtttgtagactgctcttatcacacatcctggtatttattaacaacttgagaggctcagagtgaactgtactttcatgatctacagaaaaccatggcgttaaagtgtctgtcaatgacatagttattaaagcagtggcagtcgcactgaggaatgtacgacaagctaatggtgagaaattattttctcctcgtaaatgatttcattaaaaataactaaactatggtttgttcccatccctaactatgcgctagattaaaaccttagttcatcctctttaaggaaactcggcttccatgttggattattcttgcaatgccgtttacctccgttgagagtatttagtaaagatgttttgagattgtaatactgtaacattcaatatgactggtaatgcattttagactcggttttagtcgttacaagtaggacattttttggtgtgagtttgatgtaatgatttgtggattggaatcgtgtggttgttttttctcttctgctttctcaaacctttcttatggttgcttaaagttctctttctcaatgtctggcagctttctgggatgctgagaaaggagatatcgttatgtgtgacagtgttgacatatcaattgcagttgcaactgagaaggtacacttgtgtgtttgattttctgatcatttcaacagtttatccctcatcatcttggcattttttgcagggcttaatgactccaattatcaagaatgcagaccagaaatctatttctgctatttccttagaggtaattttattctctctgaagttaaacgaatatggaaggctatagaggcacatatgtttgatcagttcttaccatattccatgtgttgttgatcgctatagttatgaattttaatatgtcaaatgatttttggatcaggttaaggagctggcacaaaaggctcgatctggaaagcttgctcctcatgagtttcaaggagggacattcaggtattcatcatttttaagttattaagcatagtacggaattatcaatcatgtgtaacttttcctacttaacgagaaaaccatactttatcgttttgcagcatatcaaatctaggaatgtatcctgtggataatttctgcgcaatcattaacccccctcaggtaatcatagccttaacgatgcaccctgaatcacagattgaagattaagttttgctgtttgtaatttgtggtgtagaggatttagtttaatatttatagagatgcagatgtgtttttttggataataaacttcaggactatcaattgtcttgcaggctgggattctagcagttggtagaggaaacaaagtggttgagccagttattggactagatggtgagctagtagaatccttttgggttttcaactagggttgctattctgatcatggtatgacaagttttcgtcattgtttcaggaattgagaagccttctgttgtgacaaaaatgaatgtaacgttatccgctgatcatcggatctttgatggacaagttggaggtaatggaacattcataaatcccttcgtttcgagttttatgttatgctgctgccatatttcactgtgtttctcctttgttactcattgctttttctatgaaaccggctttgtttcagcttcgtttatgtctgaattgcgttcaaactttgaggatgttcgaagacttcttctgtgagaaagatccaactgtttaccaaatgaatcttggattactacataataaacctcggaccaacccacgtgcacatccagaaccagaactgctggtctacattgttaactctgatcacatgtttcatttttttccatttggttcatatacttaccaaaatttgttttggtctttaacaattcgtcttatagattggtaacttcctgaggtattttttgtctggtctgtcctctgcaaaataaataatttcagctgtcaatccgcaactggtgaaataatttaaaaagtattttaccctcatcaaaatttttaaaatgagattattgccatctctgttctaccagatcttattgttgagctccaagaaacgatttatagacttatagtggttagtgttgaattcatccgttaagtctttaaccaagagattacaaaatttctatccaaaatttagggtttaagtaccattacaaaagaaggaaatatcagagatttgaaggtgatgtaggttaatcatctgaagtagtctaatgtcttgcaaattgtgttgtaatttgttctatatataaagtttttgcattttcggagaaataaagaaaaaaatgatcacaatacatccgaattgatagcatcgcattcgcataataaaaacttgtagaatgaaaaaatgaaaaatcacataatgaaacaagaaactatacgcttacttattagcataatatgcttttatttatatttttagacgtaagatctacattttcatgaatcttatgcatattttctcgattggttcttgcataatcgtattaaaaacccgttattcaaccattatccgtgttacgaataaagtatgaaatataaatgaaatatggaggcaacagaagaagaaaagtttaaatgtgtgtcaaaattgtaattttcagaacttcagccggagaagaaagac

SEQ ID NO: 10040 - DNA, 3000 bp, Unknown; identical to SEQ ID NO: 9740
  misc_feature (1)..( 3000): cDNA_ID_3033896_gDNA_ID_2213619_Annot_ID_180906 3000 nt of promoter + ATG

SEQ ID NO: 10041 - DNA, 3000 bp, Unknown; identical to SEQ ID NO: 9730
  misc_feature (1)..( 3000): cDNA_ID_1379940_gDNA_ID_2213619_Annot_ID_180905 3000 nt of promoter + ATG

SEQ ID NO: 10042 - DNA, 3000 bp, Unknown; identical to SEQ ID NO: 10015
  misc_feature (1)..( 3000): cDNA_ID_2704602_gDNA_ID_2213619_Annot_ID_180880 3000 nt of promoter + ATG

SEQ ID NO: 10043 - DNA, 3000 bp, Unknown; identical to SEQ ID NO: 10039
  misc_feature (1)..( 3000): cDNA_ID_2704559_gDNA_ID_2213619_Annot_ID_131958 3000 nt of promoter + ATG

SEQ ID NO: 10044 - DNA, 3000 bp, Unknown
  misc_feature (1)..( 3000): cDNA_ID_2026998_gDNA_ID_2213619_Annot_ID_131959 3000 nt of promoter + ATG
aagtacatataatacccctgtgacacctactcgaagcttgtatcctgattcagttctaagcagtagagaattgtattcgactccttattacacacgcccgtttgggctgtctcctactagtggttcagatgatggcttatttaggcgagaatgattctgttgatccttgtgaagccgtgatatgattgttggatctttgtagagtgtggtggttgttatatacactgtagactaatatcagctttgtgtaacgtcaaaatactgtatagaagaggcaaaagttatgtatgtgattcataacttggtcattataggaccgtttgttgaaatcccatttgttgataatgtttgtgtgttcatttgttcggtttatgatatttaacatgacaaatctcttgaaacttaactagcaatgatctaactacaagtcacgaactaaagagacactgcacagcaacaacaagagatttgtccagtaagaaaaaaaaaacttcttgccagcatgagaagagatttcgagtccccttagataaggagatgagactcaagattcaagtacatacaatggaaaataagaaatcttcattttgaagtttatggtgtttttgctatacagaaccaaagtgggtaacattttcatcgtgttcaagtaatatgactagtcttcatgcccatcagatgattgatcatcctcatcatcatctttctgatcatcatcacccgtcgcctcctttttgtcacttctctcgttcctttcattccatcttgcccaggcccacttcaggacaagaaaccctccaagtgcatatacctgaaatagttatagagaatactccactaaattaaccatgaaagaatccaactttttccaggatttgaaacaatcatcagaacaaaactctttcgtatacgtcaggagtccattgatgagaaaataaagcacaccacaaccaaaacatctcgattctcgagtcatgctattcatatatcaagtcagcctttgatagctctgactactacaaaacttgcaattgaaaggagcaaaaatagtatgcttcctactccatgaacgacagaacatcaagctaattgttagaggtcatctaaagcattaccaggaatcgaaggcataacaaaaactgaaaccattttcaacattcattgtagcacactgcaactgactgcaaccaatgaaatacattgaaaacatcgaaaactatttgcctattgatagagaaaaaaagccagaatagtttctagtaaacaggaagtgataatctgagtcatagagtcataattatgaacatctaccataaacaaccatgtccctacaattctcataaataacataacaaagcacctctcaccaaaccccaaattataagccaattcaaatcatttttcatcaaagaaccctctaaaatataaacatcttaacaaaatcacctgccaaaggatgacagagttggaagtcctgccagagctgggctcagcctcaaacttgattggctctgcgcttttgggtggattgtaagggaaagtgacagtctcgtaggtcgatttcagaggttccttctcgccggtaggtttaggagcattggcatcaatagtagcaggaggaggcttaggttgaagaaaggcgaataggttggtgatgaaaggaggtaactttatgggaggagatgatgaatcagagccattagaacgatctacttgagcttcttcagccatttttcctccaccgagacggattttgagtttagggttttgaattgaatcggtgtggattaggtaggctttacaattgtctggtggtcacttctctccacttctctccttctttgcttacgacacgtgtcacacgtgtcttttcaagtttttgtttctattaacctctaatgggcctaaagccttatttggcccataataataatcaccgtcttcagtttgttttttgtatttttgtttttatttaaactccattggaaccaaaaatctgagaaattcgtatccaatcaaagttctggcttttagcctcctgaggaaaaatcaaggttgcaactttcagggtttcgatgtatcatccaacgaggggaggtgttcgcggtggtcgagatcgtaagtttcattataattcgttttggattttgcttctaattacaagatcctacataaaattctcaactgttagggttcctatgtattatccaacgttttcgttcttctctgctattttgatgattttttttgttggatctagtgtttgattgaattgtctataagcaatttgtgggagaagctgaaattcagaagaagctttgtcattctaattaacagatcgtttttggcaattagttttcaaatcaaagatgtagaacatgagctgctaatgatgagaactctattactaattgaatttgtttataaatgtgcagaattcagttgggatgaagtcaaggctgataaatatagggagaactatttgggtcacagtatcaaagcccctgttggaagatggcaaaaaggtactttttcttatgtacactctcggtggttgttaatttgtaagctaactagttttcatcttgacgatataatcctcctttgtgcttcattgctctgttcaatctcattggagtatgggcagtcaatggttgttttactttagttactcctttcataaatccactgccttagatttttgtagattaatcttcagtttagtgagttttgactgacattcatttgccatgtacaccaactgaataggtaaagatcttcattggtatgctagagataaaaagcaaaagggttccgagatggatgctatgaaagaagagattcaaagagttaaggaacaagaggagcaggccatgagggaggctcttggcttggcaccaaagtcctctacaaggccacaaggaaatcgccttgataagcaagagtttactgaacttgtgaagaggggttcgacagcagaggacttaggtgcagggaatg

SEQ ID NO: 10045 - DNA, 3000 bp, Unknown
  misc_feature (1)..( 3000): cDNA_ID_2714555_gDNA_ID_2213621_Annot_ID_131970 3000 nt of promoter + ATG
ctccaatatataatttattcatgaaatttttattggaatatatttcaaatgattagatctacaagaaacttggaaattttctcagcctgaaataccactatatattttaatgaattttaagaagttttaattgaataaactaagatttccatatattatatcaataaaattttgttaaaatttattttcagtgcattatttacatatattatagcaacactatatataagaatcaatgatttaataattaatggattgtgcttagatttaaattttattaaaattcatgattgcataacaataacacacaacacttccctcttctatacactcgactagttccaaagatatcctataatatcgtcttcaatccctaaactcttaaagatgtatcaatctcatcatcaacaataaagataacattcacagctaatctaaactctaataatctaaacatgtaacaactaattgtataaatgtgtttttaatgagaagattcatcttaattccttagtaggacaaggccatgctcatcaactcgttagatgatcagcaaaatttgtggaatggatctgaaaagtgaatcaccggctacaaactaaggtatatatgattgccaagagtgtagttaacgattttcaacgagtatctcaaaagggtaaccggcatgaattcatgatctaatgatcatgatcgctcttctatcatggtgtagaagagaaagctccatttggtttcagtttattctagttctttatatatgttggcgtgactaaacccttgctcctgtggcttttgtgtttcctttgaactatcttccttttcttaataaatctaggcccggtggacctagaaaaacaaatgttcacatgagttgtgcacgtgaggtaacttaacatgccaaatgttgtgctactattggcagaccataatggctcgagagggacgaagccaatgatgcgttttggaggaataaagaaaaaggaaagacagagtccaacggcatctacttgtactgagagtgggcttttaaagcttttttatgtgcatttttatttgtgggactcattatcgtcatctcttctttttgcccatccgattgtcccaaacggcatataattgctgctgatgatgtaatcttggccgttggattctctcgaacttgttagaaacgtgacacaaaattttaaaatccacattgttcgtcatgttgtcattttgttattgtaatcatgtaacagtactataaaatgaatagaaaaaggaacaattctggaacaagcatgtgtcatgatgttgccaaacccactcacaccacgcaaattgtttcgtccgattgtccaacaatttttctaatatattaataatgtactattttaattgattcttaacttatagtgataatcgtaagctaagtggaaagtgagatgtgattaatccataaaacaattcgtttgttttcgtttatgaacaggtgaccaatattcacctaccttttatacactgatcggttgattataaatataacaaatccacataatagtgctctaagctatctaattaatctattgaggataggttcgatgtgctgtttaaatattatggaagcaaaaaaaaaaaaacttttaacatggatcatggatatagcctatgaaagtgaaatacgtcatacacagttcaaaaatattatcttttttaattagaggaaattcgttcaaaattttcattgtaatttttatcgaccattgttgatgttttgaatgacaagaatacattatgcctaacaagtttaatttatgaatgaatgcaaatttatcaaaataattaatatattttaaagtaatatataagattaaagaaaaactaaaactaaagtacattgagttcttttctagtttaccgcatatattaaattaaatatttaggatattagggatattatttcacatcaaaagttgagtataattttaagtgatatatataaaatataagtttctccacctataaccagtgtcgtgcctaaggttatcggagattaaggcgaagttgaaatcggaaaccaaattttttttttgtaatataaattttaaataaaataaaagtaaaaaaatttcaaacgatataaagtattaaaaataaaagaaataagaaacaaataaaacactaagacacgatcttcctttgatctcaataaattctttcacgaatttaagaatttaaaacctaaatcaaaaattttatttataaatttacaacctttactcaattccgattttgatttcttttttggtttgagatacgtttccttacgggtttagaaatctcgatttttttttttctttatttattctcaatttccttattctaagcctaattgtgtataaataaaaaaaaaaggtatatgccggattcaaatttgggttgttttccattaaagagttttctaaaaccattctaatacactacatttatgataattaggggccctaaaattttttaatattttcgttatctgaaataaatatcttttttttgctaaataactaattagttttaagttggaatctcataatctaatatattggaatgttaccactctgacaacattaattagttctaatatatatatacatgctaaacttttctattgaaataaacaacgtgagatcaaagagtggaaaacaaaactaagacgagataaatagagttttttaaaaatttgtccgtaaggatatttgggccaaacatacacctgaaagagtagattaacaggctttatttcggtccatagtatcacttgaaacgtttacttatgcaagcaccgaagcacccaaattttgaccataccaaaagagaacacacatgcaagtctctcgatcaattcacgtgtctctcaaccgctatgacgtggcctctatcctctgttcttataccttgctcttgaaggcaaagatgaaataattcaagaacaaaccaaaaatccccaaattggagatcaag

SEQ ID NO: 10046 - DNA, 3000 bp, Unknown
  misc_feature (1)..( 3000): cDNA_ID_1441333_gDNA_ID_2213621_Annot_ID_131971 3000 nt of promoter + ATG
ttttctcatttttattttgtaagattattctttctctatttatttattttctgatatattgttaattgttgtagttttttcttctcactgaaggttgagaatgggaggaacaaagaaagtcttggacattaccattgtcaatttgaaaaattagattaccgcataagtctctgatatacaaccaaaaatatttagtttggtcgttgcatggactgtcgatatttctaaaaagtaaaaaaccaatgataagtcatctctactccatttttactgttaacccaaattttgtcctgacaaatcatgcggtgtatatacatagttctcgggcttccaagattcttggaatctacttgatctctgttgtatcgtctaatctacagcatgcaaggaaaaatattgatttgtgaagaatcaaataatgatgatttcaaacatcaacatcaataaaaaagcaaacatacttctggctttaaattttgaaaactataaattcacattttacatagaaatactccaagatactgttctcaagatccaactaagaacaataagttaaaaaggacttcaagggaattgacttctatatgcttttttttctctgccaatttattaatactttgaaactttgatctaaaactaacatgtggtatcagagcttctatatatatagaagctttaatacccaatgttaggtctagattgaagctacaaagtacaagttcattggcagaattattcattgtggctattaatcaattttaacatttttatatacacatcactcttgccaactagatccacaaaagatcctacaaaaaaggaattcaaatatattttggaaaatcaagtccttacttgataaggacgattcttgctcctttaatttgttaacaagaaaaagaaaaaatatctcatatctcggattaatacctcacaaaccgaccgatttatgtatttctgatttggtttaagttcaggttcaatttatagagaagttggattaaaaaataaccaaggcctatgtattaatgtttttttttgcaagattatgcgctaggttgcatggaaactcgctccgaggtgcgtttctcgtttccgaaacgtttcggaaacggaaactctccggaaatacgaaaaacgtcacggaaacgcgtttcctaaaaatctaggtttagaaacacgatggaaacttacgtttccaaaatagaaactcacgtttccgaaatagacatacgacaaatcttttttattgactttaaaaatttaataactaaaattgaaaatattaaaattattattacatataaataattttggaagactttgagttttaagatctttcttttgttaaaccagatttgaaaagagctttatattatctttgataaaactaatgaaaatgttggtctaaattaactatttgaacttgaaccttttaatttttatcttttagaattttagtttatttatttaatattgatattttggacttgtattgtttaaatcattttttctttaatatagttttatgttaatgttatatatatatatataatgttatatatatgtataaatgtgtatacgtttccaaaacgtttccaatccctaattttaagaaaaaatcgtttcccgtttccgaaacgtttcgtatccgcatttccgtttccgttttcatgcaacatagattatgcgaatgattgcaatttacaagtaacaacttgagagatgtacgttcactatgtcgcgaagaattggtgaggaaatctttcgtaatattttgttatccaatggtatttatctcgattgtaatcgttaaatcatgaatggatggttaaatatttaccaaataaataaaaagaagaagaataattaaaatttatatattggtgagcaaatattattattccgattaaattatactttttaattgttgttttgtaaaattgttcagttctgttttgttttgtagtctctattatcatcagagttgtttagtttgatcgtcgtgtggactcttgacagtcctcatagtctactaaatctaaaaccaatgataaatcaactaattaattaaataatcatgtctataaagtataaactatatttttatgtgttaacccatccaaatctgcaagtccatacaaattgactctaaatatattgaagctgcaaaatcagccaagtacaaaattgactctaagtatattgaagctgcaaaatcagccaaggttacgcaatataatcatatagcgatcgatgcatcagaataataagttagaaagcgatatcaattgcaaaatagtatagagtagtataaaaatatgaaaacactctgaagttgaatgcaccaaaatctaaatgcattgttttgtctgccaaattgacttctatctagaagcttctagtgtgaagctctgataccacttgtaacgtccaaatcaaagcttcgagttacaagtcaattagtagaatgatttattgtttttgtttcttttacttatgaaaagactctaaagcaaagcgaaggaagagatgaggaagaaaaagatttgcccaaacggcaaacactaaattatttagattgatgttctattgttcatatgaacaataacgtctatatatatgtgaatctgattcgatagaataacctaattacttgggctttttttgggcttatattgatttatctgacaagtctgatcccggataaagttcatgatttggttaagttcggttcaatttaaagagaaattatattgggctttaaaacccaggcccatataaaaacgactcacgtggtattattaataaccggagccctagacccgccgtgaaatcgagcgattgagagcacttcgcaaaatcagagcgacaaaaaaaaataaaaaccaatcctttcgattccaaattttttgttactcactcgcacgagttttatttggtcgttagttatctctttcgttgaataacggttttaatttaaaccgttactttttatca

SEQ ID NO: 10047 - DNA, 3000 bp, Unknown
  misc_feature (1)..( 3000): cDNA_ID_2714547_gDNA_ID_2213621_Annot_ID_131973 3000 nt of promoter + ATG
atagtagtagtagtattagatatatgattccaaatttgagattattactagtgtattgttgatttagctgcatattggacaacgaacaagaccattctcattacactccttacacttcaccaccactgcatcattcccccatccttccaccactttacagcttccattacaacccgaacacggcaaaaacgctaatccgccgcaaccaccgcaaccgccgccacaccgatctttcttcctcggaatctctttaagcaattcaccaagcaatccttcttccaccaatctcatcacttcctctgctccaccaatgtacttccccttcacaaaaacccgaggcggcaacaccgccgccgtcgattctaccgccattagattggataactcttctctaaatcctctatccattgacacatctctctcacaaaccactacaccaaaactctcaatcgcagctctcacggcgttacacgcctcaaacgtccgtcgaacaccgcgcaacgacgtcgtataaatcacaacgcgattctctccgccgtcacataacctctcagattcctccgctaatttcggatctaacggtttcaaaacctcgtaatcgttagggtttttcaaattaggatcggagttctctttctttaatccgccggaaaatccattacatttcaccggaatcggagagaatcgacaagtatcgccgtctaaacctgacattagctcccagaagttaataacctccgtcgtcggctcagacttaaccatcatcatcgccgcctccttaccgttgatagtgaatctctcaggcggagtcattggcgtgataacggatttggcggaggaggaggaggaaggagacggaggagaaggtgaagaagagtcgagattgagaagaccgtaagtggtggaagttagcttgacgaaatgttggcttaaggaggagctggtgaggtgagagaagctgctgtcatcggtcggagtaaggaggttggaggagacgcaaccacccatcgccggagatttcgaggattaagcaacgtcggagaaaaaatgaatcacggagattgagtgaaagagagacggtgaagtgagattaaagacaaaataacataaaactgctaattagataaaacttgtttatataaatacaatttttctaaagttgggaagtgacaatgcacgtggctttggtgttctttttaatccatatttttcgttgaataaagaattcttttttcttaacaaaatatttgagatatttgttttgtttgattttacgttaataaaaaagagaaaatacaaggcttaattttagaactaggatttagaatcaggaccactatttggttggagtataaggaacagaaattgattttgataatttcgttagaaggagatagagacatttaacaagtcaacaaagttcatgatggttatggtaaaaataaaaataaattccttgtttaggttaaactaaataaagaaaaaattgcttgttgaggtacatttgaaaatgttgaggtacaattgttgaatggataatgaattttataaaatctaataaggtaatattgaatcaatgatttggtatgattataccatgttcttcttgtattggtcgttgcgattaaatttgatgactaaaaattaaagaacgaaatgagaaataaatggcataatttattataaaattcgttgctggttgttcaaaactgacaatggaagaaaagctggattatgttcatttaggccgctatatttttcacgactcctacgttgttagatcaatatctctattttttccaacgacacttctattttttcagcgacatctccgatctgtctatatggatcattttactttattttttttaacggctactgccgttttacttcgtcatagttaccgacgcagtggtccataaaataaaagaacctatatattttcttaatatccatttttattcaatctggttttatttaatattaaatttttttatataattaaaatcaacatgttattgatttttatatatgtacaaggtatgcaataaagagtttcacatccgatgttattcgatgaaaaaaataaaactatcaattaaacttgtgtgccttaaatttggatattagaatgttagtcgatcgaaaaaataaaattaaagtgattaaaatattattaaaaattgaaaatttaaatgtagaactataacagttatgtttttataatacttttaaaattcaattttcttttgcaattttggtagaaagatattttaaagaaatatcataggtatatatctattaaattcgtaaaattaccactgattaaacaacaacaaaaattacttcagaaccgactctatttctgcttaaccacctccataccaaacaacgaaattgatttttcctggttaagaaattagacccggactcaaactttattcgggtcgggttataaaacttttataaatgccctcacaatcttgtcttggtcgcttcgcaattttcttcttttttttgttattacttttttttttcctccgatttgagagtttgcttacctcggaacttctctccgacatcgtaccgtctcgtccgattgagctggtttacctttccggcgaagcttacttgtaccctcaattagggtttcaagaaagaaccctccaatccaacaatctcgtatcagtgaatggtatcgtatcgtcttcttcaattttatccaatgctttgattgcaactcagcttaactcgaaaattgatcaatggggtttcgatttggttgtgattttaaagccaaattgagactcttttgatgaagtttcagataaagaagttagctttttttgtttccaggtccgtttaggttggcttgtaattgtgtagttttttttgtttcttttgaaggttttgattgagttttaatggttggggatttgggaaggacaattgccttgtcgtctcccgattgtcaccattgtagttaaatctttgaatatg

SEQ ID NO: 10048 - DNA, 3000 bp, Unknown
  misc_feature (1)..( 3000): cDNA_ID_2714535_gDNA_ID_2213621_Annot_ID_131976 3000 nt of promoter + ATG
gcttttgtagagttcgtaatggtaataatcgaacacacctccacacatttctttgagtcatattctgagtagtctttctttatatcttcacaggcggaaagcgcaatagctgctctcaactgcagtggagttgttcttggttctttacctataaggtcagtgaaacaaaaccgatcttcacgacacaaattcgttctctttttcggttttatgacggtttgttattctacagggtgagtccttcaaagacgcctgttcgtccgagatcaccgaggcatccaatgcattgatcttagctttacaggttttcacatatctcatgtctccgcaatatatatatcgctgtgtcgtcttaaaaacagcattacacagacatgtaaagatgtttgtctgcatctctcatctcttgttttcgaaatgtaactctgggatctgatgatgcttctttcttcttcctttacctgagaatcttttgggtaaaaaaaacctcgtagagagtttttatttatctcttaaaaagaaaagagcttaaaacatatcacacatccagaagttacttcgtacagttacaattttacaatcgtgtgttattggtttcgaagaaagtcaaaactgatttcttttctttttttttgtcggaataaaaaattgatttatgacaaaaagagtttggatcaaatttgatgttcttagttttgtccgaaggacaacagaagcggttgtgttgttgtaatatggagatcaaaaaacaggtcaacttagaacagctgtttttgtcagttcttaatatctaaaaagtcaactttggaaatttcgagagataatataattaaaaaaatgttttggtggttttcttaatttgtgacgtcatcaagtacgaaatgcggtctaggtacaacggtggttactcaatgtttgtgcttttcgagactgagtttttactttctagtttgtagtgtgttatttttgttttataggcaatgtatgaagctaccatttacaatctttttgtacatatatgggattttttttttttttacaacaattgaacaaaatatgaatgagagtttatgaggttttaaagtacatcttcattatgaaatttttttcaagtattcatccaaacattattgagatagatacaagacattcgtcgttttaaatattgtacgattccaattcacctactcgattttcggtggttaaacaatccaatttgaattttataaacttcctaatgttttttatgtattattaaacaaaatattaaaatcactatagacttttatttacggaataaaatcactatatattatcttaagaaaaggtttagaagcagtaactattaaaaaagacctattattatcaaacaaattgaaaaataaaggttaagaaaaaaacattttgataaaaaaaacctttaagaataatgtttcttattcgtcttttcttaaagcaattttttcccctttttttttgttggtctcggctgaagcccctaggacattcgtgcgtatgttctaaaatatacacttatcaaaagatgttgaatgtgttaggtgttgaatgcattaaacggttcggttttgtctccaatttattttttagattgttagaatttgtggatattttgaacttattaaactttaaaaatacttaaaacccaagaaatgtctgcgtatttgacggcaagatcaaattactgtgttcaaaaactcacaagtccttgctccctaattcctataaacgatgctcatattaatttcgctacccctacggttagttagaagatccacgcaaaatgtgtttttccacattaacagagaccatttctattcaaattttaatcttttcttttcaaataattatgcttggttttgagactaaaataaatttaattgaatgagctttcaaccgttttcacatgaaagcttgtttaattgttttagaacaccggatatttaagtttcctcgaatatttaacgaatttcggaagaggatatgctttttggaaaaaagtggcaagtctcactatatatcttacactaaaatagaatactaataataagattaaaaagagatgaatacattggagatgttctaaagcattcgagctaaaatttaagtgttttatgcaccgagtttacgtatttgattctaaatccgatattacaatgcaaccacacgagggtttactggtttaaggctttatactattggtgcacacacattacacatcatcaccattttctagtcatttctatcaccagactctgtccattttgtgattggtgtgccattgaaagccatttaatatcaagtaagtagtccccgccaaaacctaccacttattttctccaccatacattaccaaattttgcaattattgtattttattttaatgaaaatctatccagtttcattgacgtttaaaacacacaatatttttagaacaatgtacataaatttgacgtgacgttgtctaaatcacgaagattggcggtattcaatgacggtctttaatgctaggagttcacaaatcttatgtgaagatagtatagtttaaatttttgcatgaaatataaagttagttggagcacaaacaaaatttaagataccatcgatttttcggtcgtttatcagccggtgactggagcgccgaatttgagattcgcattacgatggtttatgtaaagagattggttatatcaatcttatcaaacccacctctctcgggattattgactcgatttggatatttatacatgtgactatatttagacatacatagatctcagtcctgtatatatagagctacattcataaaagaaagatctaacataacaaaaggaaaaaagcatcaagaacatggcggagactcaaggaaaggtcatcacttgtaaaggtaagtaaatgactcaccaatgagatggtttcctatcattatgctgttgatgcatatgatgatgatgatgatgattatgatagtaatgatgcatg

SEQ ID NO: 10049 - DNA, 3000 bp, Unknown
  misc_feature (1)..( 3000): cDNA_ID_2714531_gDNA_ID_2213621_Annot_ID_131977 3000 nt of promoter + ATG
tatttgagcgatccatccggattcaacaaatatgtgtcgggatgaaagtgggagaagtgactctgtttttccatggatatatagatgagatgaaaccatgagacttgttgaaaacgttcaacaatatgttgtcaattaaaagataaaaattaattaataaaaatatcatatatatatatacacatattctttttaagtttttgcttttggttttggtcggaaatacacttttttctttatatttccagtttacgtaattcatccaaaagtagaacatcagagtaaagtgactatatatacacatatgcattacgaatatttgatggattcatttaatttgtattttaaacaaaataacaacaaaatgtaacaatatcatttgagttaaatgcttatgtcgatttccttgatccacaacttctcttaacatgtttttacctttcatatttctccaactcaatcgttttggaaatcctgatggaatattttagaaaacaatcaacagctaaatataattacccggagatttttaaaagcatactcactgattccttattcagtaagttggaaaccacattcctgggcatgatcgataatagtgctaaatcggcaagggttgaagaagatgacaaagaaaaatgcatattaagaatgaaaaaagccggtgagatctgaaggaaacattagtatcaccaaatattataaaataaatttggtttttgacgttttgtgggttggatgcaaatcatgtatttcttgtagtgatatataaatgaaattaacgattaaatgaaaaatcaataaaaattagcaaatcaatttaaccgagtcaaagttagggctttgtttagcattttattacaacaaagaatatttttgacatttttccctatatatatatatatatatatatatatatttgtgtcaaaactacacacagatctataacaacatagttaatgaccagtttgagactcaatctaacctctaaaattcatcaatttgagtaaggttaccagaattttattgtaaagtatttttgctctcgaactgtcatatgaacgcattaccaagtaaaattgtctaaaatatgtcattgttggttgccttaaagtccctggtaatttactaacagcaagttctttagtaaagatatggacgcaaatttaatcaaaaaatacaaagttaatcaagagttagtagatagagttatttacatatattttctgtttgaataaactaatttaaatatgtatatatttacatatattacaaaaaataatgttaaagagtaaatcaccaaacttgctgttagtaaaatagataatagatgggcgtccataatatattagattaggttacactcaatttagaacgtgtgaaaaattaattgaacaatgaaaatcaaaaatgaaaagtaaatttaaagttttatcaaaaaccaaataataccatttaactatttgtagaaaattgaacagtaacttccaattattttttcagctttttatacaaatttattgtggtgttcatgttttaatgccctaactgagttttatactttgtggaataccctcttctaatatatatatagcttgtaatatagtttttcaatttaattaacattaggtaaataaaaaatttgtgagagaaaggaacattcaagaagatattatttttattagtaatgtttttatatagaagcatatatatttactaacatacttgaattagtttcataattgttttagatagattaatgataacaccaattataaattttgacattttgtatattttgctgacatctatatcttacacttatcttaaccaaaaaaaataaaaaaaattaagaaaaatattcaaaaaatatatttgtaagggtctctatttattatatcatgaattatattgaacttggttatccttattctaacctaataatctttctaaaatataatcaattaattgaaatgtgttgtgatttcatgaattacagttttgccacatggcatgctctcctaagaatattaaaattttctacattaacattaacaaattttatattttatatttatgataggataaagaactctaatatttttttgaataatattaacaaacaacaaaaataacaaaataaggtaaatattttgttaacaaatttcatattttttatttttgatacgataaagaacttttacttttttctttgaatatattaacaacaacaaaataaatagaatgaggttactagtttaatatattaataaaataaaaaaattgaatatatagaaaataaaaaatcttacttattatatatactcctttttgataagggtaaggactttttaaaatatatatattaaaaaatttacactggagaaatgacggcatcttatattttaattaaaacatattacgattatataagttaaatctaactttatataataaaatagtattaattttaactaattaaacttatattttgggtagacatatgtttttaatatctctaatcaaatattagtgtatcctccttttttaccatcatattttttctaccgtattatgtttccttctaaatccgtaaaattagactcataaaacagaccaaacactccagagtccaggctctctctatctctccccggtacggtcggattctacgttatccaatcacactctatttttcaccgcagttaaagaaaaaaacacaaagtgaagtaaactcattactagtttggtttctcaacgaatccttacttaatcactctgatcaaataccattaattatcaccgatcctctgattaatcactctttaatcgtctctttatttctctctctctctcttcttcttcttcttcttcctccagagagcaccttatgctgattcctctccttttcttcctcaactcataaacccgatcggccgattccttcacaattatccttaaaattttcgattttgattattgggtttctctctgatcatg

SEQ ID NO: 10050 - DNA, 3000 bp, Unknown
  misc_feature (1)..( 3000): cDNA_ID_1012423_gDNA_ID_2213621_Annot_ID_195725 3000 nt of promoter + ATG
gtgatatataaatgaaattaacgattaaatgaaaaatcaataaaaattagcaaatcaatttaaccgagtcaaagttagggctttgtttagcattttattacaacaaagaatatttttgacatttttccctatatatatatatatatatatatatatatttgtgtcaaaactacacacagatctataacaacatagttaatgaccagtttgagactcaatctaacctctaaaattcatcaatttgagtaaggttaccagaattttattgtaaagtatttttgctctcgaactgtcatatgaacgcattaccaagtaaaattgtctaaaatatgtcattgttggttgccttaaagtccctggtaatttactaacagcaagttctttagtaaagatatggacgcaaatttaatcaaaaaatacaaagttaatcaagagttagtagatagagttatttacatatattttctgtttgaataaactaatttaaatatgtatatatttacatatattacaaaaaataatgttaaagagtaaatcaccaaacttgctgttagtaaaatagataatagatgggcgtccataatatattagattaggttacactcaatttagaacgtgtgaaaaattaattgaacaatgaaaatcaaaaatgaaaagtaaatttaaagttttatcaaaaaccaaataataccatttaactatttgtagaaaattgaacagtaacttccaattattttttcagctttttatacaaatttattgtggtgttcatgttttaatgccctaactgagttttatactttgtggaataccctcttctaatatatatatagcttgtaatatagtttttcaatttaattaacattaggtaaataaaaaatttgtgagagaaaggaacattcaagaagatattatttttattagtaatgtttttatatagaagcatatatatttactaacatacttgaattagtttcataattgttttagatagattaatgataacaccaattataaattttgacattttgtatattttgctgacatctatatcttacacttatcttaaccaaaaaaaataaaaaaaattaagaaaaatattcaaaaaatatatttgtaagggtctctatttattatatcatgaattatattgaacttggttatccttattctaacctaataatctttctaaaatataatcaattaattgaaatgtgttgtgatttcatgaattacagttttgccacatggcatgctctcctaagaatattaaaattttctacattaacattaacaaattttatattttatatttatgataggataaagaactctaatatttttttgaataatattaacaaacaacaaaaataacaaaataaggtaaatattttgttaacaaatttcatattttttatttttgatacgataaagaacttttacttttttctttgaatatattaacaacaacaaaataaatagaatgaggttactagtttaatatattaataaaataaaaaaattgaatatatagaaaataaaaaatcttacttattatatatactcctttttgataagggtaaggactttttaaaatatatatattaaaaaatttacactggagaaatgacggcatcttatattttaattaaaacatattacgattatataagttaaatctaactttatataataaaatagtattaattttaactaattaaacttatattttgggtagacatatgtttttaatatctctaatcaaatattagtgtatcctccttttttaccatcatattttttctaccgtattatgtttccttctaaatccgtaaaattagactcataaaacagaccaaacactccagagtccaggctctctctatctctccccggtacggtcggattctacgttatccaatcacactctatttttcaccgcagttaaagaaaaaaacacaaagtgaagtaaactcattactagtttggtttctcaacgaatccttacttaatcactctgatcaaataccattaattatcaccgatcctctgattaatcactctttaatcgtctctttatttctctctctctctcttcttcttcttcttcttcctccagagagcaccttatgctgattcctctccttttcttcctcaactcataaacccgatcggccgattccttcacaattatccttaaaattttcgattttgattattgggtttctctctgatcatggcggttgttgagactggagcagcagctactgctgctgatgcaggaggagtcgtgatccagccgccgccgtcttcaccaccatcttcaatgactagtcaagattccggcgtttcttccgatgatcagaaccatcactctaggatcgatcaagttctccggcacgatcaaggtctttacagcaagatcgggtcacacgtggcgagatccgacggcgttgacggtggtgagagctttaagcgtgatatgagagagcttcaggagcttttctctaagcttaatcctatggctgaagagtttgttcctccttctctgaataaacaaggaggtaacggtgttaacggtggtttcttcacctctgctggttccttcttccgcaacaatggctttgctggtaccggaaatggcggatacggtaacgaaaacggtggtttccgacgggtaagagacactggttttcgtcgattgtcctgtgcaaagttatgatcttttgttgaattgaggtttaactttactgaattgtattagggtttttgttaattgattgtgttttcacaaattttgtgttgttttgtttagtctacgattcatagctttggatcaattgtgtttcgttttcgttggagatctttgaaaagaaagattgtacatttgaaagcttgaattttacttgatgagactactttatatccatatcattcgttttgattgtgtgtgtgtgggtggtgtagaagaagagttttggtcaagggaaacgaaggatg

SEQ ID NO: 10051 - DNA, 3000 bp, Unknown; identical to SEQ ID NO: 10047
  misc_feature (1)..( 3000): cDNA_ID_3034125_gDNA_ID_2213621_Annot_ID_195720 3000 nt of promoter + ATG

SEQ ID NO: 10052 - DNA, 3000 bp, Unknown
  misc_feature (1)..( 3000): cDNA_ID_1537635_gDNA_ID_2213621_Annot_ID_195719 3000 nt of promoter + ATG
tactccatcttcagagcagaaagcaaccgagggcactcccgggtacatatatataaactaattttctgttttgtttgtgcttccatgggcaagtgaatcttagatgataaaccggtgtttgcttactaatactttgataggagattcttcagctttcttgttttattgcacgtagttgatagtgagatgatatattggtcttgtggaactaaaatatggcgctttatgttgacgttttcttcttttggaaattgtttcaggagtaccactagagtttcgtcaatccggcaactttctagcaactttgctcagtttaataacctgaatgcttcttcccgccagagaaaacctttgacgataaaggtatactaattaagacgtctttcattgactttagtactctatgaaaaatctccatttagttgttttcctcttatcagtttttgttctgtctatattctataggatgctcaagctttaaacgagtggcggtttacaaagctaaaagagtacagagacagaaacattgaagtagaaaatgaagcttttgatcggtacatgagtaatgtgaatttactcgaagaagcattttcatttacatctgttcctgatgaagagagtcatggaacagcagctcctgagcaaaacaaagaggaaaatattgtttcagagcttaaactgaggctgagatcgaactctgcaagaacagagagctttaagaagcggatcgcggagacagtcaaagccggtttggtgaagcttaagagactggatttaggcagttcttcagatgatcaagatgatatcaaaaggcgggtcaaaagaaagaaatgggaagagaaaggttcagctttgaatgaaataatcgataaactgaacaaagcaagaaccgaagaggatctcaaatcttgcttagagatgaaatcaaagctctgtggtcaagtttctcccactgctgcttccgagaagaacaagatctttccgggtgtagtccgaaaagttgagatgagtgaagaagcacttcaaaaaatcgctgagaatctccaatcttttgacaaagttggaatgttgtgaagtcgagaacatcctgtggatgaactgaaaagtttgagtggcaagaaaatttctagatccttcgtgaccacggtattgtacaatgatcaaacatccctcaaaactgatcctgaagactccaaagactcaagagattcttgtaaagtagtgttgagcatcatttagatattagaactcagccatggataaagctgttgattctatctcattggatttttttcactgtgtgttgttgctttgttagatttgaaattgctcattggattacctttgacttaataaatagttggtttggtttggtattggataaccgctcagtctaattagaccggtttgtttttttggaaaaaaatgaatccatccatccataggccactttcaacacgtatatttgaaaacgactaaaaccaaactcttagattctagttttgttttgctgccccaattccactattgatcaaaacatatccaaaagtttttgtggaactaaaaagtaaaaataacgtttagtttgtttccaatttcaaccatatatatcttattcatatatgcatgttgtggttgtctcgtgtgtgtagtattcatttacattatgcaaaccaactggaaacatgttgaatgggttatgggttggtggttgggacttgaggatcaaacaactcaaatgagctcattataagttaagctctcaataatcattaatttatttttgttaccacctaatatttctacgaagggttggtgtaacaatttttaattgtaagataattgtgtaatcattttcaatattaatttttattatgtatttattttaaaaagttatataatacgtaacacatttagtacttggttttggtagcttcatcaatgtaccatccgaagttccaaaaaataaaaaaaaatgtcgatttcaccgttggtgaaaaagaaactaaattgatatgtattattcattttttagaagagattatgggtttaaatctgaaacttcttagttaaatttttaattaatttatttattttgcatgctttattatatatttgaaattagaatctacatgattaatgatttttttctcagatagaataaaaaatatatttactgataaattattcttttacatctttccggattcgctactaatgtgtttttgttaactttaaccagattgcttatggattatgatatatagtatccattacttaaaaagtaaaagagatgaaaaaccaagaataattaatgtcaccaaactatcaacaacaacaaaaagagagtgtaatattcaagataaacgaatcctattatataaaaaaaggtgggaagaagttgctgtctaatgatgtaattatgttaactagtgtgctaaggaaagaaatcaagcaagtctcacacatacacatgttatgacttatgattagcgacaagcatttcattttattttatttttgctaagcaaaccttttgtttagtaaaatagacaatgtgcaaaaaattccaaacttcttaaattgaaaaaaatactatatttaaatttacctttttaagtaagaaattaaaagattttgtagtacactacatgttttaaaacaaccactatccaaacaaaaacttggtcaccgaataaactgtagaaatatcgatttccgtcatttaaattcactttatttttggttgtttttttcttggaatatgcaagagtaatggcgtggttgaagacacgagagagagagagagaatcctaaagaaaaagccaaagcatattaagaagaagagaaccaaaacgaacaaacccaaccctaaagaaacactattattaaacctatatttatagacatttaaagagagagtgaaaggtgcagaagaaaacagagacagagttcaaataccttaagatcacatcatcatatagcttttgtatcattaaa

SEQ ID NO: 10053 - DNA, 3000 bp, Unknown; identical to SEQ ID NO: 10046
  misc_feature (1)..( 3000): cDNA_ID_1441333_gDNA_ID_2213621_Annot_ID_195718 3000 nt of promoter + ATG

SEQ ID NO: 10054 - DNA, 3000 bp, Unknown
  misc_feature (1)..( 3000): cDNA_ID_2714763_gDNA_ID_2213622_Annot_ID_131980 3000 nt of promoter + ATG
tccacattctctaacttctcaaaaaacaggaagagaagcaagacgcaatgaagagttcaatgagcatcattgtcttcttgtttgtgaccatcttcaccatctctgcttcttccttgaaccctgaggaaacttgcatacaaagaaacatcaaccggtcacaacctccaagctcttcactcgaacccaagacatcaaagttcgactttcttgtggacaagttgtgcagagacatggctcgtgccgtcatgttctctgtgaggataaccggaaaattcccatctcactatgtgaaggcgatgtgtaatgtgtttggaaatgacgagaagaaagtgaaagagtatgttgtgaagaaatggttgggaggttcgaagctcgtgtctagtttatcttgtgcttttcattgaaagagtataattgtctttagtgatattagtctattaacaattagctaaggttttcatccgaaagtcaaaaagattatgcaaattaaaacgacacaattagtaaagaaattatgctcaaaagtcaaaaacttacaaataacagtttttatgcaaaattaacttcagaaatttatgaatagcaattccataaaaatatatcataagaatgtgtaaaaaatcagagatttattctcctttttgctaccgaatccattactcatgttattgagacccaccccactaaactcataggttaatcactctcggataagaacattcgaacaattaccgacacacaaaaagtttgaagagaaaaacaaaaaatgttgtcgagattgttcaaggcaggtgaaaaggttttgtcgaatctcgttagcaagaaagacatttacatggcgtcgaggaatcaggagaaatctcccaaagtgcaagagctttacgacctctgcaaagagactttcactggcaaagctccttctcctgcttccatggctatccaaaagctatgctctgtgttgggtatttttctttcttcttttgtctctgtttgattttctcctactgcgatagggttattgcaattgcagctagttttgatcgaatcagtgacctagttaaagggtttaacgttgttttgttggatttgaataaatgtggaaactcatttgatccaccaaatctggccaattgcagattcacaatttgaaatcgtcagagtctctgagaagtgcaaatcttgtaactttgatgtatacatgatgcaaatttaggatttttagagaagaaatatcatatattaatatatcaatctattcttcatagagggactactaggatcagtgattttatggttcattgtggtgagagttgaagttagaatttggggaatgtttgttttataagcagaagtgtgatttgttttttggtcattcttgtgtgcagactcagttagtcctgcagatgttgggcttgaagaggtatctcaagacgatgatcgaggctatggagtttctggggttagccgtttcaatagagtaggacgatgggcacaaccgataacattcttagacattcatgaatgtgatacttttacagtaagtctttgattgatactgaattctttctgctgatcaatcaacaaatctcaaaacacaagtgtttgtttgtcctttcttcagatgtgtattttctgcttcccaacgtcttcagtgatcccattgcatgatcatccagagatggctgtgtttagtaaaatcctctatggatcacttcatgttaaagcttacgattgggtcgaacctccatgtattatcacacaagataaaggcgtccccggttctcttccaggttattgttagtttctcatcttgggtttcactttgtgtcattgataattaagacttcttgcaactacttgtataacagcaaggttggcgaaattggtgagtgacaaagttataacgcctcagtctgagataccggcgttgtacccaaagactggaggcaatctccattgcttcactgcgttgactccatgtgctgtgctcgacattctctcacctccttacaaagaaagtgttggcaggagttgcagttactacatggactatccgttttccactttcggtatgcaaactttctctcttttgcctttagaagaacattatgttactctgttttcgtttaccgttttttctctttggattgataataatagcattggagaacggaatgaagaaggtggatgaaggaaaggaagacgaatacgcatggcttgtacagattgacacgcccgatgatcttcacatgcgtcccggatcatatactggtccaactatcagagtctagatatttgtggtttgttttgtagcaaagtagagcaactcttgtaacattccaagataagtttctggagaagatatcaatacgatttcagattaaagatgaactctttgtttagtccatgtccacttctcagttctcacacgcattcaagcaaatgaaactgcggaaaactacaaatagatcggcaatgagaaatgttaagatttcatttcgaatctgtgcttacatcactgataacagctttcacaactttgttaagagtgtctctttgtttcacaacttaatcggaagagaagtagaggaaaagatcgttacgattatccagcgggaaaaaaaaaacgaattctaatgtgcccgctataaaatcttccgcaagagtgtaacagtgatgcagctgaatcaataagactgtcttcttctccgaatttgaaaattaaattccagttttttcagtttgactctgcttcttcttcctcgtgggtaacgacgatataccgttaaaattaggaaccaaattacccaatggtcgtcgtcaaatcatttttaatcccaatttggtatttttccacgtgggtcaaacaaaaaacaattttttacataaagagaagagagtagtgacgagaagattagcactactgaatcaaacttagccgccgccaccgtcacgttgaaaccttcatctctctatctctctgagacctctccttcaatg

SEQ ID NO: 10055 - DNA, 3000 bp, Unknown
  misc_feature (1)..( 3000): cDNA_ID_2714755_gDNA_ID_2213622_Annot_ID_131982 3000 nt of promoter + ATG
aggcgcatatcttcctcctttaaacccgttaatccaaccccgaacctcctcgttaatcctctccagtccatactctatatgctcagctaaaagaccaccgtgaacaaaaaccgaatcaccaacaacagcaactgtttgattcttagtcaagaatctctttgcaatcggaccatcaggtctcaatgcagcaatcctagctctaattccttcaaaacagtcggctctcatacgagggaagctcatcggaatcccttcgtaaggatccttaggtttatcaagaccactgcataaagtcttcatcttgttccctaaacaataccaatcagcccaaatctgaaattcctctaaacctttcttagtcacatatctaaagtcaccttctatattcatgatctcatggttcccattcatagtcagaatcttacctccagctctctcagcctctcgtttcaatttctctaagaaataaagtatcttcaactcctctccacctcgatctagtacgtcgcccacctgaacaaccatcgttgatccaccagtccatctgtccgacgaatcaatcagaccagcgatcttgaatgcttctctagacttctcgagatcgccatggagatcaccgattgcaacgagtcgctccggcttctcgaacctcgtttgcagaatctcattttgtgagctaggatcttggggcaggaagatgccggagacggagtaatcaacgaaagtgtcgacgaaggaagagatgagcttgggaatgcttttgcagattccgctagggttttctctgcttgacattttccgtgataaatggcggccaagaacaatgcgcctttataagtttccttattaagcagtttattaaattaattcattgactagccaataaacgaagccaattagtgagtgactctttttgtctgtgtatcttctagatattgttcaagttgggctttggatctcctacaaggccacgcccattgttttgttgctcatgaattaagtaggcccattaacccagatagttggaaatgagttgaaccagagtattggactctgagcagcagagcagcccagagttgagaccagacgagatcttccaagcttagttgtataaaccaacgatgagtgaccggtattgaagtccctttactacaatttgcgagctgtcttatgtctattttatatacaagagttacagtacacaaatagttttttactaaaagacaagaaataagaaaacaagattcattctccttatgacaacaaaaaaaagaaagaaaacaagattcattcatacaaaaaggaggaagttgtgtcagaattgcaaccaatttaaatacatttagaaccgtcaacgcctctattgtttgttgtgactcttccaagtatgaaggttattgtattaatttatcctcaagttttttataacattgatatgataatggttttaaacgctttatgcgttattgtaaaatttatttaccccacaatagaaaaagaaaaatgcaattgtttagttttcataagtcacaatcgtagaaatattttaatataaattgaggtgtttgttgtatgtttatttgttctctttggataagtcacgacttgccaagaagaaggagcgtgagagatcgtgttaatgtggggtctttcttcttcaattaattacgatctaaattgctgagtttttttttttaataatgatttgactttcttttcctactattatactaaaatgatattttatcccaaatgtagtaaatttaatagcgatatctaatataagtttcagctaaatttaattcaatactcttttttttttttttttgaaaaacagtaacactgttatttgaaaaaattcaaaagcatttaaatatagtggaaacaaaactttatcctttgaacttttttataaagaaaaagtttagattcttctactgtttaaaaagaaaagaaccattaagtacgttaatgcggttaccgaacatgacattaagctttcgtttccttaattatccgagtggtccaattctttaattacgaaattatgaaagcgaattaataattagttaacgaaagtgacattgagaacgcgtttgcgtttcagttatggcgtgcaaacaaagctaaacaaaaaattcagagagattaaaaaaaaacaaaaggaatccaaaggaaataaatgattttgtttgcttttgcttgcaaataaaaatcattaaaaaaaaacgaggcgtaacaggaaggagaagaagcaggggtccatcatcaaatacaacattgtagcaattgcgttttcgactttatagagatattttcatagagatggtctcgaagctaacaagttgacaaatttcttcgttataagagagatagatgagttgcaggagagtgctgaagtcgatacaagccttggcggctcatagtttactcttctgtttcacgcttttattggtgcttaaactcgatcacaccgtctcttcctcatggtggttagtctcttttctctctttcaattctcttttctctgaaattgactgcatgattcaaattctttgcttctgatttgttcaatttcgattttcgtttttggtgtggaggagaatcatttccctgatttcataatttggggattttgaatttgaggaccttgtctttttgccccccgttgaatttcgaagctaaagattgtctctttttgtttaggcaaagtatcagtttttgtttttgagagaattgaaaaagcagatcctttaacaatttcccgattcattgtttctatttgccgttaatagcaacaaaagcaatcacgtcaatagtttttactgtataaagtttttgcaaattttggtaagtcatgtatgcattttgtatcctagtgtgttaaaaagttacatcctttagaggtatgcatttaccaatgactttcacgaaaccaaaaggattcagctttttacttgggtctgataaaaaatatttctgtatttggggttatgcagg

SEQ ID NO: 10056 - DNA, 3000 bp, Unknown
  misc_feature (1)..( 3000): cDNA_ID_2714751_gDNA_ID_2213622_Annot_ID_131983 3000 nt of promoter + ATG
aagctatcccagtttttatgatggcgaaaatcattcattggtccctctatctttgtttcaggagtctcctcactcagctagagttaaagtgttggcaagcggtaacacaacagaaagaagattcaggtctggatttagtgttcacttcttcctctataatgagacccaaatttttttgcttggatcaaccaacaaacatgttatgtatgtgcagtgtatggataggagggagtatattggcatcactaggctcatttcaacagatgtggttctccaagtctgagtaagtctctgttctgattttccattaatcagactcgcaaagaaactatagtttgttttctctcctgacactcggatttggggtcttggtgtaaatggcaggtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctattttaaaaacataaaaacatgtggaagaagtttcgttgctttattagattttcgcacaatcaagaccgtccacgttttgttactacgaaccaagataatccacaaaattaacaagaaaataacaaatccgaaactacaaaaagcagcttcataagttttctttttcttttttaaaaaagaagaaaaaatcagctttatcgtgcctctcaaaaagctaatgacttcgaagttccaaaattccggtcttcgaacatattttatagaatagcaaaatgttttgaaccacaagattattaataatataaataatgtaattgatattggtaagtaataatacttttattaatcataaaatggtctgaataataataaagacaaaatggacgtaacttctccgccactacagacttacgtgtcatgtctccatatccgcatgcaaaatccaatagatgacacattctaaatcatccaattatatacgcccacgtgtcaacctctgtctcgtctctctaaataacgtttaccgaccttctcttgtggacggtaagaatcgccggcgtcccctaatatatcggatttcaatccaaagacacactcacaatttaaaaaaaaacgtttcttttctcttcgattcccgattacggcttttgattttgtgggactcttctcagtttttctgggcttttggtttttggattctatcttctttcatttttcagattttttattttattttgttgtatttctatattgggaaacaaaatcatgcagaggatcgtcgataatgctcttgctatcacaaaagagtgagtccctctctcttttcgatttcaccattagtctgtgcacgcttattgattttgtgatttctgatttgtttttttagttgcatgtttagtggttttagtaatttgatatgtgatttcaactgttttgtttccttaatttggattttaattcgattagattttctcaaatagtaattcgatttgctttagatatggaagttgccaaattttgagccagtggttttatagtggagctaggagctaagtctatatcttatatcttctgatttacattaatcttgagatttagtggtatatagttttactaatttggggatacatttctgatttaccatttttagttagttgttgaaggtttgttgtctctttgaagaaagtatacatattgactctttgtcctgtaataattacagcgattctcgttgtatctgcggatagttttctttgtttaatgcttgtctgtttgggtttttggtgttcgttgtgggtttttgattggtattaggattgtttgtgttagtctaaaatagttttaagctaactaatgattttggtttttagtgcaggtcagtgaaaactctgacttatgagtctttgaacaacattgcaagatgcattaatggattttctgcgcttctcttgacacttttgcccggaaagtccaatgttcttgaaggtcttcatggatgggagcttaggcctacattgcgtggacctcgtttaccacgctggatgcataagtaaaactctcttcaactctctaatacttctttgtggttaccttatagcagcttattcgactctcttttgatttctgtggttttgcagtggagtctcttctttcaaccacttcattcacgaactctctgtggattctgatacttctagcttggactattcctctggtgatgatgatagtgatggcatgtccacgcctccatcacccttgtctcaaagctcactccgctcttgggctagtcttcctgccaattacgaaagccattggacagactggataaccttcattgtctggtgggctttactacctgcccggatccttctatgggtaccattatatcttttacgtcttttagctagaagaaattcaagaatgcagcctctgagcccaggaaggtaccaacattcgtctagaccttgttttagcaaagctatctcagggaaagagcatgacgtgcccaaccgaactactgataaaagacgcggagtcattgaggttagtgttgatgggcatacttaaatcacatttcttgtttttgagttttcttacgcaattatgtgttctactttggcaggatcttcagcttggtatcgagatctttatagaaacaatatttgatttctttcacaaggcggcacatcttcttctttctccatcagaaacttttggaatagttttatcatggttctcttcctccagtcacagctctaaaggaaactatggtgacgtttcggatgatgagatcattcagactgccattctaggagataacgattcatctcttacagaaagaagaaccacaacgagcttatacaatacagatacccggacctgtcaagatgttataacagagcttgggtaaggggggaatg

SEQ ID NO: 10057 - DNA, 3000 bp, Unknown
  misc_feature (1)..( 3000): cDNA_ID_2714743_gDNA_ID_2213622_Annot_ID_131985 3000 nt of promoter + ATG
ttgaccggtatttttggtttattaatgaaaataaattttattgagattatgggttgaaaaacaatctgtaattagacacgaaaacgtgctctaagacgtgcatagcaatcataccagatttgcataccatttctttgcaaaattcgaaaacagttccaaatttgggaatctgggttttttcagttcatgattcatcagtcatgacaccatcgtgtctttgatagaaatcataaaccacaaatgcacaataaataatagaatctctcccgagtctttccgtctctgtttacacctctatcaatcttctgcaatcatcggaatcaagaaccagaaatggcggcaccaaagctggaatctttcaggcggggtagcatgttcgacggatctttcaggcgaggtagtatgttcgatggttcgtttcgacaaagcatgagagataggcttatcctacagagcagaggctattccaatgtcaacgacgatgacaaaacttccgtccgttgctgctcctacaggttatacattacatacaatctctccttctttccagaaccttctattgaccaaacctttttgaagccattttatcttaatatgatgcctcttggagtccaatgtcaagtaatctcaaatggttaagtcttgaaatgctattggtgttgtttgcagctacttctctgacaagatcacgggggttgtgaagaaattaaaggatgttttggttacggcatgggagatgggaacagctgacccgaggaagatgatattctcggcgaagatgggtttggctctgacacttacctctatcctcatcttctttaagatcccaggattagagctcagcggccactatctctgggcaattcttacagtagttgttatcttcgagttcagtataggtatatgcaacagactttacacatcaaatttgagcattctaaaaactttaatacctgacatgtgatcttctcttgttttttgtataggagccacctttagcaaaggatgtaaccggggactaggaacattgtccgcaggaggactggcgcttggcatgtcttggatatcggagatgactggaaattgggcagatgtttttaatgctgctagcatctttgtagtaggtatatatacgaaatcatgatgtgtggtctaaactaaagcttccacaatctcattctgatttctgacaatatcgcatgcctgctcttgtatcagccttttttgcgacttatgcaaagctatatccaacgatgaagccttacgagtacggattccgggtgttcttgctgacctattgctacgtaatagtgtcaggatacaaaacaggggaattcatggaaacagctgtttcaaggttccttctgatagctcttggtgccagtgttggcctcatagtgaatacttgcatttatcccatatgggctggggaagatctccataacttggtcgccaagaactttgtgaacgtagcgacttctctggaaggtttattattaactctctccctgaatttgagtttctggttgaaaagcttcttagtctgtttccaatccatggaaaatgttcctttgtgcaggttgtgtgaacggatatcttgagtgcgtagcatatgatacaatcccatctaggattctggtctatgaagctgtcgcggaagatccagtgtacagtggttacagatcagccgttcaatctacaagccaagaagacaccctggtaagattcttttaacacataagaacagcaacaacattatcaaaagaccagcttacttgagatcctcacatctttttcttgttgttggtgtgattgtgaagatgagttttgcatcatgggagccaccacacggaccgtacaaatcctttagatacccatgggcactgtatgtgaaagtaggtggtgcattgaggcattgtgctatcatggtcatggcgttacatggctgcattctctcagagatccaggtactttccaatctttaagtcagaaacattctataatcttcagatcttaagagagatttgagacaagagtatgcaaagtaattgcaggctgcagaggatagaagacgagaatttcgtaatgagcttcaaagagtgggaatcgaaggagcaaaagtactaagatacattggggaaagcctgaagaagatggagaagctaaaccctatagaagacatactctacgagattcaccaagcagcagaagaactacagagcaaaatcgacaagaaatcataccttctcgtgaacgccaagaattgggaaatcgggaaccggcctagggttagggatttgactgatgaacaaaaaatctcgaatctcgactctgatctaagtcggatcttggctcataaatctcagagtgaagccactcttcgtccaccgaagaattgggatgatgttacaactgcagctaacttgagttcggcgacgatgcttccttacctgcaatcaaggacgatgatacataaacagccgtcgtggcctagccggatctctattacgccgggaagtatgttacagccaccactgggagagccgggaaaaatgtacgagagcgcgagtaatctttctctagctacgttcgcttcgctactgatcgaattcgtcgcgaggcttgagaatctcgtgaatgcgtacgatgagctcagtgtcaaagctaatttcaaagaagctgtctctgagtgaaaaagaggacgacaagtgtatgctttgtatttgtcgaattaaataattattatattgaattgtgtatcaacaaggtcgttgtagtatagtggtaagtattcccgcctgtcacgcgggtgacccgggttcgatccccggcaacggcgatttttttttgttattttcggtttcgtacctcaattttgtggtcttttaaatctagtcccttcagttttctttctcctttttaccttttttggtcgacaccgacagaacaaaatccatttggggataaactataaaccctaattccccagaagaaaagatg

SEQ ID NO: 10058 - DNA, 3000 bp, Unknown
  misc_feature (1)..( 3000): cDNA_ID_2714739_gDNA_ID_2213622_Annot_ID_131986 3000 nt of promoter + ATG
aagaactttgatccttgactggtacttctcctcacgagctttaaacacactgttttgctgcaaaaaagagaactcagaatataaaacatttgaacacaatttactatttctccgaagaaacaagaaataccgttcttagatgttcagattgagttgaaattcgtcgctcgatttcctgcacgacttttctcagcagacatgctacacgctgatcattacagattagatcaaaagatgtcccaagcagcatttgaaaaatgtgtgcatgcatatttgcttttacaagcacgtagcatccataaaaatcatggtcaggattgttagagactcaagtacctgagggagttcaccattctttctctcaatagtttcatcaagaattccattaacgatacttagaagtgactgtgtgggagcattctgcattcaacagaagcatatatagggtattattataaacaactttgaaaaataaactagtatgacaaagaagagaaccagagcctaggaaaagcatataaaaattcattgataaggtacacttaagcttaagcagcaatacatctaaattgtttgatttcatcagttctgaaatctttgcggcttggagatcaaatcgcccctgtttcatttggaaagcctcgtgggacttgtgtcctccatggagcattgatccaggggatgatggatctgtggtagaaataactcattacgtcatattataaagagaccttttctaataacataatgcagacaaatacataaaaatgtacctagagctgaagaattgggcaggggacgttgaaatctggaatccgccagacctttattatgcctttcacgtggagatgatggagagaagggactacggggagttgaacctccatgagagctgcctgattgatcagtgagagaattcatcatcaattcaccaaaggcaaacttatggaaacacttgataaagccacaagtccttcattctctatcaacaaggcctgaaaacacgattgttatataaatcatcaaaccaaatcacatacaaagaagctacaaaacataaagcctagaggaaactaattgaaaccagggaatgcaacaacatgatcaagtaaaaccatgctaatgaaatgcaaggatcattcggatctacctagtagcattctcaaaatgcgaattaagaagaaaatagcagaagagacgaacctacctggagaggaacagaagattgctcttttggtgcaacaagagaagaacggcattgggttcaactaagtcaaaaaaaaaaaacacagtacaattcaccattcagaatatccgatcatgaaaaataaccacaggggaaagcaagatcatctctccaaacctgggaaaatcgcaaggagaagaccaagtcctaacctgccagaagaaaacacagagacgtggatttgtcacgtcaatcagactttttcagactttttttttttaattgataccaaattttccttcttttttttcttcgtctctgtagcgcgaatgtaggaagaagcgcgagtatctctgcttctccagtcgtttatacgggtcgggtcgggtacgaccaggccgggttttaattttggagttttcacttttagcccctgtaatttttgtgtattatgtattgttcgtagtgttttttgtttattgcagatgtagtacctaactttgtttcgaatttatactttcttttttttttggttaataagtaatatatgaaaatcaaatggatttctcattatggtagtacatcaaaatcgaatggattttctttggtcttcttctgtgctttgtatggtagtacacagcaattcctctgtaaaagctcagagcaactatagaatgtatcgccaagttccacgtcctctgaatcttcatctgatgcaactaaatcttgtcccgaggaacttgagggaagagctttagtttgaatttcctcagactcacagctctcagcaggattggtattcaaggtcaaattatctaacatctgaacagagtcatcgtcagcctcaactgactcatgaaggttatcggaaatgggacaggttaattcttgttctgtagcactttcaaaagcatgttcacgctgaaattcagattccaacattgcttctgataaccctgcaaaacaaactcaaatatctcatgacataaattattgactgattcattactcaagattaaatttaaccaagatgagatatctcttgcttgagcttgcgaatggctaggcctgcttgctcctgtcctcttttatcacgcttctcctttgcttttatagcatctgatcttgccgaataatattctttggcaatcacatcgaatggccttggaccagagacctagtatgatttttaaaatcaagatatcacagcagagagagacatcaaaccaggaaaacaagaccaatatggtgttgtaaaactaatttgactgaagtttgcaatttcacataatcatcataaacaaatgaagaaaagtcccacttctacccaatgggaaagaaaatatattgatagcaggtagccacaaacactccaaaaaattgaacaaaatatcttaataaacttctgccataatggatacgcttaatgtaatccctttttcagaaaaaaacaacacttcattaaacacttcataattttgaccggtatttttggtttattaatgaaaataaattttattgagattatgggttgaaaaacaatctgtaattagacacgaaaacgtgctctaagacgtgcatagcaatcataccagatttgcataccatttctttgcaaaattcgaaaacagttccaaatttgggaatctgggttttttcagttcatgattcatcagtcatgacaccatcgtgtctttgatagaaatcataaaccacaaatgcacaataaataatagaatctctcccgagtctttccgtctctgtttacacctctatcaatcttctgcaatcatcggaatcaagaaccagaaatg

SEQ ID NO: 10059 - DNA, 3000 bp, Unknown
  misc_feature (1)..( 3000): cDNA_ID_2714731_gDNA_ID_2213622_Annot_ID_131988 3000 nt of promoter + ATG
tgtttcttcaaccagtttttcaaccacagtacctttctgcaattgtggataaataggttattagatcaacgaaagtctagactgaatcaaggacataacatcagcaagaacataatcaatgtataaaattagtatgatacctctggatcatcaaggagtttaagggcacgtcccgaatctgaattgagcagatctctgacattttcattatatatttccagaccagaaatcttgatagtaaaatctctttcaggggtctggaaacaacagtgaaacaaataaaggtattggtcagaagaactgcatttgacgtctaaaacattgactctgaccaaagcagtgcttaccttaattatgtgattgtaaatatcattgacagctttctccgttactcctctcatggtatatgtctttccactgcttgtttgtccatatgcaaatattgttgctgaatcattaaaaagggaagttagtcatctatgataaatccgagtaaaagacagaagaatcattaaaaagacaagtaccatttatgcccatcaaagcagacaatgcaacattcttaacaccatcttcatacacattctctgttaaactctctggtccaaaaactttatctgaaatcaaaagagtgcattattagccatcaaaaaccgcaggacttgaagagttggaaacatcagatataaaacttcaattaccaaatgtaaatgaggactgatgatgcaaacgttcttgaacttgtggtttagacacaatggtgtggtcatttacacattcccaagcaacttggtctttagctaacagttctctcttattcattggccttaaccttacagtaacaacaatcttctcttccctggatcttgagcttccacctggtgttacagctggtgttctgtccatcttcgaaaccggagttcccggtgtttttatagtcatttccctacaaaatattcccaattttttcatcagatctaatagatcaacttaattctaagcttaaattctcccccaaatctatcagatctatggaaaaaagttcatataaggcaacattgtgcagacttaatccataaaaaggtaatctttagtttttgctcataaaaggaaaatttagcttcttcagattaatttcatcaaatccagaaatgttatattcaaaacttcctaaaaacgtcatttcactaaatagttctaacaaaaacaatagttaagagagatcaaaaacacttacagagaaaaaaacgaacaaatgaatcggagttttactctcagatcaaagagagagatctcaggcagctaagaatgtagaatcgtctcagatcgacgatagagataaattaaaagaataaaagaatattgagaggagaagatagtgagagcggtttctgggtttcgtgtatctttgtggtagaaatgatgaagaagaagaacgggttttgggggttcttttgtctttacggaaacccgtgcagagtgagattttgaatctgacgaacctctaacggctagttctttccacgtttcttttgaggggcttttatttttagcttatttcaaaagctctccccacgttttaatttcttctagaaatcacctttacctcaattttttccatggataattttctcatttactgtttctgcaaattttctctatagattttttttttttctgtcaattatcatttcatctttaattattacttcggtattttgttttttttcttagctgccaattttgatgtattttgtcttcttgtaattattattggcccttaacacaaaacggtcatttattgttattttctttttcatcctctacaattttaatttatttgcagatcaagcgggaaatagtaactactaaccaatttggcgtataaaaatagtaaactacgtttacaccctcattatacttcactaggcagaacctcccctctattgcagcaagtgggattggaatattattatacgagtctttgaggtgtggagtcaaggtcttcggcatgagattttgaaatatctgcaagcctgtatatttcgttttttatagcaactttagttgaatatgtgtatacaaatattaagaaaacaacataaatggataaataaactcaaaagataacacatgtattctcattttccttggtcaaaaattcaaacttcaaaaaaaaaaaacaatcaattctccatctctttgctatttattcaatggtgtgtttttgattggatcacaagtctatcattcagttgacttcataataaagtatatcaaaaccatgttcactcagattttgatgcaattatatgctattggactatttcaccagtctgcaatttcttttacaaaattatgattgaagtccttagtgaggtttaatgaaatactaacataaattttcacataatactcttttgtaattcgattaacgtttttttttctttttgtgtataatcatcagttctcttcattcctttatatatataatgttttcttatattcatcaattttataagtttgcagtcctgttatatattggaagcataaaatcgcagtggaattttcaagaaaaattgttgacatacttaaaaatgttcttttgggtcaaagaattaaaatgtttataacttacaaataagtcattaattaaccttagtcgaacaattgcatttgtatgtaactatgaagtcgatatttataggtatcaactatcaagtcgctttcagtctgtccaaaaaaaaacacactatagtttccaacaagtcaaataaccattaaagatctgtatgaatctctgaccgttcatatacataaataatttatttaggatgtagttataatgtaatcactaatcagcgatcataatctgttttaaattcgccggactgtaattaataaaagtcgtcaccgatcattttgaccaatcttccataaaatccccaaaacctctcaccaaaaaaaaaaaaagaaggctttagttgtcaaaacccaatg

SEQ ID NO: 10060 - DNA, 3000 bp, Unknown
  misc_feature (1)..( 3000): cDNA_ID_2714727_gDNA_ID_2213622_Annot_ID_131989 3000 nt of promoter + ATG
taaagattattaaaagttttggtcaatgacgataacaattctcgaccaatttggtcaaagtatacgttctggagtctgacgaaactaatcttaaatgttaatcacatcaagaacagaaattggtactaatcttagaagaaaagtggtactaatcttagaagaagtaaaagcttgaatctaaatgataaacgactaaccttggttagtgttatcgtcgcaggaggagttgtgaggtctgtccgcacatagacaccggaaactctccgaatctaacgccgaaccacaaatcccaccggaatcaatgcatctccggcaagctttgtcttccatgatgtacctcaaatcgaatccttttctcaaagcttccacaaaagttagttcggaccgttgaagctcgtccttagcagacctcagcatcggaatttctgcatatttcatacaaccttcgtcagaatccgacgatcgcaagacatgatatgtcaccggatcctcgtagctttcttcgcaagaaatctgcaacggagctacgccggaacagttgacgaatacatcgatcgtctcggtgttggagtctaatgtgaactgattcttcccgttgaagttccaaatgtttaggcaacctccgtctagtagactatcatcggcaacggaaattttatgatcctccagattcgcagaaacaacgcgaagagtgatgttcccgatcgctagggttaggttttgatcaccctcgcaggagagtttgaatgacgaatgaccgcagaatttgggtttattgaatccaccccagaacggatacgtggtactctcgaataccctgtgtccagatccacatgtcagattacgtgagcgacactcctcgtactgttgatcggctgagaagcacgacgggaggtcagcgacggagaagacgacgaagctgatgaagaaaaaaaagatggacattgggttttgacaactaaagccttctttttttttttttggtgagaggttttggggattttatggaagattggtcaaaatgatcggtgacgacttttattaattacagtccggcgaatttaaaacagattatgatcgctgattagtgattacattataactacatcctaaataaattatttatgtatatgaacggtcagagattcatacagatctttaatggttatttgacttgttggaaactatagtgtgtttttttttggacagactgaaagcgacttgatagttgatacctataaatatcgacttcatagttacatacaaatgcaattgttcgactaaggttaattaatgacttatttgtaagttataaacattttaattctttgacccaaaagaacatttttaagtatgtcaacaatttttcttgaaaattccactgcgattttatgcttccaatatataacaggactgcaaacttataaaattgatgaatataagaaaacattatatatataaaggaatgaagagaactgatgattatacacaaaaagaaaaaaaaacgttaatcgaattacaaaagagtattatgtgaaaatttatgttagtatttcattaaacctcactaaggacttcaatcataattttgtaaaagaaattgcagactggtgaaatagtccaatagcatataattgcatcaaaatctgagtgaacatggttttgatatactttattatgaagtcaactgaatgatagacttgtgatccaatcaaaaacacaccattgaataaatagcaaagagatggagaattgattgttttttttttttgaagtttgaatttttgaccaaggaaaatgagaatacatgtgttatcttttgagtttatttatccatttatgttgttttcttaatatttgtatacacatattcaactaaagttgctataaaaaacgaaatatacaggcttgcagatatttcaaaatctcatgccgaagaccttgactccacacctcaaagactcgtataataatattccaatcccacttgctgcaatagaggggaggttctgcctagtgaagtataatgagggtgtaaacgtagtttactatttttatacgccaaattggttagtagttactatttcccgcttgatctgcaaataaattaaaattgtagaggatgaaaaagaaaataacaataaatgaccgttttgtgttaagggccaataataattacaagaagacaaaatacatcaaaattggcagctaagaaaaaaaacaaaataccgaagtaataattaaagatgaaatgataattgacagaaaaaaaaaaaatctatagagaaaatttgcagaaacagtaaatgagaaaattatccatggaaaaaattgaggtaaaggtgatttctagaagaaattaaaacgtggggagagcttttgaaataagctaaaaataaaagcccctcaaaagaaacgtggaaagaactagccgttagaggttcgtcagattcaaaatctcactctgcacgggtttccgtaaagacaaaagaacccccaaaacccgttcttcttcttcatcatttctaccacaaagatacacgaaacccagaaaccgctctcactatcttctcctctcaatattcttttattcttttaatttatctctatcgtcgatctgagacgattctacattcttagctgcctgagatctctctctttgatctgagagtaaaactccgattcatttgttcgtttttttctctgtaagtgtttttgatctctcttaactattgtttttgttagaactatttagtgaaatgacgtttttaggaagttttgaatataacatttctggatttgatgaaattaatctgaagaagctaaattttccttttatgagcaaaaactaaagattacctttttatggattaagtctgcacaatgttgccttatatgaacttttttccatagatctgatagatttgggggagaatttaagcttagaattaagttgatctattagatctgatgaaaaaattgggaatattttgtagggaa

SEQ ID NO: 10061 - DNA, 3000 bp, Unknown
  misc_feature (1)..( 3000): cDNA_ID_2714723_gDNA_ID_2213622_Annot_ID_131990 3000 nt of promoter + ATG
atgttgaacaatcaagaaatactctatacttcgccaaccgagccaaggaagttacaaacaatgcccacgtgaacatggtaatgatctttgttccatgcttttggttcatcttagtgcccttttggatgaaaacaaactaaaatatttacttcctgtctattatctacaggttgtctctgataagcaactagtgaaacatcttcagaaagaagtggctagattggaggccgagcgtcgcacccctggtccatcgacagaaaaggatttcaagatccagcaggtttctgtccatttcagatcaccaaaatatataattgaaccaaagctttggtacttagtttatggctattttgtgacattctcagatggaaatggaaatcggagagcttagaagacaaagagatgatgcacaaattcaacttgaggagttacgccaaaagcttcaaggggatcagcaacaaaataaggtctcttaatctacctctctgtctatctactgtactaaatatattcacaagcgttggctgaagtttaaactaaaccttttgttgaatctcagggcttaaatccttttgaatctccagacccaccggtcagaaaatgtctttcctattctgttgccgtaacgcctagctcggagaacaaaacgctaaaccggaatgagagagcaagaaagactacgatgcgccaatctatgatacggcaatcatcaactgctccatttacattgatgcatgaaatccgcaaactcgaacaccttcaagaacagttaggggaggaagcaacgaaagcccttgaagtgttacaaaaggaagtagcttgccatagactagggaatcaagatgcagctcagacgatagctaagcttcaagcagagataagggaaatgcgtactgttaaaccatctgcaatgcttaaagaggttggagatgtcatagctcctaacaagagcgtaagtgccaatctcaaggaagagataacaaggctccattcacaaggaagcaccattgcgaatctagaggagcaacttgagagcgttcagaagtcaatagataagttggtgatgtctcttccgagcaatatcagtgctggagatgagactccaaagacaaagaatcatcatcatcaatcaaagaagaagaagcttcttcctctgacaccaagcagcgcatccaaccgccagaacttcttgaaatctccatgctctccgctttcagcttctaggcaagtcttggattgtgatgctgagaacaaagctcctcaagaaaacaacagttctgcagctagaggggcgacgacaccacaggggtctgagaaagagactccacagaaaggagaagaaagcggagatgtctcgtcaagagaaggtactccaggctacagaagatcaagctcagtgaacatgaagaaaatgcagcaaatgtttcaaaacgcagcagaggagaatgtaagaagcataagagcatacgtaaccgaactcaaagaacgagtagctaaactacagtaccagaaacaacttctcgtttgtcaggttagataaagatcacaacccataaataaaccttttttcctccttttatattttctcatcagttttgaacttacgcaggtgcttgagttggaagcaaatgatggagctggatatagtgtagagaacgaggagaacacgataatggaagatgaagagcagaatcaagtggcgtggcatataactttcatagaggaaagacaacagatcatagagctgtggcatgtctgccatgtctccataatccacaggacacaattctacctactgttcaaaggtgaccaagccgatcaaatctacatggaagtcgagctaagacggttaacttggttagaacaacatctagcagaagtaggaaacgcaactccagctcgaaactgcgatgaatctgtggtttctctatcatcaaggtaatgaatgaatgaataactctcacttggaaaaatgttgttgtaaaagtttcttcaactaatatggtcttgtttcgttttcagtataaaagcattgagaagagagcgagagtttttggcgaaaagggttaactcgagattgacgcctgaggagagagaggagctgtatatgaaatgggatgtgccattggaagggaaacagaggaaacttcagttcgtgaacaagctatggactgatccttatgattcaaggcacgtgcaagagagtgcagagatagttgcgaagctagttggattctgtgaaagtggcaacatctctaaagagatgtttgagctcaatttcgcagtgccttcagataaaagacagtggaacattggttgggacaacatctctaatcttcttcacctatgaagacttattgtgtgtttatgatttgtaaaagtacacgacacttctttgtctcctctgaatttgattaaataagctttaccagactcgtctgattatgtttaatatagtggtctagatttcttaaaccttgtgaggacaagcttgctaaaccctcaagtccaactgctaaccaaaagttgtccaaaacactgcgttttattggaaacaacgatgtgccaacgtggcatatttggaagactctcctcgtctttttcgctggacaaccatataattatctcagctactaaccaacaaataaaaaatcaaaatattatttaaatgttaatgttgttctctcgaatcattccttaagaaagattttcactttccaatttgcttcactgtcttgtcgattctgcttctccaaaaaatttcttctttagttctgagtttttctctgttctgaaaaaccccaaattttgttttttttggccattcaaaatttcagaagaaggcgatacaaaatcgtctttgaattctctttgtttatgatctgttcaagtaaaggaacggtcgtaattgctactagaagctcatttcccagattactaaaccggattcaaaatcgaaatgatgttccgattagtgtcatagctactcgacgatcatca

SEQ ID NO: 10062 - DNA, 3000 bp, Unknown
  misc_feature (1)..( 3000): cDNA_ID_3443632_gDNA_ID_2213622_Annot_ID_195758 3000 nt of promoter + ATG
ccagaatttaaggagcatcgaggtaagagaagtagatgtaacacgggatacttatattagtatataccacatgttatgcatgctttgtttgctaagttctagcaatgatcaacagatctctgtagaaaaagttgctctcaagtcatctgaagtgagagatgaagaaatcagaagagcagttgagatggccgatgctttccttcgggctggcagggagactctaattatgagcagtcgtgaactcatcacgggaaaaagttgttctctatctcaaatctttatatatttgtgtcgttggtataaaatcatgactgaggaatatcatcattaacgggtctatattcattttgacagcatcttcggaaagtcttgatattaacagcaaagtgagctccgctctggttgaagtagtgagccagatatcgaccagacctcgttatattcttgctaaggtatttagcttctatatttatctttccatctcataaacttcctgacacactctgtcaatccccagttgaaatggtaactgttctatgatccaaagcctttcgatttttttttatgacactgtaacgtcattgtttagggtggaattacgtcatcagacacagcaacgaaagccctgaaagcacgacgtgcacttgtgattggtcaagcccttgctggtgttccagtatggaagttaggtccagaaagtagacatccaggggtcccctacattgttttccctggtaaatcttaatttgtattcaaaacatttaactgaataaaaataggtattcttaatcaactctttttccttatatgtaacaggtaatgttggtaacagcacagcgcttgcagaagttgtgaagtcttggtcagtggtagcaggacggtcgacaaaagagctgcttctggtgagtatccttctcgttctctagcttcatatatctcttctcatattgatgttgtctttctatgtaaaacagaatgcagaaaaaggtggatatgcagttggagcatttaacgtgtataacctggaaggaatagaagctgttgtagcggccgcagaggaagaaaatagtcctgctatattgcaggttagtgttctgaccaaaagtggatttctgatatacaatagcaaccaaagattaacattctgttctgagttgttcaaagatgtccgacacaaagagatttgataactgaactttttttggctaccttttttaggtccatccaggtgcctttaaacaaggaggcattcctttggtttcatgttgcatctctgcagctgaacaagccagggtaagtggctttgtaactgtacgttgattctgcattagatacataccaaaattttaggcaatcatgtacttttgaactcgctctctagctttcatctgtggtttttcggaatagacattgaaatcaaaacttaatagctgatcctaaatacccagtacatgggtctgactctgagccccctgattaatacgcacaatgtggcaggttccaatatccgtacactttgatcatggaactacaaagcatgagctattagaagctcttgagctagtaagtttgagatctctatcacttatgtgcaatctctgtgtcatcttttacttattcttatattgaaaattcataccaaatcgatttcttgcagggactagattcagtgatggtagatggttctcatctttccttcacagaaaatttatcctacacgaaatccataacagagttggcccgttccaaaaacattatggtggaagctgaactaggccgactctcaggaacagaggatggcttgactgttgaagactatgaagcaaagctcaccaacgttaaccaggtccttgttggttttaagccccgataaatccaatctctcacctaacaaatttatgttgctaaaccaaactacaatttattattatgagttttcaggctcaggaatttatggaaactggtatagatgctttggctgtgtgtataggaaatgtccatggaaagtaccccaagtccggtccaaacctcaagcttgatttacttaaggtgaattatattcttgtgctgactgaagtaagttctatgagtttgtgtcattcttattctaactgatcaccatgtatgtaggaactgcacgccttaagctcgaagaaaggcgtttttcttgttcttcacggagcttctggtttgtctgagaaccttatcaaggtatgagtcgatcatgtttgaaagtttcttgtttggtaatagaaaactaataaaatcggcgggaaattttttcttttgatggagatcttgatatgaatttaactgaattaacgtctttgtgggctatgaaaattgttgactgaatgagatcaggaatgcattgagaatggagtgaggaagttcaacgtgaacacagaagtaagaacggcttacatggaagctcttagctctgggaagaagaccgacattgttgatgtcatgtccgcaacaaaagcagccatgaaagctgtgatcgcagataagatccgtctctttggctctgccggaaaagcttgagttgttgataaaaaaatgtccgatcaattagttaagtacaattgtacatcacatccaaagaataaaaaaacaacaaatattacatcacatccaaagaagatgaatgcattgtatgcaatgcagatgcagtgttgttggaaataaagaaatcatttttagtactgtttaactgttttttttttctttttctcagtcaaatatataaatagaaactaaatgggcaaatatttaattgttgttatcggataaaactactaattattcatggctataaaatcctcgcaatcttcgccgtttatcttcccgttccccgatcaaaaatatcccaaactctcacacacattctcttcattgggactcatattcttctttcttttctttttctttcttttttcgtgtttttattttgctatctccaagtatttatctttatgacttgctttgttcctatcc

SEQ ID NO: 10063 - DNA, 3000 bp, Unknown
  misc_feature (1)..( 3000): cDNA_ID_3035160_gDNA_ID_2213622_Annot_ID_195757 3000 nt of promoter + ATG
ttttcttttctaaacttgattgagacatagtgcgattaaagtgtagaatgtgattaatacgatagagtagagtagagtagagagaagaaaacgcacatggacgaaggatgggtctgattgtgaagagctgggcgatagggcagagctcgagtcacgacgctacctaactcatcattagacatggcttctccctccgttttgtttttgtttttcatttttatactttgacatcataataataaatttatagttcatctgtttttagaaattccaaaagccaaaaacaaagattacataacataagtcggtaccatgaaacaaacaatatatcatatcaatatatatacagctcaatagttgtctggaactctggatacatttattcatttaattaaaggaaaatttgttagttgccacttttttatacagtatgttttttaatcaaggttttctattgttaaaacaaaagcattataaaaaaacatgccatgtataatcattactgtagatttggtattcagatgtagacagataaattcatgttactcaatagattaacgttataaatttaattaataatttgtagtcgattaagaaaattatatagacttcatatgtgtacattatacgtatacagtaacacacagattagtatcaatttttaggctttatagatgtaagaataactatatcaaattttgttgaacattattagtttttatgtctggtgtatatgtctatatatgtggctgtatgtttacttgcgtatatgtatttgtcgctgtcagattttaaaacagttcaaattatgtgatttgatttgtcaagtgccctggactttggactctacttgttttgttgtttatcgctcgttttgttggattaaaataaattaaatcgaatccatttgatgaactgtcatatggtttagtatatcaataattttacaacacaaagtcactaacactcggataacattattattatactaacacatccattagctagaagcctagaactaaagtgaaaaggggatcttaattagctatcgtcaacatatttaaatcagggaattattattaattacattatctgggagttggaatgtcaaaatcttgacaggaactaaaaagctagcttccaaaaacgttagctattaaattctagctaaggagtaacatatacattttaacagtctttttaaaaatatataactgagatatgtgtatcataaactggagtttgcaaactagttgttcgtattgtaacgttatagttaaaatcttccatattcaggtgcactaatttacatgtttatgactaagtagaagataaaaatgaaaattaagaaccataatacgaccatttataaatctggagattagacaatatgttggtaattaaagagttgttggaagttattagtactattatttggatttcatagtacatatagatcagttataacctttagttgaaataaaaacgttaccgaacatggtctgattaatttccaacaaatgaaaacctagctgataaagacgtgaaataaatatagtagatcatcagaagaagagtgttgccacgacagccgatgcaaagctaagtccaccgaagttgatggccggggctgagcttgttggcttggccgtcgaaggagctgcatttccggttgatccgcttcctgttcctgcgttttaataagaataaaattacattaataatccaaaattttaaaaacttagttttataccacgaaaaatataattctcgtataaaaccctcgcaattcgatttaaatttcaaatatttaaacttctatgtattcataccggtactggtggaagatgccggaggagttttcggggttgccggcggtgttgaagacgaattagtaccttcgttaacacaaaatattgtcgcattaattaggctagatatataagaaataaaaacggcgtgacattaggctaaattaagaaactaattaaaacgacgtcgtagtatggtttattcaccggcgctggttttgcatagtgacacgtcagctttggcgccacaagccttggggagatcgagagcgttttctttagtgaggttaagcgatttgagcatatcaacgttgttaaagacagcgcagagacacgtggcgtctttggctacgatctcattcaacggcatgcaacacgtcgccggcggcggagtcgccaagtgaagatacggctgacacggcatcagtttctgaatacacggcagtgagtgtgcgtctcctcctgcaccgccgctcggtggtgaagtcatctgagcattagacgacgtaacgtagcaaaatacaagaacgacggcgacggcgaatctaacagcctccatttcaaaacgttaaatatctctttgtattatgttctttctatctttagttggttgtgaagatgtgaaagttgtaaaacatgcgtgtggtttatatatgtacacaaggtggttataatttttggtttttgaatttaatccagctcaccagcctgatttttcgagataatcagtttctgatcctatcattatgcattggaaacgaagactaagctctggattaattagaaaatcgttacatttattattacaggagttgccaattttaagagtttagatgtttgttcatatagaaagtgtaatgatatggtaccttaaatggaatgatatcatatatgttttctcacctaacacaatacaacttcttatcatttttttttaataaatatgtataatgtacgattactatttctttttgatcaaaaaagttttgcttttggcagataagttaaaggctaaaaggctgttggatatggacttccacgtaagagcctacacgatgtaacgttacattaatctcaatttgttaaattatagtatcatatatatatatatagagagagacagagagatgcatatgaaattggtttgttgactgtaaattacatcggagaattgtagtgatcggagaaa

SEQ ID NO: 10064 - DNA, 3000 bp, Unknown
  misc_feature (1)..( 3000): cDNA_ID_3443646_gDNA_ID_2213622_Annot_ID_195756 3000 nt of promoter + ATG
ttcctttgaacagaaagaacgacatcgataaaataacactttcaagttgatgtatcataccagattctgagagagaacatcgaggaagcgaccctctatgtcatcttttagcaacaacggaatatgattcttgtaaatcctgaaaacaaaatatacacaagacaatttaattctgtgacagccatggtcaaaatatgggcatgtcaatttggcataaaccttcagtgatatattcaatgggcctaaatgaggagctaaaaacaaaaactatttttcttccagatagatttggtaaacaggaaaccctggtgtagttacaacttacttgcaatagtctattctcaaaacttccagaattagactattcagcttatttttttccgttctctaaatgtgtgtatcttaaagatctactactacaagaaatgttctcaaacctgtgattaataacagtcctactatcaaaagacctttttattactcataacaaaaggaaagtccatgtagcataaagcataccatgaatttccagcagcattggaaattatgtcataaagtatccatggatgcacacccgcctgagaacctaaagatatagcctccacagcagcaacaagatgtatgccctcaagcaactcattcaccattttaactttactggttcagaaagaaaaaaacaatgacatcaattggttttctgtaatgccggggaacagttagaatagtcaaaggtgtttttacacatattatgaccaaaggtttctcatagatttcatgacattaaactcagtaaacaagttgagcattatgatcccaatatgactcgtgacgaggaaataggcagtcaaacacttagaagttgtagtgatcacgagaaggttattctggaaagttgcataccttccagcaccaatttctccctcaaaggtgtacagattttgacacattgctgaatgaaacaaagagattttctcagaaaacaaaatgaaaattcataacgtctacatctggagagggtctatacactagagttaagttttaccagtaagatagggttgtgctcttgtgatcgaatctgaccttccagatgctattatcttaaaagttgaaaagaaaagggttactataagtacggtgacatgcaacttttaacaatgaatggagatcagctagcaatagtactccaccagcataacaaactttgctagacaagagagtatataccattagttttccatcaagaagctcagacatcccttttaaaacataggcatcaactacaaaaatctgctctcttttctctgcattggaaacaaatcccaattgtcacgactgaaaagcacaaacttcaaaatacggtgttgaaaggcaaaccatgcctcaaactcagagtatcaaattgaaacctgtaagttgtttctctagtttctggagttgcaaagtcgatattgtcgaagacaaaagcaatacagcgtccttctgtagacctgcgaagaaatgacgcatacagtctcctacacaataattctgagataaagttcataaaatatgagctaaagaatcttcaggattacctttcataacaccctcatcaccaaaaatgacatcttgaatttggtcagggtgggatagtacaaccacaacggctgctgcagctgcttaattaaaaacaaagacagaggagagaggaagcaaagtaaataacatgacacaagacagtatcagaagtaaacagagtcatgaaacgaagtagcaatacaaacacaacaagacggtttgcatgtacagagtctaatgctggatatcaaatcaaatgctctgaactcatttccatgtatcttagtgtttcaaatgccttataactaacaacacactcagatgctgctatacctttcccaacatctgcagggctgtcacatttgtgtcctcccaattcaatgaacttctccactaattctgtacttatctgtcgaattagatacaacaatttagcttccctccttattttttccaatagacaaagcaaaaaaaatcaacaaaaattccacactactaatcaaatcaatttcacgtgtgtagtgaatgattgaaataaaccagtaaaacagctgaattcccgagagatagaccgagtatttcgaaattactacagaacccacaaatttcacatgtttaattccgaataattgaaccccgatcaatatgatatttccagaacatgccgatccccagaaaaaaaagaaaaaaaaaaaagaagaagaagcaacagacctcgaatgcttgaaccttaaacccagaacgaagaagcgaagaagctaattcgaagctgaaagaatcaagaccaacaaacccaaccacgccactcattttctccgatcactacaattctccgatgtaatttacagtcaacaaaccaatttcatatgcatctctctgtctctctctatatatatatatatgatactataatttaacaaattgagattaatgtaacgttacatcgtgtaggctcttacgtggaagtccatatccaacagccttttagcctttaacttatctgccaaaagcaaaacttttttgatcaaaaagaaatagtaatcgtacattatacatatttattaaaaaaaaatgataagaagttgtattgtgttaggtgagaaaacatatatgatatcattccatttaaggtaccatatcattacactttctatatgaacaaacatctaaactcttaaaattggcaactcctgtaataataaatgtaacgattttctaattaatccagagcttagtcttcgtttccaatgcataatgataggatcagaaactgattatctcgaaaaatcaggctggtgagctggattaaattcaaaaaccaaaaattataaccaccttgtgtacatatataaaccacacgcatgttttacaactttcacatcttcacaaccaactaaagatagaaagaacataatacaaagagatatttaacgttttgaaatg

SEQ ID NO: 10065 - DNA, 3000 bp, Unknown
  misc_feature (1)..( 3000): cDNA_ID_2714705_gDNA_ID_2213622_Annot_ID_195754 3000 nt of promoter + ATG
cggccaaaaactgtaagaaagtcaaatatatttttctgcttataatcttaccgccttgattcatgctttttcactgaattaagaatatttagtttctaaatgacctttgtcacaacaaaaagtcacacttagatacacgcattttctatttgtaattttctttgtttggtagagcgaaacataaaacaaactaaataagctgttctcataagggatgaatctgattaattatcgagtttgacttgattatatgaaaattaattatgtagcggccatatatatgtgcattaatgaattagtgttgttgaaacgaaaaccttactttttgtagtttaataagttaaattatatctatcagataaagtcccaataaagttaagaaacgacaactatattacgaagagaaagaagatacacacagttgtacacaaccagctaacaaaattaattaatacttaatcatcacttaatccctaaactaatacaactatatatataagcataattataaagccagcccattcttctaaacgtctttctctctttctatttctctttctctttctcttgttcgtctactctgatcacaataatgggaaacacatcttcatgcgcaccattgatcatatcaacaaactcatcctcaggagtggttaaaatcttggctccattcaccggaactcttgaagttttctcaaaacccatcaaaacctccgacatcgtctctagacactccggccactttattaccgactcaactttactccaaatcagccaccgagtcaccgccgtgtctcccgacgaatatttacggccgagacgacatctctacctcctcctcccgaccgacatgctcttctctgtcttaacacaagaagaactttctctcatctccaacaaagccgcggagacactcaacaaaagccggtataaccatttgaagagaatattcccggtctgcatatttccgatgaccggagacagaagaagaaacccatcatcagttaatgaagatcgagctcatgatggtgtggaaataagagaaaccctagatgagaaggtactatacgaatcaaaacatggatcttggaggcctaaattggagacgatcgtggagagctaaatgcctaaaatctcgaggatcattaaaatactatatatataaacaaatcaattttcaaacgtagacgagtattttgttcttttatttttcctgattttttgtccgactttaaagagaaattgaggcttatatggttttgttcatgatttgaatattcgtgtagataatttagtgattcaattgtgtaattataggtttatttaatttatactggacaagaattggataaaaaggatattggtcaacgaatcaaagaattgggttttttggtaatccagattttaggtacagctattttggtatttggtacgtatttatatatagtatacatatattttcaactttggtatgtatactttgtcaaaataaataaaaaacacttaatgaccaaaaaaaaaacactatggtacgtatatatgtatatatccaaattttaattaaataacctttagaattttattggaactattcgcagatactctgaatataaaagatatcggcagccaattcaataattaaaagaggataataaaaaggacctgcgcagttttttggtagtaggccaaaagtctacctaaactaaacctatacgagaataacctagattgattatttcattctcatccatcataaaattttcatatccaagcaagcttttaccatttatcaaaaaaggatataaaaggtaagcttttaccatttaaaatttttaaacattaaaactttagaaaatactttataaacatagacataaaaaaaattgataataaatgttctattaatcctgattataaccatctttatgagaataagaagtaaacttttagccattttttggggtcgtattattactcttagtaacctaccattcaacatcattgatagtagtttgagtttcaattatcaaagaaaagaaaaaacaatgaataagatagaaaacttgtagtgtaatggcccatggcccatttataagttttttcagcagtaacaacaacgtttgggcttctagaagaaagcaacaaaatgtgactatgtgagtcgttttatattagttgagataaatgttgataaaaaaagaaaagaaataaaaaggcatcgcctaataccgtgtttgcgtcagggacgagtttgtggatgaccacactctcttactactaaactaacaaaaacacttgctcagcttcttcacgcaccgttgatgcgcgtatctcacaccattcctgcattttcttctccgtgtctgtgccgatgtttttttggtggtttacgagttgaccttattttgttgtctttttgtaggatatctaagtttgatttttctttgacgaaaaaacattaaaattctagaagataaacaaaatactcgtgtttattttgataagtgggaatacgtaaactgctcatttaatagtgtaacatattaaaggcttttgtgtcgattttgattgtttatttggttattaccattagtgaaaccaaaatttggaatccattaggaagagttgtctcattaacgaatctcaaaatacagagaaaggagttacatttcagattccaaaccgaacaaaaccgagaactcaattacaataaccgggaaagttgagtcaataaatatgtatactttcgatttagcaagttgattagataaaaaaaaaaaaaaaatagttgaagcgcgtgggaagttccatataaaaatagtcctaaaaccaataacgctcttaacaaattcacatctccctctctcttatccatttcctctctagacttccttaaatcgattctcccgaattcgagaacagagcctttttttctttaattccaactctttctctcttgttctgaattcgtggttcgtcggtattataaaaaaaaacatg

SEQ ID NO: 10066 - DNA, 3000 bp, Unknown
  misc_feature (1)..( 3000): cDNA_ID_3035172_gDNA_ID_2213622_Annot_ID_195751 3000 nt of promoter + ATG
tgaatcgtcagatgaatttcaatagagcatatttctgatcatacaaaaattctacaaaaaaataataattgcgatttgggtcacccggaaaatatccagacccgtaatatcacaagcagtcggatctaaagactttcacggagaaaagggtgaccgagaagctgcgacgccgtccacctctcactcgattctttacggagacaacagtcaacaaaactcctaaactcgtcggaacatccttccggcgcacgcggtggttctccaaagcacacgacgcacattaacgtcgcccagtcaggtctctgtccctgaggaagcaacggaaaatgtccgacgaagagctcaagtatcatcactccgaaactccagatatcgcctgcgtaaacatcggagttttctccggcggcagagtcaaatctctccgggctcatgtaagcgcaagtgccgacgtaggaattgcagtaatctaacgatcgggtaatgattttgctcactccaaaatcagcgattttaacttcgtttctcgagtttaagagtagattcgcaggtttgatgtctctgtgaacgatcttgagtgagtggagataacttaaacctttcaaaatctggcgggaaaatcccgctagttgtttctccgtaacggcgccgcggagagattctaggtttccaccgtccatatactccatgaggatcgaaacctctccgacgattggtttctcgaagatcccttgacacctgacgacataaggagaatccgtgcgacggaggatctccatctcgcgcgctaattgtcttgtgaaagcaggactcatgtcgccgttgactgatttcagagcgtatatctcccccgtggttttgtggtggactttgtatacgatcccgctgcttcctcttccgagaacgtggagtttctcgacatcggaagctgagattccgttgttgatgacgggggcggtggatgaggcaaaggagaaccaggggaggtgaacagagagcggtgggacagggagacggaggttgatttgacggcgtttacgaacaagagccatggaaatagaagagagagagagagagtgatgatggtgatcgaagagtgatggaagttgcagtttttatatggagacttgagtgggatttaagtgaggagcctgggaagctaataaatctttccattaaatgttaatcactcttttttgttctttatcttaattattatttgttgagttgtatctaaaaatggcaactagtgtgtctaccgtttatgtttatcttgcacgaggttaaatgcatgggactgctatctgtcctacttacccggaacctggctatagtggcttgtgtatattgagataaatctacgcaataatgattagatttatatacatttaaagagtttgttttagtgattttgaatggtaactcaattatcaaagtttgttacagcctgtatcgtgataattacaaattacaaaggcgttataaaagcgttacttttaacgttttgcattaatgattagatttatatgcatttaaagagtttgttttagtgattttgaatggtaactcaattatcaaagtttggtacagcatgtaccgtgatattacaaattacaaaagcgttataaaaacgttatttttaactttttgtactacttatttatatagttttgcattctaatttacagctaaaacaactttaaagctttgtgttacctatcagaatcgttatcttcacattcaaacacataatccattgttgttgaaaaataataatactttcaaaacatttattttagtgatattaatttgacttgatagtaagattattatttactcataaagacattggtggaatttagttatataattttcatatactaaactataggagattttaaagtttaatgtgaatttgtgaggttcaatgtacctcggaggctaaggacttctaatgaaaatgaccaaacaataagttatatttaggccatcatgcaaaagctttccaatggccatcgccattaatattgccaagttaattattaatatgattttagtaaaaactatgattagatcttcagattcttagtggacagtcacacatgaccctacggattacaagtatttagcatgtcgattgtcatgcgcgtatatatccaaagaatactgaataaaaataatatgaagtcaatcaaatgaataacaatcaaattatatgaagtcaatcaaacctttatgaatgtgatttgcttctttttccaaccaaaaaacttgtttgtttatttgttagttgttactcccaaaaaaatgtagtaagctttttatgccccatgtattatatatcaagacgatctccaaacatgactatagtttcataggatggattggatatcaggacatgtgtgaatttactaatttttagtattgaaacaaacaacatttcaaccaaaattttttaccattaaaattaatatatcgacgtccgatagtataaagcttgaataaactgaatttcgtatcagtagccagtttgaaaaataaatttgttccttgagattttggtgttcttttccaaaagaaagaacaaagaaaacaaaaggcccttgtaaaaggcggtttagttcataaagaaaactgggcctatctaaaaatttgaactaatgccatatttgggcttagtaagcccggcttacgatacgacgtttatagtcggatctgattcggatccaaacccgtttgatggatccggctcctaccaaatcacttcagatttctgtataagctaaaaatccttgaatttttcagtaagttactatagcatccgagaatttcattctttaactctggttcgtaatcggaaaactcaaagacctgttgtgaagatatattggagaagaaaaaaaaaacgatttcccggcactgaaatagcattatcagatctcgttcccaccgggaagatttcccggcacactgaaattctgacttggaatcgtctgtgaaact

SEQ ID NO: 10067 - DNA, 3000 bp, Unknown; identical to SEQ ID NO: 10060
  misc_feature (1)..( 3000): cDNA_ID_3035180_gDNA_ID_2213622_Annot_ID_195748 3000 nt of promoter + ATG

SEQ ID NO: 10068 - DNA, 3000 bp, Unknown
  misc_feature (1)..( 3000): cDNA_ID_2714731_gDNA_ID_2213622_Annot_ID_195746 3000 nt of promoter + ATG
tgatatgtggttataataactaaccagtattttaatagattcgatttgatttatgatgctcttcgcaccatcaaaagatataaaattctactttggcaaagttatgttatgctctgttgtttcgttaatcatcccgctcaagttttaacagattacaaaatccatctcaggtgcatccgctgcggtcgtaggattaatagctgcgagcatattttggtatgtataccatcgtagaaaaacaaaaagttacagaaattcttcagcattgcttccaagaaacatctcatcagatccatctgcaaagtcttttgacatcgagaaagcagaggaattattagtcggagttcatattttctcttacgaagaacttgaagaagccactaataacttcgacccatctaaagaactcggtgatggaggctttggtactgtctattacggtaagcttaaagatggacgaagcgtagccgttaaacggttatacgataacaacttcaaaagagcagagcaattcaggaatgaagttgagatcttaacgggtttacgccatccaaacctcgtggctctctttggatgctcctcaaaacagagccgggacttactgctagtgtatgagtatgttgcaaacggcacgttagctgatcatctacatggtccacaggcaaaccctagctcacttccttggtctattcggctcaaaatcgctgttgaaactgcctctgccttgaagtatctccacgcctccaagatcatccaccgtgatgttaaatccaacaacatccttctcgaccaaaacttcaatgtcaaggtcagtaactcacactggttattactcaatctggtgggattttatcggatcataatcttaacttctttctgtgttttttttactgttttcgacattttaggttgcggattttggactctctagactgtttcctatggataaaacgcacgtatctaccgctccacaaggaactccgggatatgtcgacccggattaccacttatgctatcaactctcaaacaaaagcgacgtgtacagctttgcggtagtgttaatggagcttatctcttcacttccagcagtcgacatcacaagaccgcgccaagagatcaacctctcgaacatggcagtcgttaaaatccagaaccacgagctccgcgacatggtggatccgtcacttgggtttgacacggatacaagagtgagacagacggtgatcgctgtcgctgagctggcgttccaatgcttgcagtcggataaagatcttaggccatgtatgtcgcacgtgcaggatacgttgacgaggatacagaacaatggatttggttcggaaatggatgttgtagatgtgaacaagagtggaccgttggttgcacagtctccagatagtgtcattgtgaaatgggacagtaagtaaaattagtcgcacggccactaacattgtatgtgtttattatttgtatgtttaaaattgtcagttaacagttagagaatggtgttcgtgttctgtattagatgatatttttgggaatgtatataatgatgatcttgttccgattccacctagagagggaccgtaacatacaaaacttcgtgattgggcctgaccggactaaatcagcaattttgtattgctatttgctgccaactgaaactatttttttattagtggttaattttatttttttacggaaaaggtaaaaatatttgagacatcaaaataatgatggtaattaagtaacgccagctcagcgacggcgatgactatccaccaatttaacgtcagaagaatatatatatgtatattgagcttatcttctgtttccaatgtaagtggaaagtccactgctgcaatcacaatgtaagacctgcatctatgaagttttaatgaaagacactttcagagaaaaaaaaaaaaaacttctgtttccaaaatttcctaattaaagcacaccaatttgggcatggatgctttactacttctattaatgaacaagttaaagagtaagttgtcttgaatgaatgaaattgcatgtgaatcaaatccctccaccatacataatagataatctatagtaatggcccaactaaacattgacatttgttgcaacctaactctttcctaaaaggaagaaaaaaaaaaaaaaaaaaaaactctttcctaaaactcaatgtgtttgatcatcacaaggacaaacaaaggaaatctctagtatgccgattaaagtgaaaatttgtcttcaccaatataaataatttggtaacttaaactttaactaaagattcataaattggcgtcaacttatgtaaaagaaccttcatatatactttcgtttatctccctatatttttatacatacacatatttatagtatttttgtcgattaattggcattggccatttggaagttataattaagttggcaaatggatgtgatctcttaccctatacacctacataaaaaaccctccatgcaaaacattaatggatgttttcattaaaacaagttttgatatcaacttagtttgactagctacatccatttcaatattttcttcccaatattaataataaatttaaagatagaccactagttcttaacctcacaccaaactgactagaaatgttcttcccccttgcaaacagagaaagcctaatggaacccacgaccaaacattggtcctacttttccttgtttggacatatctccccgacacacaaatcccagaacgttcacttgcccacgtggctctccctttatttctctctttttctttcttaattttctccacatttctttttctaaaatcataaattaaattaataaaaaaatccaatcgaacaatataaaagtctcaagttttgtatcaaccagtctaaagaagttgtcagaaaaaaaaaaaaaaaaaagtgtcaagaagatcatatctcaattcattatattatggcaaatttcgagaatctttcttctgattttcagacaatagccatg

SEQ ID NO: 10069 - DNA, 3000 bp, Unknown; identical to SEQ ID NO: 10058
  misc_feature (1)..( 3000): cDNA_ID_2714739_gDNA_ID_2213622_Annot_ID_195744 3000 nt of promoter + ATG

SEQ ID NO: 10070 - DNA, 3000 bp, Unknown; identical to SEQ ID NO: 10057
  misc_feature (1)..( 3000): cDNA_ID_3035192_gDNA_ID_2213622_Annot_ID_195743 3000 nt of promoter + ATG

SEQ ID NO: 10071 - DNA, 3000 bp, Unknown
  misc_feature (1)..( 3000): cDNA_ID_3035196_gDNA_ID_2213622_Annot_ID_195742 3000 nt of promoter + ATG
tccacttctgctctatatgctgtgaaagtctaccttgttctgtatggtgtataatttgagaagcactgatgacactttattgtatttctagcggtggaggatccacaaccatttcaccggtgcatgatggttatgttcttcagaaggtacttgtattacacgatttagtaagaattcagctttgtgatgctgtttctttgggtttggattttgtactgcaggagaaagtttcccatctctcgtttccatagtcatctgtagctgctataaattctcatccatgtgaattatgacctacagcattgatgtagattgtgattctccgattgttgaccatacttttattcgcaggctgttgtatcgtctccacttggaggggaatttctcactgactgcctactgaaaagcttggagagtaaaggaattaaagtaggttaaaaaaattcttcactgttcttttcttttaagccaaattatctgagtgatactggttattttttctgcagataagacctagatactctttcaagaggaaggaagtacgagcaggggaattccaggtgcatatgtggatcagtgaatgaaactactagcagtgaatagtctctaatttcctccctttgaatccttgcaggttgaagatgtggatattcctgacaccacggaaagctacaaactcttctgccaggtctgtaattgattatgaaacttcgtttgaaaatttcagttgtgataatttggtgatttgtttcaacagaggatgatagtgggtgatatcaaggattccatttgtcgagttcctgatactccctatgacggtaccttatgttattctgtctgtctctggtttcataaatttgttttatttcaaagtttaaagttgcttgagagttgaacgttagatactttttatctttcaatgtcatttgatcgcatagccttagtttttctgatgtgatgcatttatctgcagataaatcatattcaaacatccctactacgtcgtacgagcttcctgatggccagtaagctcagtttatatgtctatttcggtttatttgtgcctcaaatgtacatgctactgttgcttttgttttctacgtataaggtttgagcttagtttctagccaaatgtaccactgctctgaaccttgtttaagctgagataagtgcttagttggatctgagtcattaaagccattgggcataaaagtttagaagagtcagacattgctttggaaacctgcatggaacctaatgttcataatgagaattaagttaaaagaaaaagtgctagcttcattgaagacaggaagctgcacctgtaatttttgtagtctttctcaatatcttattaaccatgtctgttgaaggacgctcgagattggtgctgataggttcaaagttcctgatgtgatgttcaacccgtccatagtccaggtacaccatttgagcacgataaattcaacagaagattctgaagacattttgtttcttatcttgagcgttttgagcctcgaattatttatcaaaggtttcttctccgtttttattgcaatttgcagacgattcctggaatggagaagtatgctgagatgattccttccgttcgtgggttaccacacatggtatatgcatggtatttagtcattgcaaagcttccatctcttaactttttctaactttactctccattttactgacttgtacaggtcatggagagcatcaacaaatgtgatgtagacatccggagagagttgtatagtagcatactggtaaaatagcaatcaatgccaactcttaaatacccctacttttagtttcgttggatgtggatgattaacatttcctttcttctcgcattatgccagcttgctggtggcacatcgtcaatgcaacagctgaaagaacgtctcgaaaaggacttgatcgaagtattgtgtcctaaactcttttcctctgtctttaaagctatcccagtttttatgatggcgaaaatcattcattggtccctctatctttgtttcaggagtctcctcactcagctagagttaaagtgttggcaagcggtaacacaacagaaagaagattcaggtctggatttagtgttcacttcttcctctataatgagacccaaatttttttgcttggatcaaccaacaaacatgttatgtatgtgcagtgtatggataggagggagtatattggcatcactaggctcatttcaacagatgtggttctccaagtctgagtaagtctctgttctgattttccattaatcagactcgcaaagaaactatagtttgttttctctcctgacactcggatttggggtcttggtgtaaatggcaggtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctattttaaaaacataaaaacatgtggaagaagtttcgttgctttattagattttcgcacaatcaagaccgtccacgttttgttactacgaaccaagataatccacaaaattaacaagaaaataacaaatccgaaactacaaaaagcagcttcataagttttctttttcttttttaaaaaagaagaaaaaatcagctttatcgtgcctctcaaaaagctaatgacttcgaagttccaaaattccggtcttcgaacatattttatagaatagcaaaatgttttgaaccacaagattattaataatataaataatgtaattgatattggtaagtaataatacttttattaatcataaaatggtctgaataataataaagacaaaatggacgtaacttctccgccactacagacttacgtgtcatgtctccatatccgcatgcaaaatccaatagatg

SEQ ID NO: 10072 - DNA, 3000 bp, Unknown; identical to SEQ ID NO: 10054
  misc_feature (1)..( 3000): cDNA_ID_3035216_gDNA_ID_2213622_Annot_ID_195737 3000 nt of promoter + ATG

SEQ ID NO: 10073 - DNA, 3000 bp, Unknown
  misc_feature (1)..( 3000): cDNA_ID_2714711_gDNA_ID_2213622_Annot_ID_131993 3000 nt of promoter + ATG
gaagggttctatgggtctgattggcctatacaagcaaaggtgaagcgtaaggagatgtcttccgctgatgcacattatatctttgtgcgtgagctgcgttttggtaaagcctatgagacatctactcaaagaacttgcatggaagggtgtaatcagatagctggatttgtgcattaccggtttattttagaggaagagatacctgtcctttatgtgtatgaaatacagctggaatcccgggttcaaggaaagggactaggagaatttttaatgcagttgattgagctcattgcttctaaggttgattccaaaattagtctcttatattcctatttttcgatattgatggcattagcttctgttttcagattcatagcctgatgataatattgttatgttcgttttcatcttctcagaatcggatgagtgcgatcgtgctaactgttctaacatctaatgcattggcaatgactttctacatgagcaagttagggtaagaggtacaccttttggaagatgatcttatttcatgtaacaactcagatgatattttttgcaagtgttcatgggttcctaatatttctgtttcttgctgtagtcagtcatttctatttctcgactctttactgatattggctcgtccaaacatctgaattcccattcgtttttatacagatacagaatatcaagcatttctccctcaaaagctaatcttccggtacagaatcagtagtcttatttttcattattttgtataaggcattcactaaaagaacttctacaattttttgtgtttgcagactctctcggtgaagtatgagatactttgcaaaacttttgattccgaagctaaatctgtgttggaggtttgccctttcgctgcaccactcacatttatgacaaaactgctgatctaatataatatgtgagtgcttcttttgctttttatcttggtattgtattattaagactgctatgattgctttattttgcaagaagaatgatgaagaacctaccaaagattgagtatcaagcatggaatagcacatatagattcactgtaagtttccactttggtctactggagatatcagcaatcgtttattgtttagttttctgaaaaatctgttgcttgaatctgacagaccacagaggggtgtgataagatgcatttagaaaacagacgaatccgatgaagacttggttcctccaatgacttggttcacaccagaggcagatacagaactccaacaatgcctagcaactgccaaattgaccattttgaaacctgagtcctcgcaacaaaccagtcgtttgcaaccagcggagactaaatttggtaagctgtgagtacttctaggctttcttaaccttacggggagattgtgcagttatatactaggactaggacttagtagagtgagaacaattgttgaatttggttttgatataatgaatcagagagatatcttttcttttacaaaattgccaaaagtattgaatcatgagtgcttgaaccttaatttattgtagatagacaaatgtgagatagaatatgaattgcgtaacatagaaggacttaaggacctcattatcatataattaaattgaggaaaagatcttgttcttttttcatagtttggggtcagaaagcgatcattttaatttaaaacatataatgtatatatcaaaaatgaaacaaaaagataataataaagagaggaatggggtgatctgtccgtatcaaaattgtggctctaatagtttgtgtgattaagaaatatagttgtcacatccgacaccatgtgatgcgacttgatttgcccattatcccaaccattttataatcttttgtcatgaacttttctttcatacagttttataagactaaagagatattttgaaatcgaattactacataatacatatcaattactcaagtatcaaatcatctaattaatcaagtgatttttttaactcaagaataatgtatttttccctttacaaaaatcgaaggttacaacttacaaaactgaacaatgagactagttttggcctttttgggggcaaaccggcaaagagtaatatcacgaaagcaagtggaagtcagagacggatcggaaacacacaaaaaaaggatatcttccaaataatcacaaaaaaatatcttcttcataatttgctaacgtttcacattttttatccacagaatctttttctgtacggattagagaaacagatcagattctttgaagaagacacagcgcgtggtgtacactagcgagagtgagtgttagctttgttctgagccacaagatatctctctctcagtgtcaaccttctcgaaatttccatgaacattaaataatgataaaaatctgaatctgacgtggcacatctctgctatttaatataaaaaattggtcacttgctatttctagtaccttctttctttcttcactctctcctgtctcctcttctcactgtttcctatttcgtaattttctcgagaaatcgtcttttcttgtttacgctaatttgatttctcgagaaaaaaaaaaggaagcagaagaagattcttattttatctttacactgttcagaaatcttcggtggacggataacttgcagagttctgattgaggtttctttttcttttccctgttttctcttggatcttgtttcttcatgtgcggactatacaaaaaactgattcggtgaaattaatcagctttatgctctgttttgttcgctttcaggctggttttgtgagaattatagttgcagcaagaaagcgtttcagatattttttaatggccgctgaggtaataattgactagagattgatgaattaagagtagttattgacgcttatagaagaagtagattctatatgaagaaagtttctttttttggaagaacttgaagtaaaagccatttaatttcatttcttgtttccacttcaggatcgaagtgaggaactaagcagcaatgtagaaa

SEQ ID NO: 10074 - DNA, 3000 bp, Unknown
  misc_feature (1)..( 3000): cDNA_ID_2714708_gDNA_ID_2213622_Annot_ID_131994 3000 nt of promoter + ATG
atccattgcagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctagttttagccattgtacagtttggagtcaattttgatgatccgtgaacattgttttagccatttgctgggtgacttggatcatagcattccacgaaccaaatcctaaatccgagttggtaagtggttttacttgtccgccacatgtaattcttgtaatgaagtttctcctgctgtctcacgttaagaagacacttctttttttcttcatatacaaatcagttttaacagtgtatttgtttggccaactattcctagctctgtttcaatcttaggtctggtttatgattattagccttaagaccagtcttaatgttaaaaggtttttacattaagcagattaatatacgagtgaaacttcaaactctgagaattgaaacattgtgcaaagggaaccccctaaatttctgtggacacttgcttaaaaattggagccctcaagtctaattcacttacttaaatattggagccctcaaagtctaatgaaatctatgataaataacaacaattgaagtatatgcaatcaacacaagccttgcttattctatattgaaaagtgtaattctagcttctatctccctgggttcaggtgatgaactgtatcactatcacagaaaagaagcagcaaaaaaatctcagcaatggcgtctgttagatatctcactggtttatgtatgcctatcaaagaacttctctatgagtacagagaaaattgcaaatccagcgcaacctatacacgcagcttttggcccacctgaaacaagaccaatccattaagtcctcaagaacacatgtatcatgtaagagaaatcaaacctctacgagattacagtttgggaactaggccgttgcatattgataatgaatctctaagatttaaattccatgcacagaagataataggtcttacctcgggcggacattgaaccaccggtaacacatccagctatagcggtgtttacagtgtcatgcttagctcttgcctttttcagagaggtaaaccaaaaaagtcgataataaggttttgaagttacgatacatgagttagtagtggaatttccttgtttttcttggtcaataaacaaggtattaccttttcgacaatgcattctgcagcagagaaaaccaaacccataactgcaaatgtcttacaggaattccaactcctttgccccatttgttttgccgtgaacacaaactgctacctagccgtcatagtatcatgcgtaataggattatctaatgcccccaggaacaaacccatcatcaacccgagtcctcctcctacaccacaattcacacagaatgtgaacaaatcaattgaatatccttcacatgtctaactgtcatatcaactctacaaccggcgagcatttatattagtagctttataccttttagagtatttataataatagattcgatttgagatttcacatcatcaattcacctaaccaaatccgattattaagtgcaatctgaaagtgactcaataaccagctcagaagcatatcaccattagaaagctaatcactttaccaatttcactattctcaaaccaatcaaagtacctagagcttttagcatttttggaaaagcaagagcaatggagcaatatagatcgagaaagagaggatatttgaactgacccatgactccactagttacagcacgaacggcgcagttgttccaaacctcttgagctcggatctcctcgatggttggcatccggatcggttgaatctggtagagttctcatcagaagccgcggggggagaagaagcaccggttgttgtttcagcagcactcgaatcagccatttcaaaggttaagagagtaggatccgacaagggacaatgtcatcaaaagcttaaaagaaggggattgtacgaatcagatcaagcgtgttcgttcgcgtgcctgtgagataaaattaatcagggtttatcccgaggttctagggtttaagctacagctagctaccactttaggcccattagtctacattttgggcctgtacactcgagccttactaaggtccaatatatgtatccaattaggttttgaggatatcaagatgtgccacgtggcatattgcttttcgaaagaaaaaacgtctacctagttcctacatatgcatgccgcttcaaattccccctccatatatgctgctctaatctcttttcaaaacaaccaaagacagagatcagaaacatcaaaaatcaaagagcgaaaccagagcc

SEQ ID NO: 10075 - DNA, 3000 bp, Unknown; identical to SEQ ID NO: 10065
  misc_feature (1)..( 3000): cDNA_ID_2714705_gDNA_ID_2213622_Annot_ID_131995 3000 nt of promoter + ATG

SEQ ID NO: 10076 - DNA, 3000 bp, Unknown; identical to SEQ ID NO: 10064
  misc_feature (1)..( 3000): cDNA_ID_3443646_gDNA_ID_2213622_Annot_ID_131997 3000 nt of promoter + ATG

SEQ ID NO: 10077 - DNA, 3000 bp, Unknown; identical to SEQ ID NO: 10063
  misc_feature (1)..( 3000): cDNA_ID_2714698_gDNA_ID_2213622_Annot_ID_131998 3000 nt of promoter + ATG

SEQ ID NO: 10078 - DNA, 3000 bp, Unknown
  misc_feature (1)..( 3000): cDNA_ID_2714694_gDNA_ID_2213622_Annot_ID_131999 3000 nt of promoter + ATG
tttcgtagccatagatggacagatgaagctatatcagaaacgtttggtgtcgtctgtttggtgtcttattaagctgtaagtaacggaaacgttttattttatttataggtttatgaaacccttgctggaattaaagtcgaagggagacttcctgttctgaagaaacaagacctactgaaatctcttccagctgaatggccttcagaccctacaactgacatacatagactaaatatgggaaactcgaagacattggttgttcttgatgatgatccaactggcacacaaactgttcatgacgtagaggttttaactgaatggttagccttgcatctttctctatgaaaaactgaacttatcgtgtcaacaaaaaagatatcatgaatctttcactgaaataattggcaagtcgctagcctagaaactaatggaaggaattgataattgcttattgcttttccctacattttgacaggagtgttgaatctatttctgagcagtttagaaaaaagcctgcatgcttcttcattttgacaaattcaaggtccctgagccctgagaaggtcaagacaatttttattttgtgtaatctacttattgcagagtcccaatttcatggaacaatgaaactttatttttacatcaacttcaccaatgccaagctctaactgcatatttcatcaacaggctagtgaattgatcaaagacatctgttccaacctatgtgctgcatcaaaagaagttggcaatgctgactacacgattgttctgaggggtgattcaacattacgtggtcattttcctcaggcaagtttggtaaccctatcatgaaatagcagactatcatgtcaatgttatgatttcagcttggcatctgtttctgtcataacttgatattatgatccacacacaggaagcagatgctgctgtctcaatacttggggaaatggatgcatggattatttgccccttcttccttcaagggggacgttatactattgatgatgtgcattatgttgcggattctgataggtatgtctttgtgagcaacgtgtgtgtgtgtgtgtgtgtgtaattttttcaaactttcagaatcagggaaaagttcccttcagaggatgaagattgatggtcttcattttgaatattgcaggctcgttcctgcaggagagacagagtttgccaaagatgcatcctttggatataaatcctcaaatctccgtgaggtcttaattcttccaacaagggaatcatcttatgttatttgaccctttaagaaattaatagtaaggaacaatttgatatgatttcagtgggttgaggagaaaacagctggcgtcattccggctaacagcgttcagtcgatctcaattcagcttttaagaaaaggtggccctgatgcagtgtgtgagtttctgtgcagtttaaagaaggtaaatttttctaagcagatttcgcgacgacttctggatgttgctttccgtgaacttttggtcttcatagttgtggaatcagttagtcccagttgtgtagaaagtcttaactctatttccatttcatatgtaaatcaggggtctacatgtattgtcaacgccgctagtgaaagagacatggctgtatttgcagccgggatgatccaggtaagccgcccaattattcttctagtctttttagtttttgaggcatattcaattagaggatacatttatttttctcttatattcttggtcccttcgttcgattgaacattatatttggcaggcagaactgaaagggagatcctttttatgccgcactgctgctagctttgtgtctgctctaatagggattattccaaaagatcctgtgttgccaaaagatttcgaatctaacaaagaaagcagtggtgcactaatagttgtaggctcatatgtcccgaaaacaacaaagcaggttagattatctactaacaacactaatttctttgatatcttctcaatgaaataaaattaaagagccctgagtcattttcttctaactaacaggttgaagaacttcaatcacaacataaccagaatttaaggagcatcgaggtaagagaagtagatgtaacacgggatacttatattagtatataccacatgttatgcatgctttgtttgctaagttctagcaatgatcaacagatctctgtagaaaaagttgctctcaagtcatctgaagtgagagatgaagaaatcagaagagcagttgagatggccgatgctttccttcgggctggcagggagactctaattatgagcagtcgtgaactcatcacgggaaaaagttgttctctatctcaaatctttatatatttgtgtcgttggtataaaatcatgactgaggaatatcatcattaacgggtctatattcattttgacagcatcttcggaaagtcttgatattaacagcaaagtgagctccgctctggttgaagtagtgagccagatatcgaccagacctcgttatattcttgctaaggtatttagcttctatatttatctttccatctcataaacttcctgacacactctgtcaatccccagttgaaatggtaactgttctatgatccaaagcctttcgatttttttttatgacactgtaacgtcattgtttagggtggaattacgtcatcagacacagcaacgaaagccctgaaagcacgacgtgcacttgtgattggtcaagcccttgctggtgttccagtatggaagttaggtccagaaagtagacatccaggggtcccctacattgttttccctggtaaatcttaatttgtattcaaaacatttaactgaataaaaataggtattcttaatcaactctttttccttatatgtaacaggtaatgttggtaacagcacagcgcttgcagaagttgtgaagtcttggtcagtggtagcaggacggtcgacaaaagagctgcttctggtgagtatccttctcgttctctagcttcatatatctcttctcatattg

SEQ ID NO: 10079 - DNA, 3000 bp, Unknown
  misc_feature (1)..( 3000): cDNA_ID_2686953_gDNA_ID_2213624_Annot_ID_132001 3000 nt of promoter + ATG
tagaattcatagatatacatgtgtacatacgtgactttgtgacgatatatcgttttaatttgttaaattttgatcccttctcttaggtatgcaacaccgtaagagatgtcgattgagaggtcgaaactacgtaaggccagaagttaaacaacgcaacttctcaaaagatgaagacgatctcatcctcaagcttcatgcacttcttggcaataggttcgtattcattcttcttattctttaattcaatagtaatgtgaacggtacgtgctaataatcattttgatgttatgttttttcagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttctagacgtcacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccagctctttgccttcaggactctagcgaatcctctaccaatggttcaacaggtcaagaaacgcttcttctattccgatgagaaatggtgtatttgtttgtacacatttgttatattacaaatgcacatattataatattcactagagagatggtataacgatgtttgaaatatgttaatcctgaattggaccggctggtcattgaacaactattctcttaaatgtccggttctgttttcagtgattagtattatagtagatcgttaataactaaccgacgataaccgctgcttatttgatcaatcaagctgtaagaaattatagctaatacagcaatgttaacggtgcacattgacgggaagtattaattaactctcttaaaatggacaagtatgttcattttcctccaaactacactttactctttattcaaaagcaatttcaaactctcgtttcgcacaaaggaatctataaatacgaaaattacttactaaagatataaaggaagcaaattagttaacttataaaataatgaaatgtatcgatttaaggatgtcttaagcatggagactatacggtcaaatatgcaccaactagtacaaacacgttcacatatattttgaacaaaactcacaatgaatttgtttaaagtatcttcatacatgcttaaaataaaaattagaaagtaaatacatttgtacaaccgctattcaaacatcatcaaatattaaacaaaattgcatgaccaaagaatatgaatgtttgacaagtatagaagaggagattgtttgctaagaaaatggaccaatatttatcatcgaaactacaatcatcattaaggttgtttctacgattgcgggatctacaaccatcaaagaagttgtttccacaactgtataaactctgatctcaccttcactttcatattgttccgcaagtacaactacaccataaatttcagaaataacggtgagtattgtggttaatggagagttgtgtgtggatgtgcaagcaaaaatcacatgcctcatcaaacacttcaaggttattaatcttcatctgattcagacgaataccctcttctttatgtagatctttttatttttgcatatgtccaaaaataattatgaaaccagccagtcaaacttgccaaaaatgtctaaaagataatgttgtctatttttcaagttgctatcggttgttatgtaggacgcagaagtcacgggcatggacgtcggccgatatgatgtggatgtcgtggttgaacctttcttttgttaaaccgagataacttttcaatacaagactgtcacaaactatatgtaagtcatgtttataaattttaatcaaaagtatactaaactgtggtaaaacagttttaagaaaattataggtcccaatttgtatacatgcttcaaattatctaaaatgttgttaaaattcgatctaccgggtcatgttcgaccgttccatttgcaggctatataatactcaccaaaattatgttaattgacataatttttctagaacatttttgctgtaagagatattaaattttcttacacatacaaagttatttttaagggaaaataaaacatgtaaagctatatttagttaattacaaagaagattttttccatcttttaataaacactagggtaagacagatcatatactagaaacacatgtcaatacaatgcatctaaaggcctggaaattttatcttagtttcttttcaaatagaaaaaataactaatttgactatttattaccatttaagattacataaataatacatacagataaatttcataactccaacataaatttcaacacaactataaaatacaatcatataagatctactttacaactaagcacacaacaaaccattttcttcaataaatagaaaagtggatttttttattgaatttaaaagtatagttcatttctattatacagttttgatctaatataaatgataataattgattatttttttgacaactgtatcattttctcttcaacctctacttgcaccgtgaatctcgctctcaattatctagtttgttctattgtattatttaaatgtatcacataaacttttatctaaaaatataaagccagtaaactaaaaagaaaagaaaaaaccatttttagagttagataaaaagtttaaaacaaaaaacactaaaaccaaaacggtgtcgtaacagcgacttatcctttttcgccacatggcttcgttggatacataaaagcgatagagacgcatctctgagtcagaagcgagccagcgagagagagagagcgagtcacaaaaattcgaattttaagccgccgtgtgagacggcgtaatg

SEQ ID NO: 10080 - DNA, 3000 bp, Unknown
  misc_feature (1)..( 3000): cDNA_ID_2714376_gDNA_ID_2213624_Annot_ID_195788 3000 nt of promoter + ATG
agagaggagagattacgggttacatataatcagttaatcacaaatattaaagaaatgtgtgtactgtgtactacagtttagcgccatttgtactgcataaagaccccccacgtacatacatacaccaaaccagagagacttacattagaagaaaaaactatggcaacctctgcattcttacaaagaagtagaacatcggaggagatgaatcaggtaagaaagcctctgtaaatcctgtctcacaagttttcctcttctctaaaacaaataaaactgtttttgctcttctctggctcgctcgctctaggtcttatcatttacaaattcttatgtactgcagatatacgaccatttctcttctaataacttgctgtgacctgtgattccctgaacctctttattttttaatcttcaagcattttaatattcaatattaatgtttaattctgcagcttcattgcattgtgccattcttaatttgttatatattactgcgtcaggggttgactttaggctaaggctaccttttcctatatatatcattgtcatgatcatcttgttaacttaattagggttttagacattaattgcagttctaagtttaacttaggaccatcggtggtaggaaagagcacaagcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaaggttttgttttcactgttattattacaagttaggtatgttctgcttgttgttgagctatatataacttttcttgctgattggcagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaaggtactgtgtctcatcttatcttcttcatttctctttagtttatgttttgatagaatggagacaatgtgctagtcttcatggatatgaacaatgatgtaacttttcttctccaaacaatacatgtttagggtccaagtcatgggaggattgtgttttaactttagctaagcattgagattatgttaagattatataacgtttagaaaagatataggactaatggtttatcattaagttcataaaccaatggtttttgttcttaagatatattgattctattggtgggagagagactgtttcgacctcaatgaacctggatttgagtgtagcattatgtataaagagggatgatttacatatatttgcatgtattatcaatggctgatcctagatctatggaccaaaaacactaaactaaattcaaaattagtttttagcaattcgatagtatggcactaaaaagtcattggatagtatttacatatatacattggatgttcttttttgagagaactaacaattgcaaaatgtatatgggaaagtgtagatggatgagaagccatgtgaaggtgatgactacatcacagtgttaaagaacaacatcatttcttcgcttcgtgacaacacaaagtgcaaatgatatatagtgaggtatagaatcaacagaatatctttgatgatgcatatcgcaacttataatattcctcttcttgcttagatcatgtttggtttcgtgttgggaatctcataaatcatatatagatgtagaagttatgtttatctccctatggtaaacctcttcttagtatgcctcaagatcacgatttacatgctctagtacccgatccgagaggattatctaccaaaggcccataacttgtaatccaaatagaaatttctttgcgaagctaaaactcaagttttccaaaacaagttgttagaatgccgactaaagtttctttatataggtttaacaagaaatgtataacctaaagatttgatcccatggcataaaaaaaataataattaaaaacatggaagcaaaatatatacaacagatagactatgatcttgcagtctaaaggtgagaccactctttgatggaccacaacctcaactttccgaatcagccggcttttgtttcaggagccaagagaaagacacaacaaccaaatcaaaaatgacaacacggctccaaaagaatatggagtttggcaaggcttacctttgctataaataagttgagcattggacttgaaataactttgtctaatgaattcttacttgtattttataagacgaaaacgtaaatcttgcattaagaattcatacaaattttcataattgataaaattcttacattatcgtactagaaatcggaaatgcattccaccattatgcgtgttagtactaatcggagttttaacttgtactaaatttaacaaatatgacggagagagttgaaagcttatcacaatggcatttaccgttttgcccttgtcgttgtaatttcaacatttccaatttcttaacgcctttactgacatcgaccccaaaaagaaaaaaaaaaaagaagaagagtcaaacctgagaatctcatctctctctgaagtagaagaagaagaagacgatg

SEQ ID NO: 10081 - DNA, 3000 bp, Unknown
  misc_feature (1)..( 3000): cDNA_ID_3013579_gDNA_ID_2213624_Annot_ID_195779 3000 nt of promoter + ATG
tttcacaagggggaaactggaagagctatttagagattcgggatgtgttgcgaagctgaggatgaaaatcggatctaacggcgaagaggcggcgccggctgtgacggataataggaattatgtggtggatttgtatttggagagagatattggagatttagaggtggcgagtgaggcgatattgaggtttcctggagtagtggagcatgggatgtttctgggaatggcgactacgttgatcgtcgccggcaaatttggtgttaccgtcaaggataggtttggataaaagtgtcatttgaaaaccattagggtttatggtttgattttgattttcgatggattctctctggttctgtaaaccctttcctcctattggtttaaaactttgacttattttttaaaactttgtagaattttgacttttggaggctgtttactgcattgcccctgaccttatagtattcactaaattgccccggaactttttcaatctacaaaacgccaggaacttttacgattttcttaaaaagtccttgaacttctgatatataataaattgccccggaagttttgatatttaagaagtattactgttttgagtattttccagaacttctgatatatatactaattgtccgaaaacttttaatattcaccgagtctgtcccaaaatcaaaatgttcgagtctcttcattggtgtttcgggaatatttgccgtcactgtcaaatccattacgcttatgttactggactttgtggtgtagtttcgtgaaagtaaacgagcaagatacaaaaaaaagaaaagcataatgggcctttttatagaacaatgggcttttgggtataaaattattttcaaattgcatcgaatgcaatttgacaacaatctatatgttggcagccaaacctcatcaacaagggtatatattgctcaacttgcttcgtttgtgtaaagtggattcgtttcgtgtcagattttagtttcacttcagaatattcacgtaacatttacagacttatagggtaaaattttaagaaagctaattcatatgccattgtagaccagcgcgaagaaaacaatttaataaaacaaataacatgatatgatattatataatattcatctagatcttcatattctacatgaaatatgtggttaggtagactcgataacaaaagaaattgaaataaaagacacttttttcaaatattttaatgggagaacaaaatatcatgttatgggttgtttttggcacaaagcaagaaagttgcatcctcaataaaaacagatctcagacattttgggttcacatgatcctctcacatgcttcctctcacgcatttgaacactcttgactctaccaaataacccactccaatggcatgttaatattttatgaatcacaaccaaacatatatcgactttaaaaacaaattagtatcttactttaatgttagaaagaaaaacttttcatataagagatacacttttttcttttcgtattaaagataaaagtagagacgtatatcaaataccaaacccaccactcatacacattaaagtgattttggtataaaaactgttatcagcttctttgtaatatagctctttgttggttgtaaaatgtcctagaatagtttcataaaaatgtaaggcattggagtgagacactttaatagtttaattgcccacgtcaaaagaaaacttttatttccgtcgatgtggagaaaaatgttgccgtcactaggaagagtctaaaaagtcttaagatcacataacccaaaccgcaagttatggtaaaattcaaagtcttaaagtcaggtccgaaagcaaatacttatttaaaaataccctcttttcctgcaaattactttgaaaaaaatatatataaaaattctatctcacgtaactcttgaaggcaacctacaataacactactcatgtgatagaaaaacgcaatccatgtgaaaataatcatgtcctaaattcaacctatatcagtaaaaaatttggtcaaaattaagaaaataaacgctattttctttaatcaaacaaacgccacacatccaacattagttactgataggttgtagtggcgattgttaaacttgtaatggcgattgaattagatattcaggtgaattgtatagactatagacacaaaacaatgcatgattgatagaaactaatacaaacttatggcaaaatacataaacccatagtaaaaaaacaaaacacatgactctcgaataataatggtccaatcaatgtagcagcgtcccgattaaaggaccacgtggctacagaagatacagccacaagagacaccgagacggaagggagggacgccaccaccacgttaagtttatttagatccatcgagtcgagtcccctagtgggacccacttgtactcaatgtgcataatcaaattaattgaatcttaatttttaaacaaccatgctttaacagaattataaccaaatcattaattgtcaataaaaatctttatatttttattttaccattttaatttttaaaaattaatttctttatcttctctcagatttcttcctatataaacccaatacattaccagtttaatacctaacaattactcaattagtacaagttgttatacaactaaatcttcatttgttaaatcatctttactcaaattgaatagtagtgtgcgtgtgaaaacaagaaaagtggaaaaggacaaaagagagagtaaaggacgcctcctaataaagcactcttcttccttttcactttcctcattgaagagagagccaaattcagcttaaagccccataagcgtaagcgtaagcgcggggataaatctctctcttcctcacctgcgttttcgtggagcatcttcttcaacaatggctgcttctccgatctgatcatatcctgatttgaattttgctatctctcatgcctcgaactcgttttgtcgacgtagcatcctagtgactgaggaagaagaagaag

SEQ ID NO: 10082 - DNA, 3000 bp, Unknown
  misc_feature (1)..( 3000): cDNA_ID_2686576_gDNA_ID_2213624_Annot_ID_195776 3000 nt of promoter + ATG
gtatttgacggttctttttagagaagtaaagaccattttaaaaaggttaggctaaattttatagatacggaaatttctgaattttgaaaagattatctttaagtattgaaatatgaatttaatacattaaatattttaccaatcaggagcccaacataatcagaggccatgccacttggatatgactaaatggtgagaagagaggcatgatttttactatctagcaaaaacttacttccattcactcatttccataaaatcggatcttgattcttcaacgaagccaaaatgatttatcttttctctgaaactataattaaaagattcacattccaagaaattaacacgtttttctgtaagttccacgcatattccaatcgcatctctctaaagcagcctttctccaccattggatattatgacggtccatatctttgatttcttttgtttaaaattctataacaaaggtcactgttacgttacgtgtatacatatctcatctaaaaccatgtgaatacgatgatgctctatttaaaagatgatttaggccacgaaataagatcaagcaagtgcacggttcatgccacttttggtacaaaacttcttaaactttgaattggtaatactccaccaacactcaccaacacacaccattgaagttcaatgtatttgataacatcacattctttacaaacaaagttgacatttaactttagatttattgcataccttggacagtagtctcaacggtgagtttgaagaagatgacaatgtagaacgtaagagacaacagtgcaaagatgtgttgccagaatagaagtgccgaggcttctctaacagcgtaacctcttagactcgcgatggctccaagtaaaatggcactcggagtcgaatactgcaaaagaagcacaaacttgaacattggatctgctgaggaaatgagaccaagtttatcagctgacatcacaatccctattcccactaacggaagcaccaagagtcttgcaacacttattccaatcgtagtacgtaacccaagagttgattcatttggtccttcagagagcataccaccaagtacaagcatcacagagggaaccattgcacttcccattatattcaaactatctgtgatgaaagaaagcggagcatcatacccaaagacaacacttttcagctgaggcactgatccgataatgatcgctaatagagatgcgattgttggaggttgaagtatgtgtttgactggagtctgttcagccacaactcttattctcctcattactctaggctcagccaagcattgaatagacctagggctggaactctctcctccatattctcccccgagatcaacttcaggaaaagaagtctgagagaaactagatatgctgttgaagactctagcaataaaaggtgtcttgcaatgttctgtctctttgtcctcaatccctggccactcagcttccactagaagaggcctactagcatcatgattctccacattgatctcctctatctcaaccccttcttcctcaacgacctcatagtactccaaaggcggctccatcatatgatacacaacagtataaacaagaatcacagcaacccattgcgcaaacgatacatacgaaacccctctcgagttacaattcggtccaaaagggttcgtcttcgtgtgacacaccgagctaacaatagctaacaaaagattcccagtatttccaaaagcagtcataacaatggtgaatctattaaactcaggaggtggtctgcatatgaggactaccaagtatcctatcaaggacccaacgaccgcactgagtaacacgttgaccggtataaaccaccattgaacaatgttatcaagagtaatgctttctccaagctcagtgaaaatcaaacaaggtaagaacaaagcaaacacaagcttgcttaagagcctaaacgtggctcttgggactaattgagtcttgggatgagcaagaagtagaccaatcacggttaaacagataagcttcaacaaaggcacaacaccactgagtatatccacaaccctagaattaacatttccactggagaaacctgacatctcgatctcactatgtaaagctcgaagtcaacgatagaaaaaaacacaagaagatgaccaaattggtgatttaaaccacaacccaagtaattgaatgagaagaactatacacagcagtgaagaatctgaaccaggaaatagaagaacactaacaaatcaattagaccacagtcgtgaagatggttggatagagataaagccgattagagaacaacacctggagctacacaatacacatggaacttgtcaatgaagaagaagacaagattgcgatgacagatgcatcatccacgccaaatctactgattgcaataattttgtatcttgaagtttcttcttgatttgaaaattttgtatttatcacatcgtgcgaagaagataatctgtggttgaacgatactgtcaaagattatccattgggctagcgacaacacgagtctaaaaaagaagcccaattataagcccattaatgcgtcaaaatatacaaaccaaacactagcggctgaatgatcggtcatttccggtttaatattaaatcagaacaagacgacaaaagggaacgcttggcttgagatttgatcagtaatcgcacgtgggaataaaatagctgccgcaaaccaaacagatccacgtggaacccaaaaccagacatactaactcgtgtctgtacgtaattggttaagaagattaaaaagcatgaatcggcgggtaccggatccaaaattctgatctcggattcgtcttctctgccctaaaagaaaaaccctacgtgagctgcgtcagttctgggtcctccgcaatttgagaatcggagatatctcaagtttcgcaaagtctcgtggatttgatcttcgtctccttgatcgatggattcaccttgagcaatcgttgatcgagcttcgaagatg

SEQ ID NO: 10083 - DNA, 3000 bp, Unknown
  misc_feature (1)..( 3000): cDNA_ID_1393962_gDNA_ID_2213624_Annot_ID_195772 3000 nt of promoter + ATG
gaaaaatatctattggtttatagtactgacgaatcagtgctcttttataactagtcaaatttaatattattttgctctcctaccgaatgaatacacattttttttatagtttctataagctctttaagttttgttctgataaattatactaagaacatcatcaaatctaatgattaattgatagaaagttattacccactaactatataattatgattgcttttctaccactttggcctagctaattgtgctctgttcctttaaactattttattactctgctaatgattcgaatgatttaagtttttgaatttctctaactctgtcacacactgatatgagttaaatcattgtgaagtacagaaattccacagagacttgcctgccacgccagtgttcgcatatggtacatcaaagcgttcagcaacagttcctggaccaacaatagaagctgtttatggcgtcgacacctacgtgacgtggcgaaatcacctccctttacatcatatcctcccttgggacccaacaatctctccggcaatccctaaacacggcggcattcccacggtggttcacttgcacggaggtatccacgaaccaactagcgatggaaatgcagattcatggttcaccgctggtttcaaagaaactggttccaaatggaccaaaaagactacacattacgtcaacaagcaacaacctggaaacatgtggtaccatgaccacgcggcagggttgaccagagtcaaccttcttgccggtttgttaggctcttacattctccgtcatagctcagtcgaatcgcctcttcggttacctaccggacgcgaattcgatcgtcctttggtcatctttgaccgatcttttcgtaaagatggttccatttacatgaacgctacagggaacaatccaacgattcatccacaatggcagccagagtatttcggcgacgccatcattgtgaacggtaaagcatggccgagattaaccgtccgccgccggaaatatagatttcgaatcacaaacgctagtaacgcaaggttcttccggttcttcttctccaacggtctcgacttcattgtcgttggttccgattccgcttatctagcgaaaccagtatcgaccaaatctgttctcctagctccgtcggagattgtcgacgtactcgttgacttttcaaagtcaacatcgaaaacggcaattcttgccaacaatgcaccttatccttacccgtcgggagatcccgtcacggaagagaacagcaaagtcatgaagtttataatcaactacaaatcagaagttgacacgtcgattattccgaagaagctaattgaataccctcctgctcatgtatcaacctccacacgtacacgttacattgctatgttcgagtatgtgtcaagcattgacgagccaacacatctatacatcaacggtctgccttacaacgctcccgtaaccgaaactccaaaaatcggcacaagcgaggtatttataaccaaaatttcactattcactaaccgtatagttcaaatctttaatgcttacaataatgaaggtgtgggaagtgataaacttaaccgaggataaccatccgttgcacattcacttgggattgtttaaagtattggagcaaacggcattggtgaagagtgaggagttcatagagtgcatgactaaaagaaacgatgccgtcaagtgtgagattagcaaatacgcacgagggaacaagaccgcggttacggtacacgagcggggatggaaaaacgtattcaagatgatgccgggacatgtaacgaagatactcgttagattttcttacattcactcaaacgaatcttactcctttgacgcaactcaagagccaggctatgtttaccactgtcacgtaagttggtaaaatactaaaaagttgatgacgaatttagctttttcttttagaactaactgtatgatattggcattgcagatattggaccatgaagacaatatgatgatgaggccctttgcaatggtgctataattctaaaacgaaaacaatttacaattacgagtgcagaatacaaacgagttgatatagattgagatttcagattacataaatatcttatacagaaagtgttaaaagataattcgattggattgatgttatatctctatcattgtttttcacttggcctcggagattagaagcagcttgttaatgggcttttaacagttacgggctttaacgggcccaataacaaaactcttttgcttcttatatgattttggagtagatggtaagtgagatagggaagtggtgagtgaaattagaaaattcctcgtatacaaagtcctaaccaccagtcaaattcaattgaatgctcccatgtttctcccttatctgttcctgaacctacactctttaatttcatggtttcctattttctcttaatttgtttattttcatgtcatattcggaagcttcagatattttatcaaataatgcatccaaataattttgagccactagtcaaatatcttcttcgtcttcttcttgcttaatatatattttagtgaatctattattgataccacacacacatctttgatatttcacaaaaggtatctatcggagccgtacatatattttacgaaaatgtggataagagcgagatttggattggtattggtaaggcaaattaaatgcgacacacttccacattcatgattccacaaattctaatggatttgaacaaatatgggaccaatttttatttgtttcaactcctaaatgtgggaccaattaacaaggttgatgtattcttcttgttcttcctcgttcattaatagtttgattgagcatgcacgcttctctcaacccaccagtccaagtcaaacctcctcaagccatcccctaatcctatatatcagtttcttctcgcaaaccacctcacaatctatcaacagttttaaaaaaagacataactcaaccaatctcactttgaaaaagacatg

SEQ ID NO: 10084 - DNA, 3000 bp, Unknown; identical to SEQ ID NO: 10079
  misc_feature (1)..( 3000): cDNA_ID_2686953_gDNA_ID_2213624_Annot_ID_195771 3000 nt of promoter + ATG

SEQ ID NO: 10085 - DNA, 3000 bp, Unknown; identical to SEQ ID NO: 5986
  misc_feature (1)..( 3000): cDNA_ID_3033680_gDNA_ID_2213624_Annot_ID_195769 3000 nt of promoter + ATG

SEQ ID NO: 10086 - DNA, 3000 bp, Unknown; identical to SEQ ID NO: 10083
  misc_feature (1)..( 3000): cDNA_ID_1393962_gDNA_ID_2213624_Annot_ID_132002 3000 nt of promoter + ATG

SEQ ID NO: 10087 - DNA, 3000 bp, Unknown
  misc_feature (1)..( 3000): cDNA_ID_2714418_gDNA_ID_2213624_Annot_ID_132006 3000 nt of promoter + ATG
gtcaaagattatccattgggctagcgacaacacgagtctaaaaaagaagcccaattataagcccattaatgcgtcaaaatatacaaaccaaacactagcggctgaatgatcggtcatttccggtttaatattaaatcagaacaagacgacaaaagggaacgcttggcttgagatttgatcagtaatcgcacgtgggaataaaatagctgccgcaaaccaaacagatccacgtggaacccaaaaccagacatactaactcgtgtctgtacgtaattggttaagaagattaaaaagcatgaatcggcgggtaccggatccaaaattctgatctcggattcgtcttctctgccctaaaagaaaaaccctacgtgagctgcgtcagttctgggtcctccgcaatttgagaatcggagatatctcaagtttcgcaaagtctcgtggatttgatcttcgtctccttgatcgatggattcaccttgagcaatcgttgatcgagcttcgaagatgtcgaatcactccagagatgagcctagtactgccccgaagacagatcaatggtatgatcttgtccttggttcctctgccaaagatgactcctcccataaattctgcactttgcgatgtgagtttctgattatgttaccattcttaattttgggttaattcgacctaaattggaatacatagaataagatgtttgataattgtgtacttgcagatgaatttaagccggcttcaatcgataagaacaggtcaggatcaatgcacaagaagaaggataacagagtttcagttgagtttcagaataaccaaccaggtaaacccaaggtgacatttgaaggtagtagtgaggattacaaagaaagcgatgcggtgttgtttttcgatggggagaagtttcgtttagagaggttgcatcgggctgttacgcagctgcgacatgttaggacacctggtgaatctgctgcggcttctcaatctgcggtgcctgtggagcatcggttatctcctgttggtcgtgctgctaaatctccacaagtcaatagaagtttgcttcctgatgtgcctgtgagtttccaaatgccttttactttttccttatccaatttgatgtgttcaggttttgtatttattgaatgcttgatggtataaaatgttgctgctactggtttaagtttacattttctgtaatgtatgcaggttgaggtggaaagaatcgaaattgggaagccagagaactcaggttagcagttattgaagtgatttattcatatgattatgcattttaaatcccatcttattgctatttttgttttgagaagtggattttgattcttggatcataggcaaacgtatcatagttttcattatttgttagtctctttggcttaagatatagttggttgattttggttgctagtacatagacgtctgatttccaattaaaactacagctctgttccccaattcgactactactttttagtagtcggattattccgtcatttcttaatgccgttatgagtactcggttctgtattggtgtagtcaaatgagactaggcaggaatatcaaactgttgattcaagtgtacatatccgttctactgttctaagcatgtatatggtatttctggtctttgttttaaaactattttaacagttttaaaatctaacataaaaagtggttgcagctgaacctgccaacactggaaacgtgcctgcaacctcaccagtcgaggacaagaacgatgatggagatgagcatcaagagatcgatctggttgaaatatttggctcatttacaccagagaacgacaatgcagagaaagagaacgctgatggtggagaatatgtagaaagcttaaataaacagcttagcatgacggaagaagagattgcagatgtagatgacgatagcggcggtgaaggagaaaaaggtcttaacgcagcagaagcacttagagcacaagtgaacgcagaggtgcaaaagagtcaaacctcaagctcaagcagtagcagtggaagtagcagcggaagtgacagtgatggtcgtagcaaaagcgtaagcagcggaagtggcagcggcggccaaagcagtagtggaagcagtagccgtggaagtggaggaagtgacgatgaagatgaagtcaactccgtataacaaccagctcccaacaactttgtcaaacaatatttccatatttgagacactttgtctgaataatttggttgaagaatccaaaagggtaaaaatttatgttttactacgaaagtagtaaatacaaatgatataaagatccagttactattccaggagtagcaattttccattttttaaaatccagaatctcgtgttataaagctgtccttattagttagtaatcttgtattactctttaattaattcaattagtaaagtaaatctctctcctcgactggttaaccacccgaccacaccacccttcacttttattttcactctctgtaataagcgcgtgaagaacagaacacgcaggtttctttgtctttttctacaagagcgtgtataacacgcgcctgaaattggaagtggtggaagaaagttagctattactgttaacaatggagttattaaaagtttgccaaagttttttctttttttctacaaccgaccgagtcggagatcgaagttttgaacctaagaatctcgttgtcttcttcttctgcagagcctccaaagtctaaatcttttggttacgtctctcaaaccccaacctttatactcactctctttctttttctctcttacctccattggcttcttcttgagatctcgtcaggctctgatcccaatctatgttcgatctcactctcaccgagatctcatcttcctccattttttcaaagatccatatatgagctctaaaaccacagatttcaatctgtgaatccgtatatatgctcaatcggagccagattctaacaaatcaaagaaaggaagaagaagtgaagaacaatg

SEQ ID NO: 10088 - DNA, 3000 bp, Unknown; identical to SEQ ID NO: 10082
  misc_feature (1)..( 3000): cDNA_ID_2686576_gDNA_ID_2213624_Annot_ID_132007 3000 nt of promoter + ATG

SEQ ID NO: 10089 - DNA, 3000 bp, Unknown; identical to SEQ ID NO: 10081
  misc_feature (1)..( 3000): cDNA_ID_2714406_gDNA_ID_2213624_Annot_ID_132010 3000 nt of promoter + ATG

SEQ ID NO: 10090 - DNA, 3000 bp, Unknown; identical to SEQ ID NO: 10080
  misc_feature (1)..( 3000): cDNA_ID_2714376_gDNA_ID_2213624_Annot_ID_132018 3000 nt of promoter + ATG

SEQ ID NO: 10091 - DNA, 3000 bp, Unknown
  misc_feature (1)..( 3000): cDNA_ID_2714812_gDNA_ID_2213625_Annot_ID_132022 3000 nt of promoter + ATG
tctccgacatcggtggtttctttagcaccgttggtcggcttcgttcttcaaatttagtttttgcctttcaaccttgttcgattctattttgcttcggttttaattggttttgatttctctttctcttcatttcgatctaaatttgtaatttttcgatcctcccttctttaaggggcttaatttgttcttcaagcttattgagttttcattttaaaagatcaaatttttagttacggattgaagtttaatttagtgtcttttgtttgattttgatgaaattagagctgttgtttgtctttcttgttgccgatgcttgttgaatcgtttgggtttatgttgtttttcctttaaatggcagaagtcgaagtcgatagtttgtgagctatttctttcttgaaggttttaaattttacagtcattgtcacagaagatttgtcaattgtctcatcggatttgtagctgcttccgatttggcgtttacagcaattccggtgaacttaagttttttgtggttatgattctccacctgcgacattctgcaactcatcattttctgtttccacgtgtcctctttaccgtgtctctagtgccatgtgggctttgacttattagcacattagctttctcttcttcagaaggtggtctttgggcttttgtccgtttatggcctgttatatggctttgtaaaatatggcttgttaaaaggctttgtaatataaataataaaacagttgtgacaaaaaaaaaaaaatatatagtttgatggtgattggtgaacttcttttttttccaagattgcagtaaacgtcgtctttagctccaaaaacaacctttgtcttgttcagctaatggcgatttttgaatggcggcacagaagacggccattcgacggcggaggaactcgtcgccgtcgtttcttcagcccattgtattcgagaaatttcaagagaacgattctcttcgctgtgattttcttagctatcttccctcctctctacttccatttcaagctccgacgaattcgtcagattgtcgcgcaaaagtgcgattggcttcaccatcctccacttgtctgtgctcacggcggcgattccaccctcgctttcccaaacactgtacgtacactctcgatctcttcttcttcacactcttgctactaacctttttaaaccttaatctcttggactcttctcaatcgtagatggacgcttacagtttcgctatacgttctcgagttgattgcattgaagtcgatgtttctcgttcctccgatggtgttttattcgctcttcacaacaggttacagactctgatccttgttgtatcatcttcttctaatgtttctgtgtttggattctcatcggtgttcttcttattcatcttctgatcacacgcacagtcagggatctgcagcgtattgctcgtaactcttctgttcaagttggagatctgagtatgaaacaggtctcatctctccctctctctctttaccagcttttgggatatgcttttttgcatccatttttcataaaccttttgatgatctttttgcagatcaaggaactcgatgtctcggagattgttaaaggaaccttgggaagtagtaggattcctactcttgaagaggctttagcggtaatgcctgtttttttaattactatcttgtcattgctttgctttgtaatttctgcttagtaacaagtggctgaagctagttttgatcttgaatcatctagttgatatcgaattcagtccggaaagtgatccttgatgccaaagttggaccgccaatgtatgaaaaggggttagcacaagacatcctttctattgtaagtactatgtttttgttagctcttgtacttgtaaagctttagtacaatgtgctcgagatttataaacatgttttgattccttaatagcgttgcttaatcatttatttcctggtatctttgtacacaaagctagaacagcttactatagatacttgaaaaaacaagagtatggataaattgttgatgtttcaatggtggtatttctggctttgctcacatgaatcgccaatcctctgttgttagattgagagagcgcagtgcaataattgcatcgtatgggccaaaagcgacactttggctagggacataattagacgagcaccagatactatggtaaacagaaatggattgtcttgtgaggatcagatagagaagtttcttgctcatttcctagtgattttggcaggtgggatacattgtgatggtagatcctttgactggggcgagaaacagcctgctgagaatgaagggagctagggttgtgggagtttatcatcccttgatcgatgaagaattagttagagttgtccgtcggtaagcaatcgatttcaatgttttcaaataaaaacacacctgctcatgtgtttacaaccttgctcgatctgatcaacaggagaaacaaagaggtgtatgcatggactgtggatgatgctgatcccatgaaaaggatgcttcacttaggtgtggatgctgttgtgacgagcgatccatctatgtttcagggtctcatggaagatcttagaactgagtgtcttgaagaaggtttttcaatacggacgtgagaatttctttttcgagcattcttaatgactgtaataccaactcagaagtttttggcaaagatctttctttatgttgttttgctgatccacaagtttttgacaactacacactacgacgccttgatacacagtaagacgagtctttctcaagaaaagcaaagtatggccggttcttgatgaagccattgcttctatcgatacagctactgataatctgatccaggagactctgaggcaacacttttcggactgcacagtgaaaacaatctcacacagatatcttcttttatacataacgatatgagcctgctcctagaacaaggtctaatacacttgtatttaagtttaaataatcagatgactgatattaagtctgtttatataat

SEQ ID NO: 10092 - DNA, 3000 bp, Unknown
  misc_feature (1)..( 3000): cDNA_ID_2714808_gDNA_ID_2213625_Annot_ID_132023 3000 nt of promoter + ATG
gatccgattcacaatgtgcctgagaatcaacacaagaaaagagtataagtattgacccaaaaaccccaattaaagaaccctaaaccctgaggaaagagattaccaagggatgtatttgatggagcacccatcttcaactcgagttcggatgactgaatctggaacctttttgttaagctccttgagaatctcagcgagtggtctactgattcctgaagttggaacatcgttctctgtttcagtagagaatcgacgaacacctttccccatctccgacgaccattctctcgatacagcacctgatccgctcctcaacgtccattttgccgcctttagccgtaaccctaaccccgccatttctgtcgccggacaaaattctcaaaggtcgcgtttttatgtaagcgtgtagggtttagttgtcgtctgataggcacgaaatgggcttatcaaagaactaacagaattatgatgagaagtagaagaaagaggtgagaaatcagaagaagatgattgttgattttgattgatctttttgatactcgtttacagagaagaagaaaagcttaagtacacgacaataaagaggaaatgggctttaaacactaaacccaaatagaagcccacgaaggcccatccagggtcactaatcttcacttcggtttgtatcatcgtcccgcttcctttaattagactttttatttatttaatcttcactacggatttatgtattactatttactaattgttttatataatgtatgttcatataaagtaaagttgaatgcatctgtttttttaaacataaatatgatttgtaattgttttcaaaaagtccaactatattagttcatctgaaaacgaaagtgcttgaattgttttttattgttgttctagattctccgttgtttttttaatttatatatccttgttcttttagttatatatttagtttgtgagacggtgaaattttagaaaatttaattcttacattaaaaatataacatgtctttattaaccatgtctctgcatatccaatataatcatattcaacttgatgttcttgaaaaatttagttaaattcttgtcataatttgtattagttataaggatagctccttaaacatctttcaaattacttgttttcttagcataaatctcaaaaagcttagatatatttaatttgcatattcatttagtttctttcataataatcgtctaatttttaggcaaggaatctatatatacatttttgcagccattttgtgaaataaatcctgtagttggacttatttacaatagttgccactggattttaatgtttgtttttgataattaaaaagaaaatcttcgaattaaatatttgacatttaacaatcttcccaaaatctctccacattaactacacgattatttactaaaatattacttccaacatatttaatatcatttaattactacaaaattatcatttttgatattgcttctctccataactataacaattcgattataatcatcaaagcgcagagatataatctgatagcatttaattactacaaaattacaaaatatttagacaatgattcataaacatatcataaataagatcaacattaataaaataaatggttttttttttagaggacgggtttggcaggacgttacttaataacatttgtaaactataaaataaaattattttatagatagatacaatttataaacttttatatatactaaatttaaaaaataaattgttccctcggtataccgcgggttaaaatttagtatgtgtaacatgtttggatctcaaaattaaagagaatatattgaattaaaaaatgtagaaagagtgatggttcaagttctgattaattatatcctcctattttagttattatgttgaattaattactaattatgtattatttattttatgaagtctaggtgccaagctctcatgtgctgatgtgtcaaattgtgggagagagttgaccaactttcatatatatgattaggttaattagataagacctaaaacgacgacgtttgctgctctctctgtaatctcaagattctgattagggaaggatttcaaaacggtacgtagtcggtttagttagggagcggtaaattggtcagaccggaccaatggttttattacattgatttggttaaatgtaaatttaattcctaggttctttcaaaacgctgcgtattgatgtcacccttctctcctgaagcctctccatctcctctctatccctcggtctgcagaagaaaaaaagctcggcaatttcacattatcaatatgttattagatcaatgttacaatcattttacagtattcaaattgtaagatttattgtaagattttcatttctatattttaaattattgtaagattatattatatatatttatagcctattatacatatttattatttctaattcataattgtaaactaaattattagtgttaaatcttttttagagtgttaagactttagagtgttgcattgttgaaggtgattaattgttaaagaatggatgatacatgcatcgttatataccacggtctattgcacatcggacatgttctaatctagttaattaggattaaaaaagtagataccaaacctttttcaagaatttgtagatgaaattttaaaatctatcaaagaattaattctaagggattaattgctaaagaaaattaaatgaaagcatatttaatcataaattgtcttaatttattttcattatttttaggaataatataaacatatattaatcaacatttattatttatagcataaacaaatacatgtttatttatttgctctttattattctaatataaattaatagtgttatatatttttcgccacagttaatgttaaatctaaagttaaaaatccaacattagatcattattttctttatatatagagatacacaaatctactccaagaatcatcatcgtaggaaaagaatg

SEQ ID NO: 10093 - DNA, 3000 bp, Unknown
  misc_feature (1)..( 3000): cDNA_ID_2714805_gDNA_ID_2213625_Annot_ID_132024 3000 nt of promoter + ATG
ttcgtcgactggatcaccagaaaaagtgtagtaactagaagaagaaagacaagtttttctgttgttttgatcatctctagaaaaagtctccaaaagaaaagttattgagtttgaatattcttcaacaaaattcgctgtaaagtgttgactaatatgaagaaatttcatattaggggttggtaagcctgtacgaatgagtcgtttgtgggaaaagtaggttgattcgatcatcgatgtccatttttttgataagactttgaatctagccagtgattttattggaagatggtgaaagatcccttcagctatatcatctggtataaatattgtcttgggattattatgtttatcattctccattcttttcctacgatgatgattcttggagtagatttgtgtatctctatatataaagaaaataatgatctaatgttggatttttaactttagatttaacattaactgtggcgaaaaatatataacactattaatttatattagaataataaagagcaaataaataaacatgtatttgtttatgctataaataataaatgttgattaatatatgtttatattattcctaaaaataatgaaaataaattaagacaatttatgattaaatatgctttcatttaattttctttagcaattaatcccttagaattaattctttgatagattttaaaatttcatctacaaattcttgaaaaaggtttggtatctacttttttaatcctaattaactagattagaacatgtccgatgtgcaatagaccgtggtatataacgatgcatgtatcatccattctttaacaattaatcaccttcaacaatgcaacactctaaagtcttaacactctaaaaaagatttaacactaataatttagtttacaattatgaattagaaataataaatatgtataataggctataaatatatataatataatcttacaataatttaaaatatagaaatgaaaatcttacaataaatcttacaatttgaatactgtaaaatgattgtaacattgatctaataacatattgataatgtgaaattgccgagctttttttcttctgcagaccgagggatagagaggagatggagaggcttcaggagagaagggtgacatcaatacgcagcgttttgaaagaacctaggaattaaatttacatttaaccaaatcaatgtaataaaaccattggtccggtctgaccaatttaccgctccctaactaaaccgactacgtaccgttttgaaatccttccctaatcagaatcttgagattacagagagagcagcaaacgtcgtcgttttaggtcttatctaattaacctaatcatatatatgaaagttggtcaactctctcccacaatttgacacatcagcacatgagagcttggcacctagacttcataaaataaataatacataattagtaattaattcaacataataactaaaataggaggatataattaatcagaacttgaaccatcactctttctacattttttaattcaatatattctctttaattttgagatccaaacatgttacacatactaaattttaacccgcggtataccgagggaacaatttattttttaaatttagtatatataaaagtttataaattgtatctatctataaaataattttattttatagtttacaaatgttattaagtaacgtcctgccaaacccgtcctctaaaaaaaaaaccatttattttattaatgttgatcttatttatgatatgtttatgaatcattgtctaaatattttgtaattttgtagtaattaaatgctatcagattatatctctgcgctttgatgattataatcgaattgttatagttatggagagaagcaatatcaaaaatgataattttgtagtaattaaatgatattaaatatgttggaagtaatattttagtaaataatcgtgtagttaatgtggagagattttgggaagattgttaaatgtcaaatatttaattcgaagattttctttttaattatcaaaaacaaacattaaaatccagtggcaactattgtaaataagtccaactacaggatttatttcacaaaatggctgcaaaaatgtatatatagattccttgcctaaaaattagacgattattatgaaagaaactaaatgaatatgcaaattaaatatatctaagctttttgagatttatgctaagaaaacaagtaatttgaaagatgtttaaggagctatccttataactaatacaaattatgacaagaatttaactaaatttttcaagaacatcaagttgaatatgattatattggatatgcagagacatggttaataaagacatgttatatttttaatgtaagaattaaattttctaaaatttcaccgtctcacaaactaaatatataactaaaagaacaaggatatataaattaaaaaaacaacggagaatctagaacaacaataaaaaacaattcaagcactttcgttttcagatgaactaatatagttggactttttgaaaacaattacaaatcatatttatgtttaaaaaaacagatgcattcaactttactttatatgaacatacattatataaaacaattagtaaatagtaatacataaatccgtagtgaagattaaataaataaaaagtctaattaaaggaagcgggacgatgatacaaaccgaagtgaagattagtgaccctggatgggccttcgtgggcttctatttgggtttagtgtttaaagcccatttcctctttattgtcgtgtacttaagcttttcttcttctctgtaaacgagtatcaaaaagatcaatcaaaatcaacaatcatcttcttctgatttctcacctctttcttctacttctcatcataattctgttagttctttgataagcccatttcgtgcctatcagacgacaactaaaccctacacgcttacataaaaacgcgacctttgagaattttgtccggcgacagaa

SEQ ID NO: 10094 - DNA, 3000 bp, Unknown
  misc_feature (1)..( 3000): cDNA_ID_3035243_gDNA_ID_2213625_Annot_ID_195836 3000 nt of promoter + ATG
ctcaccaagtgacttcatctcagggatcttatcttctatatttctcatccgtgtccatgcttcatacacccctttgctcttcattgcgttatgcaaaaggacattacctatgaaagctgtaatacgacgcccacttttcctaaattcattgactaatccaactgcctcatcatacttttcttcgttgcacaatttttgtatgtttacttcgtaacattcgatactaggctgtagtccttctcccttcatttcttccaagaaatgcatagcatcatccaatttatttgctttacagagaccaacaatcataacttggtacagtctttttttggtcttaccttgttcacgcaggtcatggaaaaagtgaagagcatcggcgattttctcattttttagataactctgaagcatgagaatgtttgaagctactgtgggcgtgataccatctctatccatcatatcatacactagtcttgcaagttttggttttcctgcaaacccagctccttcaatgaataagttgtaggcctgaaccttgtgttcccaaagagacaactgaaactttagcaaagtagtaaagaagtttttttcaccactttccatctcacaaacacattgaataacatttcgatagagactacgggtcggggtgtagcccttttcctgcatcctgatgataagtttagcagctatgtctcccctcattagtgtgattgagccatatatcaaactggtgaacattttaaaggaggtgtctacaccacttttattgaatagctcattaatcataagagcgtcctccactttcccaacatcgcaaagagctgatataatcttgcaaccagctatacgtttaggcaataagtcccgttcagcggcagcaataaccagctcccttgccatgtcaggcttccccttccagcacaaggcattggttagtgtactaaatgtctttccaccaagaaaatgccctcggtcaattgcccctttcaagacatcataagcttgttcaacactttcattggcacaaagggtatgaatcagatagttgtaagacatggcggtaggagcaaacccaatttctgacctcgaccggtataactcgagggcttcatctacaaatccagctttgcaaaagaagcataaagcagcattcatcgttttcttattcggcgaaactccacgtaccatcatctccgtaagaatatcatacacaccatcaagattgttctccttcaaaagttgaaagaccatagagttatacctgaaaacttcgagttcacaaccttccaaaggactaatcttctgcaagaaatccgcagggttattcaagaatccagctttaataagcgccctaatccaaatgttataagcacggtccatattcactgttcccaccagtttgatctcgtctaacaacttagtagcttcctgaaactttcgtttggaacatagagcatcaaccaatatacctaagccagaaccacatccagcaggatcattaggcagcaaggctcgaagataatcttcagcctcatcaagcttcccttgcttgcaaaacttcttcaccaaaatcgaatgcgtaacagcacatacgaagccacgcacggagatctggtcgaagatgacatcaaaactatcaaaacacttctcctcaacaagtgcattcaaaagcacatgatacccaaaagaatccaaatccaaacctcgaaatctcatattaccaaaatgctgaagagctatatcagtacgaccagctacagcataaccaacaacaagagcatcacagagacgaagagaatgacggcaactttcaaaaccaacacttcgatccaaaaagtcaatcataagagtcacaagcttcgcaccacgaaggatcttgaagatagcatgaaaagtagcacgcgtgtgatgaaacccaggctgacgagcagcccaatcgaagaatttgagacaacagaggatatcgtaacgagtgtgtgaaagcacgtcgaggacgaatttctcagtgagacgaagtcggagattggagaggtggagataaaaagctctatcgtctccatcgttagaaggagctcgaaggatgtcaaagattcgatcgattaattggtggctctgtttcacatctcgatgcttaaaccagtctttccattcacggacgaggaaatctccgggagcgattgaagaagaaggtttcgtgaaggtagagaacggaatagcgtcgccgttgttaccggaagtaaagtttctgaacgacgacgcagagagcgatagtatcctccgcctgaggagcattccttcgcatgatctctcgacggtgactgaccaacaccgaagcatccaaaaactcgaaaaaccctagcatttttcaaccaatcagtggcgcccacgtcatactcgatgtcgtggcttttgtacgttatttacgaaaatgtccttttagtgttagtaaggatatttcgattcccggctcgttcgttactggtttttttcttcttctccgtcgcggaaaagatggggaccaccaccaatctgagatcttggctgtatctcattcttctcttcatcgtcgtcgtcggcgtcaacgctcagaatcggagacctaagaatgttcaggtggctgttaaggctaagtggcagggtactcctcttctccttgaggctgggtaatgcttcttcttacttttttgtcgagcaccattgttactgatcttaagctgaatctgagtgatttttgttgttgtgatagtgagttgatttccaaagaatcgaagcagttgttctgggagtttactgatgcttggcttggttccgatggagatgattccgattgtaaatcagctagagattgtcttcttaagatatctaaacaggcttcgactctgttagctcaaccagtggcttctctcttccatttctcacttactctgagatctgcttcgcctaggcttgtgctttaccgtcaattggctgatgagtctctatcttctttccctcatg

SEQ ID NO: 10095 - DNA, 3000 bp, Unknown
  misc_feature (1)..( 3000): cDNA_ID_2714779_gDNA_ID_2213625_Annot_ID_195835 3000 nt of promoter + ATG
actttactcgaatagaagatttacaataaaactattggtccttaaaagtgttggttatatattctctaatgacgctcttttgttttagcagggaagctggaactcaaatttcttgaaatgggcgtctggttttgttggtggtcgtcaacaatcaatgaagggaggtcctgacaaagtgagtagcttttgtaatatggactaacttttatgattgttgtaaacctgttgcatctcaattctgcatgattctaacatgtgggctacctttgcaacaattttaatcaagttatttctatttatcatcttttcaggagcatgagaagggtgggcgacaagggaaaacgataaatatattctccattgcttcagggcatttgtaagcgctatcatttttctaacctgcttgaccgcacacattgacttaatataattacgtgcgttgaaccattttagaaaatctgaattactttaagtgcatcaatcatatgaaaagaaaatcatatttggtatttctacgtctatatgtagattggatattcgtgtgcataagagttttaagtgtattatgtgaacaaaaaaagtttaatatatgatttgctggtatcaattcatttctgacgctgaggcactgcttatgacagatacgagcgtttccttaagattatgattctcagtgtcctgaagaacaccaatcgtcctgtaaaattctggtttattaagaattatctctctcctcaatttaaggttggctccttgtttctttgcttccacatatgccttttgtgtttgtatctatatatgtcttcttatctctagatgtgaacttatcttgtagccacattaacttaatgtgtatcgcattctaatcttgcaggatgtgattccacatatggcacaagaatacaactttgagtatgagctgattacatacaaatggccgtcctggttgcataaacagaaagaaaagcaacgaattatttgggcctacaaaattcttttccttgatgtcatatttcctctctcattggaaaaggtacagatgatcatattttcatttctttcttgcgattttgatgcttggaagatgtcactataaggtattcgacatgtgttctgtaggttatatttgtcgacgcagatcaaattataaggacagacatgggagaactgtatgatatggatattaaaggaagacctctcgcgtatactcctttttgtgacaacaacagggaaatggatggctataaattttggaaacaggtaaacattaatctttttgttttgcttgtagaggtagttttggtttccatactcttacattctcaattgctttgaacagggtttctggaaagaacatttacgtggtaggccataccatatcaggtaaaaaaacctacttgaacctcagtaagttgttgcttttcccattcttaatgtgccttgttctatctgtagtgctctatacgttgttgacttggttaagttccgagagacagcggcaggagataatctaagagtattctatgagacgcttagcaaggatccaaacagtttgtccaacctagatcaggcaagttgtataatatggttctctatacttagggctgtaacctttctttggtggtcacactatcgttttactttatttgaaaggcttttgcatttgactcttaccatacaccatgctctgaatctttagagttccaggttcaaacatattgatggcatgtcattattttgtttcaggatcttcctaattatgctcagcatactgttcctatattttcacttccccaagagtggttgtggtgtgaatcctggtgtggaaacgccacaaaagccaaggccagaacaatcgatctttgcaataatcccatgacaaaggaaccaaagcttcaggtaaaatgatggctttcctcatatctacaacactcacaaagcgttgtttgttataatgcggtgttcttctgcagggtgcccgaagaatcgtaaccgaatggcccgatcttgatctcgaagcacgaaaattcacagcaaaaatcttgggtgaagatgtggaactcaacgagccagtagctgctcctgctacagacaagcctaatcctcttccatcaaatgacatctctgaagatacagaacaagacttggaatctaaagcagaactgtaaattcaatgctcctgaagtttcaaaagaggagaagataaattagacaatcatggctattttgcatttgctagataaggtttctagttttgtagctacagtttcttagacatctctcacataaattagacagaagataaagtcaacagattgcaggagaataagaatatcagtataatatgattttgaatcaattacaaacatagtcactcataacgtatttgtaaactcgtccgtccaaaatctcaaatcaaaccaaaccgacaaaccagtaaaaaaaccgaaccggaaaactgacgtgtcagtgtctgtataaaaagcaatacgtgttcttttagcaaagggtctgacactctgatagaaaagctgaagtaattcaataaattattttagaagagggaagaaatctacggttttacaaggggacgttatttattaatggattttaatagaaagaaatccaacactaatacactgttatttaattaatgattttaaattcaattttaaaatttagtgttattggagtttatatctttgtaaatcatgtttaatagattttaaaattttgtgttattcaattaaaagattttaataccgtcaaaaaaaaaaaaaaaaaaacaaactaaaaggattttaaattttatttctaaattagagaagaatccagaggaattaattttcaccacttttctcttcttatatataagtcaatccccgaagtaacatttttgacacagttttcaattcttcagcagacagatcgatcacactccatcgattccgtatgaaaccctagatttctgcaactgaattcctaattcgaaaaagaatg

SEQ ID NO: 10096 - DNA, 3000 bp, Unknown
  misc_feature (1)..( 3000): cDNA_ID_3035250_gDNA_ID_2213625_Annot_ID_195833 3000 nt of promoter + ATG
cgatcacactccatcgattccgtatgaaaccctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgtaagtgagattcaagaaacttcaaagttttgatttttttctttagaaagtttgtatataagtcagaacagtttgattgattatggttataataacttgacctttataaggcggggcggctggagaatgttgttggatggtatcactctcaccctggatatggatgctggctctccggtattgatgtttctacgcagaggcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacaggtacattttcttgatttttctcggtgcaaggtcccaacatgattcttatgtttggcttttggttttggcagtactattcattagatgtcacttatttcaagtcatctcttgattctcaccttctggatctactatggaacaagtactgggtgaacactctttcttcttctccactgctgggtaatggagactatgttgctggacaaatatcagacttaggtaaactcttggatatggcctaaatcattcactcttacttttttttctcaagtcacagtcaagtaatgtgttatataatcgttttcgtaattttaccaatgaagctgagaagcttgagcaagccgagagtcatctggttcagtctcgctttggaggagttgtgccatcatcccttcataagaaaaaagaggtatgtcctagtggttcatcaaattttaattgcgattacggtggctagttaagtgcctctgtaaacatctagctactaagaggatatatcttcaaatgttttggttattgggacctggaggtgttctgtttagttgaaatgaaagtgttgttgaaggttgtacagatatataactttcgagaatgttaatgggtgttgcttgttaaagatctcatttgacgtgtgttctaaatcactttcaggatgagtctcaactaactaagataactcgggatagcgcaaagataactgtggaacaggtccatggactaatgtcgcaggtgagtaataatattgaaacgaaatggtgacatatctcccttaaggttcgtgtatttcacagactcaaaatccatcattgttgtacttgtaggtcataaaagatgaattattcaactcaatgcgtcagtccaacaacaaatctcccactgactcgtcggatccagaccctatgattacatattgaagttgctcttcttttggtttctagttttggattgacccatcatttgttgtcctttcatttattttctgttgtgtaaagaattataatgctaatgagaataatacagaagaagattttggttaaagaaatgtttttaagcccattcgattcgtcggggttaaaggaataatcttaagcccttaaacaaaaattgtatttatggaaatcagaaacctagtgatcttttccaactctatcccctctctctttccttctctgcactcacgttgtccgtgaataggtggtactaaaacatggctaacaatggcaatcatctttctctgtctttgtttgttgatgaaaagtgttccttatgggactgtcgacgacgacgcccacaaggagctatgtactgccaacctgaccatcttcaacaagcttatcaagaacgcacttcacacaacatggcaaacttatacacttgaagacgtagtattgcggagaatcttagaaagccttagttatccggagcttcgtggaagtccggggataccaaaccttcaagaaaacagtcagttattgtctatagctccgcacggatatgtttcctacaaatttgacatgtagcgagaaacatagcatatggctgtttctcgcgctgttcgtgcccgaccaaggggtttggaaactggttaaagaacggcatcgaaggaactatgtacgtgataaatttataccacgttttgctatgaacaatggttcaacatgggagctatataggtttacagtgaaaagtgactctgtagcctttttcactatggaatatcgcaaacccttgcttcttggggtggaggatctcagcctttttgatgatgatgttgatgatgattcgcattcgaataagaggaaaactccaccttgttctgagagcaagagaactgacaaaagatcttcatatggacatgtttccgagtattcctctaaataagattatggaccttaatttgatgtttaccttttattttctgttgtgtgacacaaatttgtaggcaaatgggaatgaattaaattggaataatacagaaaaaattgtgttaaggaatcgtcgacatggtttgatatttatttgagaataaagacacaaaagatgaaactagaaagcaataatttagtaagaccaacaaaaaaaaagggtggtgttttgctattgtacgcctctttctctccaaagctttttttttttcagctacagaaatg

SEQ ID NO: 10097 - DNA, 3000 bp, Unknown
  misc_feature (1)..( 3000): cDNA_ID_2714791_gDNA_ID_2213625_Annot_ID_195831 3000 nt of promoter + ATG
gcataagattcagaccacctgactttgccaatctacttctcagtcaatacgctcgccagcttctggtaatgttttacatcaaatcttcatatggtattattttattaatcaatcttctgataatcttttgaatctatgtgtagactctttacagcctaggtctaagaaaaatatttatacctggagtagcaccactaggctgcataccaaaccaacgagccagaggtatctcgccacctgatagatgtgttgacagcgtgaatcagattctaggcacatttaaccaagggctaaagtcacttgttgatcagctgaaccagcgatcacctggagccatctatgtatacggcaacacctatagcgcaattggtgacatcttaaacaacccagctgcttacggtacacttattctcggataacatggttgtcaaaggagtttcttctatgatttctactctgatcaaacatggtttatatggtacaggatttagcgtagtagacagggcttgttgcgggattgggaggaaccaaggacaaattacatgtctgccgttgcagactccttgtcccaacagaaatcagtatgtcttttgggatgcattccatcctactcagactgctaactccattctggctagacgagctttctatggtccaccttccgacgcatatcctgtcaatgtccaacagatgacactccttcactagtatattttggttttcgtgtttctttgaagttgtatgttataatgattgaacctatctatctatgagtatcgagtatcaagttgaaaccaaaatgcttgtactaaataacatatgtgctaatgaaaacaagaagacccatgatttagaagtcttagagaggacatattagtttcaaaacagagcatgccgagtttcgtgtgcaccaaatgccagaaaaaagaacacatgcattttcaatttactccgttcctactactctcatcatttcatttatcccactccagctctaactgtggttcagtctttagatgagaaacattcctcgacggcagagcttcagtattaacgtgaccagttaaccgattccaacccatgatgtgtggaagagcaaactgcacaaaatacaaaatctggttaaaaaacaatcaccaatatcccttgaagaatatatacttgatccagattcatgtgctaaaactgacagagaagcaatgcccttggtttttctagtcaatgtttttggttctcgaactgatataatagtaacagaatatagagaacgcagaataaaaatcttatcttacactaaaagctgtcttcatcactgcaaattcagcttttgtgacaggaaccacaaaatagtcattggttttgaggatgctattgttaacgcctgcaacaaaaccgcagaaggtaagtgtttatacagcattaagaattcagcattcctattgttataagacagctattctgtgcgaaaactgttatcgccatattacaaaactaatacaagtgcaagcttctaaatttactaaacagaaagctcccataactaagtatttcagtactgattatccatgttaatttgatagaagccttactcaatgagatgaagtagccgctaccatctgcgtggggcttaactgacagtgacttcctgacttgaccagcattactgaggagtcaaagacaagtctatgtcagaacatgaaaatgctgcgataaaaatataatgtattgaagcaaaaaaagacaaaccttgatttcatggaagggtcatggaaaaactcggagctgtctttggaacccatgctaattaaggatccaacttcagtaggtgacaaagcaaatttctgcaataatgtaggaaacaaaccaaatttatcagaggagaaagaagagacaagtgaagaagatagagagtgtgaaaaagatcaatacctgtttcttttcccagtcgtacttacgctcaccaatagcaggcataaaagtcatcattaaggatccacgacgatctatccgaagatttcccgactaaacaattgtactcacagtaagtaatgagaatctaaaagaagcctttaaagagaacacacaaaactaaaaagaaatggattttgggcttacatcgatttcagtgaaactgggaagaacaggttcaacagagagagcagcttttcctttgaagatagaataaggtgcgaacaatcgaccactaggctttgcggcatcttctcaaatcaagcaaacaaaattagggcaagtacacttaaactgacgaaacggaaacaaaccaagttcttacctttaccagggaatccacgtccaggggttgaagaatttgaccagcttgcaaaaccacgcaacgtcgaagcttcgaaaagtgacttactttggtcacaaaggctcctgctttaacaaaaacaaaccaacccagagaagccattttaagagtaatgaaatctaaaatctgaattttgagaggaactgaagtaacctggagagcaaagagcgggcttgcttcatcatcttcttctgtctcgagtaaaaagcatcacttgaggtcttccgacttctgaggttttatgatttatcaaaacgggttttatcgggcgacccatattttaacccgtttgttttatatataagtcttttaacggcccaatgggcctttattgttgattgggaaattaaaaatcagattagagaagacgaacgaatctgagaaaggtgaagctgaagaagaagaagaagaagaagaagaagaagaagaagaagaagaagactctctaatggcggactcaaactgatttcgaggattctgatttcgttttctagttgaagatctttcaactcttaatctcattaggaagatgtccgacatttccattgacgcattggtacttcattttttttgcattcgtgatcttctagccttaatcatggatcctttatgatctcttgtctaattcgctttgctcttctatctgaaattcatagggccaaactatg

SEQ ID NO: 10098 - DNA, 3000 bp, Unknown; identical to SEQ ID NO: 10093
  misc_feature (1)..( 3000): cDNA_ID_2714805_gDNA_ID_2213625_Annot_ID_195827 3000 nt of promoter + ATG

SEQ ID NO: 10099 - DNA, 3000 bp, Unknown
  misc_feature (1)..( 3000): cDNA_ID_3038936_gDNA_ID_2213625_Annot_ID_195823 3000 nt of promoter + ATG
aactagtgcatctcctgatcgagaacaaaaataaaaagcttgtcgtgtaagttttgtcacaacgtacttatcaaattaagcatccttttacagatagtctaactagtatctcttctgcagattcttcatgacatgtgcttgtgttgattactggggactcgtactttcaaaaattcctaccctcaagtccatttccttcttttccacccatgggaagatggatcagaaaggtagagacacggcattagcttcgtttacagaggcatcaagcggtgtccttctatgcacagatgtcgctgcacgtggacttgacattccaggcatcgattacgttgttcaggttgattgattaatgcttgttatgccatctttgttgcaatggattttgacaggttattgtatgtaactggtgcagtatgatcccccacaagacccagatgtatttatccatagggttggcaggactgcaagaatggaaagacaaggtagggccattgtgtttttaatgcccaaggagacagactatgtagagttcatgcgcattcgaagggtccctcttcaggagagaaaatgctctgagaacgcttctgatgtcatcccgattgtaagaaaacctccacgtatctcttttttctctctttctctctctcgctctcggccacagggtggtttaataataagtgctacaatgtaaaatgcagatacgttcactagccatcaaggaccgggcagtgttggagaagggattacaggcatttgtttcctttgtccgtgcttataaggagcatcactgctcttacattttcaggttcatttttcgccttgtgttgttaaaatatgttagcttttgtaactccattcttttgttccccttaaatttacagttggaaaggacttgaaatcggaaagttagccatgggatatggcatcttgtcttttccttacatatctgaagttaaacaagacagaattggcattgtcggttttacacctgtccaaggcatcacgtttgaggacataaaatacaagaacaaatctcgggagaaacaaagacagcaaaacttactagcaaggaaagacaaactgcaacaagaaaagagagggaaacgcaagaaaagctccaaagaggcggttgatgattctaacaaagcgtcgagaaagagaaagttaacggggaggcaaagacaaactatccaaacagcgcaagatgaagaagaaatgaatttgagattatagcttactggaaaaactgaagaaaggctcaattatagaagatgattttgctaaacttacaggagctcatgattttgtctgataaagaagcaagaaaacatttcaggcttcagcagagatgggaaggtggacgactatttattataactgagatcatgttttgtcttttggttgattctaaacatattggtcagaaagaatttaacaaaaggattctcaaatttaaaaagctctggagtggttttgtttttggtgagaacaagggttggaaaagttctgtaattagaaacgaaagctcaagacacatgtctaaagctattttcaatcctggtgaacataccagccggatttcagagtagagaatatatagccactgttgagagtcacaaaatacctcaacgctctttaagagatgtcaatctaaaatcgccccattatttttccagcttagctttcggcccattatatatttatttgaaaaaaatacccgctcttttattttaaaattttcataatctttcatgatcatgatccactgatccaggattaaaacatggcataaccagcaagtgatccgactaattctagaggtgaaacctacctgataatcataagaaatctattaatccatgtaattagcaagatggattactatataaaatgagatgaacatcaatgtttgtaactttgagaattgtcatttgaaacaaatctcatcttcatgattttatatctcaatctattaatctattataacttggtgatttcattctcccctttttaaaaaactttcttgcacctaataaaattctaatttatgttaataagctcatttgagcataaacctatcttggtttggttacataattgcttttcgttaacaaacatatgaaggttgctggtgtcacttgatttataactttcaaagactttcgtgtacaactccaaataaaaagagtaaaaatgaaagaagaggtcggccaaaggcgaggtcgacgcagatgaaaacgccaggtgtctcagaagaagggagcaatcgaagctggatctctctttacgccacgtcatttttagtcaacatcatgtgggacccatttccttaaccgtcattctccttctctaccgttcactagtttcctaattttgaatttcaattatttattggatttttaatttttatgaagtaatttcacactgacaaatatagtactgtaacttattcaactattcaaacttgctactttggttgctgctatatacgataacactgttatagaaaggtgtatactcattgctcgttggttttaaattggaatacaaacaaatttccagaagataaacaaattattgaaagataacttatgtcctaagtaattggtatgatggtttttactctgataattaaattagtgattttggacaaacggaaaaatcaggaaatcttaaaaatatttgtttattttgtttgatcggtttgttgttgctgaaagtttttgatcgaaaattttgtgattgaatatttagagttactttgtcaaagttggatacctaattaccaaattgcatttccaatctaaatctaacttatacatatgtctgtatgtttgtaactaacataggaacacatatgtcttgttttaacgcatatataattttattttattttgttgtgatgttttgttacaatctaaaatatgtaatagaatttttgaatacttttaatttaaaattttgggatattcctaatgatgatattaatagaccaaa

SEQ ID NO: 10100 - DNA, 3000 bp, Unknown
  misc_feature (1)..( 3000): cDNA_ID_2994697_gDNA_ID_2213625_Annot_ID_195822 3000 nt of promoter + ATG
cgcatgcattaaccttgactaaagtaagaaaaaaactaaaaataatgattttaattctaaactgcatctattaattagtcctgatgtgcaacaagccaagatgtattaaacaccaccatatacgtttattacaactcatacaatagaaaagtacaacacaaacgagtcttttggaggacacacctgaaaaattcaatacaaatatgaacaagacgttacacaatgcttcacaaaggcatagagactacaagaaatgggtttagcgaacacttggggtgactatgactttttttttttttgggaccaaacttttcagcgaaccattcttgcttgtgtgaagaaaagatgtatccgatcaccaaaccacagaaaacaccaggtccataagctattgcagctgctacacagttaaacattttttcctcctcctctaactactagatccttgggttgttgtgatgtaggattcaggacaagggttaattctccacagtctttttcgagaccatagagtttagggtatatctattaaagcttagccaatttctattcctaaacgaattatatcatcgttctcaacagatggctagattatgtccatctgaaaatttgatttgacaaatcaaaagacttggaaattaaaactaccttttaactccggcaacatacacagatttcttcataacaagctgtgggataagataattgtcgttatatatcgtaattgactcaaacactagaccttggggcctgtgtggttggtttccaaattgattgcctgtgaaggcccattaatacgaatagcctacatatatgtgctaatttaaatccctaatacagtacatagtcgtgcatctatatataaatatataataaatctacatttattttggtgtagtttttattataaagaaagagtcaaatggttactagaggatccaagtccaactttagcaatcaaatcttcggctaaaaaaatttcctccaaaattttcctcgcatagtcgtggatggtatccactgtttgtcctcctcaacaaaatgtaaaagccattcagaagtacaaacatgaaagaataaaaagaaaacacctttttgacaaaaaggatacaaaaaaatcatttgccaacaaaacaaccgaaaattcttcgagtagtatcagtgggtagggccaccaggagtaaaaaaatcattaagcatgtgagtaaaaaacaagagataaactgttgcttaattctgaaatctctcttgatctatttattattctcatgcaaaccattaatctttacgggagaaaaatattagtatgatattttgagtcctgattgcgactagtgatatcgaatgattacaattactaataagtattacctgaagctttcatcacgcgtctgcttaaacattgataaatacattatacccaagttaatcattctcttaactcatataatgtcagaagatcaatgacatcgagcagacacgttgtcgcctttttactcgcttttgttattacacaagctaaacaaaaagaatgtcccatgaaagaaaaagcaaataaagagagtaatactataataaacacatgggataagaaagtggattaaggcatcaatttcgtctccattacactaaacacacacttttgattacgttccaagactcggcgccgttatcttggcgccattcacgcttcccttttatcttttgtctcctctttttaaattcaaaatcacttaatccccctaacctaattcaactatgcactccctaactatacccatatatgaacatattcttactacggtagatccattttaaccccgaaactgcccatttcaaaattttaaacagtctatgtatatcgtaactaggaaatatattaaaaacaaacttaggtttgcataaaaggaaaacgttacttgtttagcaagtattagatatcttagaaataaaatcgtttagttaggaatcatttccaattcagtaggtgtgattgaatgtcgattttatatggttcagttgatttatgagacaaatattaatggggtcataatttgtagcatttttataggaaacagtttaaatatcaaatattggtttgttaagttaatatacgttggatatttgctttgcattaaaatatgaaaccatttactttacaagtatattgtatatacacgataaattgaaaaaatcaatgattaaatgtcgtttggattttatgtaggaaaaatctcaaaaagggaacgatctgattcgattgcaaaaaaaaatcggatcaaaatctcatataaggaaaaatacgaatcaaagacttccgcttcaaatttttttttttgaaatccatccgattaatttttttaaaatacatagatatcagtatatcaaaaaactgaaaactcttccgtcttttgagaataaaagagtccaacttttgcattcgacatttgactataacagtatcttttcgagaagacgcaaagtcgttacgtgcgtttatatttcgtttattcatgtcccaatactacctcttaggaaataagagactattaagactttcttgcttcccaatacacccccactaatatcaaataacctagtttaatttcttccgtttctcaacacttttaagaaaatacttaacaattgacataaaagaaaaaacgtacagaggaatttgaatggacaaacaaaggtgaaacaactagaatggacaaacaaaggtgaaacaactagaatttaacaatagacaaaaaaaaaagaaaaggatttggttaagcaatattaaggtatgaactaacctaaaccataaaatagtaaaaaaggaggattaaggttactttgtttaggagcagcacgttgataaccaaaaagccataattatcgcttccttcagcgcaggatccttctctctcctatctctctgtatatatatgtggaccttcacgtaatagcttcgtacttcaaacctcaaaagcaatttagctctctgtcttcaag

SEQ ID NO: 10101 - DNA, 3000 bp, Unknown
  misc_feature (1)..( 3000): cDNA_ID_2717032_gDNA_ID_2213625_Annot_ID_195818 3000 nt of promoter + ATG
tatgagcttgacctagaaaaagagtttgcgtcggtggagcttgaagtcgccgctatcgctttagggtttcggttctgacattcaatttataattcccaaattatgaatttattaagtatcgaaaatattttacataacgtatatggaaattgtactaactacaaaatagtaacttccgctctttaaccgcttgttaaaccgacagctttgatttaccctacccggttggttcctcaaccgaatcgcagaagatctatcttgatcaagcagcaatacccggtttactttacctcttaacttttttatcttaccatctcttaaggaaaaacagaggatttagggacaataaagtagacacaattccgattagtttagttacaaaaggcgtttctgtcagacgaaacagttggttacttaatttgtcttcataaacaaggtaatgaatttcgagcgtcgatgattacaagcttatctcaaatctcttttgggacattgaggcgctttggctcttctgttttaccttctgcactgaaacgcgaatttgttgaaggattgcgtacgttagtaaggtctggtgatatccgtcgagctgtttccttattctattctgcgccggtcgagcttcagtctcaacaggcttacgcagctctgttccaagcatgtgcagagcaacgcaatctcctcgatggaatcaacttgcaccaccacatgctctcacatccctattgttattcacagaacgttatacttgctaatttcctcattaatatgtatgccaaatgtgggaatatcttatacgcacgacaggtgtttgatacaatgcctgagaggaatgttgtttcatggactgcattgatcacaggctatgtacaggctgggaatgagcaagagggattctgtcttttctcgtctatgttatcccattgtttccctaacgagtttacgctgtcaagcgtgttaacttcatgtcgatatgagcctggaaagcaggtacatggacttgctctgaaacttggtttacattgttcgatctatgtggcgaatgcagttatctctatgtacggtaggtgtcatgatggtgccgcagcatatgaagcttggactgtgtttgaagccataaagtttaagaatttggttacttggaactcaatgattgctgcttttcagtgctgcaatcttgggaaaaaggccattggcgtttttatgcggatgcatagtgatggagtgggatttgatcgtgccacgttgcttaatatatgttcttccttgtacaaaagctctgacttagttcctaatgaggtttcaaagtgttgtcttcaactgcattctctgactgtaaaatccgggttggtgactcagactgaagtggctactgcattgattaaagtttattcagaaatgttagaagactatactgactgctacaagctttttatggaaatgagtcactgcagggacattgttgcttggaatgggattataacagcgtttgcagtgtatgatccggagagagctattcatctctttggtcagttacgtcaggagaagctaagccctgactggtatactttctcaagtgtactaaaagcttgtgcaggacttgtcactgctcgccatgctttgtctatacacgctcaagtgatcaagggtggttttttggctgacacggtgctgaacaactcattaatccatgcgtatgccaagtgtggctctcttgacttgtgtatgcgtgtatttgacgatatggattcgcgggatgttgtttcctggaactcaatgctcaaggcttactcattacatggccaagtagactcaattctaccagtctttcagaaaatggacatcaaccccgattcagcgactttcatagcccttctctcggcttgcagccacgcaggacgagtagaagaaggattgagaatattcagatccatgtttgagaaacctgaaactcttcctcagctaaatcactacgcttgtgtgatcgatatgctaagccgagctgagcgttttgctgaggcagaagaggttatcaagcagatgccaatggacccagatgctgtagtttggattgcattattgggatcatgtagaaagcacggtaacacccggttgggtaagttagcggcagataaacttaaagagctagtcgaacccacaaactcaatgagttacatccagatgtcaaacatatacaacgcagaaggtagctttaacgaagccaatcttagcataaaggagatggaaacatggagagtacggaaagaaccagacttaagctggacagagataggaaacaaggttcacgaattcgcatcgggaggaagacaccgtccggacaaggaagccgtatacagagaattgaagagactgattagttggttaaaggagatgggttacgttccagaaatgaggtcagcttcacaagatatagaagacgaagaacaggaggaagataatttattacatcacagcgagaaacttgcgttagcgtttgcggttatggagggaagaaaatcgagtgattgtggtgtgaatttgatacagattatgaagaacacaaggatctgtattgattgccataacttcatgaaattagcttctaagcttttgggaaaagagattcttatgagagactcgaatcggtttcaccatttcaaagattcttcttgctcctgtaatgactactggtaattttctatgttactttcatcacaagacaaagacaaggactgatttggcaaataaataaaagtataagaaaatgtgttaattaagggaaaaaaagaaaaaaaggaaaaaaaacaagttgcagaaagagagagaggtgggggaagaagacgatcttcgatccagagttgagcttctcttctgccatcgtcttcttcctcgatctcggtcaattacgcattctctgatctgatttgtgagatctctcgtcggatcaccgttttttacatcgtcgccgacaacacttaggagtaattggatccagcagaa

SEQ ID NO: 10102 - DNA, 3000 bp, Unknown; identical to SEQ ID NO: 10097
  misc_feature (1)..( 3000): cDNA_ID_2714791_gDNA_ID_2213625_Annot_ID_132028 3000 nt of promoter + ATG

SEQ ID NO: 10103 - DNA, 3000 bp, Unknown
  misc_feature (1)..( 3000): cDNA_ID_2714787_gDNA_ID_2213625_Annot_ID_132030 3000 nt of promoter + ATG
atacacgagggacggaagtcacaccagactacagactttccgcagttgtcatcggagagacttttatgcatggccgccaacaggaaaggacctgttttaaagtgggagaataacgttgcatggcctggaaaacttactttaactgataaagccctctatttcgaggtaattagttcttttttttctaagtcccttgggaaggagcgagcgagtgaacactcttttctgtttgcttttatagatgaagaacacttcagttttacatatttactgcattgatatgcaacgttagctggaattctaagttgtttaattttaaactttgcgaacccatgtcttattagaatgttcttttggtgtagaaatgagaaccctaaacccttctcatggaaatgctcttttggtttcagccagttgacataaaaggaagtaaaggggtcttgagacttgatctcgctggagacaagtcaacagtggagaaagcgaaagtggggcctctgggcttttctctctttgattctgcagtttctgtttcatccggccccgggtgagttcatatgttcatgtagctgatcactgatgtcgttctgatatgtctctgacggtgccatttgtctgggtggtcgtttacctatatgctaacctgtaaatattcatttaggttggccacttgggttctggagttcgttgaccttggaggagaacttagacgagatgtttggcatgcaattattagtgaagttatagcattgcacacatttctacgagaatttgggccaggagagggtgataagtcgctgtatcaagtgtttggtgcaaagaagggtaaggaaaaagcaattgcaagtgcatctaactgtattgcaagacttcaagctcttcaatatatgcggaatttgcctgatgatcctatcaaactagttcagttctcttttcttcaacaagtagcctatggtgacatcgtgtgtcaaactttagccgtaaatttttggggtggaccactattgaccaaagtttcagacaaacgaggtgatattgccagggcttccagagagtcctatgaaacttttgataacgtgtctgatctagatggaagtgtttacttgaaaaggtggatgagatctccttcctggggttcaactgcatccatgaacttctggaaaaactcttctctaagacaaggcttagttctgagcaaacaccttgcggttgctgatcttacacttgtagagagggcaacagaaacatgtagacaaaaatacaaggtggtcgaaaaaactcaagccactattgatgctgcaactatcaaagggatacctagtaacattgacctctttaaggtaacactttttctccattgatagttttgctacaaacattgttttggacggtttcctaattcgtcatgtttagacaactttcatctcttgtgtcaatggactcggtatttgtagtatttttcattaccttgcaaactattacataaaattaaataagtagagaccgtagtgactcaatgttgtcctgctactcttattttttaatcccaggaactcattctaccactgagtataactgccacagagtttgagaaactcaggtgctgggaggagccttacatgacggtctcttttctagcatttgcatcaacgataattttcaggttggttgacacttagacatgtgataaatgtgatatctcgtgcacattaatgattcttaggtttaagacttgtaatcgcatgcagagaaatcatattatcattgctgcttcaagttagatattattatcattgcttcaagttagacttagtaatgatctgataccactgaggatacttttctgcgcctcaggaaccttttgcagtacgttcttcccgtgtctttgatatttttggcaactgggatgcttacgttgaagggactcagacgacaaggccgtctaggaagattgtttggaataattagcattcgagatcagccatcttcaaatactattcaaaaaataattgctgtcaaagacgccatgcaaaatctggagagctatctccaaaaggtgaatgtagtgcttctaaaactacggacaattgtattatctggtcatcctcaggtatgttctaatcactggatcaggtttcagagctttttattgcattccttctcttacctggtgacgcgatttgaaacttttctcagataactactgaagtagcactggctatgctatctattgcaacggttctagtcattgtccctttcaagtatgttctggcttttgttctctacgatcaatttactcgggagctcgagttccggaaagaaatggtcaagaaatttaatgctttcttacgggaacgttgggagatggtaccagcagctcctgtcattgttttaccgtttgttaatgaagagtctacaccagcaactcaggaaaacaagcagctcagaaaaccaacaccgagaggtgattgataaaaagtgccaaatttgtataatctagtggcgtgtgcatgttttaactagaagctcaagaaggaacaaatatcaaattgtagttgacaatgattcattaaatgtatatgaaaagtagtatagatgttagttgtttatgcttattgctcatcttcttaaaaatctatttccaaaacctgtcagccttaagaaattcattatgatccgctcgtggcaactctatccgttagtctcagataatcctgtgctcatttatttcttttgatctttatctgaagaggtttagaaaaaatttcgtcatggtcatgtctccttgcgtatgcagttttagtctcttattatggaaatttcaagcatgatgcaagctttttgactcgcttacatgcaagcagtcgaaacgtgagagagtaagcagttacaaagtgaatcagaaattccggaagataactcctttgtgtcacatgcagcatgttttgcttagagccttttatataacaatctttccatattcacaagttaagtaaaatg

SEQ ID NO: 10104 - DNA, 3000 bp, Unknown; identical to SEQ ID NO: 10096
  misc_feature (1)..( 3000): cDNA_ID_2714783_gDNA_ID_2213625_Annot_ID_132031 3000 nt of promoter + ATG

SEQ ID NO: 10105 - DNA, 3000 bp, Unknown; identical to SEQ ID NO: 10095
  misc_feature (1)..( 3000): cDNA_ID_2714779_gDNA_ID_2213625_Annot_ID_132032 3000 nt of promoter + ATG

SEQ ID NO: 10106 - DNA, 3000 bp, Unknown
  misc_feature (1)..( 3000): cDNA_ID_2994632_gDNA_ID_2213625_Annot_ID_132033 3000 nt of promoter + ATG
cagagataaaaaagctcctgcaagttacaacgtccaggacatataaagcctcaagaagaagaatctggcttttctcattcatctgttgtccatgatccaaatcccaaaacagatactgaatccaaatcaactcccttgttctctctattcaacaattctgacctctctgtgacatacttttcatcattcaagttgcctctgtctactattccaaccattcctccctaagtttgaccttgaattccgttcctctagtatgcggttagcccgttcaaggatcatgtcagtccgttcattaggcacatatcctctccgagctattctttcaaccatctcatatgcatcttccgcctggttcattacaatcattctcaacagcatattgtacgtgtacatatcaagaggatagcatttctctataacttcatctaaccgcttcagttctacttccatatctattcgtcctgagaataatcctatcaactcaccaagtgacttcatctcagggatcttatcttctatatttctcatccgtgtccatgcttcatacacccctttgctcttcattgcgttatgcaaaaggacattacctatgaaagctgtaatacgacgcccacttttcctaaattcattgactaatccaactgcctcatcatacttttcttcgttgcacaatttttgtatgtttacttcgtaacattcgatactaggctgtagtccttctcccttcatttcttccaagaaatgcatagcatcatccaatttatttgctttacagagaccaacaatcataacttggtacagtctttttttggtcttaccttgttcacgcaggtcatggaaaaagtgaagagcatcggcgattttctcattttttagataactctgaagcatgagaatgtttgaagctactgtgggcgtgataccatctctatccatcatatcatacactagtcttgcaagttttggttttcctgcaaacccagctccttcaatgaataagttgtaggcctgaaccttgtgttcccaaagagacaactgaaactttagcaaagtagtaaagaagtttttttcaccactttccatctcacaaacacattgaataacatttcgatagagactacgggtcggggtgtagcccttttcctgcatcctgatgataagtttagcagctatgtctcccctcattagtgtgattgagccatatatcaaactggtgaacattttaaaggaggtgtctacaccacttttattgaatagctcattaatcataagagcgtcctccactttcccaacatcgcaaagagctgatataatcttgcaaccagctatacgtttaggcaataagtcccgttcagcggcagcaataaccagctcccttgccatgtcaggcttccccttccagcacaaggcattggttagtgtactaaatgtctttccaccaagaaaatgccctcggtcaattgcccctttcaagacatcataagcttgttcaacactttcattggcacaaagggtatgaatcagatagttgtaagacatggcggtaggagcaaacccaatttctgacctcgaccggtataactcgagggcttcatctacaaatccagctttgcaaaagaagcataaagcagcattcatcgttttcttattcggcgaaactccacgtaccatcatctccgtaagaatatcatacacaccatcaagattgttctccttcaaaagttgaaagaccatagagttatacctgaaaacttcgagttcacaaccttccaaaggactaatcttctgcaagaaatccgcagggttattcaagaatccagctttaataagcgccctaatccaaatgttataagcacggtccatattcactgttcccaccagtttgatctcgtctaacaacttagtagcttcctgaaactttcgtttggaacatagagcatcaaccaatatacctaagccagaaccacatccagcaggatcattaggcagcaaggctcgaagataatcttcagcctcatcaagcttcccttgcttgcaaaacttcttcaccaaaatcgaatgcgtaacagcacatacgaagccacgcacggagatctggtcgaagatgacatcaaaactatcaaaacacttctcctcaacaagtgcattcaaaagcacatgatacccaaaagaatccaaatccaaacctcgaaatctcatattaccaaaatgctgaagagctatatcagtacgaccagctacagcataaccaacaacaagagcatcacagagacgaagagaatgacggcaactttcaaaaccaacacttcgatccaaaaagtcaatcataagagtcacaagcttcgcaccacgaaggatcttgaagatagcatgaaaagtagcacgcgtgtgatgaaacccaggctgacgagcagcccaatcgaagaatttgagacaacagaggatatcgtaacgagtgtgtgaaagcacgtcgaggacgaatttctcagtgagacgaagtcggagattggagaggtggagataaaaagctctatcgtctccatcgttagaaggagctcgaaggatgtcaaagattcgatcgattaattggtggctctgtttcacatctcgatgcttaaaccagtctttccattcacggacgaggaaatctccgggagcgattgaagaagaaggtttcgtgaaggtagagaacggaatagcgtcgccgttgttaccggaagtaaagtttctgaacgacgacgcagagagcgatagtatcctccgcctgaggagcattccttcgcatgatctctcgacggtgactgaccaacaccgaagcatccaaaaactcgaaaaaccctagcatttttcaaccaatcagtggcgcccacgtcatactcgatgtcgtggcttttgtacgttatttacgaaaatgtccttttagtgttagtaaggatatttcgattcccggctcgttcgttactggtttttttcttcttctccgtcgcggaaaagatg

SEQ ID NO: 10107 - DNA, 3000 bp, Unknown
  misc_feature (1)..( 3000): cDNA_ID_2714915_gDNA_ID_2213626_Annot_ID_132034 3000 nt of promoter + ATG
tggtgagaatagtttgggtcattcttcatctgcctctggaaatgatcagaagaagcagaaatcgtctaaaaacaatgagctcattcacttgtgagatgtgttttgtttttcttagtggatttggattggtgtttagtctttgggaatatgcatcaacagttgttatgtaagtaaactaaaattagcagccttgtgggattgaaatatatttagggtgtaacctgtatatttcgctgctctgttttggtgttattaatttatctaagtgattaatcgttaagacttaaaattatatcaatattttaattgacaaaatatctccaaattcccctaaattacgcactccgtccctctcttcttcgactcattgaggagttgccctaatttgtagtgttaagagttgtgcgaaaatttgcattttcaatgttgttggtgttttcggtgtcacagcctcaaaatcaatttcctactcgcgttgttgttgttgttgttaagtcataagtgttaggtttgaatcaaccgctgtagtaccagtggaactgttttgatttgcttagcgagaagatggatctagtgagcagtttaccagacgatgttcgttgtcatatactgtccttccttaccacaaaggagtctgctttgacatctgttctgtctaagaagtggcggaatctgttcacgcttgtccctaatctcgacttggatgactctgagtatcttcatccggaagagactaagtgggaaagagaagaaattctggatagcttcttggattttgtggaaagagtattgtctttgcagggaaatggtcccattcgtaggttctccctcaggtgtgaaagcggtgttcctccagctcgtctgaatcgttggttatgtaaagtgctgcagcgtggtgttgcggaccttgaacttatcatcgacttcgaagatggttatcttctgcctcgagagttgttcgtcagtgagacactcgtcaatctcaggttaaaatctgaatttggttgtattcattggtggcctggagctgaaggcactttcttaccaaggcttcaaagtcttgatataagctctgcgatggttttttgtgatgataagcttcagaagcttcttccttgtttccctgtgattgaggaattacggttggtaggtatggagtggattgattctcatgtaaccgtgtcgtgtgcaaccctcactaatcagctacttcttagctccaccggttccagaacctctaaaaatccaaagagcgtttcttttgatactccaaatctgctttccctagcctactctgatttagttgctgaggactatccgttggttaatatgaaaagtttattcaaggctcgaatcatccttggagtagatgacgatcaaatcgcccgaatgcgagccccaactaactatttgtcagaggatgatgttgttcgccgatttggcaatgtggtgaagctcatgaagggcatacaaaatgttcagcaacttcacttgcattctgatacactcgaggttagttttccattttcttctttctggtctagttgtaatgtattgattgcaagatgattttagctgcgttttgtttcttgtttcaggtgctttcaatgtgctgtgaatcgatgccggtgttcaacaacgtcaaaacgttaggcattaagagtgactacgacagaggatggcaagcagtgcctgctcttctaaggaattgtccacatctagaaaccctgacctttgaggtggaactataaaccatgaaactaactacttggacaaaacatgcagttcattcttatagtaaccttattgtctcgtttctgctttcagggtctcgtgcaccatgtgacagataaatgtggagatgcttgtgactgcattttccggaaggataaaggccgttcgctcaaatcttgtccagtaaaagtggtagagattaaagagtttagagtaacaatgaaagagatgcacctgatagagcatttcttggacaactttccatgtttgaaggagatgaagatctatagagaagagtatgatccttcaccgtttggaaacgaccctcaagtggatgatcttatcttggacatgatagaagagtacaaggatatatatagttgcaatgtccaactcttggagccgtgtgacaagtgggatgaacaatgaagtctttgaacaaagtccccctaggaatttgacttatcagatccgatccttgttttgttttagttatctatgtgtatcttttaatcacactatcctcggctcggctagactgattgccacacctattttgctttagtccttggaaactttctgattgcttttggttaattttcaagactctgaattacgtattgcttaagggttactgattttcatcctctgactcagtcttgtgtgcatttaacactctttgcatctgatcacttgttggtttcattagatcttgccgatatcaaattataaaacatttgagtaaatcttgttgttgttgcatcaagcagttatcaggaaaagtggtgaacatgaagcttccttcatacgaggaggtcacagtaaatggtgaaaggaagtcgttggtaactttcttaacttggtttacatgatggttagagcaagtcgtttagagtgggttttactttttcagttgcataatattttcatgttgggattgaaataaaagtataatcacatgtatacaaaaaccaaacagtataacacgtcaaatcacattagaataattaattaaattttatcgataaaaatcaccaaaataccaataaattccgcactccgtctcttccagtctcagtcagtcgctattctctcatcgacgtttcattgccctaatttgaagattggcctctgtagcaaggtatgatgttgctctcagtctcaaaataaacaatctctctgcttcaatttcgagtggaactgtttggtttgggaaattgatttctttgctttgcgttgtgtatttttttctcttcagagaagatg

SEQ ID NO: 10108 - DNA, 3000 bp, Unknown
  misc_feature (1)..( 3000): cDNA_ID_2714911_gDNA_ID_2213626_Annot_ID_132035 3000 nt of promoter + ATG
gcgatctgtgtttttcccgcatcaatggtgatatgggttggcagtttcagggtctttgctctttcctgtcggtatcaacaagattgttacactcttcacataggaggatcttatgactttttcttcttctcttattcaatacctaggaaactgcaatcttgcaaagggcaagtatatttacgtagcacatgttcagtaaactcacttgcaaaactagcatctcttcctcactttcaattttgacaacaacttttggctgagcacaatattcccatctgcaagagcaataagtaactgttaattccatccgtagcctgaaaaagaaacatagaattgaagtagagtatgagatggtgtggcataccgcatacctacctgttcaaggcttttggcgcccgttgaaggagtttcttgtataaacctaaagttgcatgactacatataatatgcaaaacaagagaaaaggagttgttaattgaattcaagaaatgcaattgaaaactgaaagaggattgataatcacctgcattgagctgcaatcttccctttacccattttaagatcattcctcacaaccaaaacctacacagacaacaacaacaacaacaagaagcatttatatcagctactggtatcttggtgcaatacaaagacaaggaggcagagtgaggctaggtaccattttgaaatttttgcgaaaatcagcgagtttctctatctcgaggggttccttggacttggttttcttattcccgctggatcctgcatctatggcgacagatttggaggagagaaagattcggcgggtttgtcgtaaagtgctgatgtaatatccaagtgcagctccaacaagtaaaacacttaataaccacaccaaatccatacctcctacaagaattagcaaacaaaattcacaactatcattaactcaaacaatgttgaatcaatgtggtaactaaaatcagtgttctgataagaaaataacatagtaacaaattttgggaatctaaaagtgaattaagaaactagtgcattagtacttgtttctctcggaatcaagtaaaaaacataagctagttttaaacatacaaaagctgtgttggagctattgaatcgataaaaaagctacttgacgattctggggtttcaccaatagggaatttaagtagacaacaaactaataagcattatcaattgtagaaataaatctacgagggacggttaatggaagattcgttaccttaaagtcttccggcggctgagctgtgacaagtctgtttcttcgttcaagtttcaacgattttggcgatattctggtgtttggccacacgaataggtctctccttaatatgtttaaaagtgttgttcccaatcttttttatatcggcaaaatttgggcctttgagatgttgaacggcccattttcatttttaaaaacaattactttctggcattttcgaaatcatatttactttccttattattgttttttttcataaagcaaaggaaattgtttttgtataaaaaaagttgaaaccaacaaatccaagactcgtggtttcttcatgccatggagataaaaaaaaaagaaagagtccaaatattcctttaaagttaacgcgtcttctcacttgtcgtacggcattgacctcctcgtagattatttttcttctcaattaaaacctctgtgtcacagtctcaaaatcagtttcctactcgcgttgttgttcttaagtcataagtgttaggtttgaatcaatcgctctagtaccagtggaactgttgatttgcttagcgagaagatggatctgagaccctgaagatgatctggagttatcttggtccgagcagttcatatgtccttaacatcttcggggaatgtcaaaaccattttataaacacaaaatcttcttcttcttcttcctttctctctctccataattcttgtttgcgtcattcattcatcacatatccacataccacagagacagaggaatcgtcctttatcagaaatggcaggcagtaatcttctccaaggtatactctatttattcttcttctttgatggtactactatttgatctgatctattttgagttcatttttctctagtttggacctggaatcagtttctctcttgttagctatttctctcttctctattgtatgaaatcaaatccaaatctattttgctcttgaagacaacctaaagctttcacctttctctcttctttacatttcaataaagctcattgagctattttgcattttcagtctcttctaataagctcaatgagcatatatctattttcagtctcttctaattagctgcaacagagccagccatatgattcttgttgctactaaacctaaagactctcgcggaagcagcagcgatgagatgatgatgaatgatctggatgagataatatttggtgagaatagtttgggtcattcttcatctgcctctggaaatgatcagaagaagcagaaatcgtctaaaaacaatgagctcattcacttgtgagatgtgttttgtttttcttagtggatttggattggtgtttagtctttgggaatatgcatcaacagttgttatgtaagtaaactaaaattagcagccttgtgggattgaaatatatttagggtgtaacctgtatatttcgctgctctgttttggtgttattaatttatctaagtgattaatcgttaagacttaaaattatatcaatattttaattgacaaaatatctccaaattcccctaaattacgcactccgtccctctcttcttcgactcattgaggagttgccctaatttgtagtgttaagagttgtgcgaaaatttgcattttcaatgttgttggtgttttcggtgtcacagcctcaaaatcaatttcctactcgcgttgttgttgttgttgttaagtcataagtgttaggtttgaatcaaccgctgtagtaccagtggaactgttttgatttgcttagcgagaagatg

SEQ ID NO: 10109 - DNA, 3000 bp, Unknown
  misc_feature (1)..( 3000): cDNA_ID_2714901_gDNA_ID_2213626_Annot_ID_132039 3000 nt of promoter + ATG
tgattttgtttttggataattgccaatgaagcaaaagagctattttcaaccaagctaactattttaagaagggtggtgaaaaactcataagaacttccttacaccttataaacacgtaatgatcagcgtataaaacccaaaaaacagtacattaacggtgactatttaccttttcattacagagttcacaatgagaaatcaaatgaatgggaaatatagttttaagttaaatgaattcgtacgctgatgatgaccctagcttcggtttggtttgcgagggttagacacaatccgtgtctttgcaaaacagccatttcaaacctttctcatccttgttagccagcttagatgccactgacttgataccactcttcatataattcacaacaaacatcgccacctctctgcaaattacagtaaattgttgtaaaccattatagagtacaagagaatcaaagacttgttttgtctgtgagtaaatctccttacaagggtgagcaaggagttcgagaaccgttgatgaagtagacaaacaagaacgcatcaaaatgatgtcgattgattagataaaatccatgtaatctccgcacgcatctgaacatcaatcttttgtacaaacagatcgcagcattgttgtgtgcaatcacatgaaggtaaactccgcgacacacagataaaccggaagcatatttaattacctcactaataagtgacattgctgagagttaaaaaaagttgcagaaacatcagaaattataaaaccaagcaatatatagaacatgtttcagatacttattagtattataagagtcatgtaccgattccacggtttctgtatgtttctacaactccgagtgtcaagatgtatatcaaagtctcctctcctttcgaggaatcgtaatgtataagatcatctatctgtgcaagacacagaaaccatctgccagctgatgaagatagataataagaagataaaaacaacactagactcaattgcattaccagagctcccaaaacagattattcaatcataattcagacattattacaagccgctgttctaaagatttttgacaagtgaaataacttttatttagtgtacatgatcacagacgaaccaaaaaccataagcattatgaactagttcaacattcaaggtgattacaggacctgaaagatcattattgttcgaattacaaaaagacgaattcatagaatgaaaactaacctcgctatctttggcaagcacaaatttggcagtaacaaaaccaataagttcatcagagtgatcatcaggccggctccgatcaacagcagcccatgagacgatatcaactccgttcacaacactctggaaaaactcagactcatacctgacaaaacaaaaatcaatactttagaaatcttttcacaagacaccaacataggaaaatccaagtagatggatgcatacttgatggggaagatatcgcgatggatttgctccaaacgatctagatcattagggtttataggtctatagtgaatacttgggcaaagagagattcctgcatcttccattgatgaatcatctatgaatcttcgaggaaatcgcgacattgtttggtatccgaagaaccagaaaagccacttcccattgtgaagtgccagatcactggatccgacccgttgaagtaaatggatccggatagatttaacgaatctggatctgagtgggtttgtttggatttgattggttaatcttcggcgaaggaatcaatcaagaaccgagtttcgagcatgggaaagaaaaaggtgcttgcttgctttgccctctcctctgtctcttggggctttttctcgttccaagtgaagcatcttggctcgtgtgctttgcgacaaccaatcacgtgcctcttttagaaggagagtactaatgtactatttatgaatggaatattcgattctcttaaatgaaaaattgttccattttcaataatataaccatttttaacaataaaaattcgtactgttttttctatctgaaaaaaatggatttgaaaaaattcgtactttcgattcataatctgctttttattattattcgttataagtctgtactatggtaagagaaccttaaaatattcccctccacaacaaaaaataaaaatcaaactggagaagagttaggcagtaaaggagaatttccttgccctattaactcgattaggcgggccaatacacttgttatgtgttttccacttttcttcgttacaaatttagattagtcttacatgatgagccgttagatatcatagaaagaaataatcttataaaatttgataagatttctataatccacaaatctggatcgatgtttatttcagatttataaatattgtcttaaaaaaaaaattattggccgtctcggcggcaagcagagagagagagactcaacgttttcgtaacaacaaaactttgagtagcagaaaattatccaaaaaaaaacgtgaaacgcaaatggaaaaaattgagaaaagtaacgcgagtccagtgccacgtatgaaaaaaagagcttaggaccagatacgttaatcagaaaaagaccaggtacgtacgttaattaatgtttttttaaaaaggccaagcacgttagtccagcccacgtggtatttcttatcttaacaacaaaactaattttttaatttaataatcggacgttgcagaggtaatcagatcaacggtagagattacgacacgttatatcactctgcgaaactccaccgctttctggaattaaaaaaatcagagtgtataaataaaagagcagaggtaaaagctatctccagagtttaatataagtgtagacagagagagagagagcttctttcttcttctcttcgtcgctaagagatgatcttcgaatataaatctctgtaaggtttgcgaagaccggagtagtgaatctcggaattgttgaagaagacggtacaccggaatcaattgcgattttgatttatg

SEQ ID NO: 10110 - DNA, 3000 bp, Unknown
  misc_feature (1)..( 3000): cDNA_ID_2714898_gDNA_ID_2213626_Annot_ID_132040 3000 nt of promoter + ATG
tctgctgagaaaattggtttaagaaacctggactttggacagcctttgctagaaaggacatcatctgttgctgcctctgctccatcacatgaactttctgccccacattctgcagatgatgttcggtaacttgttgttgctgcctcaaccttacaagttcctgcataaggacgttcttatcgcgctgaagtctttccacttcctcttcgagtccaaatttgcccacttcaacgcacgcacccacagatgagtgctgaacttgaggttgttgtggaggctgcacttgtgcaggttttcgccggacaatactctttagtatttgcttttggcctcttaaaaagccctcgtttgcaaactcccagcggtctggatcaacttttctaaaaccctgaaaaaaagaagcatggagaatggaacagtcatcaaccgcaagaagttacttggattccgttgcaataggaagccaacatagaagatttgtataaacataaagaccattaaatacgttaataacaactattctagatatggtatgatacgttcactgggtctagctgcagcaccaaactaccatggtccaaggaaactaatacagttgttagtgtatcggcatgtacctggacggacaaatacaaacgaatggaaagctaacatgggacaactgatagaaattttgttttgtgacttaagaggccagaaatggaagtgctgaatcaaccaatcgtcagacacatatgagcacatgtccaaataagcctgcaaagttcgtggaaccttttggtaagtaaataagaacaggggaggaacaagctacgcaagagtatacacttgttagttttgcttgacctaagaaaattcattccagcctcacagacacggatgcaagctcagatacttagaaaaacaaaaacatatatgcctgcagttcacagggtatacatgtacaaaaaacaactgaagaacaatacaaatatgtgaaattatcttgcacgagtttgtcagaacccaaaaagatccaatcttaacagttagtgcaactaaaatcaacattaacacaacctactagacgtgcatagttcaaccaccagcgtcaacaactatataggaacatcaatcagtagcatcatactatacactaaataggagtcgacttctcaaagcaccttcttgcaaccttaaatcattcgtgagttttatcaataactaatgcttaattcaaccacaaaaaaaacaagagagtaaaataaaaatgaagcacataaagtaagattccctaaaatcgaactacgaaattgaagaaaatcgaatcaatgaagagaaaaacaaataaaaaagaatcgatcgaagttcactcacataagtattgagctgtctgacgaagctggagaaattgttgtgcttgaaatactttggtagaaactgtttggcgaactcaggcacgttccaaaccacgaagctgttgtttccgctgctccaagacaccacgtcgtccgtcaatggatcgtcaaccatatcgtacgttttgctcagaaaaggcggaatggagctcatcaccgccgtcgaagatttcgccgtcgctacagattcgcaaaccgttcccataaatcaaaatcgcaattgattccggtgtaccgtcttcttcaacaattccgagattcactactccggtcttcgcaaaccttacagagatttatattcgaagatcatctcttagcgacgaagagaagaagaaagaagctctctctctctctgtctacacttatattaaactctggagatagcttttacctctgctcttttatttatacactctgatttttttaattccagaaagcggtggagtttcgcagagtgatataacgtgtcgtaatctctaccgttgatctgattacctctgcaacgtccgattattaaattaaaaaattagttttgttgttaagataagaaataccacgtgggctggactaacgtgcttggcctttttaaaaaaacattaattaacgtacgtacctggtctttttctgattaacgtatctggtcctaagctctttttttcatacgtggcactggactcgcgttacttttctcaattttttccatttgcgtttcacgtttttttttggataattttctgctactcaaagttttgttgttacgaaaacgttgagtctctctctctctgcttgccgccgagacggccaataattttttttttaagacaatatttataaatctgaaataaacatcgatccagatttgtggattatagaaatcttatcaaattttataagattatttctttctatgatatctaacggctcatcatgtaagactaatctaaatttgtaacgaagaaaagtggaaaacacataacaagtgtattggcccgcctaatcgagttaatagggcaaggaaattctcctttactgcctaactcttctccagtttgatttttattttttgttgtggaggggaatattttaaggttctcttaccatagtacagacttataacgaataataataaaaagcagattatgaatcgaaagtacgaattttttcaaatccatttttttcagatagaaaaaacagtacgaatttttattgttaaaaatggttatattattgaaaatggaacaatttttcatttaagagaatcgaatattccattcataaatagtacattagtactctccttctaaaagaggcacgtgattggttgtcgcaaagcacacgagccaagatgcttcacttggaacgagaaaaagccccaagagacagaggagagggcaaagcaagcaagcacctttttctttcccatgctcgaaactcggttcttgattgattccttcgccgaagattaaccaatcaaatccaaacaaacccactcagatccagattcgttaaatctatccggatccatttacttcaacgggtcggatccagtgatctggcacttcacaatgggaagtggcttttctggttcttcggataccaaaca

SEQ ID NO: 10111 - DNA, 3000 bp, Unknown
  misc_feature (1)..( 3000): cDNA_ID_3035344_gDNA_ID_2213626_Annot_ID_132041 3000 nt of promoter + ATG
agagaagaagaaagaagctctctctctctctgtctacacttatattaaactctggagatagcttttacctctgctcttttatttatacactctgatttttttaattccagaaagcggtggagtttcgcagagtgatataacgtgtcgtaatctctaccgttgatctgattacctctgcaacgtccgattattaaattaaaaaattagttttgttgttaagataagaaataccacgtgggctggactaacgtgcttggcctttttaaaaaaacattaattaacgtacgtacctggtctttttctgattaacgtatctggtcctaagctctttttttcatacgtggcactggactcgcgttacttttctcaattttttccatttgcgtttcacgtttttttttggataattttctgctactcaaagttttgttgttacgaaaacgttgagtctctctctctctgcttgccgccgagacggccaataattttttttttaagacaatatttataaatctgaaataaacatcgatccagatttgtggattatagaaatcttatcaaattttataagattatttctttctatgatatctaacggctcatcatgtaagactaatctaaatttgtaacgaagaaaagtggaaaacacataacaagtgtattggcccgcctaatcgagttaatagggcaaggaaattctcctttactgcctaactcttctccagtttgatttttattttttgttgtggaggggaatattttaaggttctcttaccatagtacagacttataacgaataataataaaaagcagattatgaatcgaaagtacgaattttttcaaatccatttttttcagatagaaaaaacagtacgaatttttattgttaaaaatggttatattattgaaaatggaacaatttttcatttaagagaatcgaatattccattcataaatagtacattagtactctccttctaaaagaggcacgtgattggttgtcgcaaagcacacgagccaagatgcttcacttggaacgagaaaaagccccaagagacagaggagagggcaaagcaagcaagcacctttttctttcccatgctcgaaactcggttcttgattgattccttcgccgaagattaaccaatcaaatccaaacaaacccactcagatccagattcgttaaatctatccggatccatttacttcaacgggtcggatccagtgatctggcacttcacaatgggaagtggcttttctggttcttcggataccaaacaatgtcgcgatttcctcgaagattcatagatgattcatcaatggaagatgcaggaatctctctttgcccaagtattcactatagacctataaaccctaatgatctagatcgtttggagcaaatccatcgcgatatcttccccatcaagtatgcatccatctacttggattttcctatgttggtgtcttgtgaaaagatttctaaagtattgatttttgttttgtcaggtatgagtctgagtttttccagagtgttgtgaacggagttgatatcgtctcatgggctgctgttgatcggagccggcctgatgatcactctgatgaacttattggttttgttactgccaaatttgtgcttgccaaagatagcgaggttagttttcattctatgaattcgtctttttgtaattcgaacaataatgatctttcaggtcctgtaatcaccttgaatgttgaactagttcataatgcttatggtttttggttcgtctgtgatcatgtacactaaataaaagttatttcacttgtcaaaaatctttagaacagcggcttgtaataatgtctgaattatgattgaataatctgttttgggagctctggtaatgcaattgagtctagtgttgtttttatcttcttattatctatcttcatcagctggcagatggtttctgtgtcttgcacagatagatgatcttatacattacgattcctcgaaaggagaggagactttgatatacatcttgacactcggagttgtagaaacatacagaaaccgtggaatcggtacatgactcttataatactaataagtatctgaaacatgttctatatattgcttggttttataatttctgatgtttctgcaactttttttaactctcagcaatgtcacttattagtgaggtaattaaatatgcttccggtttatctgtgtgtcgcggagtttaccttcatgtgattgcacacaacaatgctgcgatctgtttgtacaaaagattgatgttcagatgcgtgcggagattacatggattttatctaatcaatcgacatcattttgatgcgttcttgtttgtctacttcatcaacggttctcgaactccttgctcacccttgtaaggagatttactcacagacaaaacaagtctttgattctcttgtactctataatggtttacaacaatttactgtaatttgcagagaggtggcgatgtttgttgtgaattatatgaagagtggtatcaagtcagtggcatctaagctggctaacaaggatgagaaaggtttgaaatggctgttttgcaaagacacggattgtgtctaaccctcgcaaaccaaaccgaagctagggtcatcatcagcgtacgaattcatttaacttaaaactatatttcccattcatttgatttctcattgtgaactctgtaatgaaaaggtaaatagtcaccgttaatgtactgttttttgggttttatacgctgatcattacgtgtttataaggtgtaaggaagttcttatgagtttttcaccacccttcttaaaatagttagcttggttgaaaatagctcttttgcttcattggcaattatccaaaaacaaaatcaccagcttaggatgtcaaaaaataggttaaacgataattttatttacttccctcaaaaaagcctgagaaaatccccatcaaaggccaaaagaacagaaaaaagtttttttcacgcggtggca

SEQ ID NO: 10112 - DNA, 3000 bp, Unknown
  misc_feature (1)..( 3000): cDNA_ID_3035342_gDNA_ID_2213626_Annot_ID_132043 3000 nt of promoter + ATG
tgacgtaaagaaaaaccatgaatcttcgtcaatgtatattgtggaccctgcaaccaagtgcactcgggtttttggatccggagcttttccaggtttcactggtagaattcgggttgacccgattactggtggagcctttaattcacacggaatcaaccacttgaaattcttgattccttctatttgggaccctaagaccaaatcttgctggactcctatgtaaaccgttattattacgacatgttacacagtttttacccttcatgaacttttaaggttgttttgttattggaaatattcaatatacttggaaatacttcatgaacttctagttccaagtcttcatgaactagactttgaacgatcctcgtgtaaattaaattctgtgagaaagaaaatccatgatttagcagataatactacagtatttgacaacaacaacaacaaaatgttgataagtaagaaaataaagctcgaagatttgtaactattcatgattttagaaaatcggaataatgaatagtgtacttatttggacactgaataagaagttacacaagtcccgattgaaatttaatttactaatgatcgttacaaaattatttgtctctttgtcatcaatcctgttagtgaatattagaattattattcattgtaaacaaataggatcatccagattgagaagtaaataattttatgtatgttacaaatgaaataattaattgatcgtaaaacctctctgaccttatatatatcgagtctcactattcaactttttcattgcacttgtcgtacaaaggagtaaacattgatatgggaaaggtatgtgcattcctgtctttggtaattccagtaatttgttaagtaaattatgtgaacttatattttgtgttttggatttggttctaaagaacaagcaaaatggagaatcagacaacaagtctgaaaagaagaaccagaaaaatggagattcatcagtcgataagtctgataagaaaaatcaatgtaaagaaattgttctgaaggtttacatgcactgtgaaggatgtgcatcacaagtttctcattgcttgaggggctatgatggtaatactctattaaaagaaacattattagattactttccctctttaatggaatcatatatatatggtctcgatcataagaatcaatgtcaaatatttaatcatttatcattgagtgaaattgtactataatttaacttaagcattatctagtctggtttcagttttatttttctttcctgtaatctagagaagttgtctattaattcccacaatgacataacgaatagtaatctctagttcttaaagcatcaattaaaaaataggattaccgtttttttcttcttactcatgactcataagtagctattatcttatttgtcttataggggttgagcatattaagacagagataggagacaataaagttgttgtgtctggaaaatttgatgatccgttgaagatattacgaagagtgcaaaagaaatttagtagaaatgctgagatgatttccccaaaacataaccctaaacaagatcagaaggagccacagcaaaagaaagaagtaagttatttccaattatttcgtgttagaacttagatatatactctcatttatatcataccttgtctaattaatctgagaataacaactaacatatctaatcatttctaaatattttttgcatgattttagagtgctcccgagatcaaaactgcaattttaagaatgaacatgcactgtgaaggatgtgttcatgaaatcaaaagaggcattgaaaaaataaaaggtaatctttgtatatacatatagaaataatacgatatcgaaagttaaaaaaaacaacttagaatatgtttgtttgttttgacaaattaaaaggcattcaatcggtggaaccagaccggtcaaagtcaacggtagtggtacgaggagtcatggatcctccaaaacttgtggagaaaatcaagaaaaaacttgggaaacatgcagagcttctaagtcaaattacagagaaaggcaaagacaataataagaagaacaataataagaaggaagaaagtgatggaaacaaaatctttagttaccctcctcagtattcatctcaacatgcttatccctctcagatttttagcgacgaaaatgtacattcttgttcaatcatgtgattttttgacccgtaaaattagagtctttttaagttatcttttatggttttgatttccttgctacacatttctatatctcaatagattttaatttaatttaatttttgagtgacactttatgaaagtaagatttggtgtcatgtgtatactcgattactagattatgtttgtagttgtgggccttttgtacaattatttgtaaaaaaaaattaacagggcattagagtataaaaaaaaagaatgtgggtatatattatattttaataacttagggtctattttgtaatataatataagttgagagtacttgttgcatttaacccaaaaagaaaaagacaagggaggacgaagatgaattgtctcaatttttagggttcatcaaaatttgaacaaaagggacctgttttgctcaatttttgatagcagaagacgaatctggatctggggtcacttcaagtaagtaaagagttaaccttttgcttttttttgtaccataaattgtgttcgaatggtacgattgagaaattgcttacgaatcaatgaaataacagttaagattttgatgatgaatgctcatgaaaatctatttaagtttgattgagaaattgaagaagagaataagaaatcgagagatttattgcgtaaatggtaatactttatgtttcagttctgctatttagatccaagcttgaatatgtatcccttagctttatttctgtaggttaagattgtttggttgttgaatgttctttgtttgtgcattgcctttgcaggattgaattaagaggtttttaagtaagttgag

SEQ ID NO: 10113 - DNA, 3000 bp, Unknown
  misc_feature (1)..( 3000): cDNA_ID_2714877_gDNA_ID_2213626_Annot_ID_132046 3000 nt of promoter + ATG
agagcctttgcacacttgaagtagcatcttgctccttctttaaagcctgggttttctcttcattcacagtttcaagctcattcttcagtttctctgcttctttttcactcttagatgattcttcttctgcaatacctagcttctgttcagatttctcaagatcaaccttttgactagcaactgtcatctccaataactcaattttctccttaagatcagtaatttcagattccatatcgtgcaatctactattgcttacttccagctgctttgtcacagataccagagataccgaagcacatttctccagcttgttagcttcttccaaccgtttctccagttctttcgctttgttttgccactcgtcagcaaagccatgcgcataagattctgccatttttgcagcttctaagtcaacattaagctgctcaatgatcatctctagttccttgacctttgcttccaaacttctcgcattctcaaggtctctttttagatccactatctccgcccctagctttaaagcaatctcattcttggagatgatttccttctctcgagttgaatcaagcaaagccttcaaccgtattaactctgacgacaagatttcaactttctctgcatgaattgcagccatcttactagcatcatctgcacgacacaaagccttactcttggcatctttagcattagccaattcttgattgacattctccagctcctgtgttaccaaaagaagagtagctgattctgaagcatgttggttcttgacattctctagttctttcttcaactcttcttcttttctctgaaccgcctctatccctgcctcaacaacctcaaatttctcaatttcgaagttctccagggactttttctgagcttctaaagcctcatctagtttctcagatgcctcttcagcttctttccgcgcttctttaagttgatcaagtgctttagctttttcattctcgagcgatgctatcagctcattggctttctttaaatcttccttgatttgaactgactgaggttgcgattctgatactctcacagcccgtatttgagttttctgcaaacaatcataagacaacaaaacaatggatatcaacatttgcagcatagtgtgtcaaaactaaaccaagttaagaccaggcaaactattatgaacacacttacttctggtggggttggagctttgggggacctcttatcagtactaggctttgagttagaagaagggcgctcgaacgaaagccgtgactgttgttgagtcggtgaaggagaattagaatcaggtttagtcacaatccgagtgagtctaggcactcttagagatgttgaagatgatttcctcaaagtagtgtcagataaaccatttctgcttcagaaaacaacaaaggtctctcatcaagcaagcaaaacaaaacaaaacaaaacaaaacacgtgagaattgattacacttgccaaaatcattaaaaaaaaaaaactaagaactctgccatggagccttagattaactaaattataaagtagaagagaagacaaataaaaatcaacataaatacaacatcacaacaacaactaagaactctgcaatgaaattattattattttttatatataagtgaagctgcttgtaagattaaaaaaatcacagaaacaggaacaatcagacaaatgtgttacaaatagaatcactaaaaaccaggagattaaaccctaaacccaaacctagtcagatctaccacatcatcatagacaacctcaagatagacccagatcggaatttgaatcgacgaaatattccaccgacatcaaaaaaaggatcggagaatgaatcttaataaggaaaaagacacttacttaatcttagaagccatagtcacagcctctgtctcgttgctgcggatcagtgagaagtaaattacgttagaggaggcgaccaaggaaaaattgagacttgatatacattattaaattatggaacctggaaactcaaatttgctcgaactctaactgggttcccatttttagcgtagagatcaagatcaagagagagagagacaatgattcggattaaggaaacgactgatgaacctaacgtagaagaaaatgatactcctagttggtgaggttttgtctcacgagtggccacactccccaaaaagtgtcaaaatgcaaactataaaataaattaaatgaattaaaaaaaatccgattcggtttcctacgtgataaacgcaaacaataacacgactaaataatcgcttgaattatcatcataaaactaaaacgtgagattagggagattaaaagactagtcttccccatagctaatgcggaataatatctgtataccgttactataaatattcgatatgtaccaaacttttttgtttgtttttttctagtaacaaaaagaagagtatatatatgcaacttagggaaatttctgaaatatgtaaaagatactatttgattgattgataactaactttgttatacatcgcattcgcaatatcttgttgaatacaatatctctacgactctaccattaggcaaactttttatcgggcccagtggcccatatttattaaggtccatttattaaccgcaagaaggactgggagtctcaaagttgacctggctccttccataaaagcagtttagtaaataaatggactgtaatcagattgatatttgaaaaaaaatgcttctgaaaacaaaaattcacttggaaaactttaaaaattagtcgcgggaaaatgagagagatttttggcgggatctctatataattttccattagttattaattatttattttatgagagtaacttgagatttgagaataagaaaagttgaaatttgtaaaagatatgagaaattagtaaattccagaaacttattagaagcggcggatcgaattcgcgacgagcgttccattagggtttcgaatcaacatcaacaaacgacgagagaaaactttttaaaac

SEQ ID NO: 10114 - DNA, 3000 bp, Unknown
  misc_feature (1)..( 3000): cDNA_ID_2714872_gDNA_ID_2213626_Annot_ID_132048 3000 nt of promoter + ATG
attccttatgcaaaaagtccccgtgatttgaaggatttgcagtctgatggtaaacaaggtagcttgtcaaaacaagccagacatctaagtcgaaaccgtctagaagatatagttgcttcgggtatgatgtccactggttataggttttttactccattagtaaacatttctctgcgttaaagatatcatgattgacacccagggatttgttttttacctatgcagtgggggattcatctaagaatgaaaagtgtagttcaagtgagcaaatatcaagtgaagcgaaatgtaaagatgaactggcacaagtagatggtgtaccccggtcgagggaattcagagaggcgggggagaaaaccaaagatgctgttggtaatcaccaaaagcgaaatattggcgaggataataataagggcaataggttgcgagcagcggttgatgctgcactgcgaaaaaaacccagctttagcaaaaacagagggttggagcaatctgatttgcctccagtgtctaatgtggattctggttgtaataaggctttaaaatgtttgtcctcaaaggtgccggtcataagagattggcctgtgggattccaaggattgccaggagggcatccaaatttacggacagacaagcagacaaatacagtaaatgaaaagcagtttacactcgctggtactgatgcaacgactgcttcccaatctgttgagcccgaagttaacgatccttctgtacaatcggtcatgagagatttgcctgtggctgccccaaatgttctgtcgacaacctcagccatcccaaagcctgagtatatttggcagtatggtttcgttcctttttatgaagatcacttttcttgtttaattacttctagataaaccttctatttcctttgaccagaggggacttggaggtgcagaaaagcagaaatttgtcagcaatgcatagtggaatacaagcgtatctttcaaccttagcttcacctaaggtggttgaagtggtgaaacaatttcctgaaaaagtcaccttgaatgaagtacccaggcttagttcatggcctgcacagtttcaagatacaggtgctaaggaacagcatgtggctcttttcttctttgccaaggacatcgagaggtaactgtatataattgtgttttgtttcacatgcttattctgtttttggtcgtttcaatgttttatttcctaatccactgacgaaatatattaaatgttattgtgacacacagttatgagaaaaattataagcctctggtagataacatgattcagaaagatttagccctaaagggaaacctcgagggcgttgagcttttgatatttgcgtccaaccagcttcctcaagattgccagcgtaagaatgttaactagattcttacgattaaactttctatgtgaagtttttggaatctcactgtctttacaatgcttgcttaccaaattaatatctatttctcccattgagaagcaaatatggctctttagtcatgctaaaacactctctaataagtttcaaaaatgtttcactgatgtgtcgttccgtataaatgtaaggcctgatctaacctgtagaaagtctattgcttagtgctacatcgattctgtttgcaggctggaacatgttatttttcctttggggtgtattccgaggaaaaaaagagagttgctctaatccaccaaagaacacacccctcccggcatcttgtgtttcgccaaatcgtgatacctttcgccatgagaatccaagcaacaaaaagtctttgactgatcgcacattgagcagaatgcaatcgtgtatgaaggtgggttgttctagacttctagtcctctgctaattatacatttcttctctgaatttacattggccattcagttttccgctctagttaaaaaaaatcttactctcaggtctgttttagtttcgagttttctagacagttgctatgtctatcttaacatcatgcaaatattgatgcattcatggatatgaaacaggaggaggatgctaaagagggtaaagcgtgcagtggcactgagaaggagaatgcattctctgtttcatatggagaaggtgaagtggatgtagaaactgaggaaggagagataggtgttagcccacagttgaagtatgagaagacggcaggtaatcaaaaggatttgctttcagctgtaacgagctctgagaataatttcgctgaccaggaaaaacttttagctgtgttcacgaatcgtctgtttttggcattgacagggcctgggacagtgaaatccgccgacatgaaccagagagtgaacgtggatgatctgaataaagaagggctgtgtgaaggtccagcgaataaaaagctgaagacagttacaggagtagaaactggatgtagcattgtcaggagggatacatctgttcataaatttgcttcaaggaaattcgtctagatgggaacacaagaagaagcagaatgtgaatacttgtttgtttttcgttagagacttccctgacaggtcctcataggaaacatatcttaaaaagtaaccaaactagtgtctcttaattttgattcatttgttatcatgaagaagacccaatcacagctttgtttgtacatattacggcgatgggcaaaagacatatgacaagatgttgattttggttgacttgactgatctgcttaagctaaagtgtgttttggctaatttcttttctctcttctgtttatgaatcttgttcattgaagagatagcatcggttcatcgaagcagttgattcgaaagtgaaatgttgtggtgtcatatttgcgaattacaaataataggaagggttttagcaaataagtaattccttgagtgtattttgggaaataagtaactcttaagggatatgttttagaaaatagataactcttctggtggacaaatggcgtatgtgttcgtcttcctcttgtatgttactcttctcagatctcttgttcgttttgatgtacaatg

SEQ ID NO: 10115 - DNA, 3000 bp, Unknown
  misc_feature (1)..( 3000): cDNA_ID_2714868_gDNA_ID_2213626_Annot_ID_132049 3000 nt of promoter + ATG
attaacaattacaacttaatgggctttatggctacatttttgtaggctcaaatcaattgataatgaagcccatttcataaatatgtaaccataataagttcggccatgacacattgggcgggcttacacgtataacaaacacaacagttaagagcaaaagacacaaaaaaagtgtagagacaaatcgccaacttgtagaaacagattaaaacagagtagtaagtgtttgataatccaaaactagatgaatattatcaaatatatctaaaaagaagttttaaggacattttggacggccttctttagtcttccagttgttgtaacatggacaagtttgtttgttgccgaaagtgccaggaggaacacaaagacattttttgcaacacttgaggcaaaagaacatgcatggcttcttgtgtgatgttgctgaacaacggaagctacactttgagttgcactctacaattgaagtttccatcaaaaaagcatatcacaacaaacaaacaaaaaacaaatcattgagatctttatgttcatgcttataattcacagcatacagtatactagaaaactgacatttcacaaaataaacaccattattgttactttaaagtttatttatcaacattatcaataattagtgattaataaattaatatgatcatatgaaacaacaaaagttttgagtccgtacgttggggtttgagtttgccaccaccacgagcagcctgtcatatatatataaaacttcaatatcagaaaactaatagccattaaatttttaaggaatgtatagcctttggtcatttttacctccacgagcagcctgtaatatataaaacttcaatatcagactttaataaactgaatctgttttgagtggtttacctgaacgaggttggagactgacaataaaaagagaagagtcaagaagaaaagagcatttcttctgatacaattcgccatttttttggttaaaaaatcttgattgccaatgaatgattcttaagaaacaataaaacggattaaagatatttatagagaaaatgattagtgtggatttccttcaatggtattcaagaaatttggtattgccaatgttcatgccgtgattctggggaagtaggtcattttaatttctaattacgtaccacacttgtcgtttttgtctcttagacaatgtcaaagactcaacagtgtaaattactaatcactaattacccacgtatagagaaccaaaagactaaaatcttgccttggaaaaaaaaaaaaaaaacatttctctcagtgaaaattggaaaattatattgtgtagttgactagtgtctaaacgctctgtttggaaaatgaaaatgtcactaatgataatatctgtatatagaaaggggaaaataagcgagtttaggaaattaattaagctaattgtgaagtgcgactaaaaagaaaaaaaagtgtaatagaaagcgaaaaatgcggcgaagttgagcatgtgatctttgtgggccatttcattgattttttgttttgtcatattatttgtgtttttagttttaatgtaaaaaaaatctgattaattttaaaaggactggacaattattaatggacatcaccataaaatctgtgaccataaatttttataaaaggcccattagcccaacggttttccaattacagaatttgggctgaaacggccgaaaataatcttaggatgacgaaatggccattttgaaattctcttcttcgtttggtctattattttattttttaacgttaacggcctaacaagttttcctaacttaaagataagtgggaacagataaaacaattaaaattaacttccaatgaaattaccaaattaacaattaagttaataatgtaattctaaattaggcttaagaagaaaacttaaatatttatgtttatataattatctgtcagaagtgcagaattcttatttttccagagtagagaggagtgctttcatggcggtaaaaggtaaaatactaatcactgtaaaaatctcttaactcttgcgttgtgtttaatactaatagactaaaattagtaattaatttataaataattgcgtgtgtatatgcacgtatgtccgtacgtatctacgtgtaggtcctagatatagagaatccttgaggtggctatttaatagcagctctcattatctgggctctgtgttttgaggaaaagcgatttatcgagaaacgaacttagggccacgccagagagagagagagagagagagagggaaatcgaatctggattttagaggaactagggtttgtatttgtactgcgaaaatcaattaatggtaagtttagggttttgtttcttctcgattggctcatgctgatagtgattaagatgatgattgcggaaatccaaatgtcgaggaagatgattttgagacctcaacaatgcaatcttatactctgatttttcggagtttttagagactaatttgcttgattatcgttagattccttgttttctggagttataatcgtgattttattcagagattggtcactgtcctttgacttttctttgtttttaaaaaaatagtaaattatgtgatttccttgagggttcttagttagaaattttgttcagtttgcatgttataccaatgttgttaagcagcatgattgaatcatctgggattgtggttaatgtttttgttgcagttattaattatgctctttgttctttctgttcacagttggattagcggattagaagtcagtgctcatcatttctgttgtttatggtaagtttatctgttttttgtattagcaattgtttggcttgttcttgcttaaagatggataatttgtatcgttttatgtaaattttgttattacgaaataatctttcagtagatttttcctttcatgcttctttttaattcactgacactattttcctaacattctctatatgatttgcttgaaggctgatagaagagttggtaatcgccccatg

SEQ ID NO: 10116 - DNA, 3000 bp, Unknown
  misc_feature (1)..( 3000): cDNA_ID_2714861_gDNA_ID_2213626_Annot_ID_132052 3000 nt of promoter + ATG
agaatcttagaaaacactaacccacatcgaaatgagttttaattgcagggcacagacagaatcattcaaaattatacatataaattgagtgaaagagaaaaaagagagaccttgatgaggtgttttgtggtttgaagaagcttagcagcaccaagaagcatagcaacatgagtatcatgaccacaagcatgcatctttccatctactttacttttcgattcccattccactaattcctttttttgtccccattttttcaaattcattagtcaaacaaagcaatctaaaaatcagagtaaaaatcggaactttgattattagatttcaaacctgtaacggaagtgcgtccatgtcggctctaagtccgaaaacaggtttcgaacaggatccgatccaagcgacgacgccagtcttcgccacaggatacttatacttcactccaagcgagtcaagctcgtctcgaacgagttgactcgttttgaactcctgaaaccctgtctctgggttctcatgaatctttctcctaattcctctcatccactcgaagaactcaggatccttggctgaatgaagcatcccgcgagcgagtgactcgagacccgaaccagaatcgtagctcccagctgaagacagaggagggagaaagaagaaggtaacgaagatgacaaagaagctccctgagaaatccattctgatttcttttgtttgtcgatgtaaactggcaagtgtcaatgaaagaaaggacaacggtgaatacgatgatgatgaaggagaaggagttggatcaccgatccatttttaatatttatatagtacgtaatttacacacgtttttggaaactcttttaatcgtttttaaatacgtatacgcctctaatgtgaaattcataatttatggttgtaatgtgaagaaaataatgaaataccaaagataaaatatgaaaatgatacaatgtagtatatttacggtataaaaggaatatttacttgaaatgaattagtacgtttaatacacgattttaccatttatgttaatgaaaattaacacttttaaaataaaacatggcatgaattagagttgtgagaatcacatgtaggcctttaaggttcttaaatttttaattccttataacataggcccatgtatttgattgacatataggccattgggttcttcgacttttaaattacttataacaaaggcccacctatttgaagcgcattgttaaacattttgtttatattttgattatgatcgaaaattctctagaacaattcgtacaaaagaagctgtttacgaaagtagctgtacatgcgaacataatcaataaaaatgtaaatgactaatgaaacatcagaatatccgtacaaaattgtgactttatattatttagttataggtacaaagttgtggagagtaaaaaaataaaaaaggtaaaaagttgtggaatagacctatgaaacaatcacaaacatacaaccaaaatgcaaattgtaattacgcaacagaggctttcttttcaaggaagtcaagtgtaagatttgcaaatgccccaattattatttgagagaaaaagggatattgctaatcacaattaacggtcacattacaattcccttttttctctgttatttcctcttctttcacaattaagttcttaacggtcacataaatattttgttttttatataatgagtttaattaagttgaagaatcaactgataaggttgatgatccgatcctcaaaagtatactaaccacaacactgtctacgttcatgttagtacctacttcaaagtccatgtacgttgggactggctgtatcttccgccgagagcagcagagagcgtcatcgctgtcttggaacgagagaaaggtcgagactatctctaaggcaaccaaaagcttagctatgatgaagacatctttctctctctctttgcctatgaatggagaatacaacaaataatataaagtgatggacatttctatgctttgcttctcttctccaaagagaaatagatgaaaaagattgttgattttcgtttctctcgaagaagaagaaagaagaagaaggtgaatagagacttttgatttctcaagaatgaacaagtagattgtagagtgttagtgtttagttctgttcttaggttgcagagattgtgtatgtgtggcgtttgatgtctcgtgttggagaggtggtctcgtttagagtgttagtgtttagttctgttcttctgttgatctgtgttttttttaaatgtaaattacacaagtatgcaaaacaaatctcttctcagaaaggggctactgttatatcatgagatttataagacaaaatgtaaaatatcggaaaaataaaacaacataattttggtgttgaatgagtttttcttgtccacacaacggcagaagcagtagacgattgttcctttgtctcttgatcacaaaccgatttcaaagtgttcttcgcatttttctcatcaatgtaagtgaaccagccagagaaagacaagtatgcaccaatatcattccggccccatattcagaataaattagaacatctttttccttccgtgttatgcacttgttctaaaaaaaaagaattccggcccatattcagaataaggagtccagtccaatagtctcaagtccaaacccgactcgggtctgtccgacccggaaaagagaactgattacagaatgcgggttttgtcaagagaaagttggatgataaaattgaggtgaaatctaatcttcaaatgatcattggttagctttttgtataacggattttctgaaatcctcttatttcccatatcggaccgtgattattgggtgatttcggatgcctaattgggtaattaatataatacagtataagattagatgcctcgaatattcgctctgtgcctaaccacaaaaaccgtaacttttggttttctctgaaacacatcccaaagtaaagaaagcatcactcttttcgtcttctctcgaaa

SEQ ID NO: 10117 - DNA, 584 bp, Unknown
  misc_feature (1)..( 584): cDNA_ID_2714819_gDNA_ID_2213626_Annot_ID_195883 3000 nt of promoter + ATG
ttcagttgttcatatcagcgatgtgatttagagaaggaaagaaagaagttagaaatcgtgcaaatggcttggtattattaacttccaacatgggaccagatatactctgtttatttcagagtcgagcaaatcactttttctggttttatagtattgtgacctttcaagtttcaatcgatttgggttacaaacttacttttttggtacttagatttatttagccttgaagcttactttcatatccgtgttacctcccagtgagaaactttttctttggagtagcttagctaagctgtatatttaattataatagatagttgtagacagacatgtggacgtgccggagtggttatcgggcatgactagaaatcatgtgggctctgcccgcgcaggttcgaatcctgccgttcacgtatttttaatttaattttgttcttttttaaaaaaaatctggcatacttgtgaaactgaaaccacatgacacatgtgctccctaaacgtcgccgtgaccagatagctccggtcagagtcattatctctctctcgctcgctctctccatcttcatctctcttgctgaaaaatg

SEQ ID NO: 10118 - DNA, 3000 bp, Unknown
  misc_feature (1)..( 3000): cDNA_ID_3035298_gDNA_ID_2213626_Annot_ID_195882 3000 nt of promoter + ATG
tgtcagaacaagaaaacaagaacacgaagttagaaacaggaacaagacttactcgaacttggaatagatattcccgaggataaaccgccaatgaaacagacttgtcaaactgaaaagtgacagttgggaaccgatctaatctgtgaatttgacagaaaatttcagagggtcaaaacatcaaacattatatactaggtgtataaaatcagtcattccatcagattcagctaaatccaactccatttcaattccaaaagcaaaaactagtacatttccagcaaataacagtaccatttcaaacattctcactaaacaccaagaatgacaaagcgatgagttaaattcttacttgtctgtataatggaaacaagtaaacgactcttgaactgtatgcaaagtaagctctggatgtgaagccaatatctgatggaaactcaagggaaaaaaacataagtgttaagaactttgtaaaataagacagaaagaattcacaagtaacagaatatagtactgacctcattcagtaacgggttataaacagcatcaggaagatacaccagagttgtaccactatcaataataactcctttgtcatctcccgaatcaaaagcattcgaagaaagttctaaaactgaattaccaacttcaattgcattgaggttgacactatagtgagctctgtgaaagagttgcaaacagtgtaagaaattcaaaacttcttgacaaagaaccaaagaagaagagctttaagagaaaggcattcacttacgatttagagagcataggtgtagtctttactttcggcgacacgacttctccaatggcgaatataccacctccattgttgttatccaaacaatgcgcaaaagaccttttgacctttccttgtgaagctagctgcgatataaacgatgaatttgattgtccaaatcccattatcccatcaaccgcagcttgtgactctccgagctgaccagactgtttagacccacatctgtataagaaccacaaataacagtgattcagagatttgcaagccacaacaagctacaaaattcatagaagaataaagctgtttttccttaaactaacccgaagataatagttccgttggtggaaccggtttgacgatttccagtaactaaatccaaatgaacaacatctttcaccaagtatccattagttgaactcccatcgccatacataataacatactgacaagtagaacctgagtgacactcagatctttggttaacgtaagagcaaaagttgtcactgcacgaaacagattttgcagtggacgaagcatccacatcataaggtgtcagctctacctgaaagataatgaaactatgaaactgaaaacataatgtaacttagagttctgtttttttttttggagggatagaattgatggtatataccagatcacttttcctaggacatctgatgcaaccagcacaattcacccataagatatcacttcctgtatcaacttgaacatggaagtctcttgatggagttccgagtccgattttagcgaagtataaactgaaattaaaaacaacaaacataaagaacaagaatcaacattttaccgtagaagacacaagaagaagaccatttcataatgagtcaagaaccaatcaaagagttgagaatctcaatagattcaaaagctttgttttttcttcagattccacatttaaaaaagacaaaaaaaatccgactttttgttaaaaaattcccaaaattacaggttctggtaaatggcgattcgaacccaatagactcaggctggctatcgccgccgagaggaatatcgatggcggagaggagtcttgagtgacggtggacgtcgtgagctctgagagctccaagatcttttactctttttccggcgaacttgcttcgaacttcaaataccaaattctccgaagccgtcgccgccgtcgagaattgcgggtcaatcagcaacgccgccgacagcaaaatagccgacaagaaccactgtctccgcctgagatccatgaccggagatatccctaactaagttagttgagaaatccaaacgaaaaaaatgaagagaagaaaaaaagcaaaagaaagaaaagtatagtttggcggtggagtacgatttaggacaaagaagaagaagaagaaaaattggtactttccaaataaaaaagtattttaatcattaactaaacaacattttgaaattaatttaagactggctagaaaattatgtactatataataagattccatgactacaaaaaaaaaaactaattaaatttcaagattgtaataattatttaaaaagaaaactgaaataactgctagaatacacttttggcagctgtaaattattttcacttgtataattcattttttcacatgaatatgcattgtcacattattaggctcatttttaacatttttttaccgtctaatgtagattttaacaaacaaacaaaaatcgactctagatgataatgagtaatgataaaatcatcagttgtcataaattgtaggattcaaaactgtttttgatcacaaatatgagagttttccttagatacaaaactagtaatcactgaactatcatgcatgttgttggtattttgtattttagtctaaaatagttaaatttatggaaaataaaagaattcatgtttgtctcatcattttgagggaccgaaccgtaatttcgcagtaagaaacataaatatcaatcttaattcctcaagaattctacacctcccgttccatctatcacgaaaacaaataattacagtaagtacccccgaatatccttgttcatccgaagcaattcgaggataataccgtctttttctctttaaaatccaattaacataaaataaatatttgctcagtccgttgagacctcacacacactctctctctgatcattcaacttttcgaaattttgcttcatcgtcttcgtcatcgtctctctgttgaattcctcaaaca

SEQ ID NO: 10119 - DNA, 3000 bp, Unknown
  misc_feature (1)..( 3000): cDNA_ID_1396296_gDNA_ID_2213626_Annot_ID_195881 3000 nt of promoter + ATG
tacagtgagaaaccaggccacacttttgctttaactactaactttgatgacctagtttcctcgagttatgatgctctggtcattcctggaggcagagcaccagaatatctggccttgaacgaacatgtccttaacatagttaaagagttcatgaattctgagaaaccagttgcgtctatttgccacggacaacagatcttagctgctgctggtgtcctcaaggtcagcactgttccttcgtagctctaattttatttaactatgtcctcctttttcttgccactacaagttgtttgaggaatttattctatgtgacctgttcactggctggtgcagggaaggaaatgcactgcttatccagccgtgaaactgaacgtggtacttggaggaggaacttggctagaaccagatccaatcgacaggtgcttcactgacgggaatctagtaactggcgcagcatggcctggacacccggagtttgtttcacaactaatggctttgttgggcattcaggtttcattctaagttccatgttatgtaaacatcgttatcaagcagaacccatccaacacacttgtctactatggtatatgttactgccatcttttctatctcgtcttttgactagcttactgtcaagtcaatcacttgtgtttcataaagaaccccactgttgatgctttatgtaaagaatgaattctataagacttgtgctagttctcacaattgtaattcataactttcaaactatatccccaattaaaaatacaaacttgctagtgcacattgcaccgaatcttccaaactcagttccgaattgcttagaaatccttcagaccgaatcaactggaaacctaaagataatcattttcatgatcatatttcttgaaacttttacacatacaagataatcttttgctgacgtttcctcatcacctatatatagggataacaccagatttcacattacatacaaacaattatggtaaagacatgagagactggttcatccggaagcagcagacctcgctgtttcaatcgctgcaaccagatcatcgtattttgcaccggtcacttccttgacaaccttgttatccttcaaaatcttgaaagttggaaccactcttattcctagctcttttgccaatggctgcaccaatgaagagtttcaatggcttagcagcaacaacaaagacaggtagtagtagcaacaacaaaaacaggtattgattatccttagctgctactagctatggttcaattgatatatggtttaggaaaaccgagttaccaaaagaagagagataaaagagcagaactcagacccggttatctggattgcagtcaagctttagaaacacaacgtcgtcgtacttctctgataaagctttgtatttaggggcaatcactttacatggaccacacctgcataaggtatccaagaatagaacatcttgaattgaaactctctttaaagactaccaacatcaaaaccaaaacattcactatggaatctaaatgaaccacatctgcagaagaatctaactgagaagatttttcaatcttagttgaaagccacggaaactttgattagtatcaaaattcaaatcaattggtaatctaagcattcgacatcgcaacgccattgatttcatcgattccgctatatacaatcagagatgtcgaatggtaaaaatttcaaagcagagagaggcatagaagagatagtaggtaccattgagtgtacatgtcaagtacgacaagcttttcaccggcggctttaacgatgggccagaacgtgtccttatcgacctccgtcacctgaccaacactgacattaacggtttctaagctacacctaacaacagaggaatctcctcttttcctagaatccaaagaacagaaaccaatcttcgtcgtcgggacgccggagtaaggaatccggcactgtttcctcgatggaccaaatcctccggtagtcggagataaagccgtcggcgaaggagaaagacggagagaaagaggcattgtttgaggaattcaacagagagacgatgacgaagacgatgaagcaaaatttcgaaaagttgaatgatcagagagagagtgtgtgtgaggtctcaacggactgagcaaatatttattttatgttaattggattttaaagagaaaaagacggtattatcctcgaattgcttcggatgaacaaggatattcgggggtacttactgtaattatttgttttcgtgatagatggaacgggaggtgtagaattcttgaggaattaagattgatatttatgtttcttactgcgaaattacggttcggtccctcaaaatgatgagacaaacatgaattcttttattttccataaatttaactattttagactaaaatacaaaataccaacaacatgcatgatagttcagtgattactagttttgtatctaaggaaaactctcatatttgtgatcaaaaacagttttgaatcctacaatttatgacaactgatgattttatcattactcattatcatctagagtcgatttttgtttgtttgttaaaatctacattagacggtaaaaaaatgttaaaaatgagcctaataatgtgacaatgcatattcatgtgaaaaaatgaattatacaagtgaaaataatttacagctgccaaaagtgtattctagcagttatttcagttttctttttaaataattattacaatcttgaaatttaattagtttttttttttgtagtcatggaatcttattatatagtacataattttctagccagtcttaaattaatttcaaaatgttgtttagttaatgattaaaatacttttttatttggaaagtaccaatttttcttcttcttcttctttgtcctaaatcgtactccaccgccaaactatacttttctttcttttgctttttttcttctcttcatttttttcgtttggatttctcaactaacttagttagggatatctccggtcatg

SEQ ID NO: 10120 - DNA, 3000 bp, Unknown
  misc_feature (1)..( 3000): cDNA_ID_2714825_gDNA_ID_2213626_Annot_ID_195880 3000 nt of promoter + ATG
agagattgcagacagaattggcaacttcgttaaggagaagggagctcctttggagctgttgtctaaactgagacaagaagggagtgagttcttagataaccagtcatcaagagaagctcttgatgagttgagtatcatgtttgaagctcttaaaagatcaaagtgcagtgagagaatagtctttgatctaagtctagctagaggtcttgattactacaccggcgtcatctttgaagctgtttgtataggagcagaggtaaaatcccgcattttggcttcctgcaattcaattaaagaaattgtagtgtatggcctttgaattcttctttctgcaggtgggatcaattggtgctggtgggcgatatgataaccttataggaatgtttggaacaaagcaagtccctgcggttgggatgagcctgggaatcgagagagtgtttaacataatggaagaacttaacgagaaacagaaacaagtaacttgccaaacccttatgctgtttgtcgaccttgttttaaaagaatggtttttgaagtttgtgttatttgctatgaatataggtgattcgaccaacggagacacaggtgttggttagtataatggtggataataaactagcggaagcagcagaactggtaagtcagttatggggtgctaagatcaacgcagagtatctagtgagcaagaggaaagaaaagcatttcaatcgtgcaaaggaatcagggattccttggatggtgatggtaggcgaaaaagaactcagtggaagttttgtgacattgaagaagctcgagaagggaagtgaagagaaagaagatcaaacatgtactagagatcgtttcgtggaagaattgaagaaactactctgagtcgttgaaaagaaatgaaaggtacacacactcactcctggttcgatgcccagacaaaaggaatcacagtgttttgcattcttttttgctgttttccttggtttgtttgataatggtgttttgcatgactcatgattgtggagacaagaacttagagattttgatgttgatgaagttttccgtatttaactaattagaggagatatacgtaaatgttaagccaattatcagaattacgtttctttcaaaaaaatccttatccctgataacctaatctgcgatcttatcagaaaaaagaaagaaaaaataagtaggaaatgaggtggaagaatataagaccgaaaagagaaaataaaacacaacaggtaaggttgtctccaaaaataaaaaaagtgatctgcagatctgtgtgatcgcatttgcatgagatgagaggaagaaagatggtacgtgttggtttctgtacctctctgccgacatgtggtggcttcaagtaactaaggtcacttgtgtattcacatctcacgtttccattgactattgtctctactcattttcgattcaactactgaaaatatttggtaagaaacaaacaggcgatttaccatcccctactgatcatttatataaaaaaacaatgagttctttggttccttaaataagaagaattcacggtggttattcttttatatacaatagtttactaagcgatacaataattaaatctgataaagagtctcaccctcatgggatgattgactgattgtgagaccctaaatatgattttgatctaaaaataaatgatctgttttattgaattttcacaattttaataattcttcatattatatattgatgatattctagtggatgtcggaaaattatgtgtaagaaacgtcttatccaagcccatgttaattctgccagcctgaaacaaaaaaaatataaatattttcatacattaatacgtaaaaaataataaaataatgattcatcagaaagaaaaaaatctgataacataatttttggatgtattattaatatagtttttttattattagagagagtgacccatctccattactgtttctatctctctcttctccattctctctctctatagagacacacaaaagtagaaagacgaagaagaagagagaacgggtttgtagttggtggttgcgtttctttctcgtttatattcttctttcttttttgttttcatctttcaattcctttttttcttttttgtttataatctaatcgacgcacgaacagagcaatctcaagctcttcttcttccccacaattgaatctgattctgagatcctcttaccttctgtttgatctctctgtttcctggtgagtctcctttcagctcgaattcgaatttggcaattcgatattaacaagtttagttttttttttctcaatgattcttcttttgattggttgcagacgaaggagatattgtagagaaagaaaggggttctcatgattctcgtgttttgagtctctttccagtataaattaaaacttacacttgtctttctttttctttttggtggaaatctacgtagatctgttccttttttctcataaaacttttgggtttaaatttctgtacaaataaaatatttgtaagaagaaaaaaacgtttttttaaacaagactcgaaaagggtcagacccagaagtctcatcttttaccttttttcttggtcagctttgaaaggcttcatcttttttttattccgttttttttttcttcattcaattttgacgatttgggtttaaaaatcactgcttgtgtatgtatgtatactggttgttgacgaattagattttgctcaaaagggttcttgcacaaagtagctggaactaaattttgaggtttgtttcttacaaactaaatcatcatatcatcctattactctttgtggtgatcattgggatctaaagacgggttttgtcttcttacagagatctcttttgcatagtttgaatcatcattgctctttccggtgagaattgtgatctaaaggttcaatctttctcgctggaggaccgtcggggtgattgtaccattgttggtctggagtgcctgctcaatataatcagggcccttaaa

SEQ ID NO: 10121 - DNA, 3000 bp, Unknown
  misc_feature (1)..( 3000): cDNA_ID_3035301_gDNA_ID_2213626_Annot_ID_195878 3000 nt of promoter + ATG
atcaaatctgcaggtcatctgatggaaaatattgaagccaagaatttgctgcacagggcttttagtgtatttttattcaactcgaagtatgagttgcttctccaggtatgtacatatgcttgctttgaagtctagataagtcaagtgctgtatacaaatggatcacaggcgtgtgactgggcatggctatgtcatatctagaatcacatttttgaagagaaaattaatttcaaaaatatgggaggttagatcataggcttgattctagagattttcttgcacatgttgggtgttgctatgatgatgggatgctctcgtgatcgtagatggttggtgggttttaataatctggctcatatgtcatctgactggtttcttctcgtttgaacagcaaaggtcaaacacaaaggttacgttccctctagtgtggactaacacttgttgcagccatcctctttaccgtgaatcagagcttatccaggacaatgcactaggtgggtatctactggcaaaacaatttagtacttctttttactatctatgtagaaaactgtagcttttctcaactagtgacctcactgttactcatcaggtgtgaggaatgctgcacaaagaaagcttctcgatgagcttggtattgtagctgaagatgtaccagtcgatgagttcactcccttgggacgtatgctgtacaaggctccttctgatggcaaatggggagagcatgaacgtaaataccatttctcaagactcttggttcccattttcttgaacagaataataaaaccttaagcttcttctgtgttggccttccttttgcagttgattacttgctcttcatcgtgcgagacgtgaaggttcaaccaaacccagatgaagtagctgagatcaagtatgtgagccgggaagagctgaaggagctggtgaagaaagcagatgcaggtgaggaaggtttgaaactgtcaccatggttcagattggtggtggacaatttcttgatgaagtggtgggatcatgttgagaaaggaactttggttgaagctatagacatgaaaaccatccacaaactctgaacatctttttttaaagtttttaaatcaatcaactttctcttcatcatttttatcttttcgatgataataatttgggatatgtgagacacttacaaaacttccaagcacctcaggcaataataaagttttcgtttttatcttaattaatgaatgaatgtcacaaagtttgtgagatgtacaaaaagcgtcgaggaaaaggataacaaggaaacagagtcgaaaccagagaaaaggcaacgcaaagattccttttttcgaagcttaacgacaacccaccttccatctgatttaagtaaagttaaaagtcactaatttaatattattgaacgaccgaaacaagtatgttgatgactttgttctcctttaaattatcatcacttcatttctcagagatttacgcacacagagttctcttcttcgtcctagtttcttctattccaggtaaatgaaataagattcgatcaaaacccagatggattttgaaatagttttcttgtgaattgaatgaaaagtgtgtatctttccttctgggttttgattgattgactgagaatatatatgatcactttatctagactaatctcgatttgtcttttgctttctgtgtttgagtaatttctcgtaaatctcatataatcaaatccccagattacttgttttgatcataattcttgattcaggtgagaagaaaaaatggcgtttgtgaccactgcggaagtgtgtgacgcgaatcaagagatgattcgaagtggccagctccgagctctgcaacccgtttttcagatttatggtcgtcgtcaaatattttcaggtccagtagttactgttaaagtctttgaagacaatggcttaatccgtcacttcctcgaagagaaaggtattaatgattcttgcttataaaattcaaaagactgaaactttactcgtagagctatgaactttcagagtatctttgacatggtttattggtattgttacattttagattcaattcttgtgttacttacttgtcaaatagtttcaattgttctttgcttgaaactatgtttgaagaagtcttaagatcatctctctatgatttagaactactgctcagtgtttatatacttcttcagtcactttgctaatcaagttcttgaatactagagacgagataggtctttcaaaaacccgagtcaataaaccaatctgttctctgtagcattcacatcaaaagctcaataatgttttaaatgttaaaacaggcaatggtagagttcttgtggtggatggtggagggagtttacgctgtgcgatactaggaggaaacccggtcgtacaagcgcagaacaacggatgggcagggatcatagtgaatggatgcatcagagacgttgatgagatcaatggttgcgacattggagtgagagctttagcttctcatccaataaaggctagtaagaaaggacttggtgaacaaagagtctctttgaacattgcaggcactcggatatgcgatggcgaatggctttatgcagatactgatggtatccttgtttctcagattgaattatccgtttaaaaggacacaagtgatgttgttgatttgttaaaatctgtaagctactacttttgtgctttgtgtttctgtaatggctatcagagtaaaagttggcttctttgaatatgattattgaactattgaatccgtttcgagttgataaaaaaaaacatttcgtaaagtgaaaattgcaaaaagatccttgaagtatccatacaagcatttttcgtagatcaatttccaataactggatacttcgagggtcattttgcagtttaccaattttctaaatccgccttcttgcaatttcacagtgcttcgttttaggtcaaacacaacgaaagacagaaaaccctaatcactccggcttcagctctgtgtgtgata

SEQ ID NO: 10122 - DNA, 3000 bp, Unknown
  misc_feature (1)..( 3000): cDNA_ID_1566217_gDNA_ID_2213626_Annot_ID_195877 3000 nt of promoter + ATG
gaagccctaaccctaaccctaatttgtgctctactcttctgatttaggacgcgagagccgatatgaatatatatactaattttatttttaaaaatggaaataatcttatctgattttgttttttggggtgttatagtgtgtggagaggtgcatggtaatgactgtggacctaaataaaataaaacgcagtaggcagaaacgcatcagtcatcaccacatgcgacacaccaacaccaatgtctgcttcttctttatttaatctcccattgattcgcctcagatctctcgctctttcgtcttctttttcttctttccgatttgcccatcgtcctctgtcatcgatttcaccgagaaagttaccgaattttcgtgctttctctggtaccgctatgacagatactaaagatgctggtatggatgctgttcagagacgtctcatgtttgaggatgagtaagtctttgatttttgattctctctactttgatttcagtttttgggtgttgccaaaattgtacctttgtctttaagttgtgttctcgaacctggtttgtcttcggcgtttggtcggtgagaaaatggaaggaaaattgactaaattaggttatgggagttggagtttttttcgattaacaatggtttatgaacttaggtgtgttgattagttgactttgatgtaatagtaacttggctccattgatttgttgaccttgatgtaaaagtaaaggattttggatttagtatttgtcaggggttccttttctgattattggaatcaagcaaaaaaagtcaacgctttagtgtctcctgtgaaagatgtcatagttttgggaggaacatagtcaagtttagctatgtttttggccaaaaatggattctttggatatatttttgtttgtctccttttagacttaattttacgattatgatggttgatcttttgctttgatggaagtgtttcctataagttttagacttaattttaccttaatttattgatccatctcttccttttcaatcttgcttgcagatgcattcttgttgatgaaactgatcgtgttgtggggcatgacagcaagtataattgtaagtgaactttgttctagtctcgtcctatcacgtagtgttatgcagtaaaattcatgtgcttgtttgcctttctcctatgactgaactcactgaactggattgctgttttatctttttctatgcccctattcaagatactgataccttatcaaatctgcaggtcatctgatggaaaatattgaagccaagaatttgctgcacagggcttttagtgtatttttattcaactcgaagtatgagttgcttctccaggtatgtacatatgcttgctttgaagtctagataagtcaagtgctgtatacaaatggatcacaggcgtgtgactgggcatggctatgtcatatctagaatcacatttttgaagagaaaattaatttcaaaaatatgggaggttagatcataggcttgattctagagattttcttgcacatgttgggtgttgctatgatgatgggatgctctcgtgatcgtagatggttggtgggttttaataatctggctcatatgtcatctgactggtttcttctcgtttgaacagcaaaggtcaaacacaaaggttacgttccctctagtgtggactaacacttgttgcagccatcctctttaccgtgaatcagagcttatccaggacaatgcactaggtgggtatctactggcaaaacaatttagtacttctttttactatctatgtagaaaactgtagcttttctcaactagtgacctcactgttactcatcaggtgtgaggaatgctgcacaaagaaagcttctcgatgagcttggtattgtagctgaagatgtaccagtcgatgagttcactcccttgggacgtatgctgtacaaggctccttctgatggcaaatggggagagcatgaacgtaaataccatttctcaagactcttggttcccattttcttgaacagaataataaaaccttaagcttcttctgtgttggccttccttttgcagttgattacttgctcttcatcgtgcgagacgtgaaggttcaaccaaacccagatgaagtagctgagatcaagtatgtgagccgggaagagctgaaggagctggtgaagaaagcagatgcaggtgaggaaggtttgaaactgtcaccatggttcagattggtggtggacaatttcttgatgaagtggtgggatcatgttgagaaaggaactttggttgaagctatagacatgaaaaccatccacaaactctgaacatctttttttaaagtttttaaatcaatcaactttctcttcatcatttttatcttttcgatgataataatttgggatatgtgagacacttacaaaacttccaagcacctcaggcaataataaagttttcgtttttatcttaattaatgaatgaatgtcacaaagtttgtgagatgtacaaaaagcgtcgaggaaaaggataacaaggaaacagagtcgaaaccagagaaaaggcaacgcaaagattccttttttcgaagcttaacgacaacccaccttccatctgatttaagtaaagttaaaagtcactaatttaatattattgaacgaccgaaacaagtatgttgatgactttgttctcctttaaattatcatcacttcatttctcagagatttacgcacacagagttctcttcttcgtcctagtttcttctattccaggtaaatgaaataagattcgatcaaaacccagatggattttgaaatagttttcttgtgaattgaatgaaaagtgtgtatctttccttctgggttttgattgattgactgagaatatatatgatcactttatctagactaatctcgatttgtcttttgctttctgtgtttgagtaatttctcgtaaatctcatataatcaaatccccagattacttgttttgatcataattcttgattcaggtgagaagaaaaa

SEQ ID NO: 10123 - DNA, 3000 bp, Unknown
  misc_feature (1)..( 3000): cDNA_ID_2686834_gDNA_ID_2213626_Annot_ID_195876 3000 nt of promoter + ATG
gaatttctcgatggttgaagatggaatttatcgatctgggtttcctcgacctgagaatttcagtttccttaaaaccctaaatcttcgttccatcatgtaagatcctttattaatcttctgggttattcaattatactgtttgataattgattatgattggagtaattaatcgtttttttattcatcaaaacagttatctgtgtcctgaaccatacccagaggagaatctcaagtttcttgaggctaacaacattaagctttaccaatttggaatcgaaggcaaaacggtgcgttttgcttctttcttgttgcttgttgtcaaagaaatgcaattgtccttgatgtcttatctcggatcttttacgatatgcaggatcctccaactcctatgccaaaagatacagttttggatgctctcaaagttttagttggtaaggaatcaacactcaataatgttttttggtctcttcttagctagttcatgagtcttaaagtagatcttttgtttctctgtagatgtgagaaaccatccaattctcatacattgcaaacgcgggaaggtaatttacagtttcttcttcctcttctaggaacttagcctatgttattatttattacaggacactcatggtggtcttggcttgtcttatttagttatgcacagtacacaatctttttgtggtcctttaggaaataggcagttatttacaggacactcatgatttggtgtttttggtgaacttgcagcataggacaggttgtctagtgggatgcttaagaaaagttcagagctggtgtttatcatcggtgctcgaggagtaccagaagaacgcgggtttaaaatggagacaaagggacttgaattttatagaggcatttgatatagtgagcttgagacagtgtctcttgagcatcatgtatcagtatcacggttatggcttcaagaggagaaggttggcatatgaagaagagaatgtcaagacaccaaaaccgcaggctgctagagtttaaaaagagagcaaccaagtggcatatgttccgtgttctgatttgagtttaatcggtgcctggattattctttaagtgggataagttttagtttaccccaaaagccgtaaccagaagttttattgtgttttttagaaatagaaatgtatagaaagtttattcttcattacaatctgatgcaggggaggtcatttttaactcaatgactcattcatgcttatgttgctttattttattttattggtcaaactcctaaagttagcttaatcttgttgtttaaacttcaaagtctctttggaataaccattagcaataatataagtggtacagcaataataccatgttttaaattcttgtaaagagttcttcgataatctaatcatttataaagagttcttaaataatcaaaccagtagaaattagatcaaaattagcaagaacttgcagtacaattttcaaatcaaaagaaaaaaaaaactgatttatgtccagaaaacctctctagccaatcaaactgaattttaaaagataacattcggtagtatactttcggtatgaaatcaattattaaaacagagaaaacagaggaggttaagagtatcgagtcagcttctaatatataccatgtgcactgcagtacaaggtatatgactaatctagcacatgtgttaggaaaaatatgttttcaaagataattaaagaaatacaagttgattagcagcattcttttactaaaacagccatattatattcatctattatatatttagctttttgatttccattctcagaatgaaaaagtgtgcagctataattgacattgtctatgtaactatgtaacacataattgacaaagaataagcaaaaccgggaaaattctatcgtaatttttctgaccagaactaaaccgagaaaaatccataaccgaaccaaatcttacctaagaatcatcattcatcacccacgtatcggataaaaactcacctcctacctagaaatcatcacccaagtatcggataaaaactcaagatcaagaacgcaaatcagattgacaattacgcaatcttctagttatagctaagaaaattccatgtcattttcagaaaacaagatgtccgtgcatacgtactttgcaaatcatccggacctaaggtttccgctgtttatgttcgaacagaaacagagtacttcatttcaaacaataagaactaatcttgatgatctaaaacttgtctgaaaaaagaaatagaggttgttgatttaacatgactacaaagctatttaagattcgctaaaccagatgacatcaacaacatgatagattttggggtaagaagtagcacattacactctttaacatcaaaagataacaaattttataaaattcaaacatagagttacttcttcaagcttcccctgataccaggtttaggtttcgattcagctactggtgctaaaacagcatggagattcacgagctttgattcctcataaatgatattaggatgcttcgattcgtgatggatctgcatcgtcttaagacctggagccgtaattttgcaatgaggacactcgtacttagcgtggcctcctttctcttttccggtccgatcagcgattccagcttttcctccgcctcgattagtcaacgcagcatcgatcttcgcttgaatctccttcgctgtatgcttctttggcttggccttaccagtcatcttcaatggcggctaaaagggatgaatttgccaggaagggagaagccctaaccctaaccctaatttgtgctctactcttctgatttaggacgcgagagccgatatgaatatatatactaattttatttttaaaaatggaaataatcttatctgattttgttttttggggtgttatagtgtgtggagaggtgcatggtaatgactgtggacctaaataaaataaaacgcagtaggcagaaacgcatcagtcatcaccacatgcgacacaccaacacca

SEQ ID NO: 10124 - DNA, 3000 bp, Unknown
  misc_feature (1)..( 3000): cDNA_ID_3035305_gDNA_ID_2213626_Annot_ID_195874 3000 nt of promoter + ATG
aaaccagatggtatttatctcctaacgatgtaccatttcttagttttccttgttcatacgatcagtaaaatgaaagaaaacaaaaaatgatcattttttgtttgtttttaaagataggagacgtgcagaagaaacagaggaaatagagcaatcggaaggaacatcgttgaagatattcactttccgggaattagctacagccacaaagaatttccggcaagagtgtttgctaggagaaggtggatttggtagggtttacaaaggaaccctcaaatctactggccaggttcttccttaaatctccagaatttggaatttaggatacattcatgagaccatcaccaaagttaggtatttttcaatgagccatcatcagaatcagaagaatttgtcttgtaggtggtggctgtaaagcaactagacaagcatggattacatggaaacaaagagtttcaagctgaggttttgtctttaggccaacttgatcatccgaatcttgttaagcttattggttactgcgcggatggagatcaaaggcttttggtctatgattatatctctggaggttcacttcaagaccatcttcatggtactaaattgagagattctcattgaacacattttttttactttgaaagaaatgacaatttgaattttgcagaaccaaaagcagacagtgatccgatggattggacaactaggatgcagatagcgtatgctgcagcgcaagggcttgattacttgcacgataaagcgaatccacccgtgatatacagagatttgaaagcttcaaacattttgttagatgatgacttttctcctaagctttctgattttggtctacataagctaggacccgggacaggtgataagatgatggctttatcttcacgagtaatgggaacttatggttactctgcacctgagtatacacgaggcggaaatctcactttgaaatcagatgtctatagctttggtgttgtgttgcttgagcttatcacgggtcgaagagctcttgatactactaggcctaatgatgaacagaacttagtttcttgggtaataaataacaaaccctaatattattgcactttttcaaccaagttaaaacaagaagtttttatcttgctgaacaattcatgttatcgcaggcacaaccgatatttagagatccgaagaggtatcccgatatggcagatccagttttggagaataaattctcagagagaggattaaaccaagcagtggcaatagcttcaatgtgtgtgcaagaggaagcatcagctcgtcctcttataagcgatgtaatggttgcgcttagcttcctttcgatgcctacagaagatggtattcccacaacagttcctatcttatccttcaaagacaagagcatgtctatagccttaagccgacatgattcaaatcttgtatctcctcctcctgagctagctacggaagatgacaaatctagtacctcatcaggcgaagaatcatctttggagagcgaaaaggagagtgtgagtaagaatgagtataagaagaaacatgaagaggaagatagctcaatggaatctgatgatgagtctgattctaactctgaacatgaaaaggaccaaccaccaaagcctattgatgagaagaaccaggcgcaaagcttgaagataaagtatagatatagctgggaagatattgatgtcaatgatgagaggctaagcagtaaaagcagccaaaaatcaaacgacgaaagtacttcttcgcgttatgatagcgacagagatcaagacgagaaagggaaagaagaagaggaagaggaagaggcagaagaaaagcatactcatattgaacacattgatagctcaaaaactgatgatgatcaaagtgtttactttgataatgatgatgattcaggagatgacaatggaggctctttgcatcggataaaatcagatgttgcgatcgattctattaaagagtgacatttttcaagattttttatcaatccgttgaagctcacaagaagtatttgaaacttttttgggtttatttttgggaaaaattcttaattgggtattaaaataagatacatattgacggtttttcttaacaaattataaccatctctctttatacatgatgaagatgttttggattgatagattaataaagaaacaagttgtataatcagataatctgattgagaaaacttatctcagcttttgtaatcctttaaaaaaaaatgttacgtacttgtgtttttctttaaatagtagatgaaataataatagtttagcattttaaagaaaaacaagtatgagataatcaaaccctagataagaatcttaataatcaatcttagctgtgactcatatagcctatgagcaaatattacattattcataggaaatggaaagtattagattctcaatttggatatactaaagtagatacttaaactgatagataaaagacatatctacttcttatcctatttttgcaattaaggatagtctttgtgttttccatctttttgtcaacgacacttgtcaaaagtttcagtctgtggaatcaaaatttttaaatgagaccacttagttttacttttctttcatgattcgaccactatactttctaagaatatttattttaatcaaaattagataatgtttacaggattgacccaaattagattcgtaaagaatcgtcagctatgaggtcaaataaaagcagagaaaacgacacgtgtcaggatcttggagattcctgaagtgaggtccaccctaaaatccatttaaggttttctaagcaaatcaacaaaggaaggaaggatcctaccaaaagctcccaaaatctgagtacgcttttcaaagttgtctcctttatgaaccccacttgatcccttctcctcctataaaaacatcttcttctcagatcaatcccatcaaatctcgggtcttgctctgtttctctctttttgattcttttagaggtttactgaattcg

SEQ ID NO: 10125 - DNA, 3000 bp, Unknown
  misc_feature (1)..( 3000): cDNA_ID_2714841_gDNA_ID_2213626_Annot_ID_195872 3000 nt of promoter + ATG
tataaagagagatggttataatttgttaagaaaaaccgtcaatatgtatcttattttaatacccaattaagaatttttcccaaaaataaacccaaaaaagtttcaaatacttcttgtgagcttcaacggattgataaaaaatcttgaaaaatgtcactctttaatagaatcgatcgcaacatctgattttatccgatgcaaagagcctccattgtcatctcctgaatcatcatcattatcaaagtaaacactttgatcatcatcagtttttgagctatcaatgtgttcaatatgagtatgcttttcttctgcctcttcctcttcctcttcttctttccctttctcgtcttgatctctgtcgctatcataacgcgaagaagtactttcgtcgtttgatttttggctgcttttactgcttagcctctcatcattgacatcaatatcttcccagctatatctatactttatcttcaagctttgcgcctggttcttctcatcaataggctttggtggttggtccttttcatgttcagagttagaatcagactcatcatcagattccattgagctatcttcctcttcatgtttcttcttatactcattcttactcacactctccttttcgctctccaaagatgattcttcgcctgatgaggtactagatttgtcatcttccgtagctagctcaggaggaggagatacaagatttgaatcatgtcggcttaaggctatagacatgctcttgtctttgaaggataagataggaactgttgtgggaataccatcttctgtaggcatcgaaaggaagctaagcgcaaccattacatcgcttataagaggacgagctgatgcttcctcttgcacacacattgaagctattgccactgcttggtttaatcctctctctgagaatttattctccaaaactggatctgccatatcgggatacctcttcggatctctaaatatcggttgtgcctgcgataacatgaattgttcagcaagataaaaacttcttgttttaacttggttgaaaaagtgcaataatattagggtttgttatttattacccaagaaactaagttctgttcatcattaggcctagtagtatcaagagctcttcgacccgtgataagctcaagcaacacaacaccaaagctatagacatctgatttcaaagtgagatttccgcctcgtgtatactcaggtgcagagtaaccataagttcccattactcgtgaagataaagccatcatcttatcacctgtcccgggtcctagcttatgtagaccaaaatcagaaagcttaggagaaaagtcatcatctaacaaaatgtttgaagctttcaaatctctgtatatcacgggtggattcgctttatcgtgcaagtaatcaagcccttgcgctgcagcatacgctatctgcatcctagttgtccaatccatcggatcactgtctgcttttggttctgcaaaattcaaattgtcatttctttcaaagtaaaaaaaatgtgttcaatgagaatctctcaatttagtaccatgaagatggtcttgaagtgaacctccagagatataatcatagaccaaaagcctttgatctccatccgcgcagtaaccaataagcttaacaagattcggatgatcaagttggcctaaagacaaaacctcagcttgaaactctttgtttccatgtaatccatgcttgtctagttgctttacagccaccacctacaagacaaattcttctgattctgatgatggctcattgaaaaatacctaactttggtgatggtctcatgaatgtatcctaaattccaaattctggagatttaaggaagaacctggccagtagatttgagggttcctttgtaaaccctaccaaatccaccttctcctagcaaacactcttgccggaaattctttgtggctgtagctaattcccggaaagtgaatatcttcaacgatgttccttccgattgctctatttcctctgtttcttctgcacgtctcctatctttaaaaacaaacaaaaaatgatcattttttgttttctttcattttactgatcgtatgaacaaggaaaactaagaaatggtacatcgttaggagataaataccatctggtttgggttcgttgttgtcgttggtctcattcgtagttgaagatttcttgttctttggcgaagagaaacacggaaaacagtgcatgatgatgatcaaaatcggttttagcaatcaaagagtattattatttgaagataaaacagatcgaaaagaattagatttttggagttttgtttaggattaagcaatggtcgggtccttcatggagattgaaggacccacgtaaaagaagaaacacaagaaaaaaaatgaaaggagaaagagaagaagaagatgaagttgacaatccaaaccaccggaaaatcgatgaagaagagtaatttttccgagaaaaaatggacaaaaaaaaagtttagattttttgtaataatctcaatctctcataaactcttaccttttcccaaaagcatggagaaccatccttcttctttcgaatttctgtataacctaattttaaaaatcctgtaaataaattctcaagtaatgatcttgaagtggattaatctgtcccacaacacactaaaattaataatttttgccagtattgatagatcatcccgctaaaaaacgctatttctggactataataatactatttctggacattatttgcaactctctgtcttctctactacgttactaatatattctactgggctttaaggcctcaaattacaatatgtttggttccaaaatttgtatttaatgggcttctctttctttaggtttttataataaaccgggtcaaacagtacccgactcgtctaattttcccgctaaagaaaaagtgaaaaccgcccaaataattttcgatggtggaatgataaaagacctaagagggagaaagagagatcgaagagtgaaatctgaaatg

SEQ ID NO: 10126 - DNA, 3000 bp, Unknown
  misc_feature (1)..( 3000): cDNA_ID_3035309_gDNA_ID_2213626_Annot_ID_195871 3000 nt of promoter + ATG
aaaaacgctatttctggactataataatactatttctggacattatttgcaactctctgtcttctctactacgttactaatatattctactgggctttaaggcctcaaattacaatatgtttggttccaaaatttgtatttaatgggcttctctttctttaggtttttataataaaccgggtcaaacagtacccgactcgtctaattttcccgctaaagaaaaagtgaaaaccgcccaaataattttcgatggtggaatgataaaagacctaagagggagaaagagagatcgaagagtgaaatctgaaatggaatcagctccgacgggatgcttcaagtgtggtcgtcccggtcattggtctcgtgattgtccatcatcggctccggtcgccggcaataattccgtttcttcttcttccgctccatctcaaatccctaataatgaatttcagagatcctccagtaaaagtggaacctcaatagctcctgctcctaaagtgacgaagacgagagttcaaaggcccaagctaactcctgaattgttactctctgaggatggtctcggctatgttcttcgctatttccctaaatccttcaagtatcgtggccgaggcaaagaggcaagtctttttttcacccgcagattcgtttaacagcggttttacatgttacagtgtgataatttggataatatgaataatttttataggtgagcgatttggggaatttgatacggttgtacagtgagtggcacactcatttgctaccttactattcctttgatcactttgtgcataaagttcaacaagtcgcttctactaagcgtgttaaggtactacattgctcgatccactttttctgtttttgtaaagcgttcttccttgtggcaattgtgaatctatgaatccggatttaaaggttgaaaatattccgatgattgtattaagcagtggttagtctagattgctgtaatcagaattacattgttcgtctccttgtttgatgttcactcatgtgttgctttcaagttgcaagatagaggatctgagtatttgttaggctgttttggtatatgatcattgtgctcatatgttagtctttacttgtgtaacatacttaggttcttccagtaactaaaaactatatgttcacttgatggctatgttgcctttgcgtttatacttgatctgaatcctgctgacgggctaacatcgtgaaacaaattatataggccagaatgacattgcttgtctcgttctttggtgatcaatcatctgttgctttaaagttcgaattactagactctgaggctgtgttaggttgctcatacgttctttacttccctaacatagttaggttctgccagaaactgaaactatatattcactcaatggctatgttgcctttgcatttatacttgatacattgatatatactgatgtgttatccttttagaattgtataaatgaactgcgagaaagggttgccagtggagttgatccaaacaagttatacgaaaagcaggaagaaaatactgttccttctgatgatcaaggtatgtcaaacagatcagcttttttcccttgaatcttcttttaagtttaagatattgatacgaaaaggaaacgcttcttatgtggctgcataacacttaagttcaatatctgttacattacaatcttgtgggtaatgaatagtcttctgctggtaatctagatatggatcagccaagtcatgacgaagagaacataccatcaaagagcgttgatgctgatacaaatgctgatgcttttgaagacagtatgttgaatgagatatttgataatgcttcaaagttaccgagcgatgaacaaaacatggataaaagcagtgaactgacagaagagcaaagagcacgtatggaagctaatagattgaaggcaatggagaaagctcagaacatttccgaggaacagagagtacgtatggaagctaataggctaaaagctctcgaaagagccaaagcaaggctccaaccaaatcaagattagactagagatgttcaatttgaattttggattgaaaaatttgtgcttttgaatgtttcaattagttatctaatagtaacaaatgtgtgtccgaaactagaacatatgtatggatgtctggtcgtgtgttagtttcggttgtggatccatcaaacccaatattatggaccgtaatttgttccaacccaagttgatgataattggcataaaagctctttattgtttggtagatttgatttttccaacaactaaaataaataaaagttgtatattcaaaaaaaattcataataaatggaatgaaataaccacatagaaaaggacaaagataataaaaatttctgacgtgttctctaccgtccaattttggtggagaagataaaataaaaattgtcgcactctagtctttacgaaaatagaaaaaaagaaaatcagtaggggcatattcgtctacgtacatacacaaactttaaattaattgatttttctcaaaatttcttgtttgatttgtgtggaggtgagacgagaacgcttttttgcttttcgtctttctctctctctttctttcttcactacctctcacctctctgtttacacgattcttcttcttcttcttcttcttctttagatgtcttcttcctccattgtcatctacctctctacacttcattttcttgttggaagaagatcgattaccggtgactcattcttagtgatgacagtataatgtctgatgcttattatcatcatcatcatcatcggagacattcttcctcttcacgtctatggattttaatgccggagttcccatgtcttctctttcacctttgatgaatcaaggtcctatcaatttcttctttcttttctctgttttgatcggcaaattttggttatttgttttgtttttaaacggattgggtttaatctcagtttcttcttcttggtttgggttgtggtttatgatcagatgcaatg

SEQ ID NO: 10127 - DNA, 3000 bp, Unknown; identical to SEQ ID NO: 10116
  misc_feature (1)..( 3000): cDNA_ID_3035325_gDNA_ID_2213626_Annot_ID_195867 3000 nt of promoter + ATG

SEQ ID NO: 10128 - DNA, 3000 bp, Unknown; identical to SEQ ID NO: 10114
  misc_feature (1)..( 3000): cDNA_ID_2714872_gDNA_ID_2213626_Annot_ID_195861 3000 nt of promoter + ATG

SEQ ID NO: 10129 - DNA, 3000 bp, Unknown; identical to SEQ ID NO: 10113
  misc_feature (1)..( 3000): cDNA_ID_2714877_gDNA_ID_2213626_Annot_ID_195859 3000 nt of promoter + ATG

SEQ ID NO: 10130 - DNA, 3000 bp, Unknown; identical to SEQ ID NO: 10112
  misc_feature (1)..( 3000): cDNA_ID_3035342_gDNA_ID_2213626_Annot_ID_195856 3000 nt of promoter + ATG

SEQ ID NO: 10131 - DNA, 3000 bp, Unknown; identical to SEQ ID NO: 10110
  misc_feature (1)..( 3000): cDNA_ID_3035344_gDNA_ID_2213626_Annot_ID_195854 3000 nt of promoter + ATG

SEQ ID NO: 10132 - DNA, 3000 bp, Unknown; identical to SEQ ID NO: 10109
  misc_feature (1)..( 3000): cDNA_ID_2714901_gDNA_ID_2213626_Annot_ID_195853 3000 nt of promoter + ATG

SEQ ID NO: 10133 - DNA, 3000 bp, Unknown; identical to SEQ ID NO: 10108
  misc_feature (1)..( 3000): cDNA_ID_2714911_gDNA_ID_2213626_Annot_ID_195849 3000 nt of promoter + ATG

SEQ ID NO: 10134 - DNA, 3000 bp, Unknown; identical to SEQ ID NO: 10107
  misc_feature (1)..( 3000): cDNA_ID_2714915_gDNA_ID_2213626_Annot_ID_195848 3000 nt of promoter + ATG

SEQ ID NO: 10135 - DNA, 3000 bp, Unknown
  misc_feature (1)..( 3000): cDNA_ID_2714854_gDNA_ID_2213626_Annot_ID_132054 3000 nt of promoter + ATG
taatgactaatgcactttcctcttcttgttcttatctttttcgaataattttcttagtagaaggcttttggtttaggtgctagttatgtggatgccatgcttaaaggctctagtcttaggttttttgaaagattgatgatagtttcattcgtcaatcgaaaaaaaaaacttattgatcaaatatatgtgcagcagaagtagaaccagcaaaatccaagaatttagagcaatcaaagcacactataggatctgaaacaaataagtcaaagggacctcttccagccggattctttgataatcagaaaactgattcttcaaataccaaaaccaccagtgaacctaaacagagtcagacacagaccactggtccagaaacaaaaccaatggtgaatggaaaccttccaaccggtttttttgataataaagaagctgacctgcttgcccatggaatcaagctcgtcaaaccagatatcaagtgagtttcttctctttttttttttgttgcttttacttttccagatgcagaaaatcaaagtgaaacctcattgttgtggaccttgtgatccagttactttcctacattctcaatttgaatggttcatatgatcttatgggtttgtacctaagaattctcttcgtgaacttatataaacatggatcttcttacagggatgaatataaagaatttgagaagttgatacaagatgatttgcaggtagtggatagccgcatggaagaagaagaggtcagataactttctgtcactatgataaattgctgacagtatcataagctctttcttaaacttaaaatcgcttttctcgcactctaattgtcaggttgatgctgcggaaactatagaagaggaggaacaacgagagcaaaggtaatttgattcattactttgttatagcaagaagatggaaatgttgagacttgtttaagattaagtaaacacttggcttctccttttaatcttattctgcagatcatacaaagagaaagtagagattctgaagaggaagaaaatggaacttaaagcggcaagattagcgaagcgcagtaaaacctctgaggggtctgttaaaaagccgaagaagacagaagaagaatcgcccagcgatgaggaggatgacgaggattctgctgttgattggagagctcaacatctttgaataaactagaaaagactgtttaaaaatctgtaccctggtaaaacatacaatgttctatgagaatatacagtgaaaactaatcaatctcatatatatacaattatcagtttcagaggatcaattggtatttgaggtatagttatcggttaatgggtataattcaagaacgtaattttcataaccagagttgccaaaaaggccgaaatatctggggatgaaacctgaaactgtggcagttccgaccagtttcaggtgataaactaaaaaaaaaaaagtgattatgactggtggtcgtatcattctagttttgagtgagaatgtttcagatattgatcatttggtggcacaaaacataatgacgaaagtggtaaatttaacaatcatctttaaagttaaaactcttattattgttaaacaaatacatgtggaataataaataattgagacaattccagaaaccaattaggggtcaaatatgtcgagaaactaattaggggtcaagtattgaagaaggaagaagaccactaactaaacatattcatatttttttgtgaatttttggactatttgtgattaccaaccatatgcttatataacttataaaaaaaatgcattaggctttccactataaaccattgacatttgaaatatttaaatcaagatatatgcataaccaaaaaaaaaagggttatgttatcttgtttataacttgaaaaggagtccacaaaacaaagagagagagaacagccaaagcaaaggtcggttaatgcacaatcgatgatataacaaatatcccattagaacataaaattagttaactaattacttctgacctaactgaatgcactcaatctcctataataccttaacattatctagcttgactaatcatataaattgtcacgtgaattttctaatggtaaagtgtttcacaacgggaatcaaagtttagggacatttcagtttagagtctatccatcataacacttgtatcccaacttggtttttccaaatttgttttagataaaataccatttttcgaattcatcgtcttcatgtgaattttaggaaaaaaagagtgacaaaacacacacacgcacacacacatcggcttcgacctacataaccaaacgatatcttgtaaaataccacacacaatcacaagtgtttaatcttatgatctctaatctcttatgcatgtttaaacgtgataaaggagaaatcgtttagcattagaaagaaagaaacatttacgaataaaatgatcgaaaaagtgacttcctcgaactttatcacatcacgataccttatcacatgtacgtaacacgtaatgacttattgtttatcttgtggttataaaagactctcttatcatttatatggtgctcttcataggtcattctaaaaataaacccatatctcactggttcaccttattttttaaaacatattattattcttttacactacgttatcttttattatgaccataaaaatattaatatagcatgggctttttgaatcacaatttgaacttttaatgtaaaaaataaacaacagcactaacaaaaaaaaaccgaaaatttgtgtataaatttcgccgattccatggtgttgttcatcgaattaacttgagttgctatttttttctctatctgataagtttcgaaatttgaaaacacaggcgccaattttaggcatataactgaaaatcacaaaaaggaaataagagagaaagagagagaaagagaaagagagagaaaaacagagaggttgtcttcttcgtcaaatatccgattatctggtatcgtgattcggaggtgta

SEQ ID NO: 10136 - DNA, 3000 bp, Unknown; identical to SEQ ID NO: 10126
  misc_feature (1)..( 3000): cDNA_ID_2714845_gDNA_ID_2213626_Annot_ID_132056 3000 nt of promoter + ATG

SEQ ID NO: 10137 - DNA, 3000 bp, Unknown
  misc_feature (1)..( 3000): cDNA_ID_2714841_gDNA_ID_2213626_Annot_ID_132057 3000 nt of promoter + ATG
ctgcttttatttgacctcatagctgacgattctttacgaatctaatttgggtcaatcctgtaaacattatctaattttgattaaaataaatattcttagaaagtatagtggtcgaatcatgaaagaaaagtaaaactaagtggtctcatttaaaaattttgattccacagactgaaacttttgacaagtgtcgttgacaaaaagatggaaaacacaaagactatccttaattgcaaaaataggataagaagtagatatgtcttttatctatcagtttaagtatctactttagtatatccaaattgagaatctaatactttccatttcctatgaataatgtaatatttgctcataggctatatgagtcacagctaagattgattattaagattcttatctagggtttgattatctcatacttgtttttctttaaaatgctaaactattattatttcatctactatttaaagaaaaacacaagtacgtaacatttttttttaaaggattacaaaagctgagataagttttctcaatcagattatctgattatacaacttgtttctttattaatctatcaatccaaaacatcttcatcatgtataaagagagatggttataatttgttaagaaaaaccgtcaatatgtatcttattttaatacccaattaagaatttttcccaaaaataaacccaaaaaagtttcaaatacttcttgtgagcttcaacggattgataaaaaatcttgaaaaatgtcactctttaatagaatcgatcgcaacatctgattttatccgatgcaaagagcctccattgtcatctcctgaatcatcatcattatcaaagtaaacactttgatcatcatcagtttttgagctatcaatgtgttcaatatgagtatgcttttcttctgcctcttcctcttcctcttcttctttccctttctcgtcttgatctctgtcgctatcataacgcgaagaagtactttcgtcgtttgatttttggctgcttttactgcttagcctctcatcattgacatcaatatcttcccagctatatctatactttatcttcaagctttgcgcctggttcttctcatcaataggctttggtggttggtccttttcatgttcagagttagaatcagactcatcatcagattccattgagctatcttcctcttcatgtttcttcttatactcattcttactcacactctccttttcgctctccaaagatgattcttcgcctgatgaggtactagatttgtcatcttccgtagctagctcaggaggaggagatacaagatttgaatcatgtcggcttaaggctatagacatgctcttgtctttgaaggataagataggaactgttgtgggaataccatcttctgtaggcatcgaaaggaagctaagcgcaaccattacatcgcttataagaggacgagctgatgcttcctcttgcacacacattgaagctattgccactgcttggtttaatcctctctctgagaatttattctccaaaactggatctgccatatcgggatacctcttcggatctctaaatatcggttgtgcctgcgataacatgaattgttcagcaagataaaaacttcttgttttaacttggttgaaaaagtgcaataatattagggtttgttatttattacccaagaaactaagttctgttcatcattaggcctagtagtatcaagagctcttcgacccgtgataagctcaagcaacacaacaccaaagctatagacatctgatttcaaagtgagatttccgcctcgtgtatactcaggtgcagagtaaccataagttcccattactcgtgaagataaagccatcatcttatcacctgtcccgggtcctagcttatgtagaccaaaatcagaaagcttaggagaaaagtcatcatctaacaaaatgtttgaagctttcaaatctctgtatatcacgggtggattcgctttatcgtgcaagtaatcaagcccttgcgctgcagcatacgctatctgcatcctagttgtccaatccatcggatcactgtctgcttttggttctgcaaaattcaaattgtcatttctttcaaagtaaaaaaaatgtgttcaatgagaatctctcaatttagtaccatgaagatggtcttgaagtgaacctccagagatataatcatagaccaaaagcctttgatctccatccgcgcagtaaccaataagcttaacaagattcggatgatcaagttggcctaaagacaaaacctcagcttgaaactctttgtttccatgtaatccatgcttgtctagttgctttacagccaccacctacaagacaaattcttctgattctgatgatggctcattgaaaaatacctaactttggtgatggtctcatgaatgtatcctaaattccaaattctggagatttaaggaagaacctggccagtagatttgagggttcctttgtaaaccctaccaaatccaccttctcctagcaaacactcttgccggaaattctttgtggctgtagctaattcccggaaagtgaatatcttcaacgatgttccttccgattgctctatttcctctgtttcttctgcacgtctcctatctttaaaaacaaacaaaaaatgatcattttttgttttctttcattttactgatcgtatgaacaaggaaaactaagaaatggtacatcgttaggagataaataccatctggtttgggttcgttgttgtcgttggtctcattcgtagttgaagatttcttgttctttggcgaagagaaacacggaaaacagtgcatgatgatgatcaaaatcggttttagcaatcaaagagtattattatttgaagataaaacagatcgaaaagaattagatttttggagttttgtttaggattaagcaatggtcgggtccttcatggagattgaaggacccacgtaaaagaagaaacacaagaaaaaaaatgaaaggagaaagagaagaagaagatg

SEQ ID NO: 10138 - DNA, 3000 bp, Unknown
  misc_feature (1)..( 3000): cDNA_ID_3035305_gDNA_ID_2213626_Annot_ID_132059 3000 nt of promoter + ATG
atttatctcctaacgatgtaccatttcttagttttccttgttcatacgatcagtaaaatgaaagaaaacaaaaaatgatcattttttgtttgtttttaaagataggagacgtgcagaagaaacagaggaaatagagcaatcggaaggaacatcgttgaagatattcactttccgggaattagctacagccacaaagaatttccggcaagagtgtttgctaggagaaggtggatttggtagggtttacaaaggaaccctcaaatctactggccaggttcttccttaaatctccagaatttggaatttaggatacattcatgagaccatcaccaaagttaggtatttttcaatgagccatcatcagaatcagaagaatttgtcttgtaggtggtggctgtaaagcaactagacaagcatggattacatggaaacaaagagtttcaagctgaggttttgtctttaggccaacttgatcatccgaatcttgttaagcttattggttactgcgcggatggagatcaaaggcttttggtctatgattatatctctggaggttcacttcaagaccatcttcatggtactaaattgagagattctcattgaacacattttttttactttgaaagaaatgacaatttgaattttgcagaaccaaaagcagacagtgatccgatggattggacaactaggatgcagatagcgtatgctgcagcgcaagggcttgattacttgcacgataaagcgaatccacccgtgatatacagagatttgaaagcttcaaacattttgttagatgatgacttttctcctaagctttctgattttggtctacataagctaggacccgggacaggtgataagatgatggctttatcttcacgagtaatgggaacttatggttactctgcacctgagtatacacgaggcggaaatctcactttgaaatcagatgtctatagctttggtgttgtgttgcttgagcttatcacgggtcgaagagctcttgatactactaggcctaatgatgaacagaacttagtttcttgggtaataaataacaaaccctaatattattgcactttttcaaccaagttaaaacaagaagtttttatcttgctgaacaattcatgttatcgcaggcacaaccgatatttagagatccgaagaggtatcccgatatggcagatccagttttggagaataaattctcagagagaggattaaaccaagcagtggcaatagcttcaatgtgtgtgcaagaggaagcatcagctcgtcctcttataagcgatgtaatggttgcgcttagcttcctttcgatgcctacagaagatggtattcccacaacagttcctatcttatccttcaaagacaagagcatgtctatagccttaagccgacatgattcaaatcttgtatctcctcctcctgagctagctacggaagatgacaaatctagtacctcatcaggcgaagaatcatctttggagagcgaaaaggagagtgtgagtaagaatgagtataagaagaaacatgaagaggaagatagctcaatggaatctgatgatgagtctgattctaactctgaacatgaaaaggaccaaccaccaaagcctattgatgagaagaaccaggcgcaaagcttgaagataaagtatagatatagctgggaagatattgatgtcaatgatgagaggctaagcagtaaaagcagccaaaaatcaaacgacgaaagtacttcttcgcgttatgatagcgacagagatcaagacgagaaagggaaagaagaagaggaagaggaagaggcagaagaaaagcatactcatattgaacacattgatagctcaaaaactgatgatgatcaaagtgtttactttgataatgatgatgattcaggagatgacaatggaggctctttgcatcggataaaatcagatgttgcgatcgattctattaaagagtgacatttttcaagattttttatcaatccgttgaagctcacaagaagtatttgaaacttttttgggtttatttttgggaaaaattcttaattgggtattaaaataagatacatattgacggtttttcttaacaaattataaccatctctctttatacatgatgaagatgttttggattgatagattaataaagaaacaagttgtataatcagataatctgattgagaaaacttatctcagcttttgtaatcctttaaaaaaaaatgttacgtacttgtgtttttctttaaatagtagatgaaataataatagtttagcattttaaagaaaaacaagtatgagataatcaaaccctagataagaatcttaataatcaatcttagctgtgactcatatagcctatgagcaaatattacattattcataggaaatggaaagtattagattctcaatttggatatactaaagtagatacttaaactgatagataaaagacatatctacttcttatcctatttttgcaattaaggatagtctttgtgttttccatctttttgtcaacgacacttgtcaaaagtttcagtctgtggaatcaaaatttttaaatgagaccacttagttttacttttctttcatgattcgaccactatactttctaagaatatttattttaatcaaaattagataatgtttacaggattgacccaaattagattcgtaaagaatcgtcagctatgaggtcaaataaaagcagagaaaacgacacgtgtcaggatcttggagattcctgaagtgaggtccaccctaaaatccatttaaggttttctaagcaaatcaacaaaggaaggaaggatcctaccaaaagctcccaaaatctgagtacgcttttcaaagttgtctcctttatgaaccccacttgatcccttctcctcctataaaaacatcttcttctcagatcaatcccatcaaatctcgggtcttgctctgtttctctctttttgattcttttagaggtttactgaattcgatgtgtttgatt

SEQ ID NO: 10139 - DNA, 3000 bp, Unknown; identical to SEQ ID NO: 10123
  misc_feature (1)..( 3000): cDNA_ID_2686834_gDNA_ID_2213626_Annot_ID_132061 3000 nt of promoter + ATG

SEQ ID NO: 10140 - DNA, 3000 bp, Unknown; identical to SEQ ID NO: 10122
  misc_feature (1)..( 3000): cDNA_ID_1566217_gDNA_ID_2213626_Annot_ID_132062 3000 nt of promoter + ATG

SEQ ID NO: 10141 - DNA, 3000 bp, Unknown
  misc_feature (1)..( 3000): cDNA_ID_3035301_gDNA_ID_2213626_Annot_ID_132063 3000 nt of promoter + ATG
ttaattaatgaatgaatgtcacaaagtttgtgagatgtacaaaaagcgtcgaggaaaaggataacaaggaaacagagtcgaaaccagagaaaaggcaacgcaaagattccttttttcgaagcttaacgacaacccaccttccatctgatttaagtaaagttaaaagtcactaatttaatattattgaacgaccgaaacaagtatgttgatgactttgttctcctttaaattatcatcacttcatttctcagagatttacgcacacagagttctcttcttcgtcctagtttcttctattccaggtaaatgaaataagattcgatcaaaacccagatggattttgaaatagttttcttgtgaattgaatgaaaagtgtgtatctttccttctgggttttgattgattgactgagaatatatatgatcactttatctagactaatctcgatttgtcttttgctttctgtgtttgagtaatttctcgtaaatctcatataatcaaatccccagattacttgttttgatcataattcttgattcaggtgagaagaaaaaatggcgtttgtgaccactgcggaagtgtgtgacgcgaatcaagagatgattcgaagtggccagctccgagctctgcaacccgtttttcagatttatggtcgtcgtcaaatattttcaggtccagtagttactgttaaagtctttgaagacaatggcttaatccgtcacttcctcgaagagaaaggtattaatgattcttgcttataaaattcaaaagactgaaactttactcgtagagctatgaactttcagagtatctttgacatggtttattggtattgttacattttagattcaattcttgtgttacttacttgtcaaatagtttcaattgttctttgcttgaaactatgtttgaagaagtcttaagatcatctctctatgatttagaactactgctcagtgtttatatacttcttcagtcactttgctaatcaagttcttgaatactagagacgagataggtctttcaaaaacccgagtcaataaaccaatctgttctctgtagcattcacatcaaaagctcaataatgttttaaatgttaaaacaggcaatggtagagttcttgtggtggatggtggagggagtttacgctgtgcgatactaggaggaaacccggtcgtacaagcgcagaacaacggatgggcagggatcatagtgaatggatgcatcagagacgttgatgagatcaatggttgcgacattggagtgagagctttagcttctcatccaataaaggctagtaagaaaggacttggtgaacaaagagtctctttgaacattgcaggcactcggatatgcgatggcgaatggctttatgcagatactgatggtatccttgtttctcagattgaattatccgtttaaaaggacacaagtgatgttgttgatttgttaaaatctgtaagctactacttttgtgctttgtgtttctgtaatggctatcagagtaaaagttggcttctttgaatatgattattgaactattgaatccgtttcgagttgataaaaaaaaacatttcgtaaagtgaaaattgcaaaaagatccttgaagtatccatacaagcatttttcgtagatcaatttccaataactggatacttcgagggtcattttgcagtttaccaattttctaaatccgccttcttgcaatttcacagtgcttcgttttaggtcaaacacaacgaaagacagaaaaccctaatcactccggcttcagctctgtgtgtgataatggcggcggagagatcgtccatcactctcggagggaaaggttcttctttatcttcttcctccgtttacaatgttgcttccggcgtcgctaatgttcgaattgactcttctgcgatcgagagattctccactagaaacgttccatcgatcaaaaggagctcctttggtatccctcaagggttaacgaacgaagaaactcgagcttctctggctgttctcttaaacaagcttattttgtcgacttctggtcctccttcttcatccaccgctcgttctgttcttccgcttaagattgttgagattctgaatttgaaggctgagagtttggaattgggtgagattgatgtgacagaaggggaaaacattgtgttggagaagtcgtgtgcttcgttgattgggatttgttctattatagatcacaaatcgacgactctttcacagattgtggattctgttgctgcgttgagttgtgaggttacaaaggctgatatagcttcgtttagcttgttggattcaggagatgggaatggtgataaagatgtgattggtgttgctggtgatctcaaggttttgcttaacgggtataaaggtacagggaaattagaaatagaagagatttcgaaaatcccttggattcatgggaaattcaggtatgtggtgaaaagcgtgcacgcggatgctaggagagaattgaattccggtgttaaaggaggcaaaactgggtctggaaacactgggattggtgaggctttaggaacaacattgttacctttgttaacggcgattaaaaacttgggagtgtgttcgttccttcgtgctaagctttgttttgagaagattgtggatgagaatctgaagaaatgtttatctgaaaagatctgtgttgagaatgagaatctaaagaatagctataagttagcttatactgctcatttggaagaggattactgcaggtttgctcacaaactgaatgagtgtctgggaattgtatggagaattgttggtttggaggcagttgctgccttttttgctcttgctggtggagaattgtttgttcagaagagcggagatgcggacaaagaagagtcgaagaccgataagaaaaagaagaagaatgagaaaaaagcagttgtgggaaaggggacaagcctagttatccagtttatcaaagatagattggtgagtaatgacgcagcaagtgatggtgaccag

SEQ ID NO: 10142 - DNA, 3000 bp, Unknown; identical to SEQ ID NO: 10120
  misc_feature (1)..( 3000): cDNA_ID_2714825_gDNA_ID_2213626_Annot_ID_132064 3000 nt of promoter + ATG

SEQ ID NO: 10143 - DNA, 3000 bp, Unknown; identical to SEQ ID NO: 10119
  misc_feature (1)..( 3000): cDNA_ID_1396296_gDNA_ID_2213626_Annot_ID_132065 3000 nt of promoter + ATG

SEQ ID NO: 10144 - DNA, 3000 bp, Unknown; identical to SEQ ID NO: 10118
  misc_feature (1)..( 3000): cDNA_ID_3035298_gDNA_ID_2213626_Annot_ID_132066 3000 nt of promoter + ATG

SEQ ID NO: 10145 - DNA, 584 bp, Unknown; identical to SEQ ID NO: 10117
  misc_feature (1)..( 584): cDNA_ID_2714819_gDNA_ID_2213626_Annot_ID_132067 3000 nt of promoter + ATG

SEQ ID NO: 10146 - DNA, 1021 bp, Unknown
  misc_feature (1)..( 1021): cDNA_ID_2714499_gDNA_ID_2213627_Annot_ID_132068 3000 nt of promoter + ATG
gaattcattaaagcaagaaagataaccttaaccaacataagattgcacttgattattctttgttacactttgaagtttgaacaattaaaaatgaacaaacaagttagagatgtgaatgtgaggctacttccaaaatacaatctatttcatcactaaacgcctaacattatctttggaaagtgagctacctaccaacccaaaattacatctaacttacgtcttttgtcttttgagttttgccaaccgtctttgatcttggaagatattcgtttacgtcctttaagttttaagcaaatccatcattgttagtgaagtcttaagttttagacgttttattactgttatggttaactgtatgaaagttgatacttagtcatgtgaaaagatatttcaccggaccataaatagagagaataaaaaacaagttatggtttgaatacttgtctaaaactattgattgcatttacatttgttttttaatctgattaaacaaaaaacggatgtcatggtagaattaacatatattacaagatataatattcagcatgatcgattatatgtcataaataaatcgcaaaaaaaaaaaactaataatgttaaaaaaaaaaagagatactctttctagtaaagtttatttacaactgtaaaatcctatatagggtcgcttagttacaaatccgtagtatcaagataagatccgccaagtttggtagtcgcaggactatgaccagccaaacatatttattagtaataaatccgcagagtttaaatgcaaatattttgttcctaattcgtgattaattcaacttatacataaattggatacgaataacaaataaaaattcacatatcgaaaacattatcaaagtaccgttgctttgaggagtgtgccactctaccatattatcactgacgtcatcatcttttgcaattatataatcatctgatttctcacgtctcctctctttttcattaattccgaaaattttgactcgcaaaatctcaacgaagctcgaaaatg

SEQ ID NO: 10147 - DNA, 3000 bp, Unknown
  misc_feature (1)..( 3000): cDNA_ID_2714491_gDNA_ID_2213627_Annot_ID_132070 3000 nt of promoter + ATG
ctggtattatttttgtactttataaatttaaaattaaagaaatttgtgttagagaattttccctgcaagtgatcgaaagacccttggatcttcagtaactacaaagctacagagttatatatgtgaacgaatcttgtcgctttcagatttaaagttgtattgagaaagaagaggttgccgtcttctggtagagacttggagaagaagagagtctgttcaattcatctagcgaataggtttctttctagaataatataactagagggagtcccacatcgaaaagaaattgtaagatggttggttttgttcgggtataaataaagagggtttagttcggttgaaagtcatctttgcgcttggggcaatgacgcagctaatgaggtactaaccgaggcgcgtctattgctggttgaaaactatttccaaaccccctcctgggcctaagcttgtcttgggccttcgagaatttctggaagggctccctttggggtaaagccctacaataactagtctaaatgtttttcgagttttgaaatttagaaaatcaaatatcatggaaagtatatatcacacaatctaggcccaagaaaacatcacttgctgatgatgaggcctgatagtgaaaattgaattgttgtttacaaattttaatttttcaatatcagatatactttaattcttttttgttggtatgaacaaatataatttgatttgttgatattatccttgtacttttaaagttgtttaaaattaaagaaatttgtcatagagaattttccctgtaaatggtggtaacatgaacagtaggaataaaagggttacgaaattattattctataggatttgcaaatgagaaatcagaaaaatgactcaactatcattagttctcacgtggtcatgtggggacgagtccgaaactccaatgtgtcccccatcaaatatagtcctcatatgacatatattcaatttgtttttcctatcaatattcctaccagatcctcaattgtctattttaatttgattacactaaaaatcttcagcatttcagtttatgattaaacgcattggcattttattttgaaatccagaaccggagctaattaaaagttcgggattcatattaatcgtaatcacatcatgtttactaaattatacaacctcagtacactcatcactcacgtgactcacacgtgcgtacctacatgaaatgcaactgctgtatatagtttgactttcaactgtcaaacaaaataaaataaaaacgaaaatcgaataaagacataaatatattgttttccctaaaaaagaaaaagagggaaaaaactagatctgaaaagacgacgtcgcatcagtcatcggaaccatcatctccgccgaagatagagaagcggtagtagagtaagaacaagatcagtacgaggaagagagcaacacccacgggagatccgctaaccctgtgaatcgattctggttctccggtggagaaaatggccgacacgaaggaaccacgttccgacgagagaaactgtatagtgaggaggaggatgataggaagcaatagaagtcccaccggactaagaagctctgcgatcgcatctgtaatggcctcaccactgtctccgatgaagaacggaacaagcaccactaatgcaacaacgacggcgagtatgattccgtgtggcgcagaaccgccaccgcctccgcctcctacaacgccttgacgatcttgatacattagatacttagtgtgaatcgcagagagtgttttttttgcttttctctttttttggttacagttggaatggagatttgtcgaattggtttttgtttgttgctttttttaaaaaatatagggtaacgagggacgcgtttgtcttttgaaaaagtgtaaagcatttcccatgcgtttttgtttttttttaattttcttcgaaatttcgacgtcatttacaataactttataaataaataaaaacaattaaatgaaaaaaaaacaagcttattgtgagcatggtgaaaaatgggagggaaatgagctccagctttcatcgatcacaatgagcgccaacacaaaggacataagaattaagaatcaatttgttggattgtgagaaatgggagggaaatgagctctttgaccatttttgttatatttgtcctttttttccccaacgctcataatgtttttgtttccccgtgacagaaaattctcaaattcccttctttttcattgggcccaaatttttaaccatttgtaacgatatttccttaattagaacaccgaagccattagacctaatcaatcctagcgtatataagtcaacattttatcacacttttctcatgtcatattctccaaaccttacggtgtaagttgtgaatactagtccagtggattttctctattcatttctccaagctatgtgttatgggtccgacgggtcaagtcaacaaatccctgatggacattaatattcataatgtggttgaattaagatttctacacttaatactctcatcaaccgtcttcttccactactcacacaaatcatagcctccttaatattatttcgtaatgctgtttcaatatgtgtaaaaagagtatatatacaggttactagtttactactgtattaattgagaaagtcaacttatactacacataatataatgagacaatggctgggatgtgaaaaaggaattactaatatgaatcatatgattaaaaagctatgttaggttttttctcttacgttttcctcaaacacacgcaacactcttgacttttgtttcttgcgtccttttgacagcaaaagattacaaagtaggaccaatcattttcttttgttctggagtttggctgcttccttcacgagactacattgttctcatacacacacactcactctctcatctctaatctctaacttcacttcctctctcatcttatcccatagataaaaccatccaaacttgtgtgcaacaaagtatgtgaaaatg

SEQ ID NO: 10148 - DNA, 3000 bp, Unknown
  misc_feature (1)..( 3000): cDNA_ID_2992162_gDNA_ID_2213627_Annot_ID_132078 3000 nt of promoter + ATG
tagcattatggagtctggagaggttatatatatatgctccgtattaatatatatggaagctagttaactaattataatgtagttctcttcatttaacaaatatatgatatattttttaattttattttttcaattggtaaagatcttacgcgaagcttagagatcgtcggttcgagtgacgtttgagatgaaaataatattatatgctacggtttcggggattacgagtttcggctcaaaaactcttggtattgaaaagaaaaatgatatattttttataggtagttgagtggtttcccttccttagagaagtaatgatggcctgggcacacattaaaagtaggagtttcttgtacgttgatgtactttgggatttggttcttgttccttgacttgagctaggaccagcttaggtatcaatctaagccaacgcatacatttggcgaggaatcgaaagtagctatattagtagaatatatcaaagttatctattactctacactgtacgtattgtctaaaattagatcatatgattatttcatgctgagaattttatacaatggctgctattacgtaccccaatatcatgcttgtgcttgggttggtaataccaacttggtatggtatctcatgaactagttcaactatctgattttagatagttttgtggttacatgcactggatgcacacatgcatgacatgtaaacaaaagatgcaacattctgacgaaatttaattcatctctaagattatagtcttatatatagacctaacatggatagatctttttttggacagaagaattcggacctgaaattgtttttattgaaattaagctaagttataagaaaacttaggtatgtaagtaaactaaaattttaaaattaatttaaaagatgaattttgaagctaaaattaccctcagggacgtgaacaattttttttttttttttctctcatcatataagcgaagaggaatgtaaagtaaaaggcctatgagttaggacatgttccgaaaaggtaaaaaaaaaaaaacaaaggtgagaagcttcggagaaggtaagaatttagaaaggtaacaaagtgactaagcctatatatagaatgttgatacttaaccaccaagcagtgctttcaagctgtcttaaagtttgggacacaaaatactaaaaaaaaaagagagaggcatatgttttagtgaaacaaatatcttctttcttcttgattataagcatatatatcgagctctgactgattctttcattgcttttgtatcgattcgtgcctagtaaagcttcttctttctaacatatattcgtttttcttttccaaaagctttgtataaagatagtgagttttggtttcgattatttggagcatatcgccctataataataagaacgtacatgactgattatttggcaaacttatgattagacacctcctcaactttctctagtgaagtaataaattatccaaaaggattcatagtaaatgtaattagttcataacaacaacatgaacgagagtaattgatatagacaacagaaaaatcatatcccatgtttgggtttaacctggagaacaatcttctcgccttccaagacacttttatttgaagaaaacgattatccttatctaaatatatacacacttttggtttaagatttgaccaatcatatgcggactaattcttctacgatacttatacaggcatcacaatcaatcttctcataaggaactttatgcaagcccatgtgaaaattatacttactaaatttttttttaaggagtaagcttcttcccttttttctgtggagactcattgattatgcatttctttgtttgagattcattttggaataaggtgaagtaatgtaaaaccataattatttaactttttacaagaaatatccactgtttttgtgtttctttgatatataacacaaaccaacgattgatttatcattgtcgtatgcattaataaggtacgtagagaaaaacacacataatattcaactcgatagacttgaccaatgaggattatatttattgaaatcacatagaaaacacgtactacagagacgaaaccggaaaaaacaaacaaattttcttccaaactactacgtactccaagagctgaagagaagaataagaaggtgatggaatcagtcacgagtctcgtggaaccttttgatgaaatcagtggatctccggttaatagctggttcaacgaggtaccaattatagaagttggcttcactatcttcaccatacatctcatcgtccgttcctgcctggttcgatctctgtctccgtcgccaccacgctttgaaactgccgaagaagctaaagaagaaacgccacgaacctcccattatgatgttttagagagagggatgtattttgcgtgtgtatatatatctaaagatacagaagcatgtgaaggaaggtgtgtctgatggtttagggttcaaaactcaaggtccttttatatataagcctgaccaagttggaatcctagaggaaccatgcacgaaacaccccctaccaaccattaaaaaagaacttttctcttctaaacatttgtatattattcacaaagaataaagattaaaaaagcatcgagatattatgtgtcgctagctgcggttattttaatcattacatagacactggtaattccatagcaaacattgaattttaagcttttgaggcaaatgaattgatatgaatttctaaagttcctagtttctttgttcctactcttttattcaaaccgaataattcaatccataaccggaataaatcgattcttttaaccgttagacgccttctttgttctttaagccggtttaattaaacgggaagcattcttcttatgaaaaccaaaaacggcaaggtgtttatcgaacaaatccagagtaagagtgtgtttggtcatctccaggtcagctgggtgtagaaatcgagcgacggcggcggagacgacggagatg

SEQ ID NO: 10149 - DNA, 3000 bp, Unknown
  misc_feature (1)..( 3000): cDNA_ID_2714460_gDNA_ID_2213627_Annot_ID_132080 3000 nt of promoter + ATG
cgcttatatgatgagagaaaaaaaaaaaaaaaattgttcacgtccctgagggtaattttagcttcaaaattcatcttttaaattaattttaaaattttagtttacttacatacctaagttttcttataacttagcttaatttcaataaaaacaatttcaggtccgaattcttctgtccaaaaaaagatctatccatgttaggtctatatataagactataatcttagagatgaattaaatttcgtcagaatgttgcatcttttgtttacatgtcatgcatgtgtgcatccagtgcatgtaaccacaaaactatctaaaatcagatagttgaactagttcatgagataccataccaagttggtattaccaacccaagcacaagcatgatattggggtacgtaatagcagccattgtataaaattctcagcatgaaataatcatatgatctaattttagacaatacgtacagtgtagagtaatagataactttgatatattctactaatatagctactttcgattcctcgccaaatgtatgcgttggcttagattgatacctaagctggtcctagctcaagtcaaggaacaagaaccaaatcccaaagtacatcaacgtacaagaaactcctacttttaatgtgtgcccaggccatcattacttctctaaggaagggaaaccactcaactacctataaaaaatatatcatttttcttttcaataccaagagtttttgagccgaaactcgtaatccccgaaaccgtagcatataatattattttcatctcaaacgtcactcgaaccgacgatctctaagcttcgcgtaagatctttaccaattgaaaaaataaaattaaaaaatatatcatatatttgttaaatgaagagaactacattataattagttaactagcttccatatatattaatacggagcatatatatataacctctccagactccataatgctattaatttggcactaactatggtaaaagttggaaatataaagttttaaaagtagtttcgtgctaacagaaaaaataaaggtttgattgcaatataagtgtggtttgtttcgtgtctctcctcaccagtgtttacatgatcaacttcattttcttatggtgtatcttcatctacttcttcaaagaccctcttgtcttggtgtgtgacctcgattccacaatcaaactcttttgttacatcttcatcttgttttgtgccatgtttttgttcacacatgatctttacttcctgattctccacaactttctcgatgccactgatcttgttttgctagattgttaagaacacacaagtttaaagaataactctctttattagctttagaaaatcaacttaaaactaaaacaactgacctcttcatcgacatcttgcttgatactatcttcttggtcattgatcttttcttcttgatcccttgcatcttgcttgatgtcaccgtcttgtccaatgttctttccttttacattctttgccttttgttgatcaacatcactatctgattttgtaaccgcctcttcattgtcgtgatgtgcaacatccgcgatgagttcttgatcagtttcgctaatgctttcagtttgaaccgatgatcttggaggcgtagaaataatgacaggtcgtctgtttgtctgatgccaagcaaggtgggtcataaaatcactgcggttatggatctgcacaaataccatatccaattaaatttaaaagagttaactacaacatattaggaaaatcacaaaagaatatggaccataattaccaaccatttgtgtggggtaataataacatgggttgttgttatacatgtaaatatattgtccccaaacgtgattcctatatattatgaaaataaatatataagcaaagaaattagatgaaaacaatattcaaactttagtttaaaaacaaaattgaataaatattaccaggtgtgcggaggacaatatggaattacgtgttgaggagcttgctgatattgatgcggcggtataacataattgaatgatcctacaaatttaaagttatgaagaagaaaaagttgtttgagaaagttttgttacacaaaataaaatcataaaaccaagatttagaaagagaaataaggatatataaaccgtttaggttagggtgattcatgttttgttttgcaccagcactagccaaattgcaattggttgttcttccatcaatgatgggtttagaattttgaagagctctaactgtagagacatagtctctaaaagtaatctgaaaattcaatacaaatcaatcgtcttcattaaaccggtattaaatatggaatcaaaccatacagagtacaaacaaaacgtgtttctaggtcagaggaaatcttcatatttttaaatatacacaaaggtttactaatgaagttgaattaaggaaaagaaaggatacttacaaaaccatagccttttgatctgccaggataagtttcagaaacaacattagcatcaaccacttgtccgaattgttcaaagtatcttctcaaatcatctgcagttgttctccatgttaaattccccacaaaaatcttcgtaaccctagtatcatgattattagtttgagacatcataaccaataaataatctcttaaaaaccaatttagagaagaaacagaaagttgcagggtttaagggtttggaactaatatatatatatatatatatataatgagataagagttgttaaaaaatatatatctatatatatctatatataaggagataaggaaattagtttcccaatagaaaaagaaattaggatattattagatggaatgcaattttatttatttattatttgtttgttttttaatcttttaaattttatttattttttttttttgggtcatctcctctcttatctctatgatgactataccgtttattttcttttcccactctgcttaggaagagaagagagaagagagaagagaagatacttgaggag

SEQ ID NO: 10150 - DNA, 3000 bp, Unknown; identical to SEQ ID NO: 10149
  misc_feature (1)..( 3000): cDNA_ID_2714460_gDNA_ID_2213627_Annot_ID_195915 3000 nt of promoter + ATG

SEQ ID NO: 10151 - DNA, 3000 bp, Unknown
  misc_feature (1)..( 3000): cDNA_ID_3033837_gDNA_ID_2213627_Annot_ID_195909 3000 nt of promoter + ATG
ctgattttgataaaattgtgtacattgaggtgtgatatagagcctgatttggttttataggtatcgtttggtcatgaccaccaacaaagtcatagctatatgtcagtcaggaggggagtttgttactatcaaagatggatcgttgtcgtattctggcggcgatgcttttgcaattgacattgatcagaatacttcaatgactgatttcaagtctgagctggctgaaaattttgggtttggtttggaggcaatgacccttaagtactttctccctggaaacaagaagacccttattaccatctctaaggacaaagatttcatacgaatggtcaacttttcttcagatgcagggactgtcgagatcttcgttattcccgaggaagctgctgccaaaaatctctccgtcatgccagctagtaggtagatgtttcttttgctttgttctagttctttcacacatttttatttccttggtctatagagtccaatgttagaacttgtgttggtttattgagctggtcatggtaagaattgtacgtggttattttcaagttgtttgcggctatgaggtctgccatttaatcgccaaaactattgctataatgtaatgaagtgcagtgtcagtttcttcttactcataataattcatgtcatctgtgaatcaggttaaagaaagtaactaatctgtgaattgctactacaggtcaagtaggacaacggcatcagaaggggtggtacctgctatttgtgctgtaggagatggtgtcgaggaggatatggcaaatgattttcaaattgaaatggcgatgccagatgatagtccgttgccgtgcaattttgttttggttgatcagaggcatcacacagcaatacagcagtgggaaaacgtcatcacgggtgttgatcaacggtttaatacctttcttgaattccgagatgcattacacaagtattcagtcgcccatgggtttgcttacaaatacaagaaaaatgacagccatcgagtgtctgtcaaatgcaaagctcaaggttgtccatggcgtatcactgcatcgaggctatcaacgactcagttaatatgtatcaagaaaatgaacccgaggcacacttgtgagagagctgtcatcaaacctggttaccgtgcaactagaggatgggtaagaaccatcttgaaagagaagttgaaagccttcccagactacaagcccaaggatatcgctgaggacataaagaaagagtatggtattcagttgaattactcacaggcatggagggcaaaagagattgcccgagagcagctacagggttcttataaagaggcgtatagtcaacttcccctaatctgtgagaagatcaaggagacaaatcctggcagtattgccactttcatgacaaaagaagattcgagcttccatcgtcttttcatatcattctatgcttcaatatctgggtttaaacaaggttcccgccctctcctgttccttgacaacgctatcttaaactcaaaataccaaggggttatgcttgttgcaacagcttctgacgctgaagatggcatatttccagtagcctttgctattgtggattcagagacagaggagaactggctttggtttttggaacaactcaaaactgcgttgtctgagtcgcgaataatcacttttgttgcagatttccagaatggtctgaagaatgcgatagcgcaggtctttgaaaaagacgcacatcatgcatactgtctaggccagcttgctgaaaaactaaatgtggacttgaaggggcagttttcccatgaagcaagacggtatatgctcaacgatttctactctgtggcatatgcaacaacacccgtgggttattaccttgccttggagaatataaaaagcatatctcctgatgcttacaactgggttatagaaagtgaaccacaccattgggcaaatgcgctgttccaaggagagagatataacaagatgaactcaaactttgggaaagacttctacagctgggtttctgaagcacatgagtttcccattacccaaatgattgacgaatttcgagcaaagatgatgcaatctatttataccaggcaggttaaatcccgggaatgggtcacaactctaacaccatctaacgaagagaagctacagaaagaaatagaacttgcgcaattacttcaggtttcatcgccagaagggagcttattccaggttaatggaggagaatcttcggtcagtatagttgatatcaatcagtgtgattgtgactgcaagacctggcggctaactgggttaccttgtagccatgcaattgccgtgattggatgcatagagaaaagcccgtatgagtattgctctacgtacttaacagttgagagtcaccggttaatgtatgcagagtcgattcaacctgtcccaaacatggacaggatgatgctggatgatccgccggaggggttagtttgcgtgactcctccacccacacggaggacaccgggaagaccaaagataaagaaggttgagccgttggacatgatgaaacgtcagctacagtgtagcaagtgcaagggactaggacataacaagaaaacatgcaaagctacttagttgttaggatgttttggttagtttaaagtagtagatgattttggatctcttctcttcttgtgtgatgaagaataaagatctcgttcgttttcagatcaaagcgagcttttttttcttcgcagaacttgttggttgatgtatgacattcacattcgaactttttgatctatgaaattggtttaagaattaataaatgtaacttacaatcctatcccataatcatagtaaaaattacgaaaatgccaccgtttcattactccttttggcggctttaactcttctccctctcagagagttcggaaactctcagcagaaaaaccctaaaattcttaagcttcgtttacacacacatacagagactgtatctgtacattcgcatcgttttgtaaaaatg

SEQ ID NO: 10152 - DNA, 3000 bp, Unknown; identical to SEQ ID NO: 10147
  misc_feature (1)..( 3000): cDNA_ID_3033845_gDNA_ID_2213627_Annot_ID_195904 3000 nt of promoter + ATG

SEQ ID NO: 10153 - DNA, 1021 bp, Unknown; identical to SEQ ID NO: 10146
  misc_feature (1)..( 1021): cDNA_ID_2714499_gDNA_ID_2213627_Annot_ID_195902 3000 nt of promoter + ATG

SEQ ID NO: 10154 - DNA, 3000 bp, Unknown
  misc_feature (1)..( 3000): cDNA_ID_2714456_gDNA_ID_2213627_Annot_ID_132081 3000 nt of promoter + ATG
gttttgattgcaacaccagggcgtttcacgtacctaatgaacgaaggaattttggggttgtcaaatttaagatggtactttaaatctttcaacaaagcaaactttccccattgatttgacgagatgaaagactttcaccaacttttgtgtgaaaattgattgggtacaatcttggttacgtgttttgcagtgccatcttggatgaggtggatatactctttggcgacgatgagtttgaggcagccctgcaaaatttgataaactcttctcctgttactgcacagtatctatttgttacagcaaccttgccacttgaaatatacaacaaacttgttgaagttttccctgattgtgaagttgtaatgggacctcgagtgcaccgtgttagtaatgctctcgaagaggttggtattaacataagtgattggaaatatgtaatgggatcaacaacagtagcagaatttttgttttgctaacttggttgctgaataatcttctttgactcgtccctgaccaatgttgagttgcactgtgcagtttcttgttgactgtagtggagatgataatgcagagaaaactcctgagactgcatttcagaacaagaaaactgctctccttcagataatggaggaaaaccctgtttccaaaactattatcttctgcaataaggtaccatggtcgccaacctactgcttttcgctactacttgaaacctttttggacatctcagtctcatatccacccttttatatgcagattgagacatgtaggaaagttgagaacatatttaagcgggttgatagaaaggaaagacagttgcacgtcctaccttttcatgctgcactctcacaagagtcaaggcttacaaacatgcaagaattcacatcatctcagcccgaagaaaattcactgtttctggtttgcactgataggtacctcaatttggttactgttatcgttttttatgatgctatattgcctgaacattgaagatgttaattttttgtttcttcctttttcgttccgaaacaattgcagagcctcccgtgggatagatttctctggtgttgatcatgtggtgctctttgacttcccacgtgaccccagtgaatacgtgagacgtgtaggaagaacagcaagaggggctaggggaaaaggaaaggctttcatctttgtggtggggaagcaagtagggttggcacggaggataattgagcgaaatgagaaaggtcacccagttcatgatgtcccaaacgcttacgagttcacaacctaagtaactcttcatcttgaccttctttttattactgcaatctgtgtgttgaaagtttcactctgttgttagttaaaagaaatacgtagagaagccaagtccaaattttgaccattagtctgttgtaatgttgttaatgacacttaacctccaagctcatggagtcttgcactgaattgatgccccaaatcaagatcataaccaattaggatataaagttatctaaaggatatggaagatttggacataagcttatcttcttcctatcatgcgtactgtagaggagaagcagctggttgcaagcaaacacagtctgggaatttattacttgtctcattttgttaaaaagattcacatggcgccaatttgccagtaggttgtgtatacgtacttgtcgcattgagaaatagacaaatgatcaaagattgggtgggaactggtgatgtatgtgaaagggaaataaatcgtcatgattttgatttgcaataaagattttgaaatggcagtttatcaatcaaaattaatacaattcagattttgaagttgcactatctgtaatctgtatataaatagaaaatatctttggattggcaaaaatacttaaatgtccaaatcaattaaattaattcacaacagattttgtttgtgtgacagaaaaatgaaaaatcccctataaaaagagctcataagaacataaattaaagcaaaacgaatagattagctacaacgaaaatgaattgcaagattgaattcatgagcttcctcgtgatgacttcaatagtcatcctatttctctttgtttcaggttagtctcttcgtgtcttaatagcaaactatgggaaaatattaataatgtgttactctatctcaagtctttttttttttttttgtatttggtgaaaagcagggaaagttgaagctgaaccccaatgcattggatcatgtgaaatgcttgctgactgtaacacggcttgtatcaggatgggatacttatttggccaatgcgttggctggaaaactcccgatatgtgttgttgcaaccattgaatgtttcgaatcttaaatgtacgtattgaaaatcatcaacaaaaactctttaatatcttgattaataatttattataatactactatataacaagcgtgtgagtttttaacaactttgcttaactcaaacactgagaaaaataaggaaaagaaaacatttgcatttcatgaacaattaattataacttatcatagtgtataaagtttatttgacgatttttaaaaaaaacattattactaccactaatcaacattattaagacattgatccgaagtatacggcgattgatttatgtgcgccttgatcatatttttgaaatgatagccgctagctgttcgttcatatataaaaataaaactataaaaaaacaatccagcttagactgagtgaaaaactcaaaaaaaagtagtaattaatgtttatggtggatcaattttataaatgccgacaaaaagaaaaaaaaaaggatcaattttataaattcaaaaaaatatatataatacgataaaaatggccttattgataattaatgttgcaatttgcacgatgctgagctggttttatgggtaaagtcaatgagtattgggtaatacaaaaataatgtatatgtcaggtcactggttacacaatttatgtatagctcaaagaaataagagttagcaaggatcccagactacca

SEQ ID NO: 10155 - DNA, 3000 bp, Unknown
  misc_feature (1)..( 3000): cDNA_ID_2714448_gDNA_ID_2213627_Annot_ID_132083 3000 nt of promoter + ATG
ctttggtagtctcgtgagtcttttttcttacaaaattgtatttctactggattctctgagaaattgaaaacaatatttataactaagtaagtaattatgttatgagaaactgaaaataatacatctcccattctgtggtaaagcctgtgcaagaaccagagaaaatgacagaaatcattgtggaagcacttcaaagaactaaacagagaggaatcatcaacaaaggttggggtggccttggaaactgtaagttcttcaatccgtattacctttccatttttggatgttttcatgtttggtatatgttactataatattgatgtggttttcatatagtgaaagaaccgaaggactttgtttacttgttggataatgtcccacatgactggctattcccgagatgcaaagctgtggtatgtctaataatctggaaattctcacagtttagccttgattatcttgtttctttatttggttctggaaatttttagtcacacattttacttgtctggattagtagtttatgagtctcatctttaaacctgaaattgttggtcccctgcttttaggttcatcatggtggtgctggaacaacggctgcgggtcttaaagcctcggtaagtttaatatgtgtgaaagcgaaagtctgtttcttgatgtaggacttaagttggtaaaatatgaaagtgttttgctttttccttgaacacagtgcccaactacaatcgtgcctttctttggagaccaacctttttggggagaacgagtgcatgctagaggtgttggtccttcaccaatcccagtggatgaattctcacttcataagcttgaagatgccataaatttcatgctcgacgataaggtaaatagtattttctaaccaatcgggttttaacaagttttggtttgattgcagtctaagcagttcagcttggtttatatgaccatcaacttgtgtggctggtcatggcattgttttataacaaagaaactgagcatctaagtgtgagcaggtaaagagcagtgcagagacactagcaaaggcgatgaaggacgaggatggtgtggctggagccgtgaaggccttctttaaacatcttccaagtgcaaaacagaatatctcggatccgatcccagaaccttctggatttctctctttcaggaaatgctttggctgttcgtaactttcttctctccctccagaatctcctcttttctcttttgtattgttgtctcttgtaatgtttttcttcttcggttttggctatacaacaacttgcttaggaaaagttttaacatttgtgaagtgcttgggaaatttgctgttctaggggatgcatatattataaaattgttataagcagcaaaaaaaaaaaaaaaaaaaatttctgaagatgtgcagattagtgaacattgttgtatcgagttttaatattatgacatattttgtttcagtttcttgagctgcaacttcaatggaatggtgttgtacagaaacaacaacaaatctctatttttttttattaatttgttgcttcttttgttttggtcatgaattgatccatgtaagagcatgcttgattgcttcttgttgttgttgttgttgtataattgatacggccgataaatgaatatcctaatgtggtgagctatttttgtttgttaatctcttcctttctttcattcctattgttttttttttcattatactcgtaagttccttacctatgaaagtgcatgtttggtcattaaacgttgttgccgacaatcaacaagtgggaggttacattaactttagtttctttacaacaaaattattgtccgcttatcaaacgatgattagttgattattgcatacttaaagcattattagcggttaaaaaaattgaatgattaactttgtaatgagcataaggtataatggtcacatgggcaaaagtcaatagtgccgcattaaggaaataaaactatccggaacactatgaggcctacaagtttcagttagctgtcctagcttaactttacatggtttaaattagggatttcagttttatttttccttttaaatttgtcttttacaaatcattatccaatgactggcgagttgcgagaaagaagagagggatgaggaataccaatcacatgacatgataccgtttgttggccaaactcattattgtttatcactgtacgattcttttatacaagtacacatgcacatgtgttttcattttctatagaaaccaaaaaacatataatccctatagatagatatcttaaccctcacttatacttgaaaggttataaattcggcttgaaagcttattggttagaagtacatatataacaagttttagcagcttatttttttcgtaagaacaatatttcttagaatggttcggagatatacctaactccgtagattaaatctgtcggtcgggtataatgcatgaaagatgacttatgacaacagtcaaattaatagttcctgtaacctactttcttattgttcaaaaatatatatgtataggtataaccgtataaaggtcttcggatgaaaaatgaaaaagaaaaacggatatggaataaataacataaacgttaattaaattctgtaatttcacaactatatatctatataattgctataaattcagggaatatatgataaagcacatagtgatatttcttcatcgtccagattagcaatcacaacctagattcatgaccctgcggaataaacaaattgtatatattttatatactttaaatagttttcttattctttatatattttattttctatgaaattaggccaataagataatgggaatggtcacacaatcttcttcttatattaacttctctctcccgtagcctttcttctactcttcttctcatattcctcttcctttttctttccttatatcgagaaaagcctctgcctcatatagagataactaaacagaacagagcaagaactatacagccataacaatg

SEQ ID NO: 10156 - DNA, 3000 bp, Unknown
  misc_feature (1)..( 3000): cDNA_ID_2714444_gDNA_ID_2213627_Annot_ID_132084 3000 nt of promoter + ATG
agggtttgtttccgtaagtgtcttgcattactctgttcttttcttttgtttttctgtaacctcaagtgaattgtccatatgatgcagggtggagttgacgcgccatgtttccatgatttcaatcacattgtcattgagcgagctaaacaaagattctcctgggtgagttatacttttcttcatccttttgttggaacttgggaagtcttgattcatagagttcgtttgctttgaataattttatctcaaaagaatcatcacagaatcatatttttatggaattttacttcacatggtatcctcgcttcttaagatatagctacaatataaatgcttataattgtgttcaggtatcaagctccagcacagtcagatcagtctaagcctcaatatcagccacaacaagggagacaagcccgcctaccatacaatgcttatggtgaaggtaatgccttaaactttcttgacgatttaaatctgtcaatgttggtaggttttattataacaccttgtgattaattggaatgtagattcgtatgggagagggagaggtcgtggcagagggagaagcaggggaagaggtggatatggaaactaccaagggagttatgaaggaaaagaccaagggaactatcaagaagattatcaaggtattgttttgccatagaaggcgatcatttcgtctaatggtaaatatatgttattgtttgtttagtttgttactgacttgtagctttattttgggataactagacaatgaaggtgggtattcaaactcgggcagaggccgtggacgtggtggacgaagctatggctatcgtggtaagtctgaacattgtcaattagttaaactcagcatattataaggtgtaagggtgatgagactataatctagatcaacactcagaagtgtgttatcatcttttggtttcaatatttacgttttgtttgaaatacgttttggctttaatttgctccactttatttgtgttagattctggatatcagggtggcagaggcgggtatggtggtgggagagatggtggatatggtggtgggagagatgacgggtatggggaaaggagaaatgacgggtatggggaaaggagaaatgacaggtatggtggaggaagagacgacgggtatggtggagggagagatgacggatatggtggaggcagaaacgatggatatgggggaagaagaggcggatttcgtggcggtcgtggtggaggcagagatgaaggatacggtggcggccgaggtggatatggaggtagaagtggcggccaaggtgatgggtatggcggaggcagaggtgacgggtatggtggaggcagaggtgacgggtatggtggaggcagaggtgatggctatggtggtggccgagttgataggtatgatggaggaagacgtgatggctatggtggaggccgatatgatggctatggtgggggtaaaagtgatggttatggaggtggccgaggcggataccgtggaggtagaggcggatatggtcgtggacgtggaaggatgggtaatggtggtcgttcaagggatggtgctagtaaccaaaacgaagcctaagctgtttcatatcccattttctaagctgtatgggttagctgctgcatatttttccgttgccttaaagacccttcaaattcttagcacaatcccaaggggtttgatatgttttaaaaaaggttatggttaagttatgtgatcttcggaggacggttctgtaaaactccctttgggtaatatccatatcaaagcctaagggagtttaaggaaggggggttccttttttggtttgttctctttacctttcttctgcacaaatttagctaagtgcaaaaataatcttttgttgcatcttgtaattagctatgggttatggtttgcttttgtgtttagtatttgtccaaatttctccctataacgtgtcaaaataaatggttttctaagggagaaaagatttagtgcagatattggaaggagtaaaaaaacaaaaagagacaaccaaacttagctgcactccctttagattgcatcttcaatcactcttaattctattttatcctttctttgaaaataattgaataagtttaggtgcactagaattttggaagacttttatcttacgagttggcagaatagaagaaaatttgattaattcttagtcagaaacacaaaattaattgttttgaaatgtggtgatacgaagaacatatgagttttctttaatatctctgagagtaaaaaatggtgctgcccaggatcgaactggagaccttttgcgtgtaaggcaaacgtgataaccactacaccacagcaccagatacttatattctgatatttgaaaacattgaatcttatattacaaaaaagtcgacatgtgaaaatacgaagaaaaaatcataaaaaatggtgaaacaatgattactcttcttcttcttgggtcaaaaactttcaagtatcttaattgtaaagtttctttaataagataataacaaattcagggaagggcaaaggcgaaaagtacgtaaaaaaaaaaaaaatggacagacagaagagaagattcgctgtcaaagcatacgacagcgctttttttaatttttgttcagcatacgacagcgttttacgaatattttttctcggacagtttgatattttttgattataaattgaccaaataatccatcactccgacagttaattaccaagtccctcgcctgaaccggagcgaacccatcacgtagccaccagacgcgtcttcgacccacttcgtccgaacgtgcccatacaatagaaccttttcttcttaatttctttaaaaaaagatttcaataatcgaagaattacaagaaaagaatcgtataattaattctctccttcactttctgggattcgaaacacgcatacgcaaattcgagatacacgaagaaaggatccagatcgttttctgctggtggagatagagagagaatcacgatg

SEQ ID NO: 10157 - DNA, 3000 bp, Unknown
  misc_feature (1)..( 3000): cDNA_ID_2714432_gDNA_ID_2213627_Annot_ID_132087 3000 nt of promoter + ATG
tgaagcaaaatttattatccataacttcgaaaagctgaaagatatgagaaacctatttggttacgaacttaaaggggcagcaaaagaaggaaaaagagaccgagctatcactactataaagaagcaatccctttaaatagtttttttaccttttgttaatgactaaaagactctcatcgtcacgcttcagtatatgccatggaaacaaaagagagcgtgcatcaaattcttctgatttggtatcagcatcaactgttgtatcgtcatcttttccaagacccattttctccattatccaagaccataagccaccagttttcttaataacctttggatatactgtttccaggacccggctatttatatttgctcttctaatggcgtgattcttagcccaaagaatggggaaaaggaaggaaacaaagaggaaaaacaatcttaacatgaaaacattcaatggcacaaccagtaatcataattgtgtatcttcttctaggagtcatacctcagaatctacaatgtaaagacaatcctccgcttcgtcgtaaagggtccctgtaggacgtaacatctttgcagattcaaaatctccatcctcaaaacctgggaaacaaccaatctgaaataaaaacattgttttgaactttagggttgttaaacaatgagcttcaaatgcacttttctctctacgaatgcccttctaagggatttcagaaaagaaagtcaataaagattataattccccaaatgtgattcagttcacttacactgtctacaatcttcccactgttttcgaaaataataatacgatgatggttggtatcagaaagaaacagacggtctccaacttcgtctgcagagatacaacctgtcacagagaatgtcaattgttaaataaaaaaacaaaattttattccaaatttttgtgagcaaaatattagagagtagcgtgaaagacaaaaatgaaaattcctgataaatttcaaaaagaccaaaaaagaaagaaaattaaagagacatacctggaaagtaaagtaacaaatcctgaaagaaagaagggaaatgtgattccttgatagcctctgcttgttttgaccaagtgttcgtgaaaagtctgacagacttggatttctcagtatcttgagtgaggaggctgtcaagagctgcagcaaagcgcaagaaaaagaaaccagaatatgtattaagcacacaaatcacgagatagaaggctgaagcgacgaatattcacaagctaaaagtagcataatgaatttctgttttctcttaagttgaacatggaacaataagtatgacattgtagagactatttgtagtgaatatatgataataaagtaggcatacctttaactacagaagcaatatcaagatccttctcttcgtagattagaggattcttaaaatctttaaacacgatgtaacgtacttccccacttgtctgatacaagtagaaaacagcacaccttcaattgaaatcgaggtatatgcacataacatgagggaatgatatacaaagaagtaatctacagcgacatttcttggacataacaatatataccttgggaaattctttttcggaaagtagcacaggaaaagtgaggtattccttcaaaatcaactcagctagagcagttcgatcatcagcgattcgagcttgatcactgaagtggatgcccatgaaacagacacccggagacctgaaaagtcaaaacaaatacttagccgtaattgccgttaagttaccattattctttggtttaacaaaaataaaagctttcttaaacctctgctgaagcaactttagtttctcaaagaaaccactcagatcacttgttccgtctagcaaatgtccagctagaactacataagttcctttgtccttgaaaagctgtttattcccaaagtctcgattcaaccaatgatgggaaggacctaagagttcattttcaaaacgttgtttacaacacaaagagatgtttcaagccaatacaaaaagatgtaagaatcagtatacagtcagttaccttcaagtttatcaagtgaagctttaataaaagagagcaaatcaacatgtggagaggaaggagaagaagaagaagaagaagaagctcgagatactcgtcgtactgatgcaaatctgaaagagactgtccaggacgaattagaaagagaccatgaaaacacctgtccaagtaattaagattataaatcgaattacccgcgagagaaacgttgttcgaccaatgtcttggatccaatgttcatgtctccatcgagtgaaggagctaaacaagtggctggagtagtgattgatcggcgaaatcgaccgtgaacattgtctagtgagcaaaacgacaaccaaaaaagatcgttaagaacgcttaaacagtgggaacccagaaagctagaatcgaagaagacgatcaaaattcggaaacctgagagaatccgagaagaaagccatgatattttcttcaaatggaggcttctgttagacatttctgtatggtgggcttcacttgtttgtcctaagctaaacgaatttcaggttttggaagggtttaaccgccagcaccggagcccggcgggatcttaagggaaaaaaactcaagactttcaggtgactggtccaagtcaaggttattatgactttggataacgaatgtcaattgaagttaattacataatcagtaaagattactaacatcggggtggtggcgcagttggctagcgcgtaggtctcatagctatctgagtaatcctgaggtcgagagttcgagcctctctcaccccaattattttttcaatatttttaagttgattcgggtcaactataacgggtcgggtaatgatccaagtacatctaatagcaaaaccctaatttggcgccgatatgtccatcttccttctccataaacccttttcttttaacctactcagtttttctgtttgcgtcgctctcatcccagggcgagaaagatg

SEQ ID NO: 10158 - DNA, 3000 bp, Unknown
  misc_feature (1)..( 3000): cDNA_ID_2730409_gDNA_ID_2213627_Annot_ID_195928 3000 nt of promoter + ATG
gtatgtgaacgttgaggttatcagttgatgttttttatttcagctgtttggagtcatgggtgatagttaagtttatcagcctgtaattacaattctttggtttcttgaagggactctggcaaaatacactggaggacaggtgtactattatccaggtttccaatcatctgttcatggagataagttaagacacgagcttgctagagaccttacaagggaaactgcgtgggaggcggttatgcgaataagatgtggaaaaggtttaatagtttatgataatatattcgtttttgctacctgctatgtcaatatttgctaatgcattggtgtgctacttgtgatcttatatatttttgcatgcaggaattcgtttctcgtcctaccatgggaacttcatgctaaggtctactgacctgcttgctcttcctgctgttgactgtgacaaagcgtatgcaatgcagctatctcttgaggagactttgctaacatcccagactgtgtatttccaagtggctttgctgtatccttgaatagttgatattttaaacatacttgagtttaaacatacaacacatcatttagcttttagtaatccttaacagaactaagatataccgcctcttgtggagagagacgtataagggtacacacatctgttgcaccagtggttacagatcttggggagatgtatagacaagcagacactggttccattgtgtctttatatgctagattaggtaagctatattcaaatttttttcatatgctacttttgatactatttaatgacaatttaaattctgcagcaattgagaaatctttgtccgcaaaattggatgatgcacggaatgcaatacagcaaaagattgttaaagccctcaaagaatatcgtaatcttcacgcggtgcagcatcgcttggggtccagattagtatacccagagtctctgaagttcttgccattgtacggattggcaattactaagtccactcctcttctaggtggacctgctgatacttctcttgatgagcgctgtgctgcaggcttcaccatgatggctctgcctgtcaaaaagctattgaagcttttgtatcccaatttattccgtgttgacgaatggctcttaaaggtttgtgtatttttatctcaatgtccattatcaaacatcagtgttcaagaaatagtaaataatttgtgaattcacatgcttgcagccatcagcagcccacgatgactttaaagacgtattaaggagattgccgctggctgcagagagtttggattctagaggcctttacatatatgatgatggttttcgattagttttgtggtttggccggatgctttcacctgacattgctaaaaatcttcttggggttgactttgcagcagacctctcaagggtatgtatttttatccacatatatccttacatatgaatatatgaacaggcggtacattcgatgatgtatatgcatcattagtgtttttcaagaatttgaaacatgataatatgtgtgaaacccttgtctttcttcgtgttgggtctcttaggttacctttcaagagcaagagaatgggatgtcaaagaagctaatgaggttggtaaagaaactgagggagagtgatccttcatatcaccccatgtgttttctagtgagacaaggagaacaaccccgagaaggcttccttctcctcagaaatctcattgaggaccagatgggcggttcgagtggttatgtcgattggattctacaacttcaccgccaagttcaacaaaactaagatagctcacaatggtaaggaaaaaaccatcataatacttccaataacatgcttaaagtaccacatcatgttcgacgcatcttatgaagcggttttactttcagacaactcgggtgctaggatgccacctctttgtaaccattgaagaactcttgagctcaaaaatcttctacttaagcaggatcatggcggccttcttccttgggccataatgtgttgttttggataaagaagtgctactttttgatttttcttcatttgtttttctatatagaccttttttctcaagattaggcttttatttgcctaaccagaatggttatctccgtaagattagtcgttttttaaatcttttgttgccttttttttttgtcctcattcgattttttgttgatgtgcgtctgttctagatttattttgggagttgcagttcatgaatctgtcctaattagggttattaacaagaagatgctactgttaaaattttaaaatatttttatgaataaataatgttgtgaaaaccttagatttggatgaaacgcatcgttggtatacatcggtaaagttcatacataaacaatacggtgattgatcgctgtaagaccaactgttcctgcaatcacaaatagataaattaggatttcaatttttaactgctgtaattctgattcaaagattctggtcggttgaaccgggacggggaaaatagacgtggcaatgtcttattggatggtactttctagaaggttacagaataaaagcggtcgtcggtataggggtcaaagtagcttaaacgacgtcgtagaggaatcttcgaatctcccaatagcttgcctttataacaaacctctctgaaccattgctatccaagaaatctttcagatttgcgcatatcgacaattttccgagcggccagtttacgtattttgtttgtacgtgatcaaatctccctcgctttctcgctatcaattttatcaattatgtgttcccgattgtttctagatttggattttctatttgcggatactagttcttttttgttcggaatcgattatggatttggtcttaagatttgcggaaattcttttgtaggtctgatatagtttgttcggaatcattcttgttgctcaggtcttagatcattgcgattgtaaattttgattttgattttttttttcttcaggtagttaacgtgtttcaaggactttgacaatg

SEQ ID NO: 10159 - DNA, 3000 bp, Unknown
  misc_feature (1)..( 3000): cDNA_ID_2730401_gDNA_ID_2213627_Annot_ID_195926 3000 nt of promoter + ATG
catatgccttctaactggttgcaacagcaaactgcggctatcgcctcatttaaggagcagccaagtgcttcccttttgtcttcttttactaaacttggagacgacattgtcatgacagatataggtaaacgacatctacgcaactttgtttacatctttttcatctctatgcatcaactaactcattttgcctttgtacgttaagcttgtcagagggtgttgaagctaaatagagattctggagcatgctctagcattcaattctcaaacagtgggatccttgggttgccctattggttgttcattccactggagagagtttttaatctgttagtgatttctcattcattatcttatccattaacaacacttctcttgttctgaaactttctaattgatgttgtgttactttggctaaattataacagagctaatggagttcaggaagcacatctcagtcatactcaggaactccggttattgccaggtgcgatttgctatacagaccctaattttttgctcatttactcatttgcttatgctagtcttgatgttagcagttcatcaccccagtcccaattagctgcatcatgaagatggtttaacattggttccagccggaattggtttgatttaattgctactttttcatttaacaggtaaaattagcatacggttgaacatagagattcctccatgcacggagcttgttgaaccgatacaagaaagctgcatatggcgacagacaagaggcgcaatcagtgaattctcgagtgctggaagtgcagttgaaccttcagaaaaggttatttaagagaattgcattcccgaattgtatggtttaaatccaggtagctcagaaattttgttttcataacttgcagattggagtttcacaacaatggtatgatgaattagacagcctcgccaaagaaatagccaaccctgaagcagctgaggaagaggaagaagaagatgttaacccctctgaggttgacagagaagaagatggacgtatccacattgattgtcctgtcaaaacaagtcctggctcaagtgaggtacgcctaaatctcctctcaagtctcttttatgtacagaagccaaactttactattagaaaaaagtataactttgtcgactccggtttgtgcagcttattgtttatgcagctttgtatttaagactagcgagaaacgaagagacagaaagtgcgacccaggaagaactggcgagaaaaatagcaaagattttaaagccagtacggaacattacaactatgaaggaagatttgtttgtgaatttgttgtccaagtcaaagagagaattgagagacattgtcttcataaagccgatgcatgtgcggataaggttagactcgaaggatcatccaaaagccgataactcaagagacgtaatcttgactgactcctctgttgaggttgatgtctctctctgacaacgaataacgatgcttttgcagtccattctttctcaaaggtaccaaatggctactctaattctttttgaggtggtaaaaatgagctcaataagacttgtataagtagtttatgacattatattaacgatggtccaagtttcatttggatttctatatttgagtgtttcttctatttttggttaaaaattagaaaatatcaatgaaattagcaaatttttgggtgccattagtaaataacaaaaaagagtgaaaataagaatatttggaaaaatgaagacacgatcactagaaaaaacagctgtcaagctctttaatttttcttttaaaaaccaaacagtttcaaactgaaatccaaactgatttttgaaatatgaggaacaacgaaattttgaacatatatagcatgttattgttatggtcctaataatgactgatttgcttgaagaacttatttgttactattccaacttattacatacatgtgtgttgatagatacatacatggataagaaaagtgtacatccatatgtttatctcaaatcttatttgcaagagcctcatgaagaagatatattgttgacttctttttgtaaacacaaggagacagagaaatagaaatgcctgccttttcttctgatttgttcgcattttttaaatagattttgggaataacaataatcttacaattattcgcatttgattttaaaaatatttagttcgtgcagccatcaacattacatcaaaccctttagttgcatttatcttatacacttcatggtctccatgttattctctctttttctgtttccagttttctctttcttctcattatttcccatttcttcaaactttacaatattaatcacttttataatctgttttaaatctataatacatatatgtgggggaaggttagagaaatgtgaggcacacaaacatgagaactatgagatatgtactccattttgcatatttaattattaacttaaagagtagtttaattgtctatattaagagaagaaattcagaaacctaaaacctgaaagaaaaaaaatccagttatctccttccatttttttaggagactcttccgcgcttcggatcccaacggttttggtgtagatttttcttgatctgggttttgttacatctttgacgaaaataaaacatatcaacgtgatgagataaagggaaaccctatgggtttcttgtgaaaggggcaaccattgtttatgaaggattctaaggtttgttcttcgttctgcattttttttaccaatccacatatgttttcctgatatttatctgaaaatgtgtttcttttgttcttgtcaacgcaggcattaattaattgaacaaaacgattcgaacaagacccattttttggtcttaatttgtggtcctcagactctgttttgtacaagtttcttcggactttgaatccaattcgccgtggtttgaaataagtttatgtctatataatcacaagaagaaggggaaaaaaaaaaggagagattcagacaacagctaccggagaa

SEQ ID NO: 10160 - DNA, 3000 bp, Unknown; identical to SEQ ID NO: 10157
  misc_feature (1)..( 3000): cDNA_ID_2714432_gDNA_ID_2213627_Annot_ID_195924 3000 nt of promoter + ATG

SEQ ID NO: 10161 - DNA, 3000 bp, Unknown; identical to SEQ ID NO: 10156
  misc_feature (1)..( 3000): cDNA_ID_2714444_gDNA_ID_2213627_Annot_ID_195921 3000 nt of promoter + ATG

SEQ ID NO: 10162 - DNA, 3000 bp, Unknown; identical to SEQ ID NO: 10155
  misc_feature (1)..( 3000): cDNA_ID_2714448_gDNA_ID_2213627_Annot_ID_195920 3000 nt of promoter + ATG

SEQ ID NO: 10163 - DNA, 3000 bp, Unknown; identical to SEQ ID NO: 10154
  misc_feature (1)..( 3000): cDNA_ID_2714456_gDNA_ID_2213627_Annot_ID_195917 3000 nt of promoter + ATG

SEQ ID NO: 10164 - DNA, 3000 bp, Unknown
  misc_feature (1)..( 3000): cDNA_ID_2714428_gDNA_ID_2213627_Annot_ID_132088 3000 nt of promoter + ATG
agaccgagtcatttacaagcaaatggaatcacgagagaagttaccaacctcgatcatagtttcatcgaaattgagaggaccatttgaaggaataataacagggttgaattcgttaaccgtcttcaagctcccaatgaaagaggattcaccactgtaaacctcatcgatgttgaaatccttggccagctcagtcacaatctttgactctgcatgtccaccctggtccctctttggcggcattgtatagtatgggattttacctgcataaccattcatattagagacaatgatgagttaagaaactggttttcaaaaatgcttttacgcttcaagtttacgaggaacaaaaaaagatccgcaccttcattccagtcatgcaaaacaattctggcagcagcatcaatatccacaagaccaccctttttaagtttaccccttacagtggcgactttgtaaaggaaatcatcaactgcctcgaagctcgggattttgtagagagtcaccagcatatctttaggacaaagcttgagaatttccttcactatttttttcacaaagcagaagatttccaagttaggtcactcagattataacctttaaaagacaaagcacaaaaataagtgtgattctatcttgagcttatatccaattacctggactaactgggtcatccaacttctcgattcttttacaatttcggagagctatggaagcatcatttcctgatgatttcaacatcacaactccaggacaatccagcaacttcacgtttttgtccaagtgaacctcttgcagagatctagtcagtccaggagtggcaccaacattgacaacatgcgctctcttcagactgttaataagactactcttgccgacattaggcagtccaataataccaactgtgatagatttttttaactgccaaagaacaacaaaggaagatttaattgaaactgaatgatataacttgatgctaaggtaggatgattaaagtttaaactatggaaccaacctcatgacttcttgagtagttcttcaacaatttgataagagtgtctgctccaagacaatcactcgtctgcaacatattgcttggttttgatgccttagatgatttccaacccaagtttgatctctgttcctgggtgctacacttgaaggcaacagctggaaattcttccctaaggtacataagccatttctcagcagcctctcggggaacaagatctggagagagtgaatcagttacaaaaattaattacaccacccagagtaaacaaacaacttattacgtccacgagtaaagactgaatatatgaacttaccaatcttgttcagcagcaacacaagatgcttattgggaccggcttgcatcaccatcctctccatgtcagtacaacgagtgccaagaggatcacgggcatcaagaacctccaaaatgacatcagacaattcaatgactttaactagctccttgtagaaagccctctccgagttatctgtgaaacaaaagacattagtgcatgtaaaggcagagagaaagcacataaacgcgtgaagaaggtatccaaaacaactcacctcgaacattgacaactttaggtaagtcctctatggtctctccttctgtcttggtatcctcatcatcaaccaaaccaagtttcctctttttggcctgaatagatttattaggagagatcagaacacaagcaccactccaaaatacgagtaaatcaaacagcaagacatgaaaaatgcaatcttttatcaatcaatcaaaactcagaacacaaaggaaatagctttaagaatttcgacctgaacttaaagttatatgattactaaatatctgaacatgtatcatagctgtgagttacaatgttaaaagaatgagattaccctttctttgcgagcttctttcttctgttcaatctcctcaagagcacgggcacgtcgaacttcaagggctttaagctcttgttccttgaaaggccagtcattgggtatacctgggtctttctctactcttggcttacggtgaaggccaagctttttagcatcctttgccttcttcttgtggtgctccttcacctttttcaggaccttatgcttctgcttcaaggtcaccctcttactcttactctctgcaaaaaaccatcaaaccaatcaataaaaccccagtaggaatcctgaactgaatgatatgattcaaattcattcaataagacagatccagaatatcaatatgattgaaggatgtatcttacttttactccgtttcaccatctttctcgccctgggatgagagcgacgcaaacagaaaaactgagtaggttaaaagaaaagggtttatggagaaggaagatggacatatcggcgccaaattagggttttgctattagatgtacttggatcattacccgacccgttatagttgacccgaatcaacttaaaaatattgaaaaaataattggggtgagagaggctcgaactctcgacctcaggattactcagatagctatgagacctacgcgctagccaactgcgccaccaccccgatgttagtaatctttactgattatgtaattaacttcaattgacattcgttatccaaagtcataataaccttgacttggaccagtcacctgaaagtcttgagtttttttcccttaagatcccgccgggctccggtgctggcggttaaacccttccaaaacctgaaattcgtttagcttaggacaaacaagtgaagcccaccatacagaaatgtctaacagaagcctccatttgaagaaaatatcatggctttcttctcggattctctcaggtttccgaattttgatcgtcttcttcgattctagctttctgggttcccactgtttaagcgttcttaacgatcttttttggttgtcgttttgctcactagacaatgttcacggtcgatttcgccgatcaatcactactccagccacttgtttagctccttcactcgatggagac

SEQ ID NO: 10165 - DNA, 3000 bp, Unknown
  misc_feature (1)..( 3000): cDNA_ID_2714938_gDNA_ID_2213633_Annot_ID_132090 3000 nt of promoter + ATG
acccactcttattttccagagagagaaggagatttccggttaaccagaaataaattccggcgacagcttgttttttgttttatacatagtttccgacgtttgacggatctctctttccaattagtcggattttaataattttttgcttagcttggttcgttttccggctaagatcggattatgttttttgtttttctctcctctttctacatgatttcagtgtaaatcccgcttgctgtcaattggtttatttcatgttcatctgttggcttgaatcttctccaaagttagagaaatatcttcgccgtaatatcttcatcgttatgcgaagtggacctttctttaggtcttgggcggagattcttcctttgaagttggggttgagatgaagatctacactatctcctattattcaaggtggaaacaacagatccaatttgatatgcggcggtaatatctttaggaggatgtctccaagagcgtgaattgaagctttcacctggtggttacgaccgtcgtcggacgtgacagcaaattgaagatttggcggtgagcaaccaaaggtgttccggcggttttctcgcttgtgccacatgaatccattaggttttagcatcaaacacgtgtctcttacgtatcttctttgtgtaattgagtttattttaaaattaggcttcaaaagactttgtatcacgtatcttgtaatctgtcctttatgagtttcgtttttttttaaacgatttatttcattagttgaatcaagtgtgattacaatgtaaagcagataaaatgaaatatggaacaaaataatgatattggaatgagttgtcatttgttattctgtgttataaaacgaaaattgccgacaaaaaaaaagaattttcggttacgaaaatataaaatcttatagatatagaaaatgtaaaaggtcttttgtaagaataatacttttctactaaaatattaagaatatagcatattatatatatcaattatgtaaataacatcaaaggtatgaaaaatgactaatggtggtggtggttattccggtgatggtagtttcagcacgattccggtgaagattccaacggcacaagttcaggcgatattccgaccatagattttcatcgatgatattccaacgatatagatatcagcgatggtggttgcgaagattacggtggtgattccagtgatagtggtggtgactttgtgatggtgatggtgatgacgtggggatgatggtggtgccgttgtggttgtgatggtgatggtggtacagtggtgatatgatatccatgataaatagtaacagtgtggtggttttagtagtgagaacgtggtggttacgatggtggcggtgatgacgttgtgatggtagtggtgactgtggtggtgatgacatagagatgatcacgttgtaataccggcgtcggtgatagaggtgactataacgtcggcgagttaattggtttggcttaggatcaattatttccaaaataccgaaaatacacattatatcattaaaccatttttttggttagttacataatataatatttttatatgttatttatgcaaatttcccaaatgtaaatcacttgggcacgtgtcaagagaaagcgcgtaatcatcacgtaatcaagcgaaagggttttgcttacaaaatcctgagccgtctttcaaagcccaataactggcccaaacattctcagtaatatttcgacctaaatccttatttagacgcatctttattcgataaaagataataacaaaacttatctctttgccttgtctgctttttcatccaaaggtccaattagcttcttaagcccaaatctctctctctttctctctttctcttcctctctcaatctactcgccggagatcggctcgattcctccgtcaccaccgcatccgaccggagatttccttccgttttctttacttcacaacgcagagcttcaatttctccctcgcaggtattcttcgcgaaaccctaaactctcactaatttcccctggatctaattggggatttttgagttttgcctcgattgtttgttaaattgttagcttttgtttgttaagtttaaatgttttggtttcactcatggaggcaaatcaattttgaaaaaaacttgaaattgttgtttgtgtttgtgtttgtgtgatataaagaaaaaagcccgatctttttttttgtttgattaaattctgtgttttgtttgaatcagtttcgttgtgttgaaaactttgtaatctgggctctagttttctcaagagacatggaataatcacaatgtcaacgaatcagttggctaagcgatttcggttaggttagtttccggttaacaaaaactaatccgacccgattaagtcactcctaggccttacccgacccggctcatcgattagtcacacgaagcttgactttaccatttctttcgagtttctctgttgagtatcgagaatcgagaaaagaactttgctcaatctttgtttctcgtttggtaatcttcgtttctaagaattggaatggtctttttcataggattcatgatagtttttggctgcaattttgtatctttcttctgattatgtgaggaatttgattttgttgtcgttgtcgttgtttcgtcttagggatttgcgagaatcattgaacaatttttcaactttgacaattaatagcacgaaatgagcttcagatttatgtgtttgagtattcaaagatatagcttttatatttgcctttgtgggtttcatggagctgaatctgtatacttatagctcattagtaaagtctgttgttgttttcccatcatttgcttctggtttgacattgtgttgagtagtaagattagagctttcttgctttacatgaagcatttcatttgtggaaagtgcttcaatccatttgggtttctctctgatttggaagatatgtctggtgaaaactttatctgggtattgcttcttttcagtgattgatcaaag

SEQ ID NO: 10166 - DNA, 3000 bp, Unknown
  misc_feature (1)..( 3000): cDNA_ID_3035378_gDNA_ID_2213633_Annot_ID_180941 3000 nt of promoter + ATG
tgtcaattgctttggttccaaaagagtattggacgtacgccttctctatcgcggtctatctcataaaccgaatgccaactccggttctctccatgacgtcaccatttcataaactctttgggatatcacctaattatgagaagcgtcgggtcttcggttgtgtttgttacccttgggtgcgttcgtagacgagacataaacttgacaatcgttctcaacaatgtatcttccttaggtactctacttctcatagtgcatatttttgctttcatccccctaccaagcgaatgtatgtgtcaaggcacgttcaatttgctgaatctgttttcccattcgtgaagcccaatcgagaggaccacaccaataatgtggtaaattccagctcgccgttgttgatattgctcgcaccacctcagatatctccgtcaccaccgtcgacgcctactgtccaacctgaactccaactcatccgctgcctagacataactcacgtgtttaagacgacaatggtcatcaagactcaccaagaatattgggctcaaatcaaacaggcccattccaatcaaataatctggcccaatacaataacccatcaacaacaagcccatcatccatcacccagaatttgcccaacaacacaacaactcgtacatcatcatcttcgtcttcaccttcgtctcacaccagagcttatcagatgtcaccggtcaccccgccaacttcgtcaacgccaccgggatccccgcactctggccttcgcctctcaccacaaccatcgtcatcgtcacaagtattatctcatatccctaactcttcctcatctcatatatctgagcctacagctccaattatacatgggtcgcaaatctcgacccatgcagaccctctttcaattgagcccattgctccacgccaaaatgagttgcaacccacaactcagcaaaacccacaaacaaatccacaaaatctaatccaagctgcgcctattcaaccacaaaaccaaattcataaaccaccacaaaataatcacaatatgcgaacttgagccaaaaacaatatacacaaaccaataaacaaactcagcctcacagtcactgccaataaacacaaatccaagtacaaatccaaggaactgacaacaattcaacaagccttgaaagatgaaaattagagttgtgcctcttctcatgaattcgatgcacttatgaagaatcacacctgggatttagtcccaccacaacctactcaaaatatcattggctgcaaataggtctttatgacgaaattccatgccaatgggctcctagatcgatataaagcaagacttgtcgctaagggttttcatcaacggtatgggcaagactacgcagaaaccttcagtcctgtcattaaatgaactacgcagaaaccttcagtcctgacatttcatacgccatcaatcgcctatcccaattcattcacaagcccactaatgagcattggcaagctgcaaaacgggtgttacgatacttggcaggtacacttacacatggaatatatcttaatgctgcctcaccaatgcttcttcatgcctattccgatgctgattggggtggtgatactgaatattacatctccacgaatggctacttaatctatcttggtcgtaatccaatctcttggacttcaaagaaacaacgcggtgttgctcgcttgtccagtgaagctgaataccgggccgttgcaaatactgcttacgaggtacaatggctatgttctctactcactgaactacaaatatccttaccgacagctctagtgatctactgtgacaacatattgccctcgactactgtgacaacatactatgacaattgcctatctttgcgcaaatccggtattccactcccgcatgaaacatattgccctcgactatcatttagttcacaatcaaatacatggtagaatgatgcgtgcagcttatatctctacacttgatcaactggtggatacacttaccaagcctcttccacgatcacgatttcaacaagcatgtgtcaagattggagtcactcaagtacctctatcttgagggagcgtataagagtattaagtaaatacttagttaagtatctaaatgtaaattttgatagttaactctaccctaattctctcatatgttctgtataaatagatgtaaaccaaattctttgaataatttcaatccttataccttggagattcaaaaaataagtgcagcgtttgttataactcagctttgaattacgattacaagcccgagtacgtaagatgcagccttttatctctcaaaagaatcaagaattggtgcttagaggttcaatatcagacttgaattgagattctattctgccgtatcctgcagctttgtatttgagaattgagattctaaaagctgttttgaaaccaattgttttggtattttgatcagactttgaattgtgtttcttagactgttgtgaccaacacattgttatcttggaaaaagatataatcacaagtgagtgttgttgcgtcatcgagacttaacctattaaacctgcagttttttttttgttttggattatctctagaaaacgagaattcatagtgatacaggactgagtttcaaagtctgtccaaaatcatatagattaaacttgcagtttggtgtttcaatctttacaaattgaaagtttagagacttattttgtcttggtttcaattctctgcaaattaaaaacattaaaacgtgacctcgagtttttggcttggaccatttggctttgcaaacactgtaacgtcgtattggttttgaatttttaattaacaattggctttaaaacaaattgcaattatttattattttacgtgaagtatacgaattctgcaacttgactttgctttcatttttgtgcatatagaaaacattcatcaatgtaaactgcagtttttgtattgactaactcacgttattaatctggttttgggtctattgtaaac

SEQ ID NO: 10167 - DNA, 3000 bp, Unknown
  misc_feature (1)..( 3000): cDNA_ID_3035374_gDNA_ID_2213633_Annot_ID_180942 3000 nt of promoter + ATG
ctagctaatcatgtttattactgttttcttgatggctataatggtttctttcaaattgcaattcaccctaatgatcaagaaaaaaccactttcacctgcccctatggaatttttgcctataagagatagacattggatgctcctggaactttccagagaagcatgacttcaatattctcggattttatcgaagagataatggaggtattcatggacgatttctcagtctatggatcctctttctactcatgtttgttaaatttgtacagggttctagaaaggtgtgaggaaaccaatttggtactcaactgggagaagtgtcacttcatggttcaggaagaaattgtgctggggcacaagatctctggtaaaggaattgaggttgataaagcaaaaatcgatgtcatgattcagctgcaaccccctaagatagttaaggatatcagaagcttcctaggccacgaagggttctacatgagattcataaaagttttttcaaagatttctcgacccctcaatagactgctgtgcaagaaaactaagttcaatttcgatgaagattgtcataaggctttccattcaataaaagaggcattggtgttcaagcacccaactaggactatccattttagattatgtgtgatgcatccgattatgcagttggagcagttctaggccaaaggattgatggcaaacttcacgtcatctactacgccagtagaacaatggacgtagctcaaacaagatatgcaaccacggaaaggagctgttagctgtggtttttgcttttgagaatttagaagctatttggttggctcgagagagaaggtttacacagaccatgcaacactaaggcacatctacgccaaaaaggaaaccaagccaaggcttttaaggtggatactattacttcaggagtttgacatggaaatcattgataagaaaggtgttgagaattgagttgcagatcatctctttagaatgaggattgaggattcaatcccgatagatgacactatgcccgaagaacaactgatgttctacgaccttgttaacaaaaacatcaccacaaaggacatactggatgaagcatatgcagttgaagaagaaaagttgccatggtatgtaaatttagtcaattatttggtaagtggtatgatccctcagagtcaggatgcatataaaaagaagaagttctttagagaagtccactattactattgggacgaaccatacttgtagaaaaagggaaatgatgggctattcagggggtgtgtctctgaaggagaagttcacggtatattggaacattgccatggcttcacctatggagggcatttcgccacttttaagattgcccagaaagtgttgcaagcaggtctgtggtggcccacaatgtttaaagacactcaagagttcataacaaaatgtgattcatgccaaagagtcgggaacatatccaggaggaatgagatgccacagaatcccattcttgaggtagaagtttttgacgtacgggggatagacttcatgggtcggttcaatcctccctcatatggaaatacttacatcctcgtagcagtggattacgtctccaagtggatcgaacctataacaacaaatgatcacaaagtggttctaaaaatgttgaagtccattatctttcccagagatggtattcccacggtagtaataagtgatggaagctcgcacttcataaacaaagtctttgaaagtttattgagaaaacattggggttaagcataaggttgccactccctatcatcctcagaccagtggccaagtggaagtgtcaaacaggcagatcaaagctatactcacaaaagttgttggtaagggattggtcagctaaacttgatgagaacctgtgggcctatagaactgcatacaaaacgtttattggaagaaccccattccagatgatatatgggaaatcttgtcatttactagaagaagtggaatataaagccatttgggcaaccaaacttctgaacttggaaatcaaaggagctcaagaaacagttgacctgcatgaactagaagacattaggctggaagcatatgagagttcgaagatctacaaagaaagaccaaaagcctttcacgacaaaaaaatccaccaaaagatttcaacgttggagaccaagttctacttttcaactccatgctcaagttgtttccaagaaagctcaaatccaggtggtctggacctttcaccatcaaagaagtaatgccatatgtgggcagttactcttatcgggaagggaagttctgaatttactgtaaatggacatagggtcaagcgttacatggcagattgtcctattcctgaaagaactacagttcacctccaggagtccattagtgcctaagatagtaagaagtctagcttaagactttaaactagctcgcttgggaggaaatcccatgtctatctctgtacatatttaattttaatattttgatatgcttcttagtgtttttggaatttaggaaataaatcaggatttgtggagctgtggagtctgtgatgaagaaacacctactacaaaagcaattttactctatcaattggtcgagtagcacgtttaaacgaccaagcatgatgatcgagtggctcacttgtttcccaatcactatattactcagcggataatgcatgtacccatcatactcaacacgatttggtcaaactttcttatcccaacaagaaagtttcggagaccatcctcctccactcattcaaatcgacatcaaggataagaatttcaatcttacttctttttctcttgtgagcgcacctaactatcatctctctcacttgattcccttagcaaaaccattcccaacatttcaatcttgagttttcattagacatcactcatccctatttcactcgatcaaacccatcgattttcttttttgtttttgactcacctattaagcttcggttttggtttctaaaagttcagtttcaca

SEQ ID NO: 10168 - DNA, 2183 bp, Unknown
  misc_feature (1)..( 2183): cDNA_ID_3016399_gDNA_ID_2213633_Annot_ID_180949 3000 nt of promoter + ATG
cttatctgcatcgatctcgatagcgaagccatgcttgctcaggcgagaacccgagataagaatgttggtaatgtcctgacatcagttgaattttactttagttaaagttgtaatgtcgaggttggacatttgtataatattaggtggttataatgttttgctagagaccgcttataatatatgagtcagaactaattgctaatattatacaaacctacatgatcacacacctaagcaaattggattaatgttggattaataataatataatatataatatatttgtatttgtgcatatataataaaatgtttattatactatatatgttatatatgatacataattagttagggttaaacgtttagctatatatatgatatattagcaacgttagtgagatatacttttgatcacaagaaccctaaaatacaagagacaaaagtttgtctaaagttttgagataagatctcaaaggaattagcattacagatctgattcacattttgtgcgtgtggataccggtaaagacacaacacttggagtgctaaaacaacctcgaattaatatggttcatcttttcgctgcagaatatccaggaatatttaaaccctaagatctagatttaattatttatttacacggtttctggctatagaattcgttattagtttttataaatcgttataaaccggtacaaatttcttcaattgtagcagagcctacttgtttaatactgaatatgaatctaatttaatctatattatgatatagataaataatttttatggtttatcatgttgaaatttgtgaaatttaattcgttaaacatggtaaaataaaattatataattcacttagaggaaattcgtttatgtttattggatatacggtttgttaagggtcatattttgattatggtattgagtaaatttttacaatgacacggcaacatgttttggtatatactaggttattaacctccgctacgcgaaggtttatttttattaattgttttaatatagtttaggatttagataaccattttgattaaacaactgcaaatacctagtttcctcacagctcgctaaaactaaatgttttttttaaagatctagactacaaccattgatatgcttttcttaacattataaaaaaatcattgttgtaggtttcacatgttagttcaagtcaatatatgttatccattctctgagaagaaaaattatctttatctttcgttatgtattattattagaaattttgtcttattgtaggataataagatcaaattaatagtattttaaatcttaatagatctcttatatcccttaaacatcccatacaccgatattattttattatatttcttccatttatttttgtattttcgtttctcaatgtataaattatatacattataaattatatatatatatatttgttgtcacttcttaaaatattataaataataagctaaactctagttagattgttagaacgaatcatttttaacatgaaactaaaatgtgcactcctaatattgtgactaagatgacatattaataaatttattgagacttgatgatattatattcatatattttataagtatgtgtaacgatagactttattttaaaggtgatattaaagtctatgctcggacgatccaaaaattaagaaaccatgcataataaaatcatatttagccctctctcttcggcgcttttatttatcccgttaatacccctacaaaaccgaaaaaacgataacagttagtagtctatctgcctcaccatttaatgctcaagatatcgaggttatattggaagatactatgtgccggcattggaaacatcaaagaaatgggaaattattactgatatttacgggcttgcggaaatatcacttacacatgctatgctatttattagggtgatattttcactctgttagcaaccgaaaaactatcatactaaattctttagcttccgacatcttaaatgcaagaaggagctaaacacagagaattgaaatctgaaaggtaaaagttaaagatctgagtattttgtactttaaagttatcatttggaaagttctttactttagggtttgtcagactattgttataattatgagaacgctaacaaaattgttatttacggaaaacctgcagataacaatg

SEQ ID NO: 10169 - DNA, 3000 bp, Unknown
  misc_feature (1)..( 3000): cDNA_ID_3035359_gDNA_ID_2213633_Annot_ID_180946 3000 nt of promoter + ATG
agagtactacaaaatagtatactcatgcgtcaaaaacggagttgtattgaatgagaaataagggtgtaaagtgggacacttggaccaaaccagaccgaaccgaaccggcctgcgggttgtcgtgtcgtcccgtcgtcagctcgagggctgtcaggcttgtggaccgtcatgcttgtgagttcttgggcttgttgagttaaatcttatggaaatattctcaaaatattccatattatcaaaatattttatattctcagaatatgctatattctcaggatagtctcaaaatatgtcatgcatatcctgagaatattctcacaaaatcctatctccctctactatataaagagtataacacatgtcccgccatacaggctaagatagcgtgttattcatccggtcttgccaaaacttttctttatttaaaattcaccaacgaacaaatttcaaccgcaacttttgatacttactaacctggagaaaatgggaaaaaggggtgagtaaaacaagtttacttagttaggggatcaactctgcctactggacatacagtaaaaacgttccaaatataatcaacaaccattacttagcaaagattcagaatgtctaacaattaaacaaacaaacatgcgtcttgctcacaacattatattttattttcgtttttagttttagtatttaactttatggcttcacaagcctatattaaatttggctactcaagcctattaaccttggctactcaagcatattttttggaagaccacggccgtagctcgatccttcctctcattgcttgtcagcggttaatgatctgtaatgggcctgtcagcccaattacagtccaacatccttaaatatatttttcatactttttagttttataatctcatatacataagaagttttgtaatttaatatatattaaatatatcaaatcatgtcaccaatgcatttcaaatattatgttactaacaacgtagcttcacacaaattcacataaatcaacaaggacaattctcgagcctatacccagcaactatcaaaaagtatataaggaaagagtttactacatatccgcaaataccaccctcaccttagcctaattgaagatgaagaacaactctcttctcctttatcctttagacaagttactagtttgcttccaagctcatactattgaacaccatcttggctctccatcaaccatgaagtaaaacactgagtcttaaaagctcctgtaaggtttggcttcaaaccaagctcgtttaacaaaacaacaacacaaaccatcacaatttaccccataattatcagtctcggaaacatatacatacatcaataactaaccgtgcaaaatgtaatcccaccgttgaatagttagacagtagcaacatgaacgtctacacaaagttttatctctatcagatttcacatgaatctcccacattcttctgaagatgctgcctcagaactgatatctaggtttctgcaacttgagatgattatgggcaaacttctaaggtcaattccagagagagcttaaatccgatggacaagttgtcagctactatgagttccttaaagaaatatctttccataaacgtcttgatatcgatataattccttctagtacatctggaaaacgtatcacaaaactagtagtcacacactgttctggatttctacttagcatagatttggacagctttggcagttacttgtccagaaaaaaacgtgtataacttctcgaatataaacccgattgaaactctgtcagttgctatggcttcatggcacgtgatctttgtagagatgtcttatttagcaactgattctttctagtatgacgggaaacatccttgtataacctcaacttgaaactactcttttctctttatcttcttccttatatgcttctagtttagcctagccgccttttctgatttattaggatctgcttcatctcacttctccttactgtcacaaaagaaatctccatctgttaatgcctttcctttgcggtggtgatgatctcttctcctccgcaacgtatcgtccttcgtctccgctttctctcatcttcctcacgattatccttcatctcttctctttctcttcctttttcttcttcttttcaagcgttccacagtgactaacatactcaacaacaacggtagtggcagacctttaattaaggttaagattaagatgacgcggtgactctcagattaggaacggtggcatgaatcttttcggtttccttcacctttgaactctcttctctctccgatctggtaacgaccacactctagaactcaagtgttgatgctttggatttgctttcttaagattcttatttggcggcttggagaagagggagatagatataccaatatatatgtgcaaccaacaatacacgtaacaaaaccctttaacattattgatttgcttcacttgaatttaagtgggctccatgggcttttttttttgacaaaacaataggatgggctattgatgtacggtttggggtgttataaagagacccagcctctaattatttctcaagctcccaaacacaaaacactctaaattctaaagtctctcttctctcttgctacttaaaagtaagttcttagtttagtagttgtcagagtatatcgtagatcaagttcgcttgagtctaatacttttgtgctcgggtattagtttgtgatcggttgtatcctgggattcataaatcgtgatgtccaaaaagcatttacggccgatttattgaattaagaaaaaatatatcatatcttacctccgtgatttactttatgtgcttaattactgttattgtaatttatcattatcgttatttaataaaattcgtacttgtttctcaattcagtgtttgtgctcctacaatcttaattcaataaatccacttttaccttatcgctttagacggattgagaattttttgaattttttaaaacggtgatgtctaagatg

SEQ ID NO: 10170 - DNA, 3000 bp, Unknown; identical to SEQ ID NO: 10165
  misc_feature (1)..( 3000): cDNA_ID_2714938_gDNA_ID_2213633_Annot_ID_180933 3000 nt of promoter + ATG

SEQ ID NO: 10171 - DNA, 3000 bp, Unknown
  misc_feature (1)..( 3000): cDNA_ID_1448143_gDNA_ID_2213634_Annot_ID_132098 3000 nt of promoter + ATG
cctaatccaaactccaaattataaactgtaaagtatctgtatatatttcttcataaaccctggaaattaaactcaaattaagatttcaaaaaataaatcataaaccctaactcttaaacttaaccctaagacttgatttctcgccctaaaatctacagagaatggtgacctaacctttttaaattttgacacttttatatctttagcttatatatatattttattttttcaattatctcatattttacgcaattgtttttatttatttaagagtgctagaaaaataagtatttgtaaatcgtataacaataataatatttaaaaacaaacgttacgtacggaccacaatatgcatatatgtacatatgcacatgtgaagcagaattgggtggattgagaatgagaggagaagcacatggaagtacacttgcatgaacatgtttgtattcataggcaaccactttcaattttatataatgactagtttgcaaacattattacccttcctttttgtttttggtatatcaaaacattactcctcctactagatgatttcttttatatattgtgtactttctacagtatttttgtttaccggaaaattctctcttttttataagaaaactttttccggaccaaacatggttttttgtcttttgatacgaagtttcctcttcaagtggaacttgaattcgggttaacccacacttgactaacaaaaataacaattctatttctctatatggctcagttattagctttttttggctttccattttcaccttttaatttgaactgaaatatttgataccacactaaaatatctctctttaactaaccatatggttatatactacactttgcaactaattgataactatatttattttagtagttttattttcgttgtaccaaagccgtccaatactaattgattaaactgttatttcagtttctataagttctcgttgaatcccttaaacttgtagcttttttatttgtttttgccgggcttgttgtagaaatttcgaagattggtcttatgtagaaaattaaagagaatattcttagagtactttgttagaggaccaccattgatgtttggattgtttgtagtaaatattgtattaaattgaattgtatattttaaataaatagtgaaacaatagacagttcacagttggaacataaactaagaaataatttcatacgttctaatatatatatgcatacaattttgttttaacgtaactacttgtattttaacatatatacataatagcaaaaatattcttaatcaaaccaaacttgtcttacatattttttattttgtcatctcattaatctatttttgaaaagtttgtatttgtgagatttctatatatttttatggatatacaaagtgaatttaatccaataaatgatcttctgttataaaaacaatgaatcaaatggattggcctacatgaagctttggtttggggacaaagaaaatatagagagggaaaggtctcacaagtcacaaaatattatacaaaaaaataaaaacaaagcacatgttctgacacatgaacatggttccttcttcacttctccttttctttctaacagctcatttctctctatctctccactcttccactactctcagcctcccactcaattcattcttctctttcccttgcattttataatgctttttgcctttttttcccttatattagcattgcattgtcataaattcctatgtatatgttacaactgatgattgattttcttgttctttaattgtttatagtatatatatagagctagggagctaatttatgtatatatgtatagacatggcttctctataagcttaattgtacatgtgaaggacagaaagagaagtgtattaattgtattggactattctttctttgtcatttgataaagtggccactcttatgctatctactcattaatgtccatacacactgactcctaaacttacgtatgatgatctttgcatttacatgtatagtaatcctgcatgcgttaaactagttaaacaagagtaaaaaagttgtgtctgctagacaatgactcaaatgataacattttaaccaaaacatttgctcacctccataagaagttgaatgtttcgataaagcttatataggttaaatcttaaaaagttagaaactagacttaattacaagtgtttcttgaatcgattagtggtatatatacataacattcatatgatttccatataatttaaaaagaggaaatacgagagggcatccggtagcatctgcccaagtgtcagctcgccggacggccagaaaacaaggcgggggaaatgatcaaacggcggagaaaggaggagagaaaggcgggagcatgtggaagagcaaaacataagaatgtttccaaaggataaataatatcatacactgttttgaaaagaaaaagtctctctaataaaataagtttagcaaaacaaaattaagggagaggggttcactaagagcacgtgctgcctgattctccatttgctcttaagagagacctcaaatctttttaatttttcttccgaaacagctgtttcatagctgtccgatctctctcgccccccatgtgaccccactcagagatataaaccctttgagatcgaatccatttatataattttatttcgctttattctattataaaaattatcttatctcatgcatccctctctctttctatctcttacttctgttttgtataactactctttgttatacatagccattttagttactctggtttgtttctcatcccattctctctctctttctctaatggttcttaatctgttttagcattttgatcatctaaaactttcaatttctctcttgatcctcacttgaattttttgttgtttctctcaaatctttgatcctttcctttgtttttcatttgacctcttacaaaaaaatctggtgtgccattaaatctttattaatg

SEQ ID NO: 10172 - DNA, 3000 bp, Unknown
  misc_feature (1)..( 3000): cDNA_ID_2715000_gDNA_ID_2213634_Annot_ID_180978 3000 nt of promoter + ATG
aatgcaggcttcatgttggattggttgcgtctgaagttgaatagggcgttggagaaacaaatagcttgtgacgcaggctaatgcacttgtaagattaaaagtattaggtccgaactttctcaactaagtaatgtctccgactggattatcattgcgctttgcttttacattgtgtttttcatggttacacccttggggttacgctaggtgaacgaagctgatatattggctcctaatcactctctctcttggatttgtatatttttgacgacagtagaaaataaacaaactgataacttaatttaattaatcttttgttatataaagagtatgtgaatataataactcccatacgtacgtaatcgtagatatatttcaactccaaattaaaaatcgggtaaaaataacatcacttgaaattttaaacacattttgcggtgacattatcctttctcaagtaggaaaaaaaacctttctcaaatatacatggctttgcaaaaaccattattattgattgagccggtttgctgaacctcaagaggattgagccggtttgctgaacctcaagagggttgaaccggtttaagttcaaagcatatgtagatacctacgcagcaagctagtctagcaatccggttcaacgatttaaccgctgaccttaaaaaaccggataaaaatataagcaacatctatccacagtagatgcaatttgtaaacctcgatttcgtcttccgtatagagaaagcttcttcatctcagtgcgtgtgattagggttttgaattcgaggctcttaaaagggttttcttcttttattgtatctagtagagtcttcaatggcaaatcaaggtggttttaagaagaagacgtttggttgggtgataaaagacttgcaaactcataggcgttgctctgttccaatcctaattggtgactcttattggtaaaagcatagtttcttttgttatctttcaaatctttatcgtcaaaacgtgatcgtatatatcaaatcatgaatgatcccatataccgtatttggttattctttctttcttgcaggcgtcttgttgctcttcccaatgaaaacggttacttttctctgtttctcgaagttaatatggaactaattccatgtggctggagaagatacgtggaatttcgcatgactatagtcaatcatatatctccgatacattctgtagataaaagtataatcctatgcactatggtttgtgaattgtgatcatgactggctatgtcaaataactattgatggatcggagtaacatattcttgttatatgtttaaatattgttacagaaggatggcgctggtttgatgagaacactaagaattgggggtttaaagacatgattcccgcagtcatccttaataacgtaaatgttgggttcttgttgaatggggagatcacgattattgctgaagttgaagttcatgaatttattgacacgttaaatgcatcacaagttgaagagcttagtgatgattcctctgaagatttgcagaacaaagataatgtaactatcgaagtcaacggctttcaggttcttgattcgcaggtaattaataagctcttttgtttcaatatttgagatagaactcgatttgacatttttgttcttcattatcatcacaggttgatcaggtcaatgcaatctttgagaaacatccagatctcatatcgaatttcagtttgaagaatcaacatatcaggaatgcttacatgcatgctcttcttgaccttacgaagacactgtccaaatctactaaggaactcacagtggaagacatgaacgaagcagacaatacgattacggatctgattaaagcaggcttgaacttggactggttgcgtcagaagtttgatcaggctttggaaaaacagatagcttacgacacacggatcggagaactcgagaaacaggtcaagaagcgaaagctggcagtgacagaacttgaagccgacctggagaaagagaaagctgcagcttcggcttcattgatgttgtttgactgagattttaagatgaagttgtgatttcttgatttgagtcttctccattgtttaatgaggaatagtgtttcctacttctagtctttttatttcagctttcctcatttcagtatcttccttttaggtagagttaaaaaacatatacatatcctatttttaacttgagaaaattaagtgatataagagtttcttggtgaataagtaagactcctctgtttctgttcattttctgctaagtaattgtttcatcctcaactacgttttggtctctgctaatttgtcttcatccacctgcggttttgaatacgaaattaaaattaaagcagagagtaagtgattatgatgaaactgttgaatcaaaattttataatataaatttgagtacgaaaaggaacctttcattccaagaaaggatattaaaattcatagtttcatttctctgtagaccaacatgtagtggtcaaaatcaacttgtagaacttgcatatattaattttaaaatattttatttaaaagttttaagtcgatggcaaatgctacaagttgaatttgaccaaataacaagcaaaggttagtcgagttttcattgttgatgccgtttctaacttctctcaaatacacaccgcgtgccgtttagtgctctgcttattggacaacgtgtggtataacagaacgtgaacgcttaaacatttttcaactgggccgggctctttggcccaactctatgacttgaatgataccatcagtgaagtcaggtcggtcggtgttcgtcgtatcaaagaagtttcctttagagctttttctctcattctgtcttcgtctaaaaaggtgaaatctttaacaactgatcatattactcttaatgatttcgtaatctcctgttcgttacgttgattattgttatctgttaaaattgatgtttaagagtgtcatcgtactactggtagcttgattgcagataacaatg

SEQ ID NO: 10173 - DNA, 3000 bp, Unknown
  misc_feature (1)..( 3000): cDNA_ID_2715026_gDNA_ID_2213634_Annot_ID_180971 3000 nt of promoter + ATG
ttttgtttatttcaagacagatctcactgccttggcttcatccagtgaccagtctggtagagccaatgaagtagttagatgatttcactgttagtcacgatgcacaaagtgtttagacttttcttatggtcgttgatcttataatgggccaaaaattgtaaattgggccgaagtgcaaaagtgaaacccatatatggagaggcggggtttagtttacaaatttggatgtgtggttggtggtgccactcaggttctagggtttcacgctctctactagtttgagcttcaatgggaaatctcgttgataacaagttcacatgggtgattcaaaacttctcgtcttcccaatcaagggtcgtcccttctaatcaattcgttattggtggctgcaagtggtaaacatgataaaccttgtcttttaatgttacaatttggattttctcttttattttgatgacggttcggatttcttttttgatgtaggcgtcttcttgtctatcctgagggattcaataagtctggtgatcatttgtcgctgtttctggaagtggctgatcctagatcattgccacctggatggagtagacatgcacgttatcttttaactattgttaatcaacattctgataaaatctcaaaacgaaacggtaattatatcttacccttattacaacataattaattagtcagataaaccagttaagtaatcttcagtttttatgtcttgtgaggcttgtttttggacttggaatattatatgtttctgaagcgtgtttctgtgttttttttggggtttggtttagttttcaagttttctgccaagttttgaatattgttttcataatctacaggttcatagttaaatttactgattagatgaattctgcttttgtgattttacagaagcaactaagtggtttaatcaaaagattccaggttggggtttgtcagcaatgattccccttactaaacttcatgccaaagatggtggatttcttgtgaatgatgaactcaagatagttgctgaggtaaatgttcttgaagttattggcaaactagatgtaccggaggaatctgaagaggaaacccaagttacccaacctatgaaaaaggtaaaggtagattatgatcatgtggagtctaatgatttgatgatcaacgagactccaccggttagtgaactcatggacgtcaatggttttcaagttcttccttcccaggtaagaaaacttttaagagttttgtagaaatttcaacctcacaagagttatcaaaaatcttgcttttttttttaattcacttgcaggtggattttgtgaagcgtatttttgaaaaacatccagacattgcaaaagatttccgtccaaagaacccacatctgaggaaagcatgcatgaatttcttgctcagcttaatggagacattgtgccaaccacctcagaagctatcaaatgaagatcttgtggaagcagacaatgcactgacatacgtgaaagtttcggggtttaaagtggattggttggagaaaaagctagaggaagtgaagaaaaagaaggaggaagaacagactggtgaggctcgaattcaagaactagaggaggaattgaaggaatttaagcagaagtgcttagatagggaagctatgctggagaaagaaaaggcaaaggtgttaacagctagagctcctctaacattggatgatgttatttaatgacttttggcatgttctggtctttgtttgtttgtttgttcgtttgagtctatgtttcgaaattggagtcttcttaaaacttagatagctagacagacctatgtgtcttcctttctttttgtacctatgggaatgactaatactgtacaaaggttgatgatgccttcaatttcagctatcaaatcaatagggaaaaccagtttccattatcataactttttaattctcttcaaacctcattagagaagattctttcgtcactaaagtaaaggattttggcataaaagcagcaatgaaacgaacgtaagacacacaagccagaaaacgagaatgtgagctcatataaaaacctaatacgagagcagaaatagtatatgtttcgagtttaaaaaccgattaaaaaaaacgtttgaaacagtgagtaaaaattattagtataccgtatacgagagatgagagtaaaagtaaattacgttttgaaagacaagtcacttatccatatgatggtgataacgacttcctcttaatcctctcatcacacatgacatatatgtaatgataattacatgtatttcctgaagttttttcaaaggtggcctacagattattgctttgagtttaaagaatacgtacgtgttaatatccatattagttaaaaatggaaaatgtttcttaagaattcacatgaattaattgacttatttatgctgcttaaggtaatcaaggatttgttatgtcagaacacactatttaggagctctagtaagtgagttttggtttcaaactgccaaaaaagtgtaagatctaaaacaaagatcgactaaattaaactacgacggtttagttgattatggaagatacacacttgttcctctctacaccttcgttgactacgctgctcatccacattttcttattcccctttgaagtttgggcctcttttctatatgggccttcctccgctataataagaaattaggccatttcaccaatctaatggactctgtgtttcgtttatattagcccagagcttcttgggttgaccaattcaacgtctaaaatttgtgaccctgaggcttctttactatgggctgacaaatagcccgaattttccgtaagctgtaataacttagccactgtacaagcttatgcatctggttttagtcttggtgacactgtgctttcgacacttgtgttttggttactatacttgtgtgccacttgggttctagggttccacgccatctgaatgatctgactcgttcgaattgcaaagtagtcttagaatg

SEQ ID NO: 10174 - DNA, 3000 bp, Unknown
  misc_feature (1)..( 3000): cDNA_ID_2715032_gDNA_ID_2213634_Annot_ID_180969 3000 nt of promoter + ATG
gattagaagaaacagaaagaagagtttaccagttacaagactctttgaacaggtattattgaatcgtaattttaacaaccatagattatcttccttcctacaatttttactccttggttaaaaaatttaattaataaatctagtacatttaatgatgataagtcttgtttagtgtattccaggttgttatattctatgtcggaccaattctcgcaactgaagtccatcttgagatctccttctatgtcagcttcaacaatggcctcagcgccagttgtgcgtgatgatcttgctgacagctctgagaactctgaagcttcatcaagtgattccgatttcacttttcctgctccatctccttcctcagacaatttttcgacttttaacccgaatcagctgcaagtcattgttcaggatctatcaaccacagaagccaaaggtcagtggtaatagcactaaaatcccatgaaagattgcaattcatttgtgtttttctttttttggacaatttttttaattcatttcctttttgttacactagcctctaaatccaccttaatataaacattttgcacatggtatacattgttaatggaatcatccttcttctcatcttgtagaacaataatattgcaggaactgagagctacgacagtgataaggaagggggcttcgaagattacttttgatcatgaagtgcagacttgatctcttcacaagatttttggagttctgacaatctctttactccattgttgtgccacagggcaaatgttatagtgtttacacttagttccaactgcaatttgtattttcctcaggaatagatgctgcaataactatgtagggtcattaagatatgtcaagttccatgttgttaattgcatacacaagccatgtttgttacttcactaatacaattgttgctcaatttcagaattactaatttgctttgttttgtcctcatcatttcgaggtgtgagttttgaattcttcctgcaattttagttccatgaatgagatcattgttagtccatgaatgagaaaatacagtatccaatatcttagttttgtacgaactacttttcaacaagcaccagtggtctagtggtagaatagtaccctgccacggtacagacccgggttcgattcccggctggtgcaaaaagtatcaatatgctattttttcgtaggtccaaaatttgaacagtcgctatttatacataaaggaagtaaaacactctataaaatccaaatatattaaactttttataagttttatgaaatgtgtcctcatcccaagcactagagcacactataacactggaggcatacatcattacactggttggtgacaattagatcgtaggagccaacagagagagactgggaatatcatgagatcatggatgaatgttcaggaatactccgggtttgccaattttaccgagtaagatagtatatgactagaaataaaccaacaaacgatgccacgagcgtcagcattcttcggcttgactttgtctcaaacacctgcaaggattcgattcaacatatcaaagacacagacacagacacaccaaaaaaacaaacatgtcaaagacactttgcaacacataatgaagctaggcttagggttctgagagagtatttctagtcagatataccgttttaaagcggtccatggttcctgagagaaatccccttgatgaatccatatcattgccctacatagaaaccttgcaaaatgttcagtaacaatagcgtctgtgagcaaatgataaaatataagtatcacaaatattctggtaaataccattctgtcaagcatgcggttatgagtatcgacctcttcatttatatcgccagatagctgtttcatgaaaaaagaaacaaataagaatctggttcaaacctagttgtgcatatagagtccaactacaacaacaatgttgaaccaataaaactatgttacggtttccatactaatcctatgggcagtaagtagtagatacagaaactcattagtgtacaaaatgaattgcaagtgtatgttcctattacgtttagggcttacttcatattcctaatcctactgaaaagtgctgaacacaagtttgaacatgacagaggaaccagaggcaggcttactcgttttaagagaatgactctatcttgcaatccctccaaggcacgctcattctcatgttcattgatctcatgagagtaagaagaagcagctctaattcctccctcttcgatgccatcaaagagagaacttctaccaccacgaggctccctgaaatcaaaattagacctcagcaaagaaacagtaacatcttccactcaatctaaattagatgaatttgaaactgatccaaatctatcagaatacagagcaacagtcctattctactgctccttcagatcttcccgatgaaacctaatctacaaattaacgagctcatgaaaacacatctaatcatcagatttcgctagatcttaacctccaaattctaaccaaagatgtgtttgaaaaagtagcgatttgaaatcattcaaggagagctaaccttctaggattcatcgatcaatcgaattaacgttttgatcctccaacgatgtctcgatttcgcttcaagatgttttccagaattcacctggatctatggtttcacaacgaacgcaaattaaggaaggaaacggttgatatgtcgaaagaacagaaagctctgtgtttatcgttcttaagcgaatcaacactcaacaacacgtgtatacgcaagtaatggataatagaaactatggggtcaaatttaaaatcaataaattgttttggaccaaatatagatttcgttatttccggaataggtcccgcgttttttttctctttttcacgaatcagattctcttctcttttgtatacaaaaaccctagtcgacggcgctgttacaccgtcgtccagatttttcaaacgccgacgaagctgatttagtgaat

SEQ ID NO: 10175 - DNA, 3000 bp, Unknown
  misc_feature (1)..( 3000): cDNA_ID_4359907_gDNA_ID_2213634_Annot_ID_180968 3000 nt of promoter + ATG
tactcttttgtgctcttcttcttcttctttttggtcaaactcttttttcttcttattgttttagcattttttagacaaaaataaagtaagaaccgaaaaggacaagaattcgatcgtgttccattggtgtcattgtcactaatcaatcagttgggaaatttgatgagtaatcaactagagaagcttcttggtgggaaattccaaattggattagatgagactaatcaaacttcgcataaacaaaaccaatgaaatgattaaaagataattaaagcatttagaagtgacaaagaacaaagtagttaagttgcatcctattcaggggacattatgtctaaaaataccaataagtaagacacttctttattacagtttttgtttttaataaagattcttaaaacttcttaattatagttaggtaaacatgttcaatctttagtacagtactacaacttagaactaaagtgtggtcctcttattgttaaaacttgacatgagcaaagataacattcattcctgggatgtgttattttctatgtatatcttactcttctatgtttgattctaaagaaacggttaagaaacaagaaaataaaacacaaaggattctctttcttcaacaatgaaaagcttccgtaccataagacaatgtaatcttaaccttaaacatatgaatagagttatttataatcgtacataaagacatgttaaagtagcagtttcttctctctctgtataaaatgtttgctttcctttgtcggtaaatgtttgacgaagaatgattgagattcttagtgaacaagcgggtcttgcgtgaaaaaaaactgcaaaaatgtttcgatatggggtcattacagatttattagatatatataagtgtaagagtttgggatcaatgtgtttttacctcaaacgatttcccggaattttcaaattccaacatactcaatgctacttcacagctttgtgcaacaattggctcagggtcctttgagaattcttctagcaaagcaatgctctgttcatctgaaaagggccgagcaatgtgaagagtaagtaaagactaaagactaagacagtagattgttgtaatctcaaactaagcattttagggaagataccagcaatagaaccaagcgcttctgcagcctcatgtctaaccattgggtgctcattcacatctctaagtactttgcttagagtagctaaagcagttttactttgcaactgacccaagacataagcaacctaagaaaaattgcatcaattacaaggcagcacttatacagatttaaggttcgagagcaataaagcaaagattcaaggtacaagattttaacaaaaacagacacattcaagttcatgaacataatacaggaaagttgacaaacctcgtgacgtagaagggcactactagcactcaaagaatcaactatggcagaaacagcttcctctccaccatgattccttagagcgaacagtgcagcatatctctcatacatgccttttgtttcatccaggagaacttgcctgtagttcgatgatcttaatcaataacgtgctacaaaatattaaataatctagagaatgttgaggtggtcaagagtggaagaacctgagttggtgaacagaagagaaagacgcagctgggcctgctgggtcaacagacatgaaaggtgatttctctgtcgttgatgactggttctcggcatcaacgttactcatgtcttcaatccttttgagagctaattcacatgtttcccgaacctcctgagctggatccgagctcaagcttttctttaaaatgttaacattacccgccaaaccaatagctccaagggcttctgctgcctgtaataatatattaacagcgaatcagtgatatgaaagaatcaaaaagcttatactgatacagagaaaataaggatcaacttatactcaactcatgtcgtactattggatgcaaagacatatcattaagaaccgactcaagagcaggaatggcttcagcatcttgcatctgacccaatgcaaatgcagcttcatgtgctaacaaattagatgagtctctggatgctgcaggacatggaaaaaaaagataaaccagaagttaaacacaagcagtaacacaccatatcagcacacaaagcttgaagaagctctgttcaatcattaactaaaagtaaaaatgtggaaacttgtatgtagttttaggtgcatcaatcaaatagcagctataaaatcaaactgcaaagactttcaatttagccttatacagaagcttcaaagaaaacacaaataaaagaatcagagtttctacattcatcaagcgccaatatctttctttcccaaagtaacaatttttttttgtagaaatagactttatataaaaaagacaagattttgagcagcagtgttaaaacaaaccaaggattagagcgttgcgaggtcctgggcctttcaagttgcgaagagagaagagagctctaaatcgctccgagattggttgtgactggtccaccaatcgctcacagagaaacttctccaagttaaccatcgatgaaactgatccattagattccatattcactaaatcagcttcgtcggcgtttgaaaaatctggacgacggtgtaacagcgccgtcgactagggtttttgtatacaaaagagaagagaatctgattcgtgaaaaagagaaaaaaaacgcgggacctattccggaaataacgaaatctatatttggtccaaaacaatttattgattttaaatttgaccccatagtttctattatccattacttgcgtatacacgtgttgttgagtgttgattcgcttaagaacgataaacacagagctttctgttctttcgacatatcaaccgtttccttccttaatttgcgttcgttgtgaaaccatagatccaggtgaattctggaaaacatcttgaagcgaaatcgagacatcgttggaggatcaaaacgttaattcgattgatcgatg

SEQ ID NO: 10176 - DNA, 3000 bp, Unknown; identical to SEQ ID NO: 10171
  misc_feature (1)..( 3000): cDNA_ID_1448143_gDNA_ID_2213634_Annot_ID_180962 3000 nt of promoter + ATG

SEQ ID NO: 10177 - DNA, 3000 bp, Unknown; identical to SEQ ID NO: 10175
  misc_feature (1)..( 3000): cDNA_ID_4359907_gDNA_ID_2213634_Annot_ID_132103 3000 nt of promoter + ATG

SEQ ID NO: 10178 - DNA, 3000 bp, Unknown; identical to SEQ ID NO: 10174
  misc_feature (1)..( 3000): cDNA_ID_2715032_gDNA_ID_2213634_Annot_ID_132104 3000 nt of promoter + ATG

SEQ ID NO: 10179 - DNA, 3000 bp, Unknown; identical to SEQ ID NO: 10173
  misc_feature (1)..( 3000): cDNA_ID_2715026_gDNA_ID_2213634_Annot_ID_132106 3000 nt of promoter + ATG

SEQ ID NO: 10180 - DNA, 3000 bp, Unknown
  misc_feature (1)..( 3000): cDNA_ID_2715010_gDNA_ID_2213634_Annot_ID_132110 3000 nt of promoter + ATG
tggctatggctgctcgtgctccacttgatttcagtgatattgttttaaatgaaaatcgaccgcagattctttagttgattctcaacttcccttttccacatggctattagaaatcgaaatattagtttttgttttataaaaatatcctgaaatatttcattttggaatcatttcgttcatacatgactcattcgtacatcaatgaacgacaaaaaaaaatcacataagattcaaccgaaattaaacaaataactgataaatcgaacttgcttaaaaacaagatacaatattgttaaaacggttattcattaaaggataaatcaaaaaattaattgctttaacaaacctattaacaattggattaatttatcggcaattccggattaatagaacctttccttgactccttttttaaggatggtttcggtgtaaatgtatatatatgttgaccaacagtaaatccctaggagcctttaacgactcgtattcctcgtggtaattaaatccttaattacccattgatctataaacattgtagggaaaaaataatatgctgacaattctattccttagtaaaatcttaatcgttaatttagttttgtttgtcgagattgttgtctgatatttcgatttatttattcaggtgtgtaggagtagctaggagtcaacatgagaggatcaatggggaatgatcaagctgataagaagaaattcagttgggtcattaagaatttctcctctttgcaatctgagaaaatatactctgatcagttcgtgattgacggctgcagatggtaagaaactaagaattaagacaatttgtcttttaatattattcgtccaaatttaggtttacgtgataaatacggcgatattgttttttttgctatttttgaaaaaaaattctctttcgttttgctgattgttttctattgattttgcttacaggcgtcttttggcctttcccaagggaaatgatactaaatctgatcatttgtctctatatcttgacgttgctgagtctgaatcattgccttgtggatggagaagacacgcacagttttcctttactatagtaaatcacattccagaaaaatgctctcaacgtaaaggtgagtattttcatgctagccacaatatatattattgcttattagtagatatattttgtgggagtttgggtgctgcgagattctagttctatgtaatgagatgagatctgttttgtattctattttgttcagaaacaatacactggttttgtgagaaagtatcagattggggcttcacaaacctggttcctcttattgaactcaaggccgaagatagtggatttctggtgaagggcgaactcaaaatagttgttgaaatagaggttcttgaagttattggcctattaaatgtgtcagaatcagaaagcatggatgtcaacgggtttcatgttctaccttcccaagtaagaaagatagttttaaacacaaaaccataagaatcactcacttaactttagtttttggattataagacattgttttttggtctgtttcttagtctcccaagattgctctctgatctggttttacttcttacgtccattttatttcactgatcacaggcgaaatatgtgaagagtttgtttgaaatacacccagacattgcaacaaaattccgtataaagaaccaatatctgaagacaggatacatgaatgtgttactctgcctgattgagactgtgcgccggtcacctaaagaaatctccaagaatgatttggccgatgcatatgttgcattggaatccttgactgatcatggatttaagttggattggttgaagaagaaacttgatcaagtgacacaaaagaaggagaaagaggcagctggtgagactcggatgcatgaaattggggaagagttgaaggatttgaagctgaagtgttcagacctcgaagctcagttggataaagtgaagtggaagtgttcagacctcgaagctcagttggtgaaggaaaaggcagatgttttggctgccatagctccactcgggtcgtctgatgacggtgtatttgatgactttttttgagttcttgggcaattagatttaggttctgctagtgagatagggttgtttgtttggcctgctctcttgctttcccttttaaagttaagaacataattaaagagacttcatgttactagggctctcaaggtgtctttaaagcattaattgagttgcttaatgaaaaaaaaagttaaatatcttaggcaaatgaagagttggagctaaacgaattggattccaatattattccattggtcgtatcatttattaattcataataatattgaaaagtatttaaattcacgaggcttcatcattaataaatttgttgatttttgataagttaataaattattgtaaaaaaacccagtcaacacaacactaacagttttcatctaacaaaatgaattaaaaaaaaaaatcaaaacagttttctgaaaaaaaaattagccataataatcgtttaacaatcattcaagataagtattctgtataccttaaaatacgcaaaaaaaaacaggatgtttttatcatccatttacgagagtaatccagatggacgcagaatggtgggaagaacggaaaacggtaaactgtaattaaaaatctctaatcgattgatttttcatgttacaatcgaaaccacgaatcctactacataagtagactgtatcaacgtagaaatttagaatctttttataagtcaagcgaatgcactaaaaataatcaagtaatactatttttagcctatatttagtcgtttgttattgactagattttgttagtgaattgaaacaatcaaatgaccccggtatacgaatcaatcaaacactatttttaggatcactagattttgttataaaaactatggcagaatatatttctttaatttctcatctttcatattcaggtagtttgattgcaaggagtcttcattaatg

SEQ ID NO: 10181 - DNA, 3000 bp, Unknown; identical to SEQ ID NO: 10172
  misc_feature (1)..( 3000): cDNA_ID_2715000_gDNA_ID_2213634_Annot_ID_132113 3000 nt of promoter + ATG

SEQ ID NO: 10182 - DNA, 3000 bp, Unknown
  misc_feature (1)..( 3000): cDNA_ID_2714954_gDNA_ID_2213634_Annot_ID_132126 3000 nt of promoter + ATG
tctttgactatgatgactaagtattaaaagtttttgtagtactttgtaatggagtagtaccttacaaatggtttaagctgggttacttaatgtaaaagtaattttgtgaggcttgaatcttaagttttttttgcttggttttgatgttgattttgttaaatttcaacaaacaaattaaacctctgtactccttaaatgttttttttggtaattctattattttaatacgtaattgtggccgtaggtgagtatcatgtcacgatgagtcaaggctgttcatatttcgagattcatagatatatatatatatatatccctcgctttttttcgttttctctgttttttcctaaatctctgttagttttctcctcaaataatcattgatcctctggtttcttcatgcacctgcgctttaccaagaatcttttaatactcatacaacataataattcgaaattatggcagagtatcaagtcacgagggacaaatgctgttttcattcgcgcacatcaatcgagactcatgcatatttcgtatatctatctgtggcagatagaattcctcaaaaacactaaactgcctcaagactctgaaaggtaaacatagctttctttttttctttgcctccgtttcgtttctgcatgcgacactgaatgtttctctctttccatacctataatttgattctattatatcaatattaatgaacacacagggtaattcaacttatatgattctatttacactagtactacattgttggtttacgaagtttgtgtgttctctctctctttccttgccactgatctattggatttttgtggatgtgtgatgaacttattattttttcttcaggtcctgcagtttgatcaggaagaatcttttactacatcaatgaccaagcaagttggtaagaagttcgcttgggtgataaagaacttctcctctttgcaatgtaagaagttttattctgttccattccagattggtgactgcaaatggtataagaaacttaccttttaaaagtttttgtcgaactcaaaaaatataggttttattgactcgtttcttctttttttttcaggcgtctttctatctatccaaaaggaaacaactgcgattacttgtctctgtttctggaagtcgctgattttaaatcactaccttctggatggagaagatacgtaaaacttcggctatatatagtaaaacaggtgtgagaagaacgctcggtattgaaaggtgattcttaacactgatattcatcactctatattttgccaagttgtcaacactgataaggagtactgttttcgatattggttaacgaagaatgaattgttacagaaacacatcgctggtttgatcaggaaatgtggggttggggtttcctatatatgcttccccttaccaaacttcatgacgaaaaggaagggtttctagttaatggagaactcatgattgttgctgaggtagatgctcttggattcattgaccccttaaatgagtcagaggaatctgaagatccaacccaacctctgaaaaagattaagcttaatgatgatggtgcggtgtctagtgatttgcttgaggaagcttcacccagaaaggaaagcatggaggtcaacggatttcaagttcttccttcacaggtaagaaatttaagaatgctgcaaacttcttgttactttacaagagacgagatcatgtcttcgtctatttccaaatatctaaataaatgttatcttatatgcattgtaaaattatgttttctctcttttgcaggtagaatctgtgagacttatatttgaaagacaccctgacattgcatcagaattccgtgcaaagaaccaatatctgaggaaagcatgcatggatttccttctcagccttgttgagacgctgtgccagtcactgcaagagttctccaatgaagatcttgtggaagcagacatcgcgctgacatacttgaaagatgcggggttcaaggtggactggttggagaaaaagttggaccaagtaagagataagaaggagaaagagcggtcttgtttggccaagctccaagaaacagaggaaactttactgaaattgaagcaaaagtgtacagagctagatgctctaatggatactgaaaaggcagagttgtcagctataagaactcctctatcatttgaagatgttgtttgatgcattgagttcttaggcatttggtgttctgatatcttagtttctcccttggtttcaaaataagatttgctcttgtaaggtaattgaacttatgtttgaagtttccacctttgtacgctatgatttatcaagcaagtttcagctaccacatttgatttagcacttagtttcttgacgacatatttattttcttgcgtctgaagcaaagatttgttctttggaagttcttcagcactcggttcattggcatgttttgaaatgaatcctcttatgtggaaagttttcatatttttgtgaaggaatgttatacaattgtgacactaatcttgaagataaaagaaaaaaagtaatctctttgggctataaacagaggtgtggcacttgaagagtcatggctcgtggctcgacgtagacttctttaatattcattgatattgtcatattttggttcatattcatgcagaataaacacgttgatgtaaaggctgttcgcattcaagcacttctctcgagacgcatgctttttctgcatattatggcagagtgtcaagttacgatgagcaaaggctgtttacattcgcacaccttctttatttttggtatcaatcattaatcatcctatatatatccatctcttgcattctgaagaaactcacgaattagataaaactccctagctagctagcttggtatgtataatctcttttttctccgtttgattttaaacaatgttccttttaaaagtactgatttctggtttcttttttacattctgcagtttgaacgggagaggttcctataatttcgatg

SEQ ID NO: 10183 - DNA, 3000 bp, Unknown
  misc_feature (1)..( 3000): cDNA_ID_2715127_gDNA_ID_2213635_Annot_ID_132129 3000 nt of promoter + ATG
tgtagaataaaacaagtccttgaaggatgcctctcagtcagtagaaactggtggtaaggcgtttaacaatgtggcatctgttgcagagacttcaaataatgtgcttacagagattccaccagcaaaggaaactacggatgtcaatgggtttgaggtttttatgtcccaggttagaatgggtttcatcatagttcactttgttcttgctagcaggtagaatcggtaaaccatatcttcaaaagagacccaaacatagccataggcttccgaccaaagaacaaacagatcagaagagcttatataaatgcactccttagcctcacctagacgctgtgccagtcgccagagaagctatcagaggatgatctgagcaaggctgatgtaacacttgttgatctgattgatgctggctttgagttggattggctgtagacaaagctggatgaggtctctcggaagaagaagatggagcagggtagtgggccccggctacaaacaatggaggaacggttgcagaagctgaagcttttgttcgtggatcttgaatctcagctgcagaaggaaaaagtggaggctttggttgcgagagctcctctctcattcaacgatggtgtttgcagattttcaggattttgtggctttgtaggtgaatctttgttttcttatgcctggaagcaaggcccaagtttgtattctttgagttttatgtcgaatgggactgagtagtgaaattaaccttaaagagtaactatttcaaaacatttgaacaactaaagtgtatgttgaggatttaagttttgaaggctgcaagaatgttgcaatgttccaaacacgtaatcatactctccactctatttgagagtaactgggaaatttttggttttggataataactccactttctatgccttcctgggcttcaaggtttgcttttgttctgctgcaaaaatgcagggaaggattcataggcatgagtcgaggagatggagactgagtgactgactaagggtatgtgactgaaaatgatgaagaacccctactctgttttcgattgatgaaagtgaaattaatttctccgttctgcatcatgatttgaagcacaaatttgagacagagaaggcagccaccgctctccttcgatgatgttgtgtgatcacttaaattcttaggcattctttaagatcggagtttttcttaaaagataatgaactctcatgtatttccgaagttgtcacttattgtgaagaagggagtcttttgcggctgattatctaagtttcagctaccaaatttgttagatctctttggagagttctctcatgggtatgaatcttgatgataaagcaacctctctaggtctgaaacagtgacttgcacttgaatctattgctttgacatagactcctttaacatacatttgcattttcatcatttaatttatagtttgggcttatgatcaagtcacgatgagccaaggcttttcatattcttcataaattatagccgtttttttactctgttttaatgcatctctgtcggtttgactctcaacaaatcattgatcctttgcagtcctgggcatgtggatattctggtcgggttcggttttccgggcttaaaatttttagattcgttaggttatatgtacaattttgggtcatgttctattcggataatttggatattggttaaagaacccataaataaccaaagttttttcttaaaataataatctaaaataaaacgtaaaccttgttttgaccttattccataactcaaatcattaaacaagtcacaaattcaaattattaatgcatatatatacagtaaaacctctataaattaataatgttaggactgcaaaattttattaatttacagaggtattaatttatcgataaattaatatttcttaatttatagagagattttcctaatttaataacttttttaaaaaaatcgataagatttctttcattttagaaaatatctttctagaaccagttacaagtaaaacataataataatatctagaaaacaacaccaaaatgtttgatacagtaaaatatgaaaactatagtcaaacaaataacaaatatgaatttaagcaaaaaattattataaatatatttttaagaaattttttacatataatatagagatatattcgatacatttatagaattattaatttatgatattgatgagaccatatatttacataggactttcaaaaaaattattatcttattaatttatcgatttatatcactttttacattggtcccaactcgggatcggaataatttattaatttatagaggttattattatatagagtattaatttatagaggttctactgtatgttcgggtagtaaaaagtattcacgtgtatcgggttctgttcgagtaataccaatacccatagtttttttgaaaacagaaccgatcggctaattaaccggaaccgaagcagaacggattcggatattttggatcggattcggttcgattcttccggttcaggtattatgctcacacctaatcctctagtttctcttctctatgcacctgcgctttacctaggctcctatattaattcgtagttaagagtatcaagtcacgagggaccaagactgaattcattcgcgcacatcaatcgagactctcctttctgcatctgctcaccttaatcgagaagtttagaattttcattttttcatatatatctttatcgtttgccagaagaaacttcagaacaagacaaaaccattgttggtatgattctcaactaagcatctgatcctctagttttacttcttcattgttaccaatgtttttgaaatcagagagtttatcaactaactgtttctagtctttgagtacatatgtagtgggatctttgtttgtttctttggcttactatcttaaagtttttttttttattatcttcaggcacagtgtatcttgattttgagcaatatttatagcgtcaatg

SEQ ID NO: 10184 - DNA, 3000 bp, Unknown
  misc_feature (1)..( 3000): cDNA_ID_2715116_gDNA_ID_2213635_Annot_ID_132132 3000 nt of promoter + ATG
cccattttcacttgaaaccagattcaagcagttccttattatgtcctgaaaatgtcaaatatccaaattccatcattgagacattacatcgaatcaccaaaaacatagaaagggtgaagaagaagaagcagaacctggaagtcaaacaaaacccatgagacgaaatgaaacagagaagagattcttttaatggaagaaaacaacagagccaaaaaggaaatgaggaggctttgaatgggtctaggattagatgggaacgtgagagagaacgataatggcggccatttctgatttaagagattctcatgaaatctcaatctctcaatgatgcaaatctgttccattggctgggagaaaaatagagtcctctgttccacgatcgctctgttatttttgttggctcctcctcagtttatcctaattttggcgtcaatgtttcgcttttaaaactaggtccctataaaaattcaaacttcctatgttaacccagaaaataaaacattatcaatttgacccaaacaaaaatcataagaaaatcttcaatttttaataatttccctaaagtaccattaaaaaaaatcacagaagctaattatgggatttctactgttttctaattcataacaatatatactgtaaatagtttaccaatcaaagacactaaaaacaattcatgtcttcaatagaaaacattcaaaagttggggactttttatgaaaattctgtataaacgcaagcagaaccaaagccctagccctctctaattcgctgtgtccgttaagtcctctcttttccgaaggatctgactttatcccggaattctgacgccgaagcttaaatggaaaaagaagatgagctccagaagttaaacggtcaagtttcagctccacgagacggagatgtagaagatgacgatccactagtgttgagttctcaagctttggcggcgcttcgggaatttctagcagaccagaacaagactgttgcgagcacgccaccggcgtcttccgtcgccggaggagaagaatccgataaagtggagctggttacggaggattggagactcagccagttctggtacgaacctgaaactgcagagactgtagcagatgaagtggtcactctctctcaaagaattccaggctgcagagtcgcttgcattgcttgccctactctctacgtttatctcaaggtactattaatcagttttgttcagtacccttaatttgtatcgaatccgttttgctaaaaatcgatacttttgttgtcgttgatgctaaatttctgtgcgacgggttttgatttgtgctgagtcagaaaagagatcctagtcttcaggtgcaattgctggagtacgatatgagattcgagagatatggaaaagagttcactttctatgattacaacgaaccagaagatctgccgcttcagctgaaacattgcttccatataatcgttgcagatcctccctacttggtaaagtttcttcaagttcttaacttttccgatgctgttctttcatgggaattttggaaatcttttagctgccccttgatagataggtttagagactgatgtgtaatctgctctgaacttctgacattcaagaagcttctgctagataggcattgcttataaattaatcttcttttaaaagattatagaaagtccaaaagcagacaagatgaaagaaaaaaagtgtaagctttacaatggagtatcagttggttatggtcatggcttagtgtcacttcttaaagatggatactttgtggctctctgctgcgttttgattatcatttgaaatatttcccgggtaggagtatttgtgacttgtgaggatatcattaatctgtgatgtttttgtgtgctatattgcttgctatcttcaaagcataaatgtctttgagtaccttctagttagcgtgttaatgatcttgattcgtttatgcttggcagagtagggaatgcctggaaagagttagtcaaacaattttgttcctcgcaagcccagtagattcattgttgcttcttctcacaggtacaatgggtacttttgttttctcaagtcaaatttatatgatcttatgatttattaactaggagatatctcacgtcttgcaggagaggtgcaaagagaacatgcagctgagctattgggtgttcgcccttgtgtgtttaagcctcatcactctagcaaactcggaaacgagttccgactgtttataagttatgatccaggtaccagattaggaggcttggaagaagacagctagttgtgacttgcttgtaagttgcttctctaaagtcttttgactgttcttgagtaaaccagtgattgttcttttacccttctgatcacaaaaagcaatgtgcttaaatccatctcacgcgttcacgtcatccccttttgctgttcatgtagttgctgttaatttcttatgacgatgcgccttaaccaatctcaggtgtctggcatttcaagcccttatcctctagcagcggaggaacatttgtggcagggaacactcatcggctcatgtgtgttggatatttttcatcaatgttctcttggtgacctcactttgttcaatcgttctctgtatcttgttgcaaccgcagatctcaagtctgatatacttttacattattatcaaaatctcaacatatttaccaaaatgatttattgcatcatgaatcaacatgacatacggaattagctcatcacaaaaaattattcaatccgttgcaactttataatttgcgaggaagagatgaaatattgatgtttgctctcagcgaataaaaagtttttggtccgacccggttctacaaactttaccagaatcaaagtgctaaaccgggcgaagaagttaagatctcgagaagagtcttttacggtgggagagaaacgagagttgttcgtcttcttccatggtcattgaaattcaaacacacgcaagcatcagagaagaggactgattcgcgacttcgattatg

SEQ ID NO: 10185 - DNA, 3000 bp, Unknown
  misc_feature (1)..( 3000): cDNA_ID_2715090_gDNA_ID_2213635_Annot_ID_181010 3000 nt of promoter + ATG
tcagggtctggatctggtgttctcagcaccagtgttagtttaacgaatgggtcatcatcagtttatccttcagccataactcaaaagaccggcgccggaggagaaacacttgttgaggttggacgctctaagacatacacaccaatggctgatgatatttgccatgttttgaagtttgaatgtgtagtagtcaatgcagagacaaaacagaatgtgggcctttcttgtaccatattgacttcccgtgttatcccagctccatcaccttctccgcgtaggctgatctctattagtggaactgatgttactgggcacctggattctaatgggcggcctttgtctatgggaacattcactgtgctgtcctacaatatattgtctgatacatatgctagcagcgacatatacagttactgccccacatgggctctcgcttggacataccgtagacagaatttgttacgggaaattgtcaagtaccgtgcagatatagtttgtctacaagaggtatgttaaatatttatggcacaagttgtactgacttggaaacgtttcaattgctagttaatggataaatacctctccaatattttcgtttttcatcttgcaggtacagaatgatcattttgaggagttttttcttcctgagctggataaacacggataccaaggtctttttaagaggaaaacaaatgaggtttgcttcaacgcatccccttgatcttccattaccttttcgtggtcacttatctgcaagatgtaccaaccagaaaatattgattcactggataattttaggttttcatcggtaatacaaacacaattgatgggtgcgctactttcttcagaagagacaggttctcacatgtaaaaaaatatgaggtatgtcttagttttctcctgttacctatctaattaggcccatttgctaaatcattgggctgctcatccaggttgagttcaacaaggctgcacagtctttgactgaggctattatccctgtttcccagaagaaaaatgctttgaatcggttggtcaaggtactctgagatgctctatagtatgatttctgttttccgcacattcttggtgatattttttcatgtaaaactgatttagagtctttctttttaggataatgttgctttaatagttgtactggaagcaaaattcggtagccaggctgctgacaatcctgggaagcgccagctactttgtgtggtaagttgtccatcttttcaatattgttctttattgtcagagatgatgctagagttgaagttatgtgtttccacttcctcttctcctttaaaggtctcgaggtgatcatgttttctctcttttcatgtatttgatgggtgcaggctaacacgcatgtaaacgttcctcatgaattgaaagatgtaaagctgtggcaggttggtctttatttctcattgtaaaagaactctcagatttcggattcttacatcactattgatccataatgattcttgcccaaataggttcacacattattgaagggactggagaaaatagctgccagtgcagatattccaatgcttgtgtgtggagatttcaacacagtacctgcgaggtctggctggttttcctatttgttatgcccaagtagcaattgtcaaactctatattaaattatgattgtggtttctacctgaattaacttggagttccttcttaatattttcagtgctcctcatacacttcttgctgtgggaaaggtcgatccattgcacccagatttgatggttgatcctcttggaattttacgtcctcacagcaagcttactcatcagctgccactggtaattatctttcccaaaaatggaaaacagatgcacagaatcgtgaaaggcagacttcaattttaattagaatggcaacatatgcgtagacatcatacctttgtgaccattgcaggttagtgcctactcacaatttgcaaaaatgggaggcaacgttattactgagcagcaacgtagaagactggatcctgcatcaagtgaaccgttgtttaccaactgtaccagggactttataggcacacttgattacatattttacacaggttaacttaagtgcttactttcaggggttttacgcgccagtgtttgctttcatctcagatttctttttcatctggtaagcaatttgctttttgttttgtttcagcggacacgctaacagtggaatcgttgttggaactgttggatgaagagtccttgaggaaggacacagctcttccatctccagaatggtcttctgatcacattgcacttttggctgaatttcgctgcatgcccagggccagacgaaacaatattttatagagatactgcagctgtaataacccgataccaaagactggttccaatggatatggttaagctacatgaagtagatagcatggccatgtccctggggtttctcccgctgggtttttcgcttgcgttctactctgtatcacagttttatttactgcttggttcgcttggcttttctttctatagttatttcctctttgccagaaagttttgtcttcactggcttgtgattgtaacaatgtaaacaattagattcttcaagaaaatagtgacttcaccttttccatattaaaatctgtgtcttctatggttgcaatcctccttacactcttaaccctacagcttaaccatcaattttctagtctcttcacttgtagatatcttgcagatactgtgaaaacgaactgtgaacaacttgatatattttatatgtacccctccaataactgaagatgatccaaattccaaaactcaaatttcaattcagaaattagacatgttaaccagtactcattatataatccttttaaatcaagtttcttgcagacttagaactctcgagtatccctataactagagagggaaacatatgtgaacaagaaacaagtcttataaaaagccacattaagttcttactctgctgcattaactgatg

SEQ ID NO: 10186 - DNA, 3000 bp, Unknown
  misc_feature (1)..( 3000): cDNA_ID_1394982_gDNA_ID_2213635_Annot_ID_181008 3000 nt of promoter + ATG
ccattcatggcgatagaacacaacaggttcgttgattgagttaagttgaaatttggataattgtgcacactaaagctaaaaccaaactatagaaacaacctcgatgatattactgaaatgaactctttaaagatcatcatcagtaagttgttctctgttgactcaatctgattgacttctttatgttgttatgaattcaaaggaaagagaagtggcactgaggtccttcaaaactgggaggacacctattttggttgcaacagacgtggcagcacgtggtcttgacattccccacgtggctcatgttgtaaacttcgatctaccaaatgacattgatgactatgtccaccgtatcggacgaacaggacgtgcaggcaaatctggaatagcaactgccttcttcaacgagaacaatgcacaactggctaggtcgcttgctgagctaatgcaagaagccaatcaagaggtccccgagtggctcacacgatatgcttcacgtgcttcatttggtggtggtaagaaacggtctggtggtcggtttggtggccgtgacttcagaagggaaggctcttacagtagaggaggaggcggcggcggcggaggaggcggcagtgattactatggcggaggaggctatggtggtggtggatacggtggtgctccaagcggtgggtatggtgctggagtgaccagtgcttgggattagccaattaggctccccaatttttcctctttttaacctgactatttatttcttctcttctacattcccaagagagcacgtgtatttgcccccacctttgagatctctcattcaagagatggatttaactaatcttgctattaggtggatctctctgttttttcaggctatttttaggatttgtcctaaaagatagacagtagtttttccgattttgatcttgttcttggtttcttctaacaatttcatttgttagtttgaaatccaatttgtctttttgtttccctttgttgttgacaatctttcttggtgaaatacaatctctctttatatcattttaaggactttgtgcttacattgtttaaactccgttccgttacttcaaaaagataaaatgcaggtacataaattgttgctctgtgtgaattaacatacaacaattagattcaacaactattgctattcagcttcagaatcttcttcaagctcacttccttccacaatctcttcttcttcagagccttcttcctcaaggtcatcctctggcctatcaagcaaaagttcctctttagagaccatgcctagccctctcgcccgataaagaaaccctgttctcatcacatgataaaacttatctcgaagacgagtgagaggatgcggatccactagttttcctcggcgatacccttctttgaggatcacagttgttgtcttacacttcaatgagaggtagaaaatgccggggtatcgcgtgaatagacgagtgaacttgtgcggaatgttgagctccgctctcatgcttctcaagtagttcctcttggttttcttgtggatagtcaagctcaagagctcgtgcaaaacagccacagctcgtttctccatgagatcgctttccggatcaatgttactcgggtcatcgtaaggagatatgtagggaagtttttgaaactcatccatccatgctttgaccttcttctgtgctccatatcctctagggaaactcataggaaaagtcaacgtagactgacctctcttgaactcgcggtatctagactcctccccggaaacatcattgtcctcgtttcgcttctgcagcgccgagaatgcgaactcatcacgccattttacaagctttaaacacgggttaccattagaagccttgacgaagcagaaatgatcagggtatttcatgactagcgtcttttcgtagttatcgggtaaaccgagatcgaatttgagagaatgtagtgatctaagagagacagtttttgatctcatcatcatcagaactctacagagtctctccactgtatcagcctcgtggctttgatgaataatctcttcttgtgagtcaagcattagtgctgtgtccgttagcttgaaacatggtaagcttgcgtaacgagcatgaggaaattcgtgaaacagagtcggatacctgcaaaaatgtcaagactttcattaccattcttacaaaattgatttctttctaaaccgtttgttccagtaacaattgaaattttctctgattgtgatacctgcgcaagaagcggagaacagggacggtgagaccaaggagtttttgccaatcggcgacggattttgcggtgaggaaaccagtgggagatcgctttatggcgtctttgaggatacaagctgctttgagatcggtctcagtatcaatgacgtgatccaggttcttgttcttcacccacttcagtctcacctttgtcattgcacccattcctcgccattgttgatgctggtgaaacagcttactcaccgaaaagagaaagctttgtgatttgacgaacatctaaagagatttgacgaaagcgcgaaatgtggatgatctgtaattgagagtgcaaaatgggtttagggtttagtgttctctcggagtttagttaggacttatcattgaaagaatgaatagagagaagtaggggagagtaatgcagagaaggtgctcgacgaaatgcctgaacgaatctaaaagcgagatttttcgacttctaactctaggcccacaggctacagtcaaagtaagccttttaagttggttcgcgatatgtttttgcagacagaacctaaaaacttggaacttctttttatctgcggtacacagccaaatttgcaaaaataagttccaacgcgtctagactcgattcgtgcgactcgggaagactaggctcgtttaaaggttcacgcttttgatatttcgagctcctagagacctagactctagtcctgaggctgattggtagaggaaattggaaaagcttggattgaaaact

SEQ ID NO: 10187 - DNA, 3000 bp, Unknown
  misc_feature (1)..( 3000): cDNA_ID_1396519_gDNA_ID_2213635_Annot_ID_181006 3000 nt of promoter + ATG
agattaacatttaatcaggttttgtaaacgcctgatggtagatggacaccaaaaattagaacccactttcaaatataacccctaagaaaaggctctaaatagttctgattattcagttagaaaccactcacactttgtagtccccagccataaataataattgctagaaaggattgatgcagactaaataacaaaacatgcatctttatgtccattgtgcaagagttatagatgttacctttcccccaatacggaaaagctctgcaagatcatggaactgtccatgaatatcaccgcagattgtcacagggcttttaacaggctgcatacagtaagaatataaaaattaaggctctttaaaccaaatgattgtttagttacacaatctaccacatgggttttataattggcacgagatgcaagatcaagaactgacctgaacgttgctttcatccattaagatctccttagctttctcacataatgctctgacctaaagcaaataaaaaaacactgcacataataaattcatctttcccctcttttacttcctagagaaatacaggactaacagtattatccagtttaacattaaaatgtcaaattagatacaccaatttgacacaagcaacaagcacaaagatcatctacagccaagaagacttttttacagctactgatcagtttttccctcgatattagcttagaagaacttttatcgaattgcaacctctctctcaacttcagctaaatctattatcatttaagatacattcccccaattggaaaatccagtaatgcatctaactgatgagattttaactagccaatcacctaatcaaaaggatacaattttggctgtgggtgagacaaatccacaatacaaagcatattgaaatgcgagctaatcgcctattcagaatccaatacagccagaaatcattaagaaacaaaaaaaaatgaaatccatttctatcaacccgtaaaactgacgtgaaatgagctctacacctatactagaagatccttctcgaagaatcagatcatcatatactcacagaaataatccacccttgatttgaaacaaaatctgagatctaatcaccgaaatggcccaaagttcactcgaaaaactaaattacagatccaattttaaacgaagaaaacgaaaaggtgcgaggaaagctatattctaacacaatcacaggcacctgttgctcggagagaggcttgcactgcatgagctgcgagatctgctcatctagatcgagggttgcatccgttggaagcgaattcgcgcccatgtttttggtagtgcgtcgtcgtcttctttccttcaagtcggatccggaaaacagatcagaaacgaggcaaaggtttccagattaggggcagccctaaccctaaattggatggattctgcgtattcttcgcttttttctttctctctctctctcgccttcgtgtgcagagtgagagaggaaatcaaaacaaaggggcgcgtgaggtaaaggggcgagtgggtttgtagctttcgagctgtgtcttgatttgaccattatatcctcctcgttgagatctaaatgataaattgactaaaacaccctttagttttcttataaaagtgtttaaataggtaatacacacaaaatttgtaaagtagttttatttcttttaattaaacacacaaaaactatataaacatacaatacaactattgttttgaagaatttttcatttttaacaaacattttagttttttctcaaaaaactataatctaagtaaaatgtgtttacataagggtctagctatgggaaaatacattatcaactatttattcatagctaatgaaatgtaattttgatttagccaaaacatcattttaattaaaatttgaatggttacaacataaaattttgaccaaaatttatgtgacatatatatttttattctctctaatgatgcatactaaaatttatgaacgatgaatgtaaaatacaaattgatttgctccttcatgaaaaataaatttaaccaaaaaaaaaagaagaaatctctaattattgacaattcatgagagtccgaacataaaaataatattcaaaatataggttcatgaaagatttagattactctatttttggaaataaatatggtttgaacttttttttacatataagttgaatcgtttttaagttagatacaattaaattcagaataaacaattttaaagttctaaagatttaagtgtaaatttgtttccccaataattattgtatatatgtttttctcaaactcttatgagtgtatataattagattttaaatcaattcttaaaatataaaacaagctaatctcattatcataccatatttttggcttaaggtcattttgaagattaataacatgtctattttatcgcgttgtgtccgatccagaaggtaaacatcgaatttagggtttttctctcccccgagcttgcttttccgttgggtgaacgactaccgttgattttcttcgtttttttggataccgattcgattctctctcaccgatttttgaggttctttctctatatcctctcgttttttgtttccgcctacgtttatctctcgatttcgagctgtatcaactagctagggttccttaattggtttatttcgtttgaggtgatactcctttcttcttctgtttgcgtgatacgattctaatttgcttgcttcgcttggcgttccctggctgggttctctttgtttctcttcgtcttggtagatttgatttcggattttgggggtttcctgcttatggagttcgatttttacattacacagctgctattgtgatttctatgattgcgtttgtgctaactattgacctatttggtatttgccaggttctctatttttcgtggataagaagataaagttattgtttattgataagttttctgctgggaagttgcaactttttctagatttaggacgttacaaatttcaatc

SEQ ID NO: 10188 - DNA, 3000 bp, Unknown
  misc_feature (1)..( 3000): cDNA_ID_3057870_gDNA_ID_2213635_Annot_ID_181005 3000 nt of promoter + ATG
tgaaaactgtttgactaactaacacctgtaacaaggattaaaaattccaatgcttctgcatgttatgtaaagatgatacaagcgatacgacaatgttaactagcatatgaaaaaatttgtaatacaagatttgattttcgccaacattatgcattgctgacttcaaaatcagaacatatgttgacaaaggagactggcattgggaaggaaagagctagcagaactcaaatcagtaagcgaaagctgctactcacataaaacaaaaaacagtgctagaatcatgtagcaaaatccaaactccaatgacaagctaaaaaccaataaacaaaaaagtgtatgataattacctgctggtgaatgggtgttcctccataagcaacaacaaccttcacaccagtttggtaggagaattttttggcttcatcatgtatctgcaagaaaatcacagaatgagaaatgtgtatattatatacacgtacattttttctttctgaagaaactctattcttgttggtgtgtatattacctggcatgccaattcccttgttggtgagaggatgactgcaaaagggtaaaccgcccgtgaaccacggggtctttctacatgctgatctttcatgattccactaattattggaaagcaaaaagcagcagtcttcccagacccagtctgggcacaggccatcaaatctctctctgcaagcagtattggaatagcatgacgctgtaccggtgttggcctcacatacttgcacctccggatgttcagatttaatgcatccccaagatctatgtcagcaaatgtgttaacaggagggggcacgtctcccccactggtctcaactggaatatcttcataggcatcaaaattaatgccagtattctcctgctctgtaaagaccggttctaactcagcatcatctccaaatgggtttacttcacgttccctacggtcccaccctccacttctgttgttccagccaccaccaccaccacctcctcctccagcaccataaccatagccagtgcgccctccatcattcctatagccaccgccgctggcaccaccacccccactgctaggaggagcccaacgagacccagctggttgaccaccataccctgcatgatcattttgtggcaaaggagcagcaacaggctctgatggcctgttccgtaggtgtgggggaacataaggaggctttgactgagaaacggccttctctgaatcagccacatctgcccatgatgcactcatgattgaaatttgtaacgtcctaaatctagaaaaagttgcaacttcccagcagaaaacttatcaataaacaataactttatcttcttatccacgaaaaatagagaacctggcaaataccaaataggtcaatagttagcacaaacgcaatcatagaaatcacaatagcagctgtgtaatgtaaaaatcgaactccataagcaggaaacccccaaaatccgaaatcaaatctaccaagacgaagagaaacaaagagaacccagccagggaacgccaagcgaagcaagcaaattagaatcgtatcacgcaaacagaagaagaaaggagtatcacctcaaacgaaataaaccaattaaggaaccctagctagttgatacagctcgaaatcgagagataaacgtaggcggaaacaaaaaacgagaggatatagagaaagaacctcaaaaatcggtgagagagaatcgaatcggtatccaaaaaaacgaagaaaatcaacggtagtcgttcacccaacggaaaagcaagctcgggggagagaaaaaccctaaattcgatgtttaccttctggatcggacacaacgcgataaaatagacatgttattaatcttcaaaatgaccttaagccaaaaatatggtatgataatgagattagcttgttttatattttaagaattgatttaaaatctaattatatacactcataagagtttgagaaaaacatatatacaataattattggggaaacaaatttacacttaaatctttagaactttaaaattgtttattctgaatttaattgtatctaacttaaaaacgattcaacttatatgtaaaaaaaagttcaaaccatatttatttccaaaaatagagtaatctaaatctttcatgaacctatattttgaatattatttttatgttcggactctcatgaattgtcaataattagagatttcttcttttttttttggttaaatttatttttcatgaaggagcaaatcaatttgtattttacattcatcgttcataaattttagtatgcatcattagagagaataaaaatatatatgtcacataaattttggtcaaaattttatgttgtaaccattcaaattttaattaaaatgatgttttggctaaatcaaaattacatttcattagctatgaataaatagttgataatgtattttcccatagctagacccttatgtaaacacattttacttagattatagttttttgagaaaaaactaaaatgtttgttaaaaatgaaaaattcttcaaaacaatagttgtattgtatgtttatatagtttttgtgtgtttaattaaaagaaataaaactactttacaaattttgtgtgtattacctatttaaacacttttataagaaaactaaagggtgttttagtcaatttatcatttagatctcaacgaggaggatataatggtcaaatcaagacacagctcgaaagctacaaacccactcgcccctttacctcacgcgcccctttgttttgatttcctctctcactctgcacacgaaggcgagagagagagagaaagaaaaaagcgaagaatacgcagaatccatccaatttagggttagggctgcccctaatctggaaacctttgcctcgtttctgatctgttttccggatccgacttgaaggaaagaagacgacgacgcactaccaaaaacatgggcgcgaattcgcttccaacggatgcaaccctcgatctagatg

SEQ ID NO: 10189 - DNA, 3000 bp, Unknown
  misc_feature (1)..( 3000): cDNA_ID_2715106_gDNA_ID_2213635_Annot_ID_181004 3000 nt of promoter + ATG
taatgatttgaccatttttatccctaaggttggtaaaggcttatcaaaggacgagaaagctaggaagttggctttgcagcactggcttgaggcagtaagaatattcttttacaatttgtctttctctgtggctataagttttgtgtaaagccatgtgatcttaattttctagcttaacagattgatcctcgacatcgatatggccacaatctgcaattctattatcatgcttggctccactgtgacagtaaacaaccctttttctactggtaagattgctattacacaatcaaaagtatgatagtatcaagcgtacaaatttacgagctaacgtccaactttggacatgtaggcttgacataggacaaggaaaagaattgaaccacgaaagatgtccaagatcaaaactttaccaacaaagcatcaagtatcttggtccggtgagttttaccctctagtttctgtgcttggttgaccaattctgtagaaccttagatctattttcagaaaaacttggtagaccaatattattgacatgcttgttagatacctttttgtaatccttcattctttcttacaaacagacagaaagggaggcatatgaagttataatcgaggatgggaaactaatgtataagcaaagtgggatagttctcgacacaaaagaaggtcctcctgacgcaaagtggatctttgtcctaagcgtatctaagatattgtatgttggaatgaagaaaaagggtaactttcaacactcgagttttctagccgggggagctacattatctgctggaagaattgtggttgacgatggtgttcttaaggttaaagaaagaaatttactcgcttatacttatgcaaaagaagagatgttataagacactgcaaaaacgttttgtgttgagtttgagttcgttggatgatattttcaggcagtttggcctcacagtggacattatcttccaacagaagagaattttcaggcgttcatgtcgtttcttagggagaacaatgtagacctcgccaatgtaaaggtaagtccattctggtctgagttttaagtcaccaacatctcataggtttggctctggtttgtttttaggctatgattacatactttattttttatattctgtagaagaatccagatgaagaagatggagaagctcctgctaaggtcaagaggatgccttcaagaatcaaagagaccgaagaagaacattgtgactttgtggatgctgagaccggttttagtcccaacactaagcccaacaatcatgcagagctacaaacattatcaaggttccattcaaaactttcaagactggatgagattccagacgaagacgacaacatgatcgaggaggaacaggatgatgaagaagaacctgaaaccccttcagaacaagggtatgagacagcagaggagacattcatagctgaggaagagttcacatatccaaaatcaaacctgttcgatgaagacattgaagattacgagaagcctgtcctgaaggagaagataatgagacggatagattcacacaaaggaattaaatcttaccagttagctgagcggctacattcgagatggagtacaggtgcagggcctagaatcagttgtatgagagattacccttcagagctacaatttagggttcttgagcaagctcatttatctccaagagcttcttcaaattcttctaagatatctccttttgccccggttagaacacgaggaacaagtcttgggagaagtcctttggccgaagaacttgaaaatctttaggtcgatttatatacatgtgacgcgaatgcccatgtcatgaagtaatcggcttgattcttttttgttacgcaagataaaaaaactagggcttcatggaagaatggttttcttatgtgtgttccttattcttcaagtcacatattcattgttcttttgttggtgtagtaatttctgcaactctgcatatttggaaaaacagaaaatcaagttttttttggttcatatttttgtcatataattattttataatccactgaatcatataatcttcactaatttaattgtcgtctaaaaaatattcatccgaatgtaaatccaatctgaagctaataactactgtaattaggtttaaattagttcaaaatttaaacctaaagaaggagatatcgtaagacttggttgttctctgtttctgactgctctaagaacaaggaaaccttttttttgttctgttttgcttttccggattccttattgacgcttgtagttgactctcattctttctgaggtctgcttcttcttgaccctttgtattttttatttcttctccttaaatacacaagttaatctcgttcttttagggtcaatgttacatggttcttggatactaatagctggtttcgtttagttctcgtttacactaaacgttagttactttttttttttcctgttagcacacacgaattgtttgtttaatatgtgtcttctacgtttcattttaatttcttaaaagtgaaacttttggtagcacaaaatcaataaattggcagcaatcacaaaatcacaatcagaaagaaaaagatagtaattagactaaaattgtgcgttgagtcaaattaagtcacgcaaatcacacgtagacttcactttcaaaaagcgctgaatcaaaactggtggctatgaatttttcccatctctcaaaatctttataacttggtctcaaaatttaacaaatactaatttattaataaatcaatctctgtctctctctctctctttctctctgccagcgaacatccattggagctcctcactatacggcccaagagatagagggagagagaagacatcataattcccaaacaaaagactttgggtataaaattgggtttattgactttgtgaaacctacccagaaaatctaccaactgtctcgaagtctctctcctctttcttgaaacgggaaagagggagggaagaacaataagaag

SEQ ID NO: 10190 - DNA, 3000 bp, Unknown
  misc_feature (1)..( 3000): cDNA_ID_2715110_gDNA_ID_2213635_Annot_ID_181003 3000 nt of promoter + ATG
ggcctcataatcgaagtcgcgaatcagtcctcttctctgatgcttgcgtgtgtttgaatttcaatgaccatggaagaagacgaacaactctcgtttctctcccaccgtaaaagactcttctcgagatcttaacttcttcgcccggtttagcactttgattctggtaaagtttgtagaaccgggtcggaccaaaaactttttattcgctgagagcaaacatcaatatttcatctcttcctcgcaaattataaagttgcaacggattgaataattttttgtgatgagctaattccgtatgtcatgttgattcatgatgcaataaatcattttggtaaatatgttgagattttgataataatgtaaaagtatatcagacttgagatctgcggttgcaacaagatacagagaacgattgaacaaagtgaggtcaccaagagaacattgatgaaaaatatccaacacacatgagccgatgagtgttccctgccacaaatgttcctccgctgctagaggataagggcttgaaatgccagacacctgagattggttaaggcgcatcgtcataagaaattaacagcaactacatgaacagcaaaaggggatgacgtgaacgcgtgagatggatttaagcacattgctttttgtgatcagaagggtaaaagaacaatcactggtttactcaagaacagtcaaaagactttagagaagcaacttacaagcaagtcacaactagctgtcttcttccaagcctcctaatctggtacctggatcataacttataaacagtcggaactcgtttccgagtttgctagagtgatgaggcttaaacacacaagggcgaacacccaatagctcagctgcatgttctctttgcacctctcctgcaagacgtgagatatctcctagttaataaatcataagatcatataaatttgacttgagaaaacaaaagtacccattgtacctgtgagaagaagcaacaatgaatctactgggcttgcgaggaacaaaattgtttgactaactctttccaggcattccctactctgccaagcataaacgaatcaagatcattaacacgctaactagaaggtactcaaagacatttatgctttgaagatagcaagcaatatagcacacaaaaacatcacagattaatgatatcctcacaagtcacaaatactcctacccgggaaatatttcaaatgataatcaaaacgcagcagagagccacaaagtatccatctttaagaagtgacactaagccatgaccataaccaactgatactccattgtaaagcttacactttttttctttcatcttgtctgcttttggactttctataatcttttaaaagaagattaatttataagcaatgcctatctagcagaagcttcttgaatgtcagaagttcagagcagattacacatcagtctctaaacctatctatcaaggggcagctaaaagatttccaaaattcccatgaaagaacagcatcggaaaagttaagaacttgaagaaactttaccaagtagggaggatctgcaacgattatatggaagcaatgtttcagctgaagcggcagatcttctggttcgttgtaatcatagaaagtgaactcttttccatatctctcgaatctcatatcgtactccagcaattgcacctgaagactaggatctcttttctgactcagcacaaatcaaaacccgtcgcacagaaatttagcatcaacgacaacaaaagtatcgatttttagcaaaacggattcgatacaaattaagggtactgaacaaaactgattaatagtaccttgagataaacgtagagagtagggcaagcaatgcaagcgactctgcagcctggaattctttgagagagagtgaccacttcatctgctacagtctctgcagtttcaggttcgtaccagaactggctgagtctccaatcctccgtaaccagctccactttatcggattcttctcctccggcgacggaagacgccggtggcgtgctcgcaacagtcttgttctggtctgctagaaattcccgaagcgccgccaaagcttgagaactcaacactagtggatcgtcatcttctacatctccgtctcgtggagctgaaacttgaccgtttaacttctggagctcatcttctttttccatttaagcttcggcgtcagaattccgggataaagtcagatccttcggaaaagagaggacttaacggacacagcgaattagagagggctagggctttggttctgcttgcgtttatacagaattttcataaaaagtccccaacttttgaatgttttctattgaagacatgaattgtttttagtgtctttgattggtaaactatttacagtatatattgttatgaattagaaaacagtagaaatcccataattagcttctgtgattttttttaatggtactttagggaaattattaaaaattgaagattttcttatgatttttgtttgggtcaaattgataatgttttattttctgggttaacataggaagtttgaatttttatagggacctagttttaaaagcgaaacattgacgccaaaattaggataaactgaggaggagccaacaaaaataacagagcgatcgtggaacagaggactctatttttctcccagccaatggaacagatttgcatcattgagagattgagatttcatgagaatctcttaaatcagaaatggccgccattatcgttctctctcacgttcccatctaatcctagacccattcaaagcctcctcatttcctttttggctctgttgttttcttccattaaaagaatctcttctctgtttcatttcgtctcatgggttttgtttgacttccaggttctgcttcttcttcttcaccctttctatgtttttggtgattcgatgtaatgtctcaatgatggaatttggatatttgacattttcaggacataataaggaactgcttgaatctggtttcaagtgaaa

SEQ ID NO: 10191 - DNA, 3000 bp, Unknown
  misc_feature (1)..( 3000): cDNA_ID_3035496_gDNA_ID_2213635_Annot_ID_181002 3000 nt of promoter + ATG
gctatgaatgtctcctctgctgtctcatacccttgttctgaaggggtttcaggttcttcttcatcatcctgttcctcctcgatcatgttgtcgtcttcgtctggaatctcatccagtcttgaaagttttgaatggaaccttgataatgtttgtagctctgcatgattgttgggcttagtgttgggactaaaaccggtctcagcatccacaaagtcacaatgttcttcttcggtctctttgattcttgaaggcatcctcttgaccttagcaggagcttctccatcttcttcatctggattcttctacagaatataaaaaataaagtatgtaatcatagcctaaaaacaaaccagagccaaacctatgagatgttggtgacttaaaactcagaccagaatggacttacctttacattggcgaggtctacattgttctccctaagaaacgacatgaacgcctgaaaattctcttctgttggaagataatgtccactgtgaggccaaactgcctgaaaatatcatccaacgaactcaaactcaacacaaaacgtttttgcagtgtcttataacatctcttcttttgcataagtataagcgagtaaatttctttctttaaccttaagaacaccatcgtcaaccacaattcttccagcagataatgtagctcccccggctagaaaactcgagtgttgaaagttaccctttttcttcattccaacatacaatatcttagatacgcttaggacaaagatccactttgcgtcaggaggaccttcttttgtgtcgagaactatcccactttgcttatacattagtttcccatcctcgattataacttcatatgcctccctttctgtctgtttgtaagaaagaatgaaggattacaaaaaggtatctaacaagcatgtcaataatattggtctaccaagtttttctgaaaatagatctaaggttctacagaattggtcaaccaagcacagaaactagagggtaaaactcaccggaccaagatacttgatgctttgttggtaaagttttgatcttggacatctttcgtggttcaattcttttccttgtcctatgtcaagcctacatgtccaaagttggacgttagctcgtaaatttgtacgcttgatactatcatacttttgattgtgtaatagcaatcttaccagtagaaaaagggttgtttactgtcacagtggagccaagcatgataatagaattgcagattgtggccatatcgatgtcgaggatcaatctgttaagctagaaaattaagatcacatggctttacacaaaacttatagccacagagaaagacaaattgtaaaagaatattcttactgcctcaagccagtgctgcaaagccaacttcctagctttctcgtcctttgataagcctttaccaaccttagggataaaaatggtcaaatcattatataaagactggagcaatgggaacgaaaacgggtgcatcaaaccaacatagttgataggcttgatgttaccttagcagctcttgttcttgctctagaccagcgtgaaactgcagtctcttgcttctcaatttcaaaaaacgatatagaacttcttttaagttcagcaaagtcaagtaccttccacctgcaaattccatttagttactactaaacagataattttatcctctctatatataccaatgccaataatcataacaccacgaaccatctttgctcaacgactacagcacaatcagctagccttcttctggttcgaaaacttctataaactttctgtaactttaatgcagcttgatatgttccatcacctaataacaaggctaaaaattcttttgcatgttcgttttcgcaaacaggtttccatatccgcattttatatctatcatcttctttcataaaagttaaaggtttaatagagaaattgttctccacatctcctggagaaattcttgatcgttgtgtccctttaccgctaagggatctgttgtatagcgtctttctagcttcaggtgattcagttatggttgaatccgagtcaatgtcattaaaactgattgatcgaagaatggtctttgtctctgcacaatcaatacaaatatgcctcagatcaaaatgccttcaaataaacgttcatagaagttgtcacaaatactaacccattttcacttgaaaccagattcaagcagttccttattatgtcctgaaaatgtcaaatatccaaattccatcattgagacattacatcgaatcaccaaaaacatagaaagggtgaagaagaagaagcagaacctggaagtcaaacaaaacccatgagacgaaatgaaacagagaagagattcttttaatggaagaaaacaacagagccaaaaaggaaatgaggaggctttgaatgggtctaggattagatgggaacgtgagagagaacgataatggcggccatttctgatttaagagattctcatgaaatctcaatctctcaatgatgcaaatctgttccattggctgggagaaaaatagagtcctctgttccacgatcgctctgttatttttgttggctcctcctcagtttatcctaattttggcgtcaatgtttcgcttttaaaactaggtccctataaaaattcaaacttcctatgttaacccagaaaataaaacattatcaatttgacccaaacaaaaatcataagaaaatcttcaatttttaataatttccctaaagtaccattaaaaaaaatcacagaagctaattatgggatttctactgttttctaattcataacaatatatactgtaaatagtttaccaatcaaagacactaaaaacaattcatgtcttcaatagaaaacattcaaaagttggggactttttatgaaaattctgtataaacgcaagcagaaccaaagccctagccctctctaattcgctgtgtccgttaagtcctctcttttccgaaggatctgactttatcccggaattctgacgccgaagcttaaatg

SEQ ID NO: 10192 - DNA, 3000 bp, Unknown; identical to SEQ ID NO: 10184
  misc_feature (1)..( 3000): cDNA_ID_3035499_gDNA_ID_2213635_Annot_ID_181001 3000 nt of promoter + ATG

SEQ ID NO: 10193 - DNA, 3000 bp, Unknown; identical to SEQ ID NO: 10183
  misc_feature (1)..( 3000): cDNA_ID_3035507_gDNA_ID_2213635_Annot_ID_180998 3000 nt of promoter + ATG

SEQ ID NO: 10194 - DNA, 3000 bp, Unknown; identical to SEQ ID NO: 10191
  misc_feature (1)..( 3000): cDNA_ID_2715114_gDNA_ID_2213635_Annot_ID_132133 3000 nt of promoter + ATG

SEQ ID NO: 10195 - DNA, 3000 bp, Unknown; identical to SEQ ID NO: 10190
  misc_feature (1)..( 3000): cDNA_ID_2715110_gDNA_ID_2213635_Annot_ID_132134 3000 nt of promoter + ATG

SEQ ID NO: 10196 - DNA, 3000 bp, Unknown; identical to SEQ ID NO: 10189
  misc_feature (1)..( 3000): cDNA_ID_2715106_gDNA_ID_2213635_Annot_ID_132135 3000 nt of promoter + ATG

SEQ ID NO: 10197 - DNA, 3000 bp, Unknown
  misc_feature (1)..( 3000): cDNA_ID_2715102_gDNA_ID_2213635_Annot_ID_132136 3000 nt of promoter + ATG
gagctgaataaacaataaaatatgtggtcaacaaatcgatgcttgaaaactgtttgactaactaacacctgtaacaaggattaaaaattccaatgcttctgcatgttatgtaaagatgatacaagcgatacgacaatgttaactagcatatgaaaaaatttgtaatacaagatttgattttcgccaacattatgcattgctgacttcaaaatcagaacatatgttgacaaaggagactggcattgggaaggaaagagctagcagaactcaaatcagtaagcgaaagctgctactcacataaaacaaaaaacagtgctagaatcatgtagcaaaatccaaactccaatgacaagctaaaaaccaataaacaaaaaagtgtatgataattacctgctggtgaatgggtgttcctccataagcaacaacaaccttcacaccagtttggtaggagaattttttggcttcatcatgtatctgcaagaaaatcacagaatgagaaatgtgtatattatatacacgtacattttttctttctgaagaaactctattcttgttggtgtgtatattacctggcatgccaattcccttgttggtgagaggatgactgcaaaagggtaaaccgcccgtgaaccacggggtctttctacatgctgatctttcatgattccactaattattggaaagcaaaaagcagcagtcttcccagacccagtctgggcacaggccatcaaatctctctctgcaagcagtattggaatagcatgacgctgtaccggtgttggcctcacatacttgcacctccggatgttcagatttaatgcatccccaagatctatgtcagcaaatgtgttaacaggagggggcacgtctcccccactggtctcaactggaatatcttcataggcatcaaaattaatgccagtattctcctgctctgtaaagaccggttctaactcagcatcatctccaaatgggtttacttcacgttccctacggtcccaccctccacttctgttgttccagccaccaccaccaccacctcctcctccagcaccataaccatagccagtgcgccctccatcattcctatagccaccgccgctggcaccaccacccccactgctaggaggagcccaacgagacccagctggttgaccaccataccctgcatgatcattttgtggcaaaggagcagcaacaggctctgatggcctgttccgtaggtgtgggggaacataaggaggctttgactgagaaacggccttctctgaatcagccacatctgcccatgatgcactcatgattgaaatttgtaacgtcctaaatctagaaaaagttgcaacttcccagcagaaaacttatcaataaacaataactttatcttcttatccacgaaaaatagagaacctggcaaataccaaataggtcaatagttagcacaaacgcaatcatagaaatcacaatagcagctgtgtaatgtaaaaatcgaactccataagcaggaaacccccaaaatccgaaatcaaatctaccaagacgaagagaaacaaagagaacccagccagggaacgccaagcgaagcaagcaaattagaatcgtatcacgcaaacagaagaagaaaggagtatcacctcaaacgaaataaaccaattaaggaaccctagctagttgatacagctcgaaatcgagagataaacgtaggcggaaacaaaaaacgagaggatatagagaaagaacctcaaaaatcggtgagagagaatcgaatcggtatccaaaaaaacgaagaaaatcaacggtagtcgttcacccaacggaaaagcaagctcgggggagagaaaaaccctaaattcgatgtttaccttctggatcggacacaacgcgataaaatagacatgttattaatcttcaaaatgaccttaagccaaaaatatggtatgataatgagattagcttgttttatattttaagaattgatttaaaatctaattatatacactcataagagtttgagaaaaacatatatacaataattattggggaaacaaatttacacttaaatctttagaactttaaaattgtttattctgaatttaattgtatctaacttaaaaacgattcaacttatatgtaaaaaaaagttcaaaccatatttatttccaaaaatagagtaatctaaatctttcatgaacctatattttgaatattatttttatgttcggactctcatgaattgtcaataattagagatttcttcttttttttttggttaaatttatttttcatgaaggagcaaatcaatttgtattttacattcatcgttcataaattttagtatgcatcattagagagaataaaaatatatatgtcacataaattttggtcaaaattttatgttgtaaccattcaaattttaattaaaatgatgttttggctaaatcaaaattacatttcattagctatgaataaatagttgataatgtattttcccatagctagacccttatgtaaacacattttacttagattatagttttttgagaaaaaactaaaatgtttgttaaaaatgaaaaattcttcaaaacaatagttgtattgtatgtttatatagtttttgtgtgtttaattaaaagaaataaaactactttacaaattttgtgtgtattacctatttaaacacttttataagaaaactaaagggtgttttagtcaatttatcatttagatctcaacgaggaggatataatggtcaaatcaagacacagctcgaaagctacaaacccactcgcccctttacctcacgcgcccctttgttttgatttcctctctcactctgcacacgaaggcgagagagagagagaaagaaaaaagcgaagaatacgcagaatccatccaatttagggttagggctgcccctaatctggaaacctttgcctcgtttctgatctgttttccggatccgacttgaaggaaagaagacgacgacgcactaccaaaaacatg

SEQ ID NO: 10198 - DNA, 3000 bp, Unknown; identical to SEQ ID NO: 10187
  misc_feature (1)..( 3000): cDNA_ID_2686560_gDNA_ID_2213635_Annot_ID_132137 3000 nt of promoter + ATG

SEQ ID NO: 10199 - DNA, 3000 bp, Unknown; identical to SEQ ID NO: 10185
  misc_feature (1)..( 3000): cDNA_ID_2715090_gDNA_ID_2213635_Annot_ID_132141 3000 nt of promoter + ATG

SEQ ID NO: 10200 - DNA, 3000 bp, Unknown
  misc_feature (1)..( 3000): cDNA_ID_2715086_gDNA_ID_2213635_Annot_ID_132142 3000 nt of promoter + ATG
gtagttatctgtagaagaatcttcaaaaaacctcagctaatcgaataatctaagaaatagaaacgactcgtagtaacaaaacaaaatcacgatgaagtaacacaaagctgagaagaatcgttccctaaaacgaacaaatgcacaaatcattaaaccctagaagcaaaatgaaatcgaacaggacatcgctgcatagatttaacgacaccatgcacagagagatatgaagccagaccttaagaaactcgactagaagaaaaatcttagatcaacgatcaatggtgttcgaaaaagcttgaggatataaaccctaattttcccttgttctcgcgatcgcacacgaagcaaatgaaacaaaggtttctgggaaatgagcaaaagagaaaagatgaagagatatttgtatttcgatgaactttattaatttccaaaagcctttctcgtttttttattttattaattttcagattgtttgccgttttccaacaacgaaaagcgtgccggcgttgctataacgaagtgaactgtgtgtcgtcataaattaacatagcgcgtgataaacacgaagagcaaggattggatagagacgaatatttattgtggtctggacaaaagtaattactgacaaatttagatattaattgccagcaaaagtatttacataccaacttattttaaacaaatgtcataaatatgagtctgtactttcatttccattgaaaatcataattttctaaatatctatattattatattatctgtctctacctaatttgaatattacaatgaaaatttgtaaaaaataaaatatttttgacatcatacatatatttcaaaaaaatattgtcagctaactcaacaattggccacaaatgcaagtaaactaaaaaacatacaactacttaacatatatggattgtatgattatacaagtcgtcaacatcataaacatataatctcgggttaaatggtcgaccaactccagcgttgatcagcattgaccaacaaaatattcaaaactaattattagtattaaaaaaattaatgttatttgatattgtaaaatacaaaaaaatatatttatatccaatataaatatattttgtatatatatataatgcattaattcatataatatttactttattttttcaatttcaaaactaaactaagagaataaatatttttttaagatatgaactattcataataataataataatagttagtttcttaagaagttaaatttttaattgctaaatatttttaatcaatagttagttttttcttatattattcgtaaaaaacatttactttgaatttaaaaattaccgtgcaaaatttagactaaaaagttatatactcaattgtttttcatattactttcttatgaaacttatatagtcatgtgtatttggttctgtaatgatttattttctaatgaataaagaagtttatatattttaattgataatacaaaaaaaagattctttcactcatatgtttctaataagatttttctggttttaatttcagttttttttttgttttaaaaattttaatcatttttttcatttttagtttagttttgaaattaaaaaaagctaaatattttaagaatcaatgtattaaatatatatgcaaaatatttttatagtagatgtaaaaattgttttttgattatagaataactagtaaaactagatttttaatattaaaaataaagtaaaaatttatttttgaatatttttgttggttaacaccggttgacgttagagttaattggttatttaacatgaaattttatatttataatgttaactatataatattatatacttggttatgcaatctatatacatcatttaattaagtgttatttagtttagttgacatatatagtttgtactgtattatattttccgtaagtttcaatcttttttattataaataggtgaatatatgtgtatatagaaaaaagagtattaaagactttttgtttccctttggaaaataaaataaaataaaaatacgagtccatatttggtcttgaacgagacttgcgttcattcctagggggatgaacctctttgttcacctccttttgcattaactaataaaaatatgtcatgtcaaatcctatttaaattacataataaattgaagctataattataatccaaaccgatatataatttcgtttaattacaaaatctaaaccctaattcttctttgtaaatccaaaccgccatttaaactcatttagtcgtaaaaaaactaaaccctaatcgtattttctaaacccaaaccgacatttaaccttgtttaattgttaaatctaaacctgttaataaatctaaaccaatatttaacccgtttaatcataaaatctaaaccttaatcgtactttctaaaccaaaaccgatatttaatctcgtttaatcataaaatctaaaccctaatcgtattttctaaacccaaatcaatatttaaccttgtttaattgtaaaatctaaaccatgattttttcaaataaactcaaatcgatatataattttgtttttgaggcaaattagattttataattaaattaaacttttattattattattaggttttaaattttaatgggctaaaacagtgaatatagaacccaagtatttttctttggtctttgtccatctttggaaattaatttagtcgtagcgaacaaatctatcccactcattggatttcaatttcataaattttaggttgtaaaattcgggtttggagaaaattgggggtaaatctagggttctgggaaaattagggttctgggaaaattagggttcatccatgctgtcgagttttagggtcaagtaaatgacggatccattaggatccgttttatatcttatgctctctcgtctcaatatatatatttaaaaatctcagcctttgggcttcgttagtgttggtttgctttcagaatttaacttagttacggtaaaagcaatg

SEQ ID NO: 10201 - DNA, 1519 bp, Unknown
  misc_feature (1)..( 1519): cDNA_ID_2715056_gDNA_ID_2213635_Annot_ID_181022 3000 nt of promoter + ATG
ttcactatcggctctgcattgtgagattcaagtcttcatgcgtgtaaagcttcctagggattttatcgaattgttcagacatcgttctcatatactctactctctttggtttcgctacttcgaagcaactcaaaccacaacaacttcctctactcatttattctgtttttaaaaaaaaaaactgattgtgaaatatcaagagtccaaaaaaaatttgaacttttaagtaattcgaatcatagaatgcagcatattacaaatattcaaaactatacgaaagtggagcccttgtgagacggacacaaatatgaattgtggtaatgcccaacgaaataattttataataatcaaaatggaatattaatatatacagtgattgcactgtttacaataaagtctttgcctttatttttctacacctgaaaattgaatcgttatgacctcttttaaattatgtgttttttttgtcccctaaccaattcaaattctcttatgtttgaaactgcaaactgaactgaaacatgtataaacatcatcaagctatatatttccatctgcattggataccaaatataaacatcatcaagcttgtgacaaaaaaaaaaaaaaaacatcatcaagctatatatatttgtagatgagatcatgctatatgtataaaagccaaaatagttgttgaaacaaaagattttccttttatgtatagaaaaaagaaacacttttaatagctcaaaggagggagctttcagtttcctaaattcaaaactctctttgtctctgtctgtctttctctctctctctctctttgcaacggctctctctgtcgtcatttcaattcaaactcagcttctctcatttttttaaaaacgtctcttgctgcttcttcacttctcttagctcactacccaaatccctaatctcaaatctgctttgagccttcctgatcttacgcattcctccaaaaccccccaaatattttctttgttttgtttgtctgatttgataaatctcattttgtgtttttatcttcttccatggtcgttgttcttgttctacagtgcgattcgtgagctgagagagataaaagtggagagctttggtcgatctttagggctagatctcccaaagccaccattgtttcgatttgggtcaatccaatttgcaaaacatctctcagctgtgtctgtctgggttctcattttgctgaattcggtatagggtttctgcaaattacacttaatggatggatccataagtaaaaaatgagatctttggcagcctgagaaactgagaggtaatcaaatttcattcctgatctaatttcctttaatcttctgctatatcaatcacattctctatatccttcagctgaaattgggtgattcattataataaaatggaaaagttttgatcttttttatctggggtcttgttgtttgatgggatccagcgtcttataagtgcattccattgaaattaaactgattcaattgttttgatccataggtaaattaagatg

SEQ ID NO: 10202 - DNA, 3000 bp, Unknown
  misc_feature (1)..( 3000): cDNA_ID_2715060_gDNA_ID_2213635_Annot_ID_181020 3000 nt of promoter + ATG
taaatatcataatctttatttaactattttaatcatcaaaacggttatgtctataattaaactaaaatgttagatatcgagaaatagctttaaaatatgtaaggtttggtaatagttgtgtgtttggtctcaaaacaattagaagatgttaattcaagggttgattgtttaagtagatatcaaattgatttttgttttaatgagttggttatcagaattattcgaagaatattaactttggcccagcaaaaaaaaattataaccggggaaaaaggaaaaaaaaaaaaaaaaaggaatagattcgatgataatgttccacgtgcaattctttattttttcttttgaaactttcctccaaatcttattgaccttgacgtgatccacttttaattaaattttccctaaatttgattgctaactttgccataattgcacaacacatagtcatcatcagtacgtcattagatttttttaaattacaggttctgttcctcacattttaaccccttatttttttcgatatcgtaggatcatttttatttatttcatatgatgtcatttcttctttgttttaattttttaatattattccttaacaatgaaaaaataataatagtatgaaaagtattaagtatgataacaatttaaaaatccgaatttgataaaagttctctttattcaacttataaacagaatccttcatccactccattcattgtattaaagaccatctctttttaaaataggtaaaatatatatataataggatttaacccgtggtacactacaaggcaaatattttatttatatataataatataaattttacggttttagtttagtattaaagttatataattttatattaatgttgtaactaaaaaaaattggtgatgataaaataataaaataaatatttaacatgtgttatatcaatccaaacccgtcctgctattcatatcaatctaaatccgtcccgctatattttttgtctcatgattttttatttttttataagtttaaatattagttgttgaattagttgtgattgtgattttatgccgaaaaagttatggacttttaatttcatggaatattcaaaccaagataaggaatgtttttaggtgcacatataattggatttgctcattttatgggattgtaaatgtattttggtttgtttcattttaattgattgccgaaatttaatagaaataattcaaatagttcaaattttggttgttttaagatttagtgaatattgtaggtgagataaggagaagataatttatcgtgttttgcgtgacatatgggattgtcatatatttcgaatatttttggtttgttatacaattaattgccttaaaaaaatataaactattaattaaaaaaaatcaaataattaaaatccagtggcagccattgtaaataagtctcaactccaaataagtctcaactccaggattttttccacaaaatgattacaaaaatgtatatgtagatatatatatatatatatatatatatatatatattgtcaaaaaataaaatatagcatatgtaactaatttttgttcttcttataaatctccgtattattaagttattaacaaaaaaaagcaaaaacaaaagcataagattaccaccaccaatcaaaaaagaaaaagagaagcgacggtggggattcacgagggatgatgtgtgatgccagctgtcgatccaagagaggtgcatctactttatgacacgtgactcatcaactcgcacgtgacatagccatcgtcacttggtcagtcgtctctcttcttcttcatcttcctctcctttccctcgtcttcatcactttcctcaaatcccatcactctctttctttcgtttggtccctcaaaaactatataaaatcccaatttcccagctctattaaaaaaaccatatacgtacacacatacaaatactctctgattattttttgtatgtgtgtacgaaaacgcatagctctttgttgtctttgatcgagatttttgctgaatctatcttcgcagtgagatcgattttgttatttgatttcgtttactcgtcaatcggaagttcgatcggaaattgaatgcgtggatctgattacggtgattttacaaaaaccctttttgaacttttctcctcttttttttgttctctcgaattgtgattcatgtttgtggcactttgagctatgtattggatcgagcttaggtgtgtttctagatggtgtttgctttcgtatcggttttaagttatggtgggttctgtgttaggattgctttcgtgttgaaactgagtttctgggtagatcgcacttatgaactgttctattcgggagtaagtttatgtagaattgtggtatttagtacacgaggatactcatgggatctatgttggtttgctatattcagttaagatccttaagagattctctcgttgacttgagagtgagattggattatgagagtggaattctattgttcttgttgaaatgctgatggtttttcttatcgttaactcttattttccgcttcttgttttgtatttttggctgataatggatcattttatgcatccagtgagatgtttggtgttaaagcttagattgatcctttagaaaatatttgatgcagccatcgttgaagaggagaacgtttgaaatttcctctatttggcactgcactagttaggttgtgatgtggaaaaacaagttcaactagtttgtttcttcaatgtgtatctatgaattcattaaaatctccgccttctttgtttccattttttttatgaccatcgtagtttttaattaccattttcgtctctgtgaacgcagatcaaatgacctccagcttaagggctactggtaaatgaagtttgattctcaatattttggtctctaggatttccttcttttttcgactgttccgtttatgggataagtaggggctgatataactatagacattaaggaaattggcaatg

SEQ ID NO: 10203 - DNA, 3000 bp, Unknown
  misc_feature (1)..( 3000): cDNA_ID_3035561_gDNA_ID_2213635_Annot_ID_181019 3000 nt of promoter + ATG
ctgggataaagtattgggatctcccatgttccagaataagccattattaccttatgaagaatggaacatagacttctctgagctgactgttgggacacgtgtcggaattggttaggatctttagctcaatgttttcgaatttatgtgttcttaaaaaaattgttggccataagtttccttaagagaaacgtctagttatcttacttcacgatccttaccctcgtatttatctatcttcaaaagtttactttttttttttgaattagtaacccatctaaatcttcttcgttgatttttccttccaggatttttcggagaagtattccgtgggatctggaacgggacagacgttgctatcaaagtgttccttgagcaagaccttacagctgagaacatggaggatttctgcaatgagatatcaattcttaggtatgtctataggctttctctgttttattcaaaattggcaataacgtctttacttgtcttctgactttctttcctgccttctccttctgcgtccaaataaccactagccgacttagacatcccaatggtactaaactactcatctatctctatgaattttcactgtgagattttagtatatgttttcatcaatgcatgcatcttcgacttcttgtagttatactgttccttggagcatgcacaaagcctccacgattatcactgatcactgagtacatggaaatgggatctttgtattacttgctccacttgagtggacaaaaaaagaggttaagctggcggaggaagctaaagatgctgcgggacatttgcaggtaatttcatcttccatacaaaaccgtgtatccttctttccaacatagtatgtagtattaatatggaaaattttggtttgaggagaaggcaataacacttccaaataggacctggaattgtgtctcgatgagaaagtttcgtaatcatctttaattaacaaacagcgtttaaacttgtaaaatgttgctaggggattgatgtgtatacaccggatggggatagtacaccgtgatataaagagtgcaaactgtcttttgagcaacaaatggacagtcaagatctgtgattttgggctgtcgagaataatgacagggacaacaatgagagacacagtctctgcaggaactccagagtggatggctcctgaacttatccgcaatgagcccttctcagaaaagtgtgatatcttcagtttaggtgtaataatgtgggagctatgcactttaaccagaccttgggaaggagtaccgcctgaacgggtaacttaactgaacaagaagaagactctttagtgacatatgtgtatatataacaagtttcctcatatttcttctcaggttgtttatgctattgcttacgagggagctcggcttgagattcctgaaggaccactgggaaagcttattgcaggtcttgtgacttgtcaaagtgttgttatttcgtttttcctgaagctttgtttggggtttatggagtatccttttctgatgtgttgtctcttgttcgcagattgttggacagaaccggaacaaagaccgagttgcaatgagatactctctcgtttgctggattgtgagtattcgctttgctaactttctctcaatcatattttccttctgtgaatataaaactttgcagcgagagaggtttttgttttcttcgtttcttttttttgaatattgttggctttctcctttgagtttgtacaaaagaactttggcgctttcacatccacaaaaagctttgtggaactcttttccgtttaatcatttgcaaattcgtaaatttcaaaacctctgaaacaaaaaagtaagtcttataaattttacaaaaggtgagaagagttgctcattctttcagtttaaatgatcaagcttgctactctttttcgtaccataaggtttgttccctgctttgcatttgctataagaaaattacggacaaatacatgtacttttcgtttatatttcgtgccttaagaaatgaaaaggagctttgattgacaaagaaaaaagagcaaactacagtttttgcagaacttctagttatttaaagaaaaaacgattttatgttcgtagccgtaatttgtcattacctatttgacaacaacatacattctagtaccgagtttaaattcggtgatataacaacgatactagtagttcgcgttacccatttagcttatcacctaaacacacaaaacttagaataacttattctaatatagcaatgtgtcattaacttacaaaaatagatcgtttgatcatattctacttggcagtactatcattacattttacggaaactaaaccaaacatctaacgagccatatccgattttttaattagctttgatttttctctacaatctacagtttcagaaatttcaccatgctataaatttgtcaattacatactatttaggatgtgataccaattcatttggaaccgttatcatattctaattaagttagacaacaaaaaaaaaggaaaatatcaaccaaaacttacatattatattaccaacgattcacccaaaaaaaaaatatattaccaacgattcataatgaaatttaattagaactaccacacataatattactaattaactttagacttatcaaattgcatattaaaatgaatatttaaagcttttgtaagaaaaaaaaatatagagaaatattatcttgttcggtagtcaacattaacaaaataaaataaaaattaaaacgttttagctgttaaaaaataaaaaccaaattaacgatgtatataaattagctagagctggctcgtttagtctggctcacggtttagtacatgcacacaaagcaaaaacgctggtttgtctttttaaaaaaaaagaacttcgtttctcttcaattccgttaccgtcactgtcaccgttcacctccgtttatctcatcctcaccgttcatcttcttcgatctaactcgccgtcgttcaccttataatg

SEQ ID NO: 10204 - DNA, 3000 bp, Unknown
  misc_feature (1)..( 3000): cDNA_ID_2991065_gDNA_ID_2213635_Annot_ID_181017 3000 nt of promoter + ATG
atctgtatatggagaaaatgaaacctttagagttttgtctatctaatcacaagttcagagaaataggcttgtattttggaattgtacagaagataagctctcagtagcaaacaatccaaactttgatcagtcacattacttataaaacgatctttgtgtatggtaaaaaagattataagtttaaatcaacccgcagcttggaaatctccaaagtcatcatctggtgcatcttcaacccctccatctttggcttttaggtcttctttcttctcttcttcttcttcttctcgctttgtatctaaatcttgttgttcagacgatctttggaggctgaggcttggcggcagacttgacggggacttctgagcagttgtgacaggggaaagcggtcccggaggtggaggtggcaggatgattgaaggaatggtggtttctattgacttgcctttatcctccaacgagagattgcccagactcttctctaccgtttttgacttgctgtctttatcgcttctctgtttcaatcattttgatgtgaaaaacaaaaagaaaccttgtgggaaatgtatccagacaataactgtaaatcttacatttttgagttggagaacaatggtttctccttcctttaagctgtaatcaacggatgaagtgttctgatagtgttgttccatttcttctgctgttttcttcttgttcaaatacctttagcaaagagagagaaagagagggtggtcagattcaaacatgatttagtttttcgaaagaacacttagaaatctggaagtggaatgttacttcatatggtcatgtagtgctgcttggaaatcatatgcttctgttctttcccggaatccgagtccgataaaagcatgtcgaacacgaccatctgcattgcatcaaagaactaaactcaaataacaactacaagttaacatctctatatctatatggaaagtacgtacctatcttttcttcaacacggagaacaaaatatcttcaagacaaaacagattattttttgttagactagctgcacatcatgagaagagcaagttaagttatgtggtcaactttttgttacctgctactgtcgattactgcttctacaggatgaagttccccctctcttagaaatgcctgagcgtaaagttcccctgtggttttatctactagttttataatgcattcttctcctttgctcaccactttcaaagctccttcccatgcccatttgttcacgtcccactcatctgctctgcaaggataaaatttatacaaaaaaagtatcagctgatgtctatctccatcttccaatggattacttgatgcactttttcaagtatcttttaccaaagaagccaagttgagttgatacaaagcgaatgtaactagataatgaccatcttgatgcaaattaaggttaagctaccattcatagtcatacatacttcacgattggttcaataagattcgttccgagtttctgatcatttgctaagccgaagggtttatcgggaaaaggggttttgtaaaaatctcctaactacatatatcagaatgactgtttctatcataaaggtaagaaagaacctgtacgaagctgcggttttccttggaggtatctgcatacacaaacaaaaagacaatgaagaggttactttgcctagcatccccgtaaagtaacagacacagaagaaagcataaacgataaaataacattgatacatcaagctccaatgttgtccattacgaatgagaattttatagttaaacctaaataacaacagttcacaatgtctatgatttcatcaaggtagccaatttggaatctcatacatcctataacacaatgaccatgtaacaatttcacgagtatctcaaaagctagtatgatttcagagagaccccatcaagatatcacttagcatgatattggttaaaattaatgtactcttttatcacaagccttgaatctatcatacgaaatctccttgaaaagatttttcgctgatagttacatgtgcaatcgatcaccattgcaaatccaaacaaaatttcgagtgatcaagactcaacgtcaagttttcaacatatgcaaattaagacaacttcctcaataccattgcaagaaatctataacaccagattgaatttacgttataactaattatcagatccaaaacatctcctaaaatcaccaagtgaacttgcaaagaaaggatgtaacttgagcataaaagacacaaaactcatcaaaaattataaaatcacatctcatgataagccaagaaaagttaccaaataaacatagcattcaggcacttggaacagagcaatctctatagcttctctctcctcgttatcatcgacattcacaggatcagtggaagacttcttgtcttcctccatagtcgaagaagacgaagcttgatccatctcagaaacaaagaatttaacttggagaaaaacccagatgagactaatcgatcaaacaaacccgtaaatcttaaatgttaagtctttcccgaactgtgattacaacaatctcacgagtcgcgaagacgaagaaacgtagaggtttcgcgttaggtgtgtgtagtgtataccattacttcaatctgagctacttcaaaaccatcagatctaagctacctctgttaaatctgaaccgtctattacgttgactttgaaaccctgatatagactagacacctatgtatcctccaccgctgggaagtcaacattgaagcagttgatggaccaacaccaaccaatagaaagaacgtccacatttactttaatgggccttttaaactaataggcctaggcccattataaatacatggatttgttttattttatttttctcatatctgtctcttggtggtgatgagtaggtaaactgtgtgcgcttattaacttctctcacactgactctgcgaccctaatttgtgagctctcttctctttgcgcagtcaatttgctacaacttagaaa

SEQ ID NO: 10205 - DNA, 3000 bp, Unknown
  misc_feature (1)..( 3000): cDNA_ID_1022623_gDNA_ID_2213635_Annot_ID_181016 3000 nt of promoter + ATG
aaccgactctacattgcataaaccgaaaaatccaaagcaaaggtgggcacaccagatataaacatagacatacctgagccatcataagtgctacataaactccagcggtgaagggatacaatggacccaagtcaccagcaggtctggacttcctgacgcgttcacccaccttccacattcttgtctggtcaatatttcccatagggaatgctggcaagccttccttttcctgttataagtaagagaatccatcaaaactcctgcacaaactgtgtttgggtaattgtaacaaaaggaagattcggaagagtcattacatagaagcgacgaccggctaagacaacacttcggatttcgctgccactttgtacatcctcgtaacattcatagagaatctccatacaaggatagaaggatgcgctgtatgcagtctcaaaatcttttttaccttcttcagacaaggagttgtacacagccaacattccctgatgttcacaattcattagaaacaggttttaaatttttatatttggctaaaaacgaattagtctgttctctacagatatcttcctactaacctgggtagagatagtccttgaaattgttcctgtgatgcattctactgtgttcttgtaagccaagtcttcactcatcccattttcggtgtatcttctaaacagagactccacgattccgtgaacagcaccaagcaaaattccttttaacaaaaaagaagaagatatgtaagtatgggattgagtgatataaagacaggtctaaaaggggatcaaactcacctctttctccaaagatgtcactcctgtactcctgttcaagagtagtagcaaaagtaaacggagaaccaagtgctactgaccatcccaatgcaacatcggcggctctaccgtcaacatcctgccaacagaatagcagaaatagtggtgaaaaaatgaacacatgaggtataagagcttttcagtaaagatagcttttgcagtagagataaagagatagaaaacctggtggactgcaaaactggcgttgattccagcaccgttaatttcttttccttggacgtaaagcctcctcacagaaggacccattcccttagggcatacagcgaccacactgatgttctttgggaaatcgagtcccgaggactgtaaatgccctagtagaaacccgtgtgataaaccaagaatgctgtttggcttcatgtgagagaatattttctcatagttatcagcctgcaaaaacaggatagaataaaatcgatgtatacaccttaggactaatacctcaacaagtagtagtggaaatatataacaaaagtgcacttacttgagcagcatcagagatcaaaagcaatacaagatcactgccagcgatagtttcccatatatcacccaaagtaccactttcttcagtgaagccagcagcacgtgcctcctcaaatgagcgagacccttttctgagaccaatctacgtaatagtatattaaaacgaaaacaaagtcagaacagagccttcacgtaacaacagaaagcaaacaaatacaagtatgaagccaactctgcagttgaaataccttgacaacaatgtcagactttgcctccacaagtgaatcccttaaattctgagcctgggcaggtccctgcatatatagataaagcgtttattacaagagaagagatgctgaataaaaagaatatgaaacaatatattaatcttgttcattccaccaactcaaatgcatcaaaagtatgaaaatgaaaacactttattcatatcctttttctgaccaatttcgtatcacaacacagaaccaagattccttattcgcaatccaacgtaagcaatttaaaaagcaatcaaacaagaagcacagtagctacagataaagagaccaaaaaaggtaagtacctgagatccccagccaatcacaccaatctgcttaatccccttgaaagcatctgggagatgcttgaacaagtctcttcctcctctcacaatgtactaaaacaaagatcagcagaaaccaaacattagcaacaactaacaaaatcaatacacatcaaaatgattatagaataagcacaaattagaacagaaatgaataagagggtaaatgagataaacctcttcgtaaccagcaagagaaactttctcctttttgaagacagatgtctcaaaatcgagagaaacaggggctttgaccgcagacgaagaaaccatgcgagcggcaagggaggatccagtggcgccatttccagcgacggtggcagtaagcgacctcagagacttggaagaagacgagaggaaaccgatattgggtagagccaaggttctggctttggaagaccaaagggttttggatgaagaagaaggagatgggcatgaaagagaaggagcgatggatgaagtagccgccgccattttctaagttgtagcaaattgactgcgcaaagagaagagagctcacaaattagggtcgcagagtcagtgtgagagaagttaataagcgcacacagtttacctactcatcaccaccaagagacagatatgagaaaaataaaataaaacaaatccatgtatttataatgggcctaggcctattagtttaaaaggcccattaaagtaaatgtggacgttctttctattggttggtgttggtccatcaactgcttcaatgttgacttcccagcggtggaggatacataggtgtctagtctatatcagggtttcaaagtcaacgtaatagacggttcagatttaacagaggtagcttagatctgatggttttgaagtagctcagattgaagtaatggtatacactacacacacctaacgcgaaacctctacgtttcttcgtcttcgcgactcgtgagattgttgtaatcacagttcgggaaagacttaacatttaagatttacgggtttgtttgatcgattagtctcatctgggtttttctccaagttaaattctttgtttctgagatg

SEQ ID NO: 10206 - DNA, 3000 bp, Unknown
  misc_feature (1)..( 3000): cDNA_ID_1396596_gDNA_ID_2213635_Annot_ID_181012 3000 nt of promoter + ATG
ctagatttacccccaattttctccaaacccgaattttacaacctaaaatttatgaaattgaaatccaatgagtgggatagatttgttcgctacgactaaattaatttccaaagatggacaaagaccaaagaaaaatacttgggttctatattcactgttttagcccattaaaatttaaaacctaataataataataaaagtttaatttaattataaaatctaatttgcctcaaaaacaaaattatatatcgatttgagtttatttgaaaaaatcatggtttagattttacaattaaacaaggttaaatattgatttgggtttagaaaatacgattagggtttagattttatgattaaacgagattaaatatcggttttggtttagaaagtacgattaaggtttagattttatgattaaacgggttaaatattggtttagatttattaacaggtttagatttaacaattaaacaaggttaaatgtcggtttgggtttagaaaatacgattagggtttagtttttttacgactaaatgagtttaaatggcggtttggatttacaaagaagaattagggtttagattttgtaattaaacgaaattatatatcggtttggattataattatagcttcaatttattatgtaatttaaataggatttgacatgacatatttttattagttaatgcaaaaggaggtgaacaaagaggttcatccccctaggaatgaacgcaagtctcgttcaagaccaaatatggactcgtatttttattttattttattttccaaagggaaacaaaaagtctttaatactcttttttctatatacacatatattcacctatttataataaaaaagattgaaacttacggaaaatataatacagtacaaactatatatgtcaactaaactaaataacacttaattaaatgatgtatatagattgcataaccaagtatataatattatatagttaacattataaatataaaatttcatgttaaataaccaattaactctaacgtcaaccggtgttaaccaacaaaaatattcaaaaataaatttttactttatttttaatattaaaaatctagttttactagttattctataatcaaaaaacaatttttacatctactataaaaatattttgcatatatatttaatacattgattcttaaaatatttagctttttttaatttcaaaactaaactaaaaatgaaaaaaatgattaaaatttttaaaacaaaaaaaaaactgaaattaaaaccagaaaaatcttattagaaacatatgagtgaaagaatcttttttttgtattatcaattaaaatatataaacttctttattcattagaaaataaatcattacagaaccaaatacacatgactatataagtttcataagaaagtaatatgaaaaacaattgagtatataactttttagtctaaattttgcacggtaatttttaaattcaaagtaaatgttttttacgaataatataagaaaaaactaactattgattaaaaatatttagcaattaaaaatttaacttcttaagaaactaactattattattattattatgaatagttcatatcttaaaaaaatatttattctcttagtttagttttgaaattgaaaaaataaagtaaatattatatgaattaatgcattatatatatatacaaaatatatttatattggatataaatatatttttttgtattttacaatatcaaataacattaatttttttaatactaataattagttttgaatattttgttggtcaatgctgatcaacgctggagttggtcgaccatttaacccgagattatatgtttatgatgttgacgacttgtataatcatacaatccatatatgttaagtagttgtatgttttttagtttacttgcatttgtggccaattgttgagttagctgacaatatttttttgaaatatatgtatgatgtcaaaaatattttattttttacaaattttcattgtaatattcaaattaggtagagacagataatataataatatagatatttagaaaattatgattttcaatggaaatgaaagtacagactcatatttatgacatttgtttaaaataagttggtatgtaaatacttttgctggcaattaatatctaaatttgtcagtaattacttttgtccagaccacaataaatattcgtctctatccaatccttgctcttcgtgtttatcacgcgctatgttaatttatgacgacacacagttcacttcgttatagcaacgccggcacgcttttcgttgttggaaaacggcaaacaatctgaaaattaataaaataaaaaaacgagaaaggcttttggaaattaataaagttcatcgaaatacaaatatctcttcatcttttctcttttgctcatttcccagaaacctttgtttcatttgcttcgtgtgcgatcgcgagaacaagggaaaattagggtttatatcctcaagctttttcgaacaccattgatcgttgatctaagatttttcttctagtcgagtttcttaaggtctggcttcatatctctctgtgcatggtgtcgttaaatctatgcagcgatgtcctgttcgatttcattttgcttctagggtttaatgatttgtgcatttgttcgttttagggaacgattcttctcagctttgtgttacttcatcgtgattttgttttgttactacgagtcgtttctatttcttagattattcgattagctgaggttttttgaagattcttctacagataactacttctctcgaatcgatttgcatttgttcttcatttttagtatttggatttgttgactctttctctcatttcttacatgcatagctgcaacttatttatggaaaacgaacttgttcgaactgatatttattacgatatccaggggctttgatcaaactcaaaattgaagaccaatactttgaaggattctggtaaagctaagcaact

SEQ ID NO: 10207 - DNA, 3000 bp, Unknown; identical to SEQ ID NO: 10200
  misc_feature (1)..( 3000): cDNA_ID_3035492_gDNA_ID_2213635_Annot_ID_181011 3000 nt of promoter + ATG

SEQ ID NO: 10208 - DNA, 3000 bp, Unknown; identical to SEQ ID NO: 10206
  misc_feature (1)..( 3000): cDNA_ID_1396596_gDNA_ID_2213635_Annot_ID_132143 3000 nt of promoter + ATG

SEQ ID NO: 10209 - DNA, 3000 bp, Unknown
  misc_feature (1)..( 3000): cDNA_ID_2715082_gDNA_ID_2213635_Annot_ID_132144 3000 nt of promoter + ATG
acaagccatacttcaagctcaaaccgtgcaactgagttccagcacgaacatccaacgatgcacaggacaataaaccactcactgttgactggttcggcaaatatccaaaatacctcatctcagagaacacaccccaagctttatcaacatccccgtatttgctgtaccctttaatgatcgtgttgaaagacactttatttctctcaggcatttgatcaaacactttgcctgcaagtgatacctcgccaagcttctcataaagactgataatgttattgcagacataaactggctgcaaaagaacagagcataaagtgatggagagagcgtgaagagctttggtccttgcaaaggaaggagcttttctgcagacattgagtaagctaactacacgatcgttgtgattggcgagatctccacagctgaggctcatgcagaaggatactgaaaacagagtacttcccagatcgatctcagttataattaagaactaagtttcgtgcatcatgaagaaagttctaataaaggtctgaaattttaaaagttcggatttttataaacatcaagaacaaagtttgaagttcagaaccagggaactaaataattgatctagaccgcaccggctggttcaaccacagtatcacggttttatctgtccaattgaccaatctggcccatattattttacaaataagatctttcaaattggcccatatttaacaaaagaaaatcgaattaatattatggttttctaaatgaaccaaaatcaactcaactttttttttttgaataattttatttttattccataatttaatttgtttatcatttccaatgaaattttatcattaataaaaaaggttgctctcctcatcccttccatctttcctttcacattttttagattatacctcatgtttgaataatattggtttacatatctaattcatattgaaaaaccctccaaatctctagagaaaaaggacgataagagtacttaactcacaaagggcaaatacccaacttttgaatctccttacatattttatgacaaactatgaaggtgtcctccaaatactctttaatcatcttttgattatcatctataatgattgtttcttcagacctcatacccatatcttcgagcggttttagtatctttactgtctcgttaaatagattctcatttaccatttctaagcatttcttctcttctatcgttagatcaactttcaatttttgtatgtctttgacggcttccaacaaaactaacaacaacaaaaagaaaaatcaaatcaaaagatttcactataaagaacaaaaaataaacaaattgttagttaccatcatagaacaaataatattcagctgccacaacccttttgaaaagttgaatacgttctgtgcttttgctcatctcaacaattttgattaaaaaaaaaaatatctaatgcattctttgttacaaggtcgagatgttattttgtagcgtatatagtgtttgaggcttctttgtttggaaaagatcgctttcgaaaaataataattattattattttccatgttatgcttcatataaaatgtggactcaggcctccgaaataacaaatagaaaaaattgtgttgaatgcttaaaaacgagaaagaaatctctcaactttgatttactggacacgcattgtatttgttttctataattagttcaaaataataatttgtaaatagttatctaaattcggtaaaatacaaaccgataacttttcatatcaaatacaacaaaagttagatataaatcttaaatttctatactttaaaattgagtaaacctgaaaagaatgaaatttagtctacctaaatttattaaaaaccaacaaaattttcataattcgaaccttaattatttcaggtttgaaccgcttatatttatgaaaaccaaatgaactagctaaaacgaaaacaaaagcgaaaatgaacatgacaattttgacaatgttaaaatgtgattctttcattaatttgacaaattcaacaattcttaagaagatcaattgaattgataaactatgctgctcttcttgggtaattctcacattttaaaaaaaaaacaaaaaagaagaagaagttaattctaccttaatctgcaacaaatcgtcttcaagataattatatcacgaattgatatttcttgtctcttaatcttaacgaagaaactacacctcctggctcctactgaatgtgcgttgaacactcacctattgactcatcttcaccattccttctttcttcaatctatcatagatataaatacacttcttttaagtcaccaatcttgttttcgtaatggtacgagtcataaatcttgatttgtctttggtaagtcatgtttagttgtggattatttgtttttacgcattttctagattttaaaattttatctttatataaacaaaaataaaacgaaaaactttcaatctttgagcgccaaaaccaaaattttcatcgaaaaggaagatcaattaaaatattataaaatttcataataatgtcttcaaagcacaaaataatagttttagtattaaacccactcggggaaaaaaaacacataaaaaaaccaaaatcgatttcattgattttttccatattcacagcgaaagaatcgatccttaatacaaaattccttcaagatctcacatctcttataagctttctcgataccatcattttcctttctttttttcttttcttcgattctaatttggttctgccggatcttcaaccttgtctgaagaagacattttctagggtttctagagattggtcgggttttcggttcaagtaaatggtggatcagcctatcgtacgctccacttcattaggttatcaacgacaatattcatcatctaataatcatcatcaaggtcttgcttcgattctgaatctctgctgctgctgcttcgatagtgttcttcgacaatcaccaggtgttattgaaaagcaatg

SEQ ID NO: 10210 - DNA, 3000 bp, Unknown; identical to SEQ ID NO: 10205
  misc_feature (1)..( 3000): cDNA_ID_2715075_gDNA_ID_2213635_Annot_ID_132146 3000 nt of promoter + ATG

SEQ ID NO: 10211 - DNA, 3000 bp, Unknown; identical to SEQ ID NO: 10204
  misc_feature (1)..( 3000): cDNA_ID_2991065_gDNA_ID_2213635_Annot_ID_132147 3000 nt of promoter + ATG

SEQ ID NO: 10212 - DNA, 3000 bp, Unknown; identical to SEQ ID NO: 10202
  misc_feature (1)..( 3000): cDNA_ID_2715060_gDNA_ID_2213635_Annot_ID_132150 3000 nt of promoter + ATG

SEQ ID NO: 10213 - DNA, 1519 bp, Unknown; identical to SEQ ID NO: 10201
  misc_feature (1)..( 1519): cDNA_ID_2715056_gDNA_ID_2213635_Annot_ID_132151 3000 nt of promoter + ATG

SEQ ID NO: 10214 - DNA, 3000 bp, Unknown
  misc_feature (1)..( 3000): cDNA_ID_2715238_gDNA_ID_2213637_Annot_ID_132184 3000 nt of promoter + ATG
ttctttcaaaaaataaacaaaactcaagccaaaaaaatatatttatacctttttctttctttccttttcaacaaatcatcagcttttatgagaaagagagattgagattcaccttctttaatttttcgcgtgtgctttgatctgacttgaaggaaaaaaatttcagaccatcaatttgagaatctgtcctatctggctgatttagttacatgactcgttgaatgcttgaattggatttacagtttggttttcgttttatgtttttgctgtttgttgcaaaattaatctcattacttgctctttgattctttgtcttgcttttccaatttcatattcgagattattctcttgaattggagattaaagcctcgtagtggacttcgaatcgtttgatagtaatggtcgaatcactagttgatggaactcgttgcttagttcatgttctgtgaatttgattcatgattatatttgggttgtatcttttcagaaaatctggttattttatgtgttcatcataaacggtttataagttttttgatggttgattcacttagtgaagaaccttgttgctagttctcgttatgtgaaattgatagaggttttagcttagatctgaaattaattttcattcacatatgttagattgaattctacatttgtgtttaagatatagatgttaaaaatttggtgcaaaatcgagaagattatcttaacacagttaaatgaacagacctcagtggacaacaatttctggacaacgatttctggacacgttcttctttacctttttatctcaaaatccaatcgagaagatcatcttaacagagttaaatgaacaaacctatgtggacaacaacttctcgacacgttcttcccttgaatttgtgatcatttatgttatattttgagatgttttgtatataaaatcaaacttggacttgtattttaaaacttcaaaatcaaattgagaagatcatcttaacagagttaaatgaacagacctttgtggacaacactttctggacacgttcttctttaccgttttatctcaaaatccaatcaagaagatcatcttaacagagttaaatgaacatacctatgtggacaacgacttgtggacacgttcttcccttgaatttgtgatcatttatgttatattttgagtgtctatatacaagtgaactaatgtgttgaataagcaaaaaaaacagatgatttgttttgaccaacttgtgattcttgcatcaccaatgacattcttttcattaaaaaaacaattgatgaaagctctacacatgaaccatttgtgttccagtgtttgtcatatttctatgtcatgtttcaccattactccatatggtcaagtctaagtggacaatttatcatggactaaactatcattaactagttcggttttgtgtgttgctatttgaaagcaatgtctacagattgttcttgggttttggagacatctaagattattgggttctacagaaataattggtgttcaaagcttggatagtttgtctccatgataacgtgtccacgtaaacgtaaccatgtggaaataagtgattctcataagcaaaagaatatgcttttaaggttagacgttcaatgaaacatcaatttatcaagaaagaatcaaattgtaccaaacaaggcgatcaaatggatatgaaatttaatactggaatttgccaacttgggttttccataaactctcaaatgtttgattttgataaactcttaaatgtttgattttgcaaggaaagaaaaaaaagtaataatgagaagagagagagagagcgcgaaaagaagaagcgacgaagaagaaggaaaaaaaaggaacgtggagagatgaaactttttttttaattataattttttattttttaggggcaaattggtcaaaagtttaatgaaaaagttggaaaagtgcctcatccctgacaagtgtctcaaaaggaataaaattttctaaaagtgccttaacgtgtcacattccctttttttttctatttgtcccaattttctaacgcctgtatatatgaactagtggaatttcctgcttgatatataaagaagaattgtaagtacaaaaaaggttttcacaaacataagcagatgctatcagtcacaaaaacctaaccttatatgtactcttttttttttaaaaccttatatgtacttcttattatagtaaaataataaaatgtacggtattacttcaaatttgaaaaatgttgaaactcgttacataataaatgaaaagaataaaacgtcaacttaattatgttttatctttaaaattttccagccgtatttccctaaacttatttgcacttgcggattagcatttattttcattgaatattgtaagaaaaaaatctatgcaatatcttgacgtttttcatttttctttcgttttgataaatacatattttaatgattttgattttgattttaattttcatttaaaaaaaatcaaatgataagttacattttcccgattgaatgtcatttcaaaacaaaaaaaaaaaatcaaatgataacttctgtttaaaaattttaagatttttttttttgggtaggataaaatttttaagatattagctaatcaaataaaatattctacaaatctaagttaagccactaattaactaaatttgtacttcaatagaaatcgccaataattatgcataaaaatctgccaaaatcagatttctatgagatttcactgttacgatctacatcttatataaagttctttctttttttcgtcgacaagaaaattccacagtttcaaccccaaatttttatattttgaccccaaagaaaaagagaactcaacacaaaaaatatatatagaattttctccacttgtaaaagcggtatcgtatctcttgcccttaaagcaaagaacttgtctctccttctccattcactcctcttttggaacatcacaagcacacaatcctctccgtctctgtttcaatg

SEQ ID NO: 10215 - DNA, 3000 bp, Unknown
  misc_feature (1)..( 3000): cDNA_ID_2685858_gDNA_ID_2213637_Annot_ID_132186 3000 nt of promoter + ATG
aagatctccacttttacttgctcttctccactttttaacctcattccaactaggaagtaagatccatgtatctctttttaacccttaaaacattggaaacaagaattctcttacacatgtatcggtagttggaaatgccgacccaaaaggaccaaaactcaccattatctcaagtgatagagcttctcaagaaactactccaccatttccacaatctccttttgtatttcttcatcctctggatcggcgtgatagttggaatcattgtttatccctctctacaaggattatcttcgccttcttcgttaaccatccaaagtgtctcccaactcttctttgtaacccctcctcctcctattctttctccttcatttcaggacaatgggcttgacatgtttctgataccactgaagaacatcatgcacgatatggaagataatgaacttctgtggagagcttcaatggatcctaagatcagggattacccttatcctagaatcccgaaggttgctttcatgttcttgacttggggacctttacctttggctcctctatgggaaaggttctttcgaggtcatgaaggtcttttcactatctacgttcacaccaattcgtcttacgacgagttcatgccgcaagactctgtgttttatggccgccgtattccaagcaaggtcagcttcccaaattattaagaaatttatttcgatacattaataggtttggaattaacgtgataaataaaatttataaatatattataaataatatatatatatatatatatatatatataacggatcgaagtacatgaatacgatatttttcctatcttttttagtaaattacataaaaatataagaatatttggtatcttaaaagaaaacatattaattattacactataatacataaaataaaatcaatccaatgtcattaactataaacgtatgcagagagtggattggggaaacgcaaacatggtagaagcagaacgaaggttattagcaaacgctttattagacatcaacaacgaacgtttcattcttctctccgaatcatgcatccctctcttcaacttctccacagtttactctttcctcatcgactccactctaacccacgtcgactcctacgacctcacaatcggtcgcgtccgctatgaccgccgcatgtatcctcacatccgcatgcaccaatggcgaaaaggctctcagtggttcgagctagaccgagccatggccctcgaggtagtctctgatacgttctactggccaatctttaaagcttactctcgctgccccgacgagcactatatcccgacgctactcaacatgaggccgagccttgggttgcgtaacgcgaataggacgcttacttggactgactggagcaagcgtagggctcacccgagattgtttggtgagtgggaggttaatgtggagttcttggagtggctaaggatgaagagtgttggtgattgtaagaaaaatggagaaaataagatgagactttgctttctctttgctcgcaagttttcgtcgactgctttggatgagttactccggttagcatctatcgtcatgtatttctgatcactctcttcccccttcgtccaaaaacaaagatgcaatcggtttaactaccaaatcttctttaagtaagtgaaatatacagtgtgtgcttaacaagttactttcagtactagggatgtgagattaatcaaagtccttgataaagttaggaactagcctgtcatcaagttataaacagaagataacttgagaaacattgagaaaacacaaaagcctgaccccccaatctcatttggtttagtcctccattagcatttatgagaaggtatccattcatattagcacctaactctgcagacaatgtatactcatatggtaagaacttatagaagagaaaaataggaaaagaaaaaaaagaacaaattgctactaataggactaaaagttttgcctagacacctgaatactcaaagaagaataaagtcatgtcagatatttaatctccttctcccatcttcttaagcgagatagaaactaagccacaaatgtttaaccaaagaaacacttgaaaacactactaccaccaagaaatgtgaagaagatcttaattaagcagctcaatacacatccatttttgggcaacactcaaaacgcaatttatcaagttgtagaaacagaaacaaaggctaaaccacatataaacaagaccttctcaagccaaaagtcgtaaatgttcgacaagagaaacactattagtaacagaaatgtgaagattttatcttaatcaagcatgttctagtatgagaaacacctaaaaagatagcacaaaaagcaagaacctaatgagaagcaccaccaccaatggcaaaattttctatacaattgttgattttttccccatttacatattgattattccattttgctatatttagtttttttttttttttttttttattcattcaaattcaattttacatatatttatgtgacccaaaacataattccaattcattttctacaaaaattcaatttttgacttaccatatcacaaatgatattattaaaataatatcaataataatataatcactcttataataaaacttcgtaatggccacaaaaaaatcagtaattttcgatttccttaaaaagtcatcgaattaaatatgaaaaatcaacgagttagtttgtccaaaacgaataaaataaatttaatagtaccttttattttttcggaaacccttgtttcgttttttttcctcgatcttcttcttccccaatctctcttattttgtgagctttttagatcctcctttcttcatcgtttcttttccgaggtttcaaattcgttcaatttctcgattgaagatacctgaaatcgcgttattctaggtccgccgctgttggatctgcaaattccccttcgaatttgaacatttgtgatttcaaattcttcgagaag

SEQ ID NO: 10216 - DNA, 3000 bp, Unknown; identical to SEQ ID NO: 10215
  misc_feature (1)..( 3000): cDNA_ID_2685858_gDNA_ID_2213637_Annot_ID_181086 3000 nt of promoter + ATG

SEQ ID NO: 10217 - DNA, 3000 bp, Unknown; identical to SEQ ID NO: 10214
  misc_feature (1)..( 3000): cDNA_ID_2715238_gDNA_ID_2213637_Annot_ID_181083 3000 nt of promoter + ATG

SEQ ID NO: 10218 - DNA, 3000 bp, Unknown
  misc_feature (1)..( 3000): cDNA_ID_2714191_gDNA_ID_2213638_Annot_ID_132188 3000 nt of promoter + ATG
gttactgtttacagatatgtatcacgactagcacatcagctggattggatcagattctaccatggatgttctaccataaggttctaggcgtctcaacattcttccttttcgttgaagggaaagctgctactccgagtatttctaaagtgctcgagtctattcctgtgagttgaactacctctcttcgcgtccactgtttattttgttttggctgtatatctctagctctttagtcctgtaggtataaatttgtatttaaggtatgcagttttcgataaatgtagtcccatgtctcttgcagggtgttaaagtaatatacaggacgaaagagcttgaggagaagcaagcgaagaggttagttagttatcccattgcatatttgcgacaaagctatagctcttcaaggcactaaacacatgttttgttgtatattctgaaattgtagcattgttttgttgtattttctactactgatcattttactgtcattcttttttgttttgtttcatcagccggatttggaatgagacctggctttcgtctttcttttataagccctgcaattatgagttatttgtcaaacaatctctcaacatggaaatggctattgtcatggctagggtaagtatttcttttagaccttatttggttcagttttgactcatgtctcatgttacattctcatttttcttgttcttactaaatatcaggatgcgggcatggattggatacttcatcttgacactgatgagctgatatacccagcaggtgctcgtgagtactcactaagacggttgctgcttgatgttcctccaaatgtggatatggttatatttccaaattacgtgagtgatatctcattcacacttcttgcattgcttattttcagctagttttgtgagtctaaagtttcttttatgatctggcctttgctatgaataatgcttttggattttgttgtttaggaaagcagcgtagaaagagatgatatcaaggatccttttacagaggtataattcagtttattactgtctttacgtaagagagtaggtttattaatatttgtttgttatgttagtattacttctgagatatgtgtggtgcaagcaggtgtcaatgttcaagaagaattatgatcatcttccaaaagatacatattttggaatgtacaaagaagcaacacgaaataatccaaattactttttgacttatggtaacggcaaatcagttgctcgggttcaagatcaccttcgtccaaatggagcacacagatggcataattacatgaaaactcccaagtatgtctatcatatattcaaacataactaaattttctattggttgaggaacatgataggactttgttgttactctaatatagaaccatgtaactatcttaaaggagttagcagtggagtggagttccggttaacagcgtagttaattttttctgtttgtgaagccaatttttttttggaaatactaacctgatgattcttgctagtgagatcaaattggaggaggctgctgtcctacactacacatattcaaaattttctgacttaacatccaggcgtgatcgatgtggctgtaagcctacaaaagaagacgtgaaaagatgctttatgttggactttgacagatctgtgagcatcttttcttaaaatctctaaaagtccttagtcatttcttaaaatctctatatttcacttcctcttacccttttatgatgctgtatggatcaacattgtaggcatttataattgcgtcaacagcaactgacgaagaaatgctaagctggtaagagccttagcatcgttcttggttacttgtgaaatagataacttctgacactctttgaacaagtttggtcctattgtgattacaaaaatatctggtcttgatcaaaaagtaatctaccctgtgtaggtaccgtgaacacgttgtgtggggtgacaaagacgtgaagacgaaactccttaggaagggtattctgactcgcatctattcaccaatggtaagaacatactctgcaattcattatacaaaattccaaacacaagtcctggaatgttgagttcttgcaagtcaattgtaaaatattatatacatttgtggtaaaatgcaggttgttatacaagcattgaaagaatctggtgtcttcagctcggttgtctcatcagcttctacaaatctgtcaaagaaaaagttcttatcatcaattcacaaaagcaactcatccaggtctactgcatctgagtcccttccatcaaaggaaagcaagtctgagggcatctctgcaaggcaccttcttgaggctgaatcagccatccctcctttatcgccacctgggatggaacaagctagattttttacagaggattaacaggttttagcacggagctgatgcattcgcttttactgatattgatactggttgcaatatgagtgctgtgtagctttaggatggcaaatgaagtggaacaaagaagagtgaagaaagcggctttgtgtgattcttcctaatcatattgaaaagtcatcgattctcttgtctcattttgctctccctctgcaacttatgatagatgagtttgcagcatttttctgttgtcattgttacttctatgtaagtttattactatgtacagaacttcaaagcacagagccttggactcatttttctacttacatcgatcgccttataactacaccactactgtcatggcctcttcatgggcaagagtaataccaaccttattaattcaagtttaatacaaatcgattaacatgcacctaaccggtaatgactcaacacgtatgttatcatgaggatgacacaatctaggattccaaaaaaaggtatgaagaaagagtcaatggtccataaacgaagatttggcaccaaaaagcggagactcctcaagttatatataaaaagcagagtaagaaggaggttttgatgtgatgattgttgtctgagagagagagaagaagaag

SEQ ID NO: 10219 - DNA, 3000 bp, Unknown
  misc_feature (1)..( 3000): cDNA_ID_2704713_gDNA_ID_2213638_Annot_ID_132190 3000 nt of promoter + ATG
acgttatgcaggaatgctccaatatgatggagagcttaagcttcctagccgctatcttgtttctccaccattgattgacagaacttctggtgaatatctggcacacaatggcgttcgtacttttgcttgcaggttaacttttagaatctctcaaatctttagttattgtctttgccattttcttctattgctgcttcctggtttatttatttgctggaattggattcataattgaaactgtgataagagtaatccagtcttctttacttgctcggtagaggtctaatttatgattgggggttgtttgttgattaaaactagtgaaatctcctagctcactttttcttgatgagattataccgttgatggttagttacatataatgaatgaattctcagctattaacctattaaaattttatttcactgaaacagtgagactgtgaagtttggccatgtaaccttcttctggaatggcaaccgctctggatatttcaatgaaaagttagaagagtacgttgagattccaagtgatagtggaatatcattcaatgtccagccaaagatgaaagcactggaaattgccgagaaagcaagggatgctatccttagtggcaagtttgaccaggtaaggtgtattctcttatcacattgtatcaacccattaaaacaattggcttctgagtttggtgccaatggattttcaggtgcgtgtaaacctgccaaatggagatatggtggggcatactggtgatattgaagcaactgttgttgcctgtgaagctgctgatcgtgctgtgagggtatgatttcaataaatttgtgacatgggaatgttagaaaccgttcttagtagcaatgactcacttagttttggtgtcctggtttgcagacaatccttgatgccatagaacaggtcggagggatatacgttgtgactgcagatcacggaaatgctgaggacatggttaaaagggacaaatccggcaagcctgctctcgataaggaagggaaccttcagattcttacctctcacacccttaaaccagtaagttctagcactactaaaacagttcgtgttatgaccattgcaactgagcatagattaagcatgaggggttgtaataccagaagtggttggtgtatcttatatgaaatttggacatgatgtgtgtgtgcaggtgccaattgccataggaggtcctggcttgtcagcaggagttaggtttagacaggatatcgagacacctgggcttgcaaatgtagctgcgacagtgatgaacctccatggatttgtggccccgagtgactatgagacaagtctgatcgaagtcgtcgagaagtgatgattcttgttgttgtagttctttttaaaagtcccacctgagcctctatagactctgattctcttttaagttactattttcaccgctctctaataaggctcgtgattttttgggagccatactgtatactcgccggccctctcacgatgttgttcaattcacagactaaatttgatttatctatttcgccaaaacataacttcattaaaaaatgttctccaaataactaaacgaattaaataaaagaaacctttcatgtaaagttaaaggtatgagactttaagggcagttgctgaacattcgtaacacatgggagaacaatagagaaagttgaaaagaaacgtagcatatagaaaaattatctttgtaaccaagttgatttagaaaaatatcactatttgtgaaaaatactagatcagtttattattactttttttttttttgtatattcacaaatatcatattcatatagaagaaaataaacaaagttgtaaaaatctggcatttaaaataaaattgaacacttcaatttatttcctttcataataataattttggcataagatatttgcaaattgatctggttcggtatggtcgacaaaataattttccacgctacccttccagccgtccattcactatttgccctcaacgttaccaaataacggtccagattcctagggcaagatctaacggttagcaagtaaagtcgtaccatcagaaagaataacaattctttcacaaagtaaacataaccaacggttaacaagttcttagggttaaatcagtaagatccaacggatattaaattgcaaggcccaaatagtttttttgcagcagataataactcgtccccactggcgagtgacgaccgagactctgtgaccctatttttcgagacgataaaagggcaaacaatcgctcttttcaaagctcgcctcttcaccacagagaaaacttcgtctctcttctctgcttcgccctctcatttcctgtgagataaaggcggagtctctctccagttattttgctcatccatcgattcttaggtatgactcgtttctctcagatctgtgattctttataatctcgtcgttcttcaaatcattgttatattcgtttcttcgatctgtgttttttagatctgtaaggtaaatgagacgtttcgatctgtagatctgattgttatattgatagattatgttatctgctttgcttaaagtccgatcggaatgttttgtgctcattgtcgaatatctgatgtatcggtttcatagatctgcttctttttgtgcgtttcgttgatctgataatcttctagtgatcaaaatcgtttggatctgttgactttagtttaaaatgtatccgatctgatgtcgaggcttcattattggaagttgttattgttgtaatcctgatttaagttgctgttcttaaatttatatgatctttgcgttataatatgacatggtagatcttggttcatggttcactgttttccaataaacttggtttgtttggttggatagcgttctgtgatacgaccatgtcttgtgttggataagaattctctgaatttccttggctggtttgtagtatgttattcacgtctggtttctcatcaatgattatgtgattttgcagagttcaaaatg

SEQ ID NO: 10220 - DNA, 3000 bp, Unknown
  misc_feature (1)..( 3000): cDNA_ID_2714183_gDNA_ID_2213638_Annot_ID_132191 3000 nt of promoter + ATG
agatgtaaacataaacgttgtaacattgccaagtgcaaatcatcttctacatatcctaccggattctaacctctttggttccaaaatctattggttcatcggtgatcttctaatataaatgtgagggtcaacaagttgcatgaagcagatagctgcaaaaaatgttaaaactcaacaaatctcaagaacacactagttccttttgaagaatgctaagctcaatgtaacaaagttgagtatggatgataggatgatatacatcttcttcaactgtctgcttctcagacaaaaagatgttgaaattattacaaaaagggcaaagctttacagcaaaagtagttagaagaaaacaaagtgagtgcactccagaaacaatccaactcttttcattctcatggagagaccaccaaagtttgttaatttgagagcacaagaagaaaacaatattacttatttccttatcaccagcagagaaacaagatgaatgtggaagtatcaacttgcttaccacaaagaaaaaataatcagaaaaagaaacactttaccaaaagaagaataattgtagaagaaaaaaagaaaaagacagtaacagatgatcaagaagatgtgatgatgatgatgatgtacacaaaagtatcctaagctgcgtattcggtttcaagcattggttgtgtacgagtcgtagtagcagttggtgctcttgtttcaccaacctgagtcatcctcagagcttcccctgtctctccagctctctccatctccctcattttctcttgcttcttgtaatttcgacatctcaaaaccagaaacagtaaaagccccaacagtatcaatccaccaaccaccgacccaacaatgatccaagtcttggaattggaatcagagctcttcttcttcttcttactctcaatcccaggaggagctagactcggagcagaagccacagatttcaccaccacagagaaatgtccctgatgctcagtctcgcatgtgtttccaggctgaatcgaatcgctgaaactcgcttcacctttagaatcgaatctaacacacttagcactagacccttgcgggattcgttccagatcagagaaatcgattctgataggatcattagacacccttaaatcaagctgaggcaaattaagcgcagagagattcttagcatcgtaagcgagaagacccaagacaggagcgacataatcataaccagacaaagggtaatacaagtgagagaaattagctaggttttgataaaccaaaacaagccttgtcacatacggcttgacgataacgccgctgggaattgagaactcattaaaaggagtgactccacgttttctaaagcttccgcttctgagtctcatagcagcgagtttgatcccagtcaaattggaaggaacagtagtagcctcgtagagaatgccggtacgaggacgaagcaaggctctaaaagagtaatcttgaagaagagcatcgagtgaagaagaagaagaagcattgggtgaagaagattgagcagagagcttttgtagacgaagagatagaaacagaagcagcagcagctggagacaacggagaaaccccattgcttttttttgtttctttcgcctctggagcaaaaaaaaatccccccagggcgagtcaaaggtgggagacacaggaataaaaagtcgccgtcacgtctgagtagaaaaagggtaaaaaggggaaatggtgaagagaagaacaaatcgaggaatgagggttaaggagcaatggaggaagctgaggaggaggaggaggaggaggaggagagagaatgaatggtcgccggtggaaaagagagagagagagaaaggagagaaggagagagccaaaaggacaaaaaggagaagaagagtgttgtcgtcagtcccatttgttcacaaaaaaaaaaatgatacagcctgttcatctgattttttctccctttacacattaacaaaaatttaatattttgtttgttttttttactttccttttcgaccaatcatattgatacattgcggcattcaatttcgccgtaacagttgtccgtctacctcttattgtgttatctgtatctctctctgtatatttcccatatatgtatactgtatgattcttttctacttttgtttttgtctttccttatccttggcccatttatctgactatgaaccacgtctcatctagtttcaggctttttaagcccaatatataggaactcaactttttgtctttggcccattagaaattgttttttagccttctaccaaccttttgaaggttcccagttaatattatgatgatattgaataaataaatgtgcacaaccctgaatttcttacatgagttttcggtttggttttcgtgtaatttcagtttgatttaatgcaatctcaaggtttaaataatgatttagataaaaaaaagttactgtcaacagaaattaatgtaatcccagttactaaaacttacccatttttgatcaaattctggttcaaataccgtataaactattaagttaactccggtttgaccttttctgtatgctattttttacgttgaccaaaataaaaaggtatatacaattttttttacatggcgcacaccatgactattacaaacggcatgatccagaacattcgttcatagcagctaaaactagaacattcgtctccttccatttttttgggggcttcacaatgtttacttgagcccaaagtaaagcccattaaattggtaccacgtcatcgctaacttttccatttctatgtttctataaaagtctcatattatgtcagtgatagctctcaacctaccatacttcaccacataaccacttctgtctctgcgaatctccataagactctttgagaagctttcctctgtttctccgctggtaagcttccgttatctctctctctctcgcttctcagatctgttccttaaacctttaatttctcaccgacgagtggatctgaatccacagttatg

SEQ ID NO: 10221 - DNA, 3000 bp, Unknown
  misc_feature (1)..( 3000): cDNA_ID_2994592_gDNA_ID_2213638_Annot_ID_132193 3000 nt of promoter + ATG
attatttcttgggcctgccgcagctttatatccacaatatcaattggaagatcagcctcaatgaggatatgcaactgctcattgagatgctcatagccaggcttccctttcagtttctcttcctagcaacaaacatatcaatgcaaaatatgagcatagtttggtaaaaagatggttggaaacagaaaaaaatgtaaacatgtcttactttttcaggatccttaattgatcctttccctctaatatacacacggcaacccgtagttgcttccacacgctttaatgaattccctctaggacccagaagccttccaacaaaattgaactaacaaccaaaagcagaagaatggttaattcacctgaacttcattgtcgcaaagaaaacaatacagcgaaacttacattcggataggtatcaactggaagatctaaacgcaaaatacgcttcactgggtatgaacttgggctagctggcgcaccttgccactccattgccattccatgaggaccaccaattctctacgagaaataaaaaggctacatttttattacagttctgaaatgagtaaaatggcaatgaaacatcatctcctagaagaagggcttaaagggtatctctacaagagataaaaaggttctagttgaagctctagatagattttctatgaggaattacctaaacagtcgagacttcttatcgggtatacaaagaccgaaacttctaactcttgaacatgcaacgatctataggctacagatggcaccacatattcaaacaaggagatggagagctaaactcataccttatattccttgcactaggaatattaggctgctccaagaaaagaatacatgagccatccataaatattttcatgtgcaagtgggtttcaaccacaatattctgttaagaaactttctatgttctattaagataatcagggatgaaaaggtagcttcttcaacaaagacatgaagaaaaaagctctaacgaaacacagtttgtaagcaaaatggctacctctggtggaagaccattccaaccacctaatccaccaccggaaacattagacataagatttggtgaagccattggactaggacttcgatgccgtaacctatcaaaatcggtaaatccttggttgggcatcattccggtgatccggaaaatttctgcacaataaaaagaaaacaaagaagagaatgtcaatgataccaatcaatatagctaacaaatctggaagctttgctaccaaaccacatacgccatcaaagcatagccacaaaaagccccaaccaatcttcattaactgaccacggagacgatactatcattaactgaactaatcaactaacaagactcaaaagcatcaaaagcatgaagaattaagagctaataaagtactctgagattaaatatgactatatgagcgaagatccaattatgtgattcagacaatgagtattaggacaagtcatcaaagagagaaatgctgcataatcaagacaaatatacaggaaacatcaacttcaccaaaaaaaattcagatctaagaaggaagaaatgagaagagtgggaccttgatttaagagtcggctacaaatgggtaagacttgcatgaaaggtccaagcttttgatgctctgctaacaactgagatatgtattgactgcagaaaacgagcaaaaaacaaagagataagagatttcatcaaagaagccattagagagggaggataagtcgaaagagaaacacctgtcaacatcggaggaaggggttctaatctgaggagaagcggctctagaaggtgagaagttattataattatacagaccagacatggtgggttctgttttgcagctatcagatattgaaaggaaaataagaaaaaggaagaagaagagattttggcggatagggagtgaggagaggaagggtgttgttgttgccgaggaagaaaaggaagagaagcaaacagagtcgtcacagtagcatttcgactcaaggagggttttttgtgtgtataaataagagaacaggaaaaaaaagaaaatgaaaagagaaacttttttttttaacaaaaaagagaaacttaccgaagactatattcggattttgtcaaaacatcttttgaattcttatctttaccatgattgtcattcaaccctatgttctttgctatcattttatcagttaaagtctttagtgtttagtagaatgctagggtaaatatgagacttatcatttaacctttttactcccttttaattactttaaaaaaaaaatctaacctttaagtatcttttttagcaactaaaaccctacatttcctttttgcgtttttatggccgtaacttccggttcacggtgttactttatcgtactaaatataagttttaacgtctgatatatataaatcgtgtcaaacaagaaaatatatcattaataaacagagattttaatttgtaacgtgtcaatctgatataactgtccgtagattttctttatttactaatttatttgtgtatctcgtgtcttaaatatccgtagattctcgtttacttgcttagtttgacatatttcatttcttactcggtactcgccttttaatcgatcgtgtttaatatcttctataagaaaacattacttccaagtgtatactgtcttcatcatccagcttcatacggttgtgggataaaatttgattactagggaaagcttacatgtactaacttggggtcataagtcataacactagtactaccaagtaggttatctagttattaccaccgtccgtgaccatgtatccatccaatccatgaaaaagtcaaaaacatttcatttggatgtattgggctttgagatttacgtttcattaaaaatgaagcccaaaagcccattattatccaattgactagagtggtctctgatcccaaatctttaacttggatcttaacacagagaagaagcacaatcggaagaaaggagaagacgaagatg

SEQ ID NO: 10222 - DNA, 3000 bp, Unknown
  misc_feature (1)..( 3000): cDNA_ID_2704737_gDNA_ID_2213638_Annot_ID_132194 3000 nt of promoter + ATG
tgaagtaaaatgtataaatgcggtattaattgtgtttcaaggacacacaaataattgccagtttttgtcaaaaggaaactatagttgtagaatattcgtctcttttcttctttttctgttatctgttctattagaaagctaaagaaatacatcaaagtcaggtctcaacggtaaaatgaaaacaagcttctttttcactaaagagtaaaagagattcctctcaacattggtctttcatatttttcctagctcatattctggtgtggttgatcgaatcttaatgaaccggagaaaataaaagatttgattatgtaatttatcataatcaagagcttgtttgtgaacacatgaaaaagtaaaggaaagaagaagaactctctctgcctgaggagttgtaatttttggcagaagctggtgtcgttttaaagagaaattagaagtgaatctatgtagttgtgttggttggtaagatcgatttagttacattaaataaaaaatattcctttgagcaaaaacaattaaaaaagataggtttcgtcacaaggtggaccatttcgaagaagaattaagagacgagcccacttgaaagagacatagcgaggggaccccatgtgaatctgcaagcagagacagaggctttgaccgttctcattcatcaaccatcctccattattagccagagtcataaaccatgtgattcatcatcacaaggcttcattggactctctcatgcatattcacaatctccacttccatcttatacaattccagttcctacccgcaacaaatccaacacctgaagatgatactgatgcttttgaaagtataactaggaatgagagaagtactaggatgagccatctttccagatattcatttattcactcacacagcaagagagtagttcagtgtatcatgcaacttaaaagcatacaaaatatcacgaatagagaaatattgataaaccaaatgttattgaggtctgatttctgaaagctttaatatgtccaaggaaaatcaaatgggaatgaaagtactagatcccccagcttcttcttcttctggaatgcactttatttgtcaccacaagtggtcaccttaagcccctacatcacatcaccatattactctcagagttaacatcgcaagccagaggagaagaaaagaaagtagtgagaggatttcgcatgcagagaagaaagaacatcactgtcctagagcttcacattacaaaaaataaaaacagctccaaaagattatcaataaaccaaccataaccaggacctcaatcattcctagacagggcaaaaacaaataaaacaaaccaccatccagaagcttccagtggtaaaacaaaaactaagcagaagtgcctaggataatttatcgagtacccaaaactcaggatatgattcatttctctacacagaatagcaaccaaaccaggaaccctgaagcctcaaactgacagagaagagaactaagtagtaacaaatctgcttgttgcttaagaatacttatacactagctatatccacagggcctctcttataaagctctgaaagcatatccattttcaaatttcaagaaccaaaaacacaaatgatcacacatttgaacctttaccggcacactaattagcttatgaaacaacaaaaccaatatactgatttgcatatgaaatttgactcgtgggagcaacaaaagaaggtgtctttgggggattttccaatatacaagcagtatcatggctatcgaagaggactaaactaagaaagagctcagagaaagcggaacgaataattaaggagagaatgagcacacacctgaggaacacaaaagagataaagcgaatcatgaggaaggagctgcagctttctcgacgactttcttgtcgcgtctttccatagcaacatcccattcatcgtggccgatgtgcttaggctgcccaatcacaaattcaaatcaaatcatcaaccaaatgttcaatagagtacccaaatttgtataaaccggatcaaatcgagcaaaccctaggagagagagagagcaatgaatcgaaaaggggggaaattcatacacggccatgataagctttgtggatgtagtactgagaattgcccatgatacagagcatcccaccgatgattccgagaggcaacatcgcttccaaccataccaacgacatcttcgtcttctcctttcttccgattgtgcttcttctctgtgttaagatccaagttaaagatttgggatcagagaccactctagtcaattggataataatgggcttttgggcttcatttttaatgaaacgtaaatctcaaagcccaatacatccaaatgaaatgtttttgactttttcatggattggatggatacatggtcacggacggtggtaataactagataacctacttggtagtactagtgttatgacttatgaccccaagttagtacatgtaagctttccctagtaatcaaattttatcccacaaccgtatgaagctggatgatgaagacagtatacacttggaagtaatgttttcttatagaagatattaaacacgatcgattaaaaggcgagtaccgagtaagaaatgaaatatgtcaaactaagcaagtaaacgagaatctacggatatttaagacacgagatacacaaataaattagtaaataaagaaaatctacggacagttatatcagattgacacgttacaaattaaaatctctgtttattaatgatatattttcttgtttgacacgatttatatatatcagacgttaaaacttatatttagtacgataaagtaacaccgtgaaccggaagttacggccataaaaacgcaaaaaggaaatgtagggttttagttgctaaaaaagatacttaaaggttagattttttttttaaagtaattaaaagggagtaaaaaggttaaatgataagtctcatatttaccctagcattctactaaacactaaagactttaactgataaa

SEQ ID NO: 10223 - DNA, 3000 bp, Unknown
  misc_feature (1)..( 3000): cDNA_ID_2704729_gDNA_ID_2213638_Annot_ID_132198 3000 nt of promoter + ATG
aaaactacacatcaaccttggctcatgaacatgtatatgaatgaaaagcaagagaggctacaataagaacataccaaaacaaacacagcgatgcgcattaagtgattaaataaactttagagatctctcccaaaagtatatactttaactttgtcctttgctatttgtttgttcatcttttatttggtgggttttgatatgacatcgacttcatttctcagttctcaatccattttattttaactaaaaatgggttaaagtcttgcttgaacaagtttggacaaacttcaaccaaactatgtatagtgttttattgtatttatggtttaacgtgttgttgctttaaatttgttattagatcataacccgtgctatacagtacgggcattaatattttgaataaattaaattgtatactttgttatgtttgctatgtttgtcaaaattaattgttatatttgtcaaactttagtaaaatatattcaaatataattaaatttattaaaacttaataaatttaaaagttttttttgtttggagacgcactatctacatacaaaatacccgtttctattttttgagtatttttagggcctgaaactttttatccaaactgacctaaacccaactggacgcgacccgaaccgaatatttagaattattctattaggtagtaaatcatatacccattaatcccaaacccgaacgggttctacccgaactcgaatggattactcatatgcccagccctattctctgatttaattatctaaaaaatcccaataaaacatatgttttggtgactactttttattcaaaaaaatttacatcctcttctgccaaaatcatttcataagacatcccaaaacccttggaataatgattccatgaatgaagaattcttatcccaaaacccttggaataatgatttcatgaatgaagaatcctaatttgaatataccagaggttttgaaaggttttaagtttttgataggtgtgtatctgagaaggtacatccatcgtgatggtaatctgcttatttataattttaacttgcattatacagcaggtagtcttatattttagttaaactaaaaacttttattgtaaagttgattataaatatatgatattattttatttgattttaaatgtatagtaaactgcgagttgtatatgttttgttgatattatttatattgtttagtgtttaaaatgatatacttgtattttgattgttaattttagagtttcacatgtagtatatcatcttgtattaatattgatttaaacccgtcaattataggatttttcagcttgtattaaaaattgaatcacatcatacacattaaaaaatctaatatgttattaattattatagtatataagattataaattttaaaataatatgtatgaaattgaatataaatattcaaattatgacacaatactcagtaaagttttttcttaaatctacttttgacccgttatagtatttttcatgtattgaacaatttatatttgtttttaaaaattcaaattgtggcatatgcgaaaaaactctaattatttttttataacgatgatattattttttcgcaaaaatagaatcatataaagatgagaggtgaattataataattattaaaaaattaatatgataatttaggtatcaaatctaatttgttgattataattggttacttttttggaaattaataatgtatttcgtttttgagttaaatttaattaattaaattagtatttgattttttaatttttaaagaaatgaattaatttactttttaaaattttatttctaatggcatacctatgtaattacttacaaaaaataaggttacattttaaaaattaatatgataatttagatatcaaatctaatttgttgattttaattggttagttttttggaaattaataatgtatttcgtttttgagttaaatttaattaattaaattagtatttgactatttaatttttaaagaaatgaattaatttactctttaaaatttaatttctaatggcatacctatataattatttacaaaaaataagattatatttaaaatgtatttccgaaataatatagtaggataataaaaatggagatgcagtgaagggaatgtgtacgttcccaagatacaaaaatagtggagtctttatggagttccgtgccacatcctgttttttttttctcacgtgccctgaatcatatgtgtcatgattttggtttttggacgtagttgaaaatgcatcaagcatcaagaccactagcatgtgaaacgagacggtccggtctagagctgagcactgagtccaaaaagaccgagtgtccgaccaatatgtagtttgaaattggtcctggtttaaatgagtttcgactaggaatgaacccgcttaaaaaatttgtaacacatggataaataaaaaagtttttgaaaagttgagaacaaatttttttttttacctttatacagctagtaatccgataggattatatatagagtgatgagagatttgtgatatttttacgattgttcaacttaataaaactaacatatatatatatatatatatatatatatatatatatatatatatatatatatattcacgtttccttaaaacaatagtagtttttatgggtttattaggaacagaatcaattagtttattttttacatccgatttaggaaagtaaatacactaaatagttttcaaaaaataaagatgacaaaaatataagggcagaaaatattaccgccgtaacataatgctttttgaataaagcttctcctcttgagcactcgagaatctttattctccgttactttcttatttctcaagaatgcattagcgtctttgtctgcacacaaagcaaaagcagagagatagggattggtctgtaattcccaagactctattttcagtactatcgattctcccggcgatctggtgagtgagatagagattcacg

SEQ ID NO: 10224 - DNA, 3000 bp, Unknown
  misc_feature (1)..( 3000): cDNA_ID_2714172_gDNA_ID_2213638_Annot_ID_132199 3000 nt of promoter + ATG
ctcctcttgagcactcgagaatctttattctccgttactttcttatttctcaagaatgcattagcgtctttgtctgcacacaaagcaaaagcagagagatagggattggtctgtaattcccaagactctattttcagtactatcgattctcccggcgatctggtgagtgagatagagattcacgatgggctcagacagcactttgtctctcccttcttcatctcctccttgtaacaatcgctcctctgttcctccaactttcaccactcggtctgtcttctttctctatctctcccccgagttctgtattaatctctgttaagcttatctgtattcacttgttattatgaatgtaatggtttgagttttgtttttatgaaaattacagcatattctctgatgttgcgggtgacatcattgttgttgtcgatggagaatcatttctacttcacaaggttagtgcacacttttctggtttgagtttttttttttttttctttacagtttttagatcaaacgcatcagagaataataataaacattgcagtttccgttagtagctaggagtggaaagatgaggaagatggtgagagatctcaaggactcttcttctatgattgagcttagagatttccctggtggaccttcgacgtttgaactcaccatgaaattttgctacggcattaatttcgatatcactgcctttaacgtggtctctctccgttgcgctgctggttatcttgagatgactgaggactacaaagaacagaacttgatctttcgagccgagaattacctcgaccagatcgtttttcgcagttttcatgaatctgtcctagtactttgctcctgcgagacgcaagagattgctgaaacatatgaaattcctgaccggtgcgtggaggccatcgccatgaatgcttgcagaaagcagttagtatcaggtttatcagaggagctcaaggggagagattgtctcgagatgtggactgaagaactctctgctctcgggattgattactacgtccaagttgtatctgcgatggcgaggttaagcgtgcggtcagagagtatcgtcgcttctctggtgcattacgctaaaacatcattaaagggtatcatcgatcgaaactgccaggaacagaggaaaatcgttgaagccatggttaaccttttgccgaatgacgaaaaaggatcttactctttatcaattattcctctcggtttcctctttggaatgctcaaggtcggaactataatagatatagagatctcttgcaggctcgagcttgaacgtagaatcgggcatcagttagagaccgcgtctctcgatgatctgcttataccttctgtccaaaacgaagattcaatgtacgatgtggataccgtccacaggatactcacattctttcttgagaggattgaagaggaagatgatgaatgtggttacgattcggattccactggacaacacagttcgttgctgaaagtgggacggatcatggatgcttacttggttgagatcgcaccggatccatacctgagtctacacaagtttacggctattatagagacactacccgaacactcacgtatcgttgacgatgggatctacagagccattgatatgtatctcaaggtaaacaaaaacacaattgaacaaagtctttttatgttttgaaaacatctgaaactgataatcaaatatggaaattaggctcatccattattgacagaagaagaacgcaagaagctatgcaacttcattgactgcaagaaactttcacaagaagcaagcaaccacgtggcacaaaacgatcggctgcctgtacaaatggtggttagagtgctttacacagaacagttgcgactgaagaaagctctgtcgggagattcagaagaagggtcgtgggttttgccttctggagtacaaagccgagcggtttcgccaagagacacgtatgcagcgttgaggagagaaaacagagagctgaagctggaaatatcaaggatgagagtgagagtgagcgagttagagaaagaacataatttgatgaaacatgagatgatggagaaatccggtaataatggtggaacgttcttgacgtcactgtccaaaggaattggaaggatcgcgacattcggtggagaaacccggcaaaaggtgaaccggaaatcaaggtcggtgtcggagagaaaatcaagtagaagcggtagataaaaacgtcaccgtttatgtggttgctatctaaacggagacaagtcatgtgtaacaggatgaataatgggccgggaggagtgtgaagtaggcccattaaaaaacaaagaaaggtctcgttttcagcctataaaaacaaggaaaacatgggattaaatggggtccggtccgagccgtctttgtccatatttatcttgataagaaaagaaatatataaaataaagtatttttttaagaaagatattaagacagtaaaaatgtttataagtgttggtcgttgtacacggttaagttgttttgttaactagtgtaaaatttggttttctgataagtttccggaaatagtacgtcacctataactagaaaattataaaaagatttggttaaatctcaccttctaaaatttactaatatagaaagagaagaccacgtggtgtctaactcatacacatacataaaccaacttgtttatagcatactataatattaccaagaaattaggaaactaccttcacttctccgcctcataaataaataatttacatctaaaaaaagaaaaggagtatgattgatgaaagatgaacatgcatcgtgataacattagatggttacaatatcctcaccaacttggaagtgacacaaattatacattactactagttagtactagtagatctgaatctctctctctttcttcttctctaatgccgtaaattgtaagctaactcttcccacatagtgcctcgattctcgcttttgctctctctctctttcctccgaca

SEQ ID NO: 10225 - DNA, 3000 bp, Unknown; identical to SEQ ID NO: 10224
  misc_feature (1)..( 3000): cDNA_ID_2714172_gDNA_ID_2213638_Annot_ID_181104 3000 nt of promoter + ATG

SEQ ID NO: 10226 - DNA, 3000 bp, Unknown; identical to SEQ ID NO: 10223
  misc_feature (1)..( 3000): cDNA_ID_2704729_gDNA_ID_2213638_Annot_ID_181103 3000 nt of promoter + ATG

SEQ ID NO: 10227 - DNA, 3000 bp, Unknown; identical to SEQ ID NO: 10222
  misc_feature (1)..( 3000): cDNA_ID_2704737_gDNA_ID_2213638_Annot_ID_181099 3000 nt of promoter + ATG

SEQ ID NO: 10228 - DNA, 3000 bp, Unknown; identical to SEQ ID NO: 10221
  misc_feature (1)..( 3000): cDNA_ID_2994592_gDNA_ID_2213638_Annot_ID_181098 3000 nt of promoter + ATG

SEQ ID NO: 10229 - DNA, 3000 bp, Unknown; identical to SEQ ID NO: 10220
  misc_feature (1)..( 3000): cDNA_ID_2714183_gDNA_ID_2213638_Annot_ID_181095 3000 nt of promoter + ATG

SEQ ID NO: 10230 - DNA, 3000 bp, Unknown; identical to SEQ ID NO: 10219
  misc_feature (1)..( 3000): cDNA_ID_2704713_gDNA_ID_2213638_Annot_ID_181094 3000 nt of promoter + ATG

SEQ ID NO: 10231 - DNA, 3000 bp, Unknown; identical to SEQ ID NO: 10218
  misc_feature (1)..( 3000): cDNA_ID_2714191_gDNA_ID_2213638_Annot_ID_181092 3000 nt of promoter + ATG

SEQ ID NO: 10232 - DNA, 3000 bp, Unknown
  misc_feature (1)..( 3000): cDNA_ID_3410142_gDNA_ID_2213638_Annot_ID_181090 3000 nt of promoter + ATG
tatgccatctgtgtgctccatttggacgaaggtgatcttgaacccgagcaactgatttgccgttaccataagtcaaaaagtaatttggattatttcgtgttgcttctttgtacattccaaaatatgtatcttttggaagatgatcataattcttcttgaacattgacacctgcttgcaccacacatatctcagaagtaatactaacataacaaacaaatattaataaacctactctcttacgtaaagacagtaataaactgaattatacctctgtaaaaggatccttgatatcatctctttctacgctgctttcctaaacaacaaaatccaaaagcattattcatagcaaaggccagatcataaaagaaactttagactcacaaaactagctgaaaataagcaatgcaagaagtgtgaatgagatatcactcacgtaatttggaaatataaccatatccacatttggaggaacatcaagcagcaaccgtcttagtgagtactcacgagcacctgctgggtatatcagctcatcagtgtcaagatgaagtatccaatccatgcccgcatcctgatatttagtaagaacaagaaaaatgagaatgtaacatgagacatgagtcaaaactgaaccaaataaggtctaaaagaaatacttaccctagccatgacaatagccatttccatgttgagagattgtttgacaaataactcataattgcagggcttataaaagaaagacgaaagccaggtctcattccaaatccggctgatgaaacaaaacaaaaaagaatgacagtaaaatgatcagtagtagaaaatacaacaaaacaatgctacaatttcagaatatacaacaaaacatgtgtttagtgccttgaagagctatagctttgtcgcaaatatgcaatgggataactaactaacctcttcgcttgcttctcctcaagctctttcgtcctgtatattactttaacaccctgcaagagacatgggactacatttatcgaaaactgcataccttaaatacaaatttatacctacaggactaaagagctagagatatacagccaaaacaaaataaacagtggacgcgaagagaggtagttcaactcacaggaatagactcgagcactttagaaatactcggagtagcagctttcccttcaacgaaaaggaagaatgttgagacgcctagaaccttatggtagaacatccatggtagaatctgatccaatccagctgatgtgctagtcgtgatacatatctgtaaacagtaacaatgtcaagaatcatatacaacatggagcacaaaaagtgaggtgactttacaaagacagatctgatcaaaaaatgaactttggtatttctcaaatctctataatccaataaaaaaagaacaacttgatatttcagattagacattgtagtaagatttaagaaaaaaaaaaggaatttggaagtgtagatcgatccaaagacttgaaatcaggggaattgaaagtagtaaccttaggctttaagctagtatcaacaccaaacttccaatcagcatagtaaggaaaagaaggagaagagctgcgagctagatttgagcagtcggaggaggattggtgagactttggggagacagatgaaacagtctccatgccgggaaagacctcgtgattgagatcggagccgccaggaaccgacgtagaggaacgaacagaagcagaggcaggatcggcgagaccaccgcctcgccattggaggataaaggcgagacaagcaagggaaactggaagtagagtaaggagaaggaggagcctagagacgaatgaatggttttgggaagaagatgaagatgaggaagaagcagatattagtggagctctgtgatggtgagtcgatttcatggttagctccaccactttgaaaaacaaaaaaaagtttcggaggaagaagacgaagaagaagaagaaagacgcgattctgagatctttctttttattttattttcgtgttttggtcgtctgagatctcatcggtaaaattaaactttactaactaaatctaattgattatcaattcatctcattttattatgtataaaaattgggagattttcttccattttttttcttaatctttctcaactggatttgaattgatagattggaaacatgtaccaacacaaagaacagaagcaattacacagggagaaacaaatctccacacactaagccactataagctaataacaacaataacctatacaaaacaacagagccatataacaaaaaaaaaaccaattcaaccaggggaaatgactctttcatcacagaaaactgaatggaaccaagacggatgacttgatgcaacatacaattgcaacctgcaatcatcagtgatactctatgacataatattccttcttcttttggatcagattaattaagttttgtttctaattattaagtcatgacacttcttccattcttaattattaagttttttttttcttgtatcaaatctttaattattaagttttttaaaaaaaattattaaaagtcatgacacttcttccattcttaattattaagtttttttcttggatcaaatcttaattattaagtcatttattgttgtttcacctaaggtaccttcatttaaaagcaccaattaaaatatttcacgtgtcgtctcattagaaattcggatgcttagagcccagtaaggaccgatatgggccggacctggttataaatgtaagactctaattggatcgctgttcgtcattacttacccatatatatttgttattcttcttttctcaattttctttctctttccatcacctttctcgttcacttgcttcagatctggcagcgatttcatttcttctccagtctttctctcgtctcggttctatctcctggccattggcggtcaggacttctcagccgtatatttgattccgtccccggatttactcttgctgtgatctgaggtcaaacatg

SEQ ID NO: 10233 - DNA, 3000 bp, Unknown
  misc_feature (1)..( 3000): cDNA_ID_3032937_gDNA_ID_2213638_Annot_ID_181112 3000 nt of promoter + ATG
ttgcaactaagaaacaacatggcgacacttgtaagcaccgttgctagttgctgctacatcaatgcagaagattaaggaactaattgacctttcatatttcccttttaaaatgtttttctgtttgattgggctttaaggtgaataacgggcctcgagtgtggacatttatgcccattttctttcacaaaaacgacacgctaactactcgttagaacacgaaacgccacgtcgtcctaatgtgctgatacaatttttatctcgtttttatttgcacagagagagatttcagtgacgtcacatcttttccttttggtgttcttctcgtcgccatggacgatctctctctagagaaaatcgagatttcgggtccaacattggcgtcactgattcaacgagcttcatcttctcccagtgacgtcgatggcttgatcttcggccaaatccaccgaatcgtctcttctaatctatccgacgattctccggcggatatcgcctcgagttcctcctcatctgatcaaattgtcgccaccgttacaagctttatctgctctggtaaaactgtctccttctacgatccgcttggccgagttgactcgcgtcgaatcgattccctccgagtcgactcaccggaccacctaattgggtggttctccgcccgcaggaaaaccgctaaccgtccatcaatgagagagttagccgtcacgtcgtctctctcgtctcaatttcacttaccaatcgaggatttgcaaaaccctagatcgatgaacatggcttcatccgtgttctttcttcttactatgccattgacggatcagtgcattcacacgcacgagtaccgtgcgtaccagttccgatcctcgaaacaacggctcgaacctagatccgttggtatagtcaacattggaccagcgtttcgaggccattacggttcgtttagtccgaaatcgggatttccaccgttgatctgcgagttgagtagctcagccatgagcgtggattgcgatgagagttccttgagtgcgaagaaacaatcagcgaaagatcagaaggagatcgatgcgttagcagaggggtttcaagttggagagttgaaacgtttggttggagctgaagctgcgaattacacaggcgggattgaagaaatgtatgagagaatgctggcgaagatcgagagcttggcttctgatgttgagaagagctcggctagggtatttcaacaggtacaaaaccatcttcaaaattcgatgttattgctattcaagaattaaagtggttttgttgttcatgttattgattgttgtctagcaaaatgttactgaattgtaccaatacaacatcttcaatggttcttccaggaaaagcataataggaagttgagaaaccgagtagccagaatcgggagatgaggcttcttttgaatttctttaaggttttttatcgagtctatatacttggaattcaatccaagagaacactggctagtagtggctagcgcaatcggaactatatgcgggaaacgatttgtattatagtttagcgatttcctagttaaacctttcctggctagattgatttgtcacaagagatcccttttccttgtatggctagtttttgtttgaagagaaacaatcaagaatgggattgattcatgtcaagagtttctataattgggcgtataatatatgtttatgaagtttaatactaagctaattagttgcatacatattgataccaattaccaaatggtagagcagaaataccccgacatgactagagataggaaaaatgatatcaccagaagaatgaatacctttgagaaaattgatatatgatattgaagttctgatcaacagtcattataatttgtatagacgtttaactttgtaaggactttggaattgattaagatgggaacttttattgtcgacatgaatggtatgacactgaggcagaatgttcaaggagggtaaatgttactataaataccatgtgaatgtgtatagtatagtaacattattcaattgatctcgaattttattgacttaatttttgattcaagagttgtaaaagttggatacagcccgttggaatgatttaataatacaagctacagaatttggaatcaaaccgaatacatgtttcttctgaatcaggtttttggttaaggatcggctaaaccgaacaaaattgggaccacggctcaaattacttgatggaaaccaaccaaaacggtttctcaacgatcaatttcacaccacagctcttagtactcgaagatgctccttcatatttgtgctatcttaactacttgtaacaacaaaacgtaccaaccgcacacttcattaatctctttatctagagcgtcaatgcactatgagcagcgatacaactcaatatccatcgcctaaaaattgtcattatttttccttttgtcgacgttgatattgacatatatattactacacacatgggttaaacactatccaaatatatgtagatgagaactgaaatcctttttatttgtcaaagcagttttaaaactttgaattttataatcaggcattaaatcatacactactgaattaaacagcatttcaaaccagtaagaaattaaatactatccaaattcctatcttaatctattagtctttttcttttctttaacaactcttctcattgtagttggtatcagtgtttaatttagtaggccttttttattgattaagagatgaatttggatagttaaagaagaaaaaatgtaattaaaaagaaataatattgttagatacaatgcagttgaatccggagggttggatcttaattggctgaaggtaaacattaaattcttccacaactaactaacagtaacactcgtgtcctagcaatcactcttcctcaactaccaatctcaaactctttccatctataaataacctctctattttctaaccctaaccataacacaaatacaccaaaaaaaaaaaaacagaaagtaacatg

SEQ ID NO: 10234 - DNA, 3000 bp, Unknown
  misc_feature (1)..( 3000): cDNA_ID_2704717_gDNA_ID_2213638_Annot_ID_181111 3000 nt of promoter + ATG
atttttcaataaaatttgtagaaatagtgaatatttatgatttctcaccagtaatataataattagtcaaacgtgaaaatcattttctttatgtggcttgttcaatagatcatccaaagtaagccgacccctgttcaaaccattaattgtatattccaacaaaactcaaaaagtctacacataaggagaaaagtatacgacctataccagaacattattaaattgcgtaatcaacaaaaacagcataggaaacgtgcatactagtgttcaaaactattttcaagttattcaatctttgtagatttttttatttcaaaaacttttgcaattcaactgcctatagtatatagaaactatcccgtttaaatgataagtaactttcagatgatatgatttggaaaaccgaagcttagatatatatttcactaattataatgcatatgacactaggtacatattacaaaagcaaacgaatgtatccacaactaatatccgtcgaaaagtctaattacataaaagaaatgatgatgtaaactttggttggtcaagcccaaagcagagtccaacaatgccgagaaaaagcagcaaaggttgagaggatgctccgccaaaataggaagaaaagaaagaaggaataaaaatacacttttaggaaagaactatgagtttgaatagagttaagtcaagtgaaaagataaaactaaaactcggatatatattaacctaaagtttctctgtagcattatttgtgaatacatgattagtaatcaaaatttcaatatactatcaaattgtgaaatttccattttataatcaaatactactccgagaaaaaaatgaaaataacacatgatgatgatgtaatattcgggaagtagagaagagaagtgagaaagaatggagattggttcgagtggggaccccacgtgtcctctgttgtctgaatttagagtttagtcgcacgcgtgcatggcgcgtgtgcttaacctttttctaaaatttttaacttattttaaaaatcttccaaagaacgatgtcagggggtcccacattagcgaagacgtgaccggatatgaaccgttgattagagggcaatgcgatctaaataagcggctaagatatcgagtcaacaaccaatctaattagtcattttgacccaagaaaagaaaacaaaacaaaaaacccaattagattaggattagtagatagatagatacggcctatttttattgaacaacaaaacaactaattataaataaaaaggacaaaactagttttccaagtttgactgagatgtcgcttttctcgaggccctctttactggaaatctaggctttctcctgaattttacaatttttcctaccttatcgtttttataaaaaaatattaattttaaattgaaaatttcgtatgaagtaatatattttctcaattcataaatgatccaagttgttgttattttcttagtatttgtaattatagcttatatgtatattttaaaattaaatataaaatttacgattatcaatcgttcgataaaaaatttgatcgttcataatattttgaaaaatagtttagaattaaattaaataaataaaataaaattattatagattttaaaaatatacactgataacattaatataaatcactaatcgacaaatacaatcgtataatttaaatcgttattaatatattggttagattaaaaatggtaatatgtatttttacatgataattgtgaaatttttatttacaaacaaagaaaaatctccaataataaaatgatattggaacatgttacacattaatacattttgagattttctcttgagccgtcgtcccctttattttatgagtttgtgacgaggttgtagagagaagaaaacaaaagtagagggggcgaaagaagaataaaaagcaaagtagagaaaattccaaactaaaagttagctgaaagaattgaattaagattgagagactgggagagagagtttaagtaatactaataattaatacatctttggatatctgttttgctttgaactttgaccactgcctcttttgggtcccacccttctctctcttctctctctaaaatctctcactttcctaaacagagagaccccttatgagttttctcctcctcctcctcctcttccttcctcatcccagaaatttccgatttcactttcacatctccctctctcttacaactctctatccgtagtttcagtttcgtcctagaatttcttttcttgtctgttccaggtttgaactaattacttctctcttatgtctgcttttgattttttctagatcgaattcgtgtttttgttttttcttaccttttttttttttgtgaattttcgcaggaatagattttgatctatcctaagattttgtttaaatgacaactctgatttcaccaattagctcagttcaaaagtgaaatttgaatattttgaaattgaaaatatctatctctaatgataatgcgatttacaaaaaaaaaaaaaaaaaaaaaaaatcatggatgtattttcctggatttattattgtcgttgtctcttgtctttaccgaatttaatctaaatggatgtcttcattaaacaaatcgaaagcgtttctaactttacagtttttcgttgtttcactgttatagaattagggtttatgtaactgtcctttacttgcttcaacttctcaaattaaacttcttttttgaaccacgagatctgtcaaaatgagattttatccacttctactgaaaattaagtttgaattgaacaatttctttagccattgatctaaacacatgcaaataaacggatctgggttttctaaaaatcacttttttctgtatgtagttgtttctgttgctaaaaaaattgtgttttgaatcatttttcagatgaaattgtgagttctccgagttatatgcatccgttagaatcaaagcggtaatcaaaagcagaatttagaggattgaaaaagatg

SEQ ID NO: 10235 - DNA, 3000 bp, Unknown
  misc_feature (1)..( 3000): cDNA_ID_3032939_gDNA_ID_2213638_Annot_ID_181108 3000 nt of promoter + ATG
ggaattggtactctaaaaaatcagataaaagcgtatgtaaaccggataattgaattgaaccgaattacggttcggttttgttgttggtgtgataaaggttcgattgagccgtaaaaccttccgtcctcctcgagtcctttccatcaggaccttatccacagtccacacacagcgagactctatttactcgccggcggaagaacaaaatggcgggaagagcgattttctctgtatcttgttcatctactccttccttgtgtatcccttattcaactgcttcgttttcatcgatgaatcgactggcgctccccgccgtccggatttctccccgaaccaacagatttcccagttaatatctctattcgcttctttaaattcgatgcatgcattgattttgaaatttatattcagacacgtttgatttttgcagggattcactgctctatgtctgctaacgacatcaaagcgggaaccaatatcgaagtcgatggtgctccttggcgtgttcttggtattcttcttcctcaattcctcttagtttatgttattatctatacttggaacttggaaggtttctgaatttgtagatactattactagttcatgacgatttaagcattgttttggttataatgcttccacttagctacttactagtctactgagggttttttcttgctttgttggagcagagtttcttcatgttaaaccaggaaaaggtgcggcatttgtgagaactaagatcaggaactatgtgaatggtagcacagtcgagagaacatttcgtgctggaatttctgtaaaaatcatctctttttctcttatatcttaatctgatgaatgattttttagttgcaccattttgattatgaccattctatgttacaggttgaggaagctaatatatataaagaaaccaaacaattcacatacaaagatgggtctcagtttgttttcatggatttggtatgtcacattggatccttacttctcttcttcgctagtatggtagtagtagcttaaagtttgtgtactaatgattacgttttctcttggttatcaaatctttttttttatatagaccacatacgaagaaacacgtcttaacgaatctgatatgggtgagaagacgaaatggttgaaagaaggaatggattgcattttgctctattggaaagacaaggtacactcactttcagcttctctgtaaaaatagttaatagttcacgtaattaagcggtgatgccaactttgtttctctctggatctttgcaaggttatcgatttcgatctaccgattacagttaagctaaaagtggttgacgttgatcctggccttcgcggtgatactgtgcaaggtaacaatgttgcaccaatctattgttgagagatctcttctcatgttttggtttaaacaagcttaaactgaccaagtggggtgatgaatttcgtaggtggatcaaaaccggcgacaatggaaacgggtgcaatagttgctgtaccactctttattaacgtcggtgaagagatatttgtggacacaagaactggtgcatacatgaaccgagcgtgatccgggtctactacacctagttaattgggtcgttaacaacaaggcaatgatacatcttttttgtatatgagaatgttcgaatccggggacacatgtttgtttttctgaacatcgagagacaatttttcgattaaataaatttatatatatttaagtttgattaaaatcagcaaattcatacaagaactaacataatttggtcaatcctaatgcttttcgtaactgtttaaaagcatgaaattttttatgatagaaaggttaagaatgaatgaggaacatcgagctagagagattcaatggaataagagattaatggcttctaaaatctctggatacgcaaaatactctctcagtctctcacaaattgatgtattttgtgaatctaatggctggtaaaatttcctcattgtggatttcaaatccacataatccggaaaaaaaagatatgatctaaaaaacaacaaaaagtcaggaagaatgggcttggtgaaaggcggcccactaaaataaataaagaattagtggacaaaaaaacctccgccgcatatttaacaactggtcaacgttctcccaataagatacggccacgtgtatgaacccctggatctgcgatgctgctcttaaattctcctctcgtcctcatttccatcttcgtctcctccctcagccatcccctctggtaatcaattctccctctctatctatgtttgtttgaattctctctcgcatagttaagattccttttttcgtattctagatccatagaatttatccaaaattcatgaattgtttctaagacacgaaacggtttaagttcaggtcatagtttttctgtagatctcgatttacgtgaaattttacttaccaatagatctgaattatcgaaattgcagttccttttcctcgagtgtctcgttcggcttcatgtcctgtggaatttttaatctttgtccgattctgaatccggaaattgttagggatttgggttttattcaagatttgtcatcgctgtgaaagttttccctttttttatgtgggttcgaagttttctgaaaatctcaattagtaaaaggatcactggacttgcttatattaattctacaccgtctcttcatagatttggtcaatcctgtatctcagatcttatttgttcatgtgatagcctttaaatgtgtgaacttttcatgtacttgcagagcttataaaaccttcatggcatttgcgcacttctgcagcatccactgtttccttaaaatcgggaaacaacaagagcttcttctccttgttattggattgccttttgccagcctttgttttagtcagttttctcctcattaacttctgtcggtacagaatctctctccaggctggtgaactcttgcagctttctcagtgattctgtatcgatttttcccgtgtaaattatg

SEQ ID NO: 10236 - DNA, 3000 bp, Unknown
  misc_feature (1)..( 3000): cDNA_ID_2714169_gDNA_ID_2213638_Annot_ID_181105 3000 nt of promoter + ATG
attgtctgcaacatcaggacccactatttcaggtggacgtgctgcatcaaatggtcgtactggaccttcattgtctaggccaagctctcctggacctagagttagaaacaccccgcaacagccaattgtgctagcagacttccctcttgatacaccacctaatctgagaacatctctcccggacagaccaatatcagctggcaggtccaggccagttggtggtagcagcatggctaaggcaagtccagaacccaaaggtcccatcacaagaaggaattcatctcctattgtgacgagaggaagactcactgagacccaaggaaaaggccgttttggtggtaatgggcagcatctcacagatgcaccagagccccgaaggatttcaaacgtttctgacataacttcacggagaaccgtgaagacctcgacaactgtcacggacaataacaacgggcttgggaggtcattctcaaaaagttcactcgatatggccattagacacatggtacatatgtctcttctcactaaatgcaagtagctttataccatgcaatgaatatctcaacattttttatggtgtgtgtaggacataagaaatggaaagactaatggttgcgcactatcaaccacaacgctattccctcagagcatcagaccagcctcatccaagatccagccaatccgttcagggaataatcattcggattctatcagcagcaatggcacagagaacgggaatgaagcaaacgagggtagaagactgatggggaagttgagtgacatggacatgtatgagagctcaaggtatgatgcattgttgctgaaagaggacgtcaaaaacacaaactggttacatagcatcgatgaccggtcgtcagatcacggactcatgtttgacaatggaggattcgagctacttccagagccatttgccccactataacacacacacacacacaccccacaagtaaacacctttttttctttctaaaatcacttctcttttttttttttttttttttttaaattttatcttacacaatttgtttgcttgtcgatggtggaaagatataaggctcaagtggttcttggttctttggttattgattcttgattcatggctattgagtgaggtttgtaactttgtagttataatatttgaagagatggtaacgtataagagggtacctcatgttcactcttgttggaaacgatcatgaacgaaaaaacaattagaatgtgaaaagaggaaagagagggtcacacgactcacgcgcctaacgtgaatcaatgacagagctaaagttaataatgggtgacaacgaagcacacaaccaacaacaggccagtgtagttctgataaaagaaaaaaattaattccagaaattgactttcattaatgtcatatttgagatttaagaagttttaaatttttgttatttattttctcttttatgttaccccaaaataaataaataccctcattaatgtcacataccaaactcctcctcttcagggggtccatatttaagaaagataccctcttacccgaattaaaaatatcaaataaagtaagctcaatttgcaacatataataatttgttgaatattccccactcttgttgttttccttgcccattttttgatcttgaaatacttttatcttcttattgtttaacgaatatcacaatcatccattttcatttatacattgcatattttcaaaaaagaagccatatatttatttaatcaactggtgacccattcaatagaacattacgatgcttttaaaagaataaggaaattaaatgttgggaattcagtaaatgccgtttattaaaagctcttatgtataaattcatttagaataaaaacaaagagaaattaacaaaaggacaaatatttaattgagcttagcaataaaaaaaaaatctaaaaaattcggaagagagtcaaagggggacttaaagccaaagagagcaaagcaaatcggagtacagagaagaagaagagagattggaatctgaaactgtaacatcgagatttacgtttctccgtcggcgtcacgccgaagcttccatactccagaaaccccaaaacgcttatttctcaaaaatctccactctctctcttctgaatcttcaatcacttggggttgtgtcactgaatctgcatcaatggcgattccagattcctcactcttttctgcttttgactttagctctagcttcttcttcacgaaatgccgttgttgttaaaaagtgatttctccactatcccatttcctttggcatttattctccactctctctcacttgtcttcttcttcttctacgatcagctcaccaatgtcctgaaccattctcctctgaatcaacctctaaggtctctctcactttcgatctctgttttccctcttgttttggggtttattagcttcgttgtttattcctttaaaagatttcttctttctcaatttcaattactccgtttagcttagctggagaaaccctagtttgtagattgcagatctgggttaatcaagtatctgtgcacacatttatgtctaaaattagttactttcgtaattggatttgttttttttgtgaagatttattatttgaagtcaaacagatttcagctgattgaatcaatgtgtgcatatagcttccataatttcatattttgatttgagaatcgagtaatgttgctttggactttatcatcagcattcccactttggtttgagaaattacgctattgtatctttgtcattattaaggaagcttttcgttgtgttgatgatctttttactcatgatacctgtgatgtgtaggtgtcattcttggctactttatccatagatacatttctcatattgagtttagcttttatgtggctataaatcattacatgatgtgttttgtgttctcttgcagttgctgttgaatgagaaagctttgatgtgagcgagcctgagagtgtaacaaaggactgatg

SEQ ID NO: 10237 - DNA, 3000 bp, Unknown
  misc_feature (1)..( 3000): cDNA_ID_2714169_gDNA_ID_2213638_Annot_ID_132200 3000 nt of promoter + ATG
ctcattgtctgcaacatcaggacccactatttcaggtggacgtgctgcatcaaatggtcgtactggaccttcattgtctaggccaagctctcctggacctagagttagaaacaccccgcaacagccaattgtgctagcagacttccctcttgatacaccacctaatctgagaacatctctcccggacagaccaatatcagctggcaggtccaggccagttggtggtagcagcatggctaaggcaagtccagaacccaaaggtcccatcacaagaaggaattcatctcctattgtgacgagaggaagactcactgagacccaaggaaaaggccgttttggtggtaatgggcagcatctcacagatgcaccagagccccgaaggatttcaaacgtttctgacataacttcacggagaaccgtgaagacctcgacaactgtcacggacaataacaacgggcttgggaggtcattctcaaaaagttcactcgatatggccattagacacatggtacatatgtctcttctcactaaatgcaagtagctttataccatgcaatgaatatctcaacattttttatggtgtgtgtaggacataagaaatggaaagactaatggttgcgcactatcaaccacaacgctattccctcagagcatcagaccagcctcatccaagatccagccaatccgttcagggaataatcattcggattctatcagcagcaatggcacagagaacgggaatgaagcaaacgagggtagaagactgatggggaagttgagtgacatggacatgtatgagagctcaaggtatgatgcattgttgctgaaagaggacgtcaaaaacacaaactggttacatagcatcgatgaccggtcgtcagatcacggactcatgtttgacaatggaggattcgagctacttccagagccatttgccccactataacacacacacacacacaccccacaagtaaacacctttttttctttctaaaatcacttctcttttttttttttttttttttttaaattttatcttacacaatttgtttgcttgtcgatggtggaaagatataaggctcaagtggttcttggttctttggttattgattcttgattcatggctattgagtgaggtttgtaactttgtagttataatatttgaagagatggtaacgtataagagggtacctcatgttcactcttgttggaaacgatcatgaacgaaaaaacaattagaatgtgaaaagaggaaagagagggtcacacgactcacgcgcctaacgtgaatcaatgacagagctaaagttaataatgggtgacaacgaagcacacaaccaacaacaggccagtgtagttctgataaaagaaaaaaattaattccagaaattgactttcattaatgtcatatttgagatttaagaagttttaaatttttgttatttattttctcttttatgttaccccaaaataaataaataccctcattaatgtcacataccaaactcctcctcttcagggggtccatatttaagaaagataccctcttacccgaattaaaaatatcaaataaagtaagctcaatttgcaacatataataatttgttgaatattccccactcttgttgttttccttgcccattttttgatcttgaaatacttttatcttcttattgtttaacgaatatcacaatcatccattttcatttatacattgcatattttcaaaaaagaagccatatatttatttaatcaactggtgacccattcaatagaacattacgatgcttttaaaagaataaggaaattaaatgttgggaattcagtaaatgccgtttattaaaagctcttatgtataaattcatttagaataaaaacaaagagaaattaacaaaaggacaaatatttaattgagcttagcaataaaaaaaaaatctaaaaaattcggaagagagtcaaagggggacttaaagccaaagagagcaaagcaaatcggagtacagagaagaagaagagagattggaatctgaaactgtaacatcgagatttacgtttctccgtcggcgtcacgccgaagcttccatactccagaaaccccaaaacgcttatttctcaaaaatctccactctctctcttctgaatcttcaatcacttggggttgtgtcactgaatctgcatcaatggcgattccagattcctcactcttttctgcttttgactttagctctagcttcttcttcacgaaatgccgttgttgttaaaaagtgatttctccactatcccatttcctttggcatttattctccactctctctcacttgtcttcttcttcttctacgatcagctcaccaatgtcctgaaccattctcctctgaatcaacctctaaggtctctctcactttcgatctctgttttccctcttgttttggggtttattagcttcgttgtttattcctttaaaagatttcttctttctcaatttcaattactccgtttagcttagctggagaaaccctagtttgtagattgcagatctgggttaatcaagtatctgtgcacacatttatgtctaaaattagttactttcgtaattggatttgttttttttgtgaagatttattatttgaagtcaaacagatttcagctgattgaatcaatgtgtgcatatagcttccataatttcatattttgatttgagaatcgagtaatgttgctttggactttatcatcagcattcccactttggtttgagaaattacgctattgtatctttgtcattattaaggaagcttttcgttgtgttgatgatctttttactcatgatacctgtgatgtgtaggtgtcattcttggctactttatccatagatacatttctcatattgagtttagcttttatgtggctataaatcattacatgatgtgttttgtgttctcttgcagttgctgttgaatgagaaagctttgatgtgagcgagcctgagagtgtaacaaaggactg

SEQ ID NO: 10238 - DNA, 3000 bp, Unknown
  misc_feature (1)..( 3000): cDNA_ID_2994588_gDNA_ID_2213638_Annot_ID_132201 3000 nt of promoter + ATG
atgtggctataaatcattacatgatgtgttttgtgttctcttgcagttgctgttgaatgagaaagctttgatgtgagcgagcctgagagtgtaacaaaggactgatgatgaagattattgcggcgtttctcttcctcttggtcacgacttttgtttcccgttgtttgtctgcagacatagaatcggacaagcaagcactgcttgagtttgcatctcttgttcctcacagtcgcaaactcaactggaactccactattccaatctgtgcctcttggactggtatcacctgctccaagaacaacgcccgtgtaaccgcactccgtttgcctggatctggactttatggacctttaccagagaaaacatttgagaagcttgatgccctcaggatcattagccttagatccaaccaccttcaagggaacattccatctgtcattctttcacttccttttatccgatcactatactttcatgaaaacaacttttctggtactatccctcccgtcctttctcatcgcctcgttaatcttgatctctccgccaactcgctctcgggaaacattcccacgagtctacaaaaccttacccagctcactgatctcagcctgcaaaacaattctcttagtggtccaattcctaacctccctcctcgccttaaatacttgaatttgagcttcaataaccttaacgggtcagttccatcttctgtcaagtccttcccagcatcctcatttcaaggtaatagccttctatgcggtgctcctctgactccatgcccagaaaacaccactgcaccatctccttcaccgacaacaccaacagaaggtcctggtacaaccaatataggtcgtggtaccgccaaaaaagttctctccactggtgctattgtgggcattgcagttggaggttcggttctgttgtttatcattcttgccatcataaccctttgctgtgccaagaaaagagatggcgggcaagatagcaccgcagtgccaaaagctaaacccgggaggagtgacaacaaggctgaggagtttgggagtggggtgcaagaggcggagaagaacaagctggtcttctttgaaggaagttcatataactttgatcttgaggacttgctcagagcctcggctgaagttttagggaaaggaagctatggcacaacgtataaggccatcttagaggaaggaaccacggtggtggtgaagagactgaaagaagtagcagctgggaaacgggagttcgagcagcagatggaagccgtgggaaggatcagtccacacgtgaatgtagctcctctccgtgcctattacttttcaaaagacgagaagctactcgtgtatgattactaccaagggggcaatttctccatgctgcttcatggtaatatgatgttttacatgttactcaaggttataaaaagtggctttaaagtaacactttagatgaattctatgcaggaaacaatgagggaggaagagcagcgttggactgggaaacaaggttaaggatctgtttggaagctgcgaggggaatttctcacatccattctgcatctggtgctaaactcctccatggaaacatcaaatcaccaaatgtcctcttaacccaagaacttcatgtctgtgtctctgatttcggtatagctccattgatgagccatcacaccttgatcccatcaagaagcttaggttacagagcacccgaggccatagaaacacggaaacatacccagaagtccgacgtatacagctttggtgtactgttgctagaaatgctgactgggaaagcagcagggaagactactgggcatgaagaagtggtggatctgccaaagtgggtgcaatcagtggtgagagaggagtggactggagaagtgtttgacgtagagctgatcaagcagcaacacaacgtagaggaagaaatggtgcagatgttgcagatagcaatggcatgtgtgtctaagcatccagattctaggccttcaatggaggaagtggttaacatgatggaggagattcgaccttcagggtccggtcctggttctggtaacagagcctcctcgccggagatgatcagaagctctgatagcccggtttagattggttttaaattctctttctctcattctcaaatcattatttatttttgcttttccttcttcttcttcttcataaaccgtttattttagttctctatgtctgactgcataatttattccaatcaatatctggaattgtagtgtaattgaaaccctcaccatgaatggttgtagttcttagattggttataagtgtgcgactagttttgaattttcatttgttgttgtatgattcgtttaaattaaatcacaagagtctttgggtgtttgaaaatctaactgaaatagtgatacaattatatgtgaaatttatcgtctcaaaaagataaactacatgagtaaataaataaaaataaaatcattgctctgtattttttgactgcatgagtcctaattggtgaaataaaaaaacttttggcacgagaattaataaatatatagaaaaggtgaaataggtgaggcggtacttgctgatagaatcagaagcttcgagactgacttgttttagattctctgactataaagaaaggcaaagtaacaagtttcgttttctcctttgcactccatttttattctcgattctcttctctcccgataaagaagctctcgctttgtgttgtccgtccttcttccaggtctaattccaccatttctctttggttaaaccctaatttctttctctcccgaatcgtcctctgtttttgttttgcgcgattagtttccaccgcttaataatagggtttccgatcacttacgttttgtgttgttttgttcggtctctggttcttccactgtgatctgttttgttcttaagttgattgtcttaagttatatcctctgttcaataatattctggtcttgttgggggtttccacaggttttctcgtctctgacgc

SEQ ID NO: 10239 - DNA, 3000 bp, Unknown
  misc_feature (1)..( 3000): cDNA_ID_2704725_gDNA_ID_2213638_Annot_ID_132204 3000 nt of promoter + ATG
gctttctcagtgattctgtatcgatttttcccgtgtaaattatggtttcctctcagcgtcctgtccccaacaaaatccagaaacagcaatatctatccatcagcccttcaaattctgtcttgaaagatgatgttgaacttgagttctctgatgtgtttggtccactccccgaagaggccaatgatattgcttacgacgagcctgctgttgtctacagtcgatcccactccttggttggcccgtgttcgctcgatagtcattctttgaagctgaccaagctcaccttactagagactgaggactcaattgacttggtggagtgtctcgaaggtgaatctttaaaagaaaatgatgatttctctggtaatgacgacagtgacaatgagaaagctttagagggagatctggtgaaagtctcaggtgtagtaggcatagatgattttgaggttatgaaggttgttgggaaaggtgcgtttgggaaagtctaccaggtgaggaaaaaggagacctctgagatatacgctatgaaagtcatgaggaaagatcacattatggagaagaaccatgctgaatacatgaaagctgagcgcgatattcttacaaaaattgatcacccattcattgttcaacttaaatactcttttcaggtatatataacacttctctctgttagcatcctatttattttactttactatttcttaacttagagcgttatacattcccttgcagaccaagtacaggctgtatcttgtgctcgactttataaacggaggtcatcttttcttccaactctatcaccaagggcttttcaggtttgtttaattcctttttgcgaaccatttttgaagtttcgctagaattttgtaaagcttaattggttctatattttactctttcgcagagaggacttggctcgagtgtacactgcagaaatcgtctctgcagtttcccatctccatgagaaaggcataatgcacagagatctgaaacccgaaaacatactcatggatacagatggccacgtgatgctaacagattttggtttagcaaaggaatttgaagaaaacacaagatcaaactccatgtgcggaactacggagtatatggcacctgaaattgttcgaggaaaaggacatgataaagcagctgactggtggagcgtagggattcttctgtatgagatgctcacaggaaaggtaaaagccgctatctattgttaatttgcttgaagcctcatgtcttggtatattgttgtgtgatgtcttgttttccttctgcagccaccgtttctcgggagcaaaggaaagatacagcagaaaattgtgaaggacaagatcaagcttccgcagtttctgtctaatgaagctcatgcaatactgaaaggggtaagtaaatgttggtgcagtttgattacagaatcaacagtaaacatgaaaatctttgtgcagttaagaactatgaagcattgtatttagaacaattctgactcttgactttgtaatgaatgtatagctgctgcaaaaagagccagaaaggcgacttggaagtggactgagcggagcagaggagataaaacagcacaaatggttcaagggaataaactggaagaagctggaggctagagaagtgatgccaagtttcaagccggaagtatcgggaaggcaatgcatagcaaattttgacaagtgttggactgacatgtctgttttggattctccggcgagcagtcccagttcggatcctaaggccaacccttttaccaatttcacttacgtcaggcctcctccttcattccttcaccagtccacaactactttgtagatttactatatttttatgtagttcctacttctttggttgttgtttccttctgacacatgaacattaaagaaaactttggttaccaagacgcttaatttataattgattttatgagattgttattgattgagattaagtagagcagctaacactttgaccttttgacccacgatgtaatataaaagaacgttgaaaacgtgtaaatataaaagatgataacggtgatgcctttggaccgaactagtgtccgtctgaacgtcttgtaatgtaatgggcttaaagaattccggcccactaaaacaaagaagaagttcggtttcccaatagaacacgaacacgtgtcctcaccccatgatccacgatgcttcggaagacataaaaaatgtagccacgcgccttcttaaaaccttttccttttttggtttggcacattaccctctttcctgttaaagttgtctcgtctccttctcgtctccttcctcaagcatattctctggtaattcctctctctctgtctctctttgacttttctctcgcagagtttagattctttttttttctggatataaattatttacacgacacgaaaccttctaggtccaggtcatagttttactctatatctggatttgtttgaaaattgcttgtgttatgcgccagctttttccctaatatatagactaggtcttaattacagatattagagttcgtttcctcgagggtttctttcgacctcgtgtcctggtgaaattttggaattctaaggctttggggttttatttgggaggggatgatcatctaaaggatattcggtcggtgtcgtgttttcttaatctcaattctgttgactttagctttggtaattgaaaaagaatcttttcgcttgcttattttaattccatatccgtctcttattatatttggtcaattatgtgatctgatctttgtgaaattttatgaactgcagcgcttaaagtactttgatggcattgggacacttgtgcagcatccactgtttccttaaaatagggaaacaagaagagcttcttgtcctagatattggtttgcctattcccagtttcttcctcattaactttattggtagcagagcctcatccatctggtgaacttgtgaagcttcctctgtgattcttttggcgattggttagaaatatg

SEQ ID NO: 10240 - DNA, 3000 bp, Unknown; identical to SEQ ID NO: 10234
  misc_feature (1)..( 3000): cDNA_ID_2704717_gDNA_ID_2213638_Annot_ID_132208 3000 nt of promoter + ATG

SEQ ID NO: 10241 - DNA, 3000 bp, Unknown; identical to SEQ ID NO: 10233
  misc_feature (1)..( 3000): cDNA_ID_3593504_gDNA_ID_2213638_Annot_ID_132209 3000 nt of promoter + ATG

SEQ ID NO: 10242 - DNA, 3000 bp, Unknown
  misc_feature (1)..( 3000): cDNA_ID_2715298_gDNA_ID_2213639_Annot_ID_132216 3000 nt of promoter + ATG
catttttttagttttgaccatttccaaccccatactcatgaaaatgtggaatgtttgcataagaataccgcaagctcctcctcccctcctttgaagattccgaccaccacaccaccccacccttgtactacatttcttcctccaacaaccacttctaattcctattcacttagcttcctccttcaatatctcccatgaactttctttttactggagatcctttatgtgcatgtgtagtggtttttcgcaaataatctggtgaggcttcttaatccggttccaatcatctttcagccacttatcttgaaatttccctttctttcttgtgtttgaggtctttaataatttataaacttcgagagcctttgagtaaagttccaacttcaaaaccatgagtgatttatgtagtaaatcctttatctttcgtgaatggtgctaacttaagaaggactctcaagcctttgggctttgtcaatcttcacaacaatatatttttgacttttgagaatttattttacttaacttcttgtagcattatgttatctatccctcttgactcttggtaagaaaaccgtagttaaaaaagaaaaaaatgacaaacacgttcaataaaaagcactgtttgatagggataattatcttatgaaatgggctctgaaaagaaagtatggaacttgtaagatgggcctttaaaggcttatacacgagagacaatggcgacgtcgcgaatctagtggatgatatatagataatgtaacgatagtataagtcaacgaaattgtactataaatagattacaacccccatggagtagtatcacccaagtttctgaaaacagtagagaaacacttatttaagcatacaaagaaaagaaagcaaaaacttccaaaatggcaaagaccctcaattccatctgcttcaccactcttctgctcgttctcttgttcatctcggctggtaatttcggttctactctttctaattaagttgttcatatgcaatgcataaattcatacatattattttgaacgtaactttttcttcttcgatctcaacatatatagtcaaaatttggtgtatatatattaatttgaatgaatgttggatatttctacagagatcccgacggctgaggctaattgtgatacgtatttaggcgaagtcacagtgtattacccatgtagggaaagagactgtgaagcccaatgctatgagcattacccacactcatgtaaaggagagtgtgagcatcatgaccacgtagtgcatcatgacaacgaagaagagcattgccactgctacggtcgttgaaatattttacgaaaaactcgtatccaataacaaataagattgtatctctataatgtaagtgtggtttcgttcctatgtaagggtatgtgtatgtgtatgagttagtttctgttaaaaacagtaggacgaagctaatgacggcttctctctgcttctataataagatcatgttgtatgctttttctttttaataataaaattgttttgtgttttgtctacgtaatttgtctattaaactatttagatcaaaacatacaatcctcgtcttgatggtctccgtacacaatacaatttgataattattcctccatttcttaatgttagatgttttaggaagaaattgttccacagagataaatgttttctattttctatgtaagaaattaaatttatacaaaatcaatattgaaccaatgagctttatatcaggcaggtggttgcataatattttttattaagtatgaaaactgaaaagtgtgaaacaactaagagtttaaaaacaggagtaacaatgttacacctcctgatataaagcttgtttagtgagtagtgacactacatttccaagagtaagattatctttaataatcttctttggcgatatacaatgacactatacttgtttagtgacactacatttctaagtgtgatcttaaaacaacaaaaaaaaacttctaagtttgactattcttttttttttttcctctacgtcaattaccaaaattaaaaaaataatgattgaaactacaaaatgacatacgaaaatgaaagtatcgatgcatcactcattcacttggtttatttttttaactaaagattgaggcaaacatctccgtccaaagatatgccgagcaaaaaactcctattgtgattgtttacactacactcatttaggcatctcttattttccaaatcgaaatttacaaaaaggtcttgtatattgttgtactaattgtgttaaaagtttttaaatattaatctttaggtagtcgagtttatagacgaaacaaaagaggagaaagatttgacttaagaagctctcaaaagatttccaaggataatatgttagaggtgaaatttgagacattgatgaatagtggaccttcaataaaagaatcaagtggccatgtccccgagctacgaagctaaagttatgggatcaagtgacctctatagatttaggaaaatgacctcttttcagaatttaaataaatatcagaaataaaaggttcaagtttactcgttgaattttaaattttttcccccaataaaaagaaaagttgggaccccaactttcttcatttgtctttttaatttggacccatatattcaacccgcctatctatatcttcttacgtaacaataaaagcaaccggattacattgtaagaaccagaaatcaaaccggcgtttaattgaaatcaattgaaccagaaaaggaaaaccgatatcatggaaaccggttgtcaacagaatcacaaggatcggagaagattattgaatcgcaccttaagctggacttgagcctgaaagcccatatgtaagaaaatgaaacggtagcgtttcgtaaaattggcgggaaaatgaattgttattgcgcggaagggctctaaaagttcagcagatttattaatcgtcgtcggaaaaaatcgataattccgttaccggagtggagcactcgtctttgaag

SEQ ID NO: 10243 - DNA, 3000 bp, Unknown
  misc_feature (1)..( 3000): cDNA_ID_2715292_gDNA_ID_2213639_Annot_ID_132218 3000 nt of promoter + ATG
ctttttatcgactttgggttcttgttcaatagactcaaactcttgtcttctttgtttgtatcagaaggatcaaagcaagagaaacaaaatgctcaaaacccctcaaagtcatggccctctctggtaaggcttctcaatgatttcagtgagtgacaggatccaattgtgttttatctgatcttttgtttaacagattgagggagatgagattggaaagaattcaacttacaatcccagaagtgactcgagttgttcaacatccactcccactagtgatgatggacaaggttccaaagctccaagtgttgttgcgaggctcatgggtttagagtctatacctgtaccaaatgccttggagccccggcgtaatcctgattttgatccatacttcctcagatcctcacgcaaggcaagcacatgggatgcatatgagaatttgggttatgtaaatctccgcagtgactatgatggtatttcttgggaccatttggattcaagaatgaacaaggagtgtaaccggcctatcgaccgctttcaaaccgaaacgttacctccaaggtcggctaaaccaatccctgtcacccacaataggctcttgtctcctatccggagtcctgggtttgttcagtccaggaaccctgcttctgtaatggaagaagcttcgagaatgattgaaccaagtcctcgggtagttgctaaaacacggttttcatcatctgattcctcttcatcacttccaatgaaaatcagagatttgaaagagaaactagaagcttcacagaaaggacaaagccctcaaatctcaaatggcacttgcaataataagtgcttcagaggaaagcaagatgaaaagagaactacattaccactcaagacacaagagcgaaataatttattgggagaaagcaggtttggtggttcgaagggtaaagtgaagccgccctctgtatctgcacatgcaaaggccaatactattcacaagcgagacagttcaatgctctcaaatggctacagagaccaaaagaagaaggtggaaactaagaaccgcatagtaaaaagtggtcttaaagaatcttctgctagcactaggaaaaccgttgataagccaaataaccagaaacagaaccaatttgctgaaacgtctgtttcaaatcagagaggcagaaaagtgatgaagaaagtaaacaaagttttggtggaaaacggaactacaactaagaagcctggttttacagcaacatcagcgaaaaagagcacttcttcatctttgtcccgcaaaaagaatctttcccgcagcaaaaaaccggcaaatggggtgcaagaagctggagttaacagtgataaacggatcaaaaagggtgagaaggtgataaaatgtaacatcaccgtcgatggcgggttgaagacaggggacgatgatcgaaagaaggacatggatgtgatttcgttcactttctcatccccgatcaaaggtttatcatcagattcgcaatactttttaaaaaagaatgatcaagatgcagagtcagcactttgtttcaataagatagatagtgattctctaaattttctgttggagaaaaagctcagagaactaacctctaagatggagtcatcttgcagtagtctgacccaagaagaagagtcttcgggttccattacaaaggattgggtgaatgggacaagatcattgccgtcagatgatcaggataacggtttatcagaaagcgaatctgattctgactatagtagttcattctacaaaaagaaaatattccaggttagttagtcatatggcaaattcctttctccgcacaaggatatgtctacttttagtagcttatcaatgttctataattcgctatatatgtttccgtaaggttttctgactccactgacctttgaaaatttcatattttctatgacgcaggcagaagatgatgaggaagttaacagtttcagcactgccgaaaatctccaaatctcctgcagcacgagtttctcaagttcacgcaatgattatcaccataacattgaagaaaccgaactctcagaatctgttgctttatcagaagctgaagaaggtcatgactgggagctcgagtacataacggagatcattgcctctggccaactgatgattaaagaattctccttggggatggctactgatatattacctctgagcttattcgatgaaaccgaaggcaagagagatgctcggggaaagatcgagagaaaaacactgtttgacttggtgaatcagtggttaacactcaaatgcgagcagatgttcatgggaacctgcaaaggagtgttggggaaacaagacatttttcttgaaaggagagagattttggcagaccaagtgttgaaagaggctcagggattgaagaagatgagagagatgatgatggatgagctagttgacaatgacatgagtagttgtgaagggaaatggcttgattacatgagagagacttacgaagaaggaattgagattgaagaagagattgtgtccgaattagttgatgacttaattaatgatcttatcatgtgttgttgacaccaatcctttggtcttcttctctccaacatgagagtgaaattgttttctataggataaaaacaagattaggctgaactaaattctgtcacaggctgaactaaatttttatctctgaaatcgaaaatacttaaaagtcttctgatagcacatgaacataaaagtgtcttatactaaaaataaaaaaagatggggtgttccgagaatcgaactcgggacctcgcgcacccgaagcgcgaatcataccactagaccaaacacccgatttgttaaatcgatagaggtaaacatatttatacggataacatatcaccaccgtctttatagggagagactctagttgtttgttcatcggagacggaagaaaattcgaatcatcagtgtttgtttcctcctctcttaaagcttagcccttctcaggtcattgttcttca

SEQ ID NO: 10244 - DNA, 3000 bp, Unknown
  misc_feature (1)..( 3000): cDNA_ID_2715288_gDNA_ID_2213639_Annot_ID_132219 3000 nt of promoter + ATG
cttctattgacttcattttaatacacaaaatatctctctctctctcaggttaaggagaagactatagctgcaagacggagtcagatcaagacaataatattcccggaagcaaatcggagagactttgaggagcttgcggaaaacatgaaagaagggcttgatgttcacttcgtggatgaatatgagaagatattcgatctagcattcaattatgaccattagaagaaatatgagaagtttctcacttgggatcttcctctattgttgttttcattttatcatcgattcttagttctgtaggctgatcttcttcttctaactctcattacctcaaaatgaaatgttccatcatccgtcgtgtgtaccttcagctaccctccaaatcttcgtaatttacaaaaacacaactgtcttgttactgctaaatatgtacaacattttaaattaaaattggtaaatttcctttttaagggtatcttgaagtaaggttatagcatgatcataagatttctaaaaacaatagttctctctgcagcaacagtttagggaaaggattaagcctaataagctaaaaatcccaaaacgtgtattgcaagttattgatgaagagcttacgaaactggaggtttttaagaccggtaacgactttactatcgctcgcaactaccttgagtggttgaccgtattcccctggggaaattacaggttttgctgatttggttcaaatcatatacactatgctcatgtgcttgaagaagtatcatgaaaattatttgtaaaatttgattaatgttggttgcagtggtgagaattgtgatgtcatgactgcagaaaagattcttgacgaggatcattatggcttatctaatgtgaaagaaagaataatagaacacattgctgttgaaaaacttagaggcactccacaaggttggtctctctatatactgtttcttgattctatatagaaaaatcatgtccttagaattgagttactaatggaagataatttgtcttgcgggtcctcccggggttggtaagactagcattgctcattctattgcgcgtgctcttcaccgtaatttctttcaattctctgttggagggctatctactgctggctaacattaaggtgattaactacgtaattgcgtaatcaatgttgaataaaaaaaatggaataaagaagaagatgttaatctcttgtatttggagaaaaccgtacgaaaagattgtggcattaagcctgaagaggtctaactcgcaaaaccagatatatttacctttcattttctgatgtttgactcaataatttaacataagtgacttcttatgctcagagtgctcttaaactagtacgagaagatacatctgaagtttgaactttgaagtcaaaacaaaatgttaaaattactttcttttttttttctttttttcttcttcttaaattaaatgcataaatcgaccttcattgcttcgttttactaaaggttttgtgaaatcttgaagatgtgacataaaatggagaaaaaacaaggatagaaaagggtccaatgaagattgacatctttagattacttttgttttggtatagatctttcgcttaactttatatcgaaatccatcattagcacaaaatctgataacgatcacaaaagcctcatcacgccatcttaaaatcaatcaaattccaaattctttatcttattttacaatttttaattcgttttgaacgtatatatcaaaaggatagatatcacatatcttgtgtgtggtacggtagcgaatctagagatgcatgaatcatactaacctataagatggaaagagtcacaattatttaatattccataaatggaaagccataagaaaaaggcaatacagaccgtaccctacaaagatttcaggcacacacatgctctatgcttgccacatccatatatgtatttgtacgtaccattgacaaaagagaaaatcacgtgcgaatttcagtgttatatattatctcaaaacaaaaaaatagagtttgtgtgtgtgtgtattaaaaagttgtaccaaccccatcaaagtgtgtgaaatgcctaacaagccaaaagatgtgacaggctgacgttgatggtggagtcgatctttcgctttatttttagacttatgagtggataaccaatcaaaaatgtgtaaataaactattcaatctagtgaagtagtggtcataaatctcacaaggaactaaatagtaagaccatatatacaattatgttgtggtttttgtttctatttgggctgaatgaagcaaaaacaattaaatagcaaaaccattacaagaaaaaggtattgtctcgtttgaattttactagctttctttgatgatacacattagtacattacacacaacacaacacaacacacggtattgatgtttatctgcacctaatggactaattacgtcgtatcacatttcagattttctcacgtcatccgccataagcgaatatttataaaggtgactctagaatgattatacaatcacattaatctaatttataatgattgcatggtcttttgtagtgtaaagtaaacaaaaaaagttggaaatctaggtgatgcacgcgtggtgatggcttggaacaatatactcgaattgagttctttcttaattttaatatgtaagttttaagaacaaataagaaaatgttatttcttttttaaaattatatgactcaattggccacatctattttttttttgttacgatccaataaatagtttgatattataattaaaaatgataataattgaataatatgatgatgtaaattacgtcaaccatttgattatctggactttgacgggcggtaacctaaatacaaatactaaaaaccctaaacaaaattatagttaaaaaaacgtggtatatatattctgttagcgaggcaaatctgaatacgcagtgataaagaaaagcttaagcaacaaaaagaaaatagataagtatttgatatg

SEQ ID NO: 10245 - DNA, 3000 bp, Unknown
  misc_feature (1)..( 3000): cDNA_ID_1022005_gDNA_ID_2213639_Annot_ID_181151 3000 nt of promoter + ATG
cacgaccttggatcagatttacaccaagaacggcttaaatgtgaaacctttagttgtcgagaggttaaaaagagatgagaaagatgaagaggcggtcaatgaagatgaagaaggcgtaaagagagatggtttcgagggtgttaagtgtaatgacgtcgaggaagaggcatggagattgctgagggattcaatagtgacatactgcgattctcctgtaggaacggtggctgctaaagatccaactgatacaacgccatcaaactacgatcaggtctttattagggattttgtaccttcggctttggcttttctcctgaagggagaaagcgaaattgttcgaaacttccttctccacacgttgcagttgcaggtattgatgcccattcgcgatgttatacactgaaacgaacacaaaatgttgtttaaaagcaaagagtttgcatttaaatgaaaggataactaagaattttttttactgcaagttaaacatttaagtaaaatcaaagatatgaaaattagtgttgttgtctgtgttgtggttccagagttgggagaaaacagttgattgttatagtccaggacaagggttaatgcctgcgagtttcaaagtcagaactttaccgcttgaagaggacaagttcgaagaggttctggatccagattttggcgaagcagctataggtcgtgttgctcccgttgattctggtcagtacttttctgcttcttcaatctgcattttccataaatagagtaagaaaagattgtattgttgattcattgtcatacataattgttgattctttcagcttggcaacatataattgaacagtttaattcacacatgctggtctaaatagaaaattttcaggtttatggtggataatcttgttgagggcatacgggaaaatcacaggagattactcgcttcaagagaggatagatgtgcagacagggataaagatgattgcaaacctgtgtttagcagatgggtttgatatgtttcccacactgttggtcactgatggctcttgtatgatagatcgacgtatgggtatccacggtcaccctcttgagatccaagtaactcccaaatataaggttttcttacttataatctttaaaaagaaaagtttgactaacatgccatgacggttctgttggcacaggctttgttctattccgctctacggtcttctcgtgagatgataactgtaaatgatagctccaaaaatataataaagacaattagcaacaggctcagcgcattatcatttcacatcagagaaaactattgggttgacaaaaacaaaatcaatgaaatttaccgttacaagacagaggagtactctatggacgccaccaacaagttcaatatctacccggaacaggtttctccatggctaatggattgggttcctgaaagtcctgactctggattcctgataggaaacctccagcctgctcacatggatttcaggttcttcaccttgggaaacctctggtcaatcatctcctcactaggaacaccaaaacagaaccaagctatattaaatttggttgaagagaaatgggacgatctcgttgggcatatgccgcttaagatatgttacccggctttagaatcttcagagtggcatataataaccgggagtgacccaaagaacacgtgagttttcttctcttccgctttgatactttttgctgaagtagcttacagtgatattttctacatgtatgtgttctgtaggccttggtcttaccacaatggtgggtcatggccaacacttctctggcaagtaagtatgagcttttaatcagacgacacatatatctgtcttccattaattcacatatgtatttaaatttttgttagttcacactagcatgcatcaagatgggtagaccagagttagcagagaaagcagtaaccttggcagagaagaggctccaagctgatcgatggccagagtactacgatacaagagacgggaagttcattggaaaacagtccaggctttaccagacatggacaattgctggtttcttaacttcaaaacagctattgcagaatcctgaaatagcatcatccttgttctgggaagaagatcttgagcttctagagtcttgcgtctgcgttctcaccaaatcaggccggaagaaatgttcacgagccgcagcaaagtctcagattcttatataaattggttttgtccagaaaacagacataggataacaacttcctgttgcaacaaatgtgttatacaggttaaccaaattaatagtgcaacaacatctgtatatatatactatatagtagttcttttctacaaattatgtcatatctctgacttacttccctaaccagatgaaacataactaaaaatcaaatttattattattactaacttgaaaaccaagcaagagtgagtacttagtgctgcacttaatctccctaatgggcatggctaatgataatccaacgagaaataagtttagcaggattcttaaaccatgtcatcagtttcaacagaaatctgcaattaaaacttaaataaactcctcttagagctttgttttcagcgagttggagaaagcttactctcatgagtatttcctcgaacactttgcaagcagattctgccaccattttttttcttaccaaacaactaaaaaggtatttgaaaccataatatactcgtcttcgagatcttcttgtatgcatgaaccgcttcctccgcttcagcaggaaactgaatagcattccacaaaactgaatcccatacaggaattttgacaaacactttgcgagcgtataaaaagttcttattttctcaaaatagtgggttaatgggctaggcccattcataaatctaataattgagagaagtattgatttatttcccacaggaacgacaccgtatcgcatcctcatttaagaaaaacccaaacggccaaatccaggttttggctcagacgaccagaggaagagcaccgacgatg

SEQ ID NO: 10246 - DNA, 3000 bp, Unknown
  misc_feature (1)..( 3000): cDNA_ID_2715284_gDNA_ID_2213639_Annot_ID_132220 3000 nt of promoter + ATG
tgccatttgtttcatgcttatgtcttgaagagagttatatataacagcatttgtaattcatttttttgtgcattgattgacaaatctcatttataatcatattaatttgatttgcagtgatgagaattttaatgtcctacgggcagaaaagattcttgacgaggatcattacggattatctgatgtaaaagaaagaatactagagtttattgctgtgggaggacttagaggcacttcacaaggtcgtatttttgcctttctagttcaatcttctttgctaaaactttttgtcctcatcattttataatttctgaaggtgaaaatttgtcaacagggaagatcatttgtctctctggcccaactggagtaggtaaaactagcattgggcgttcaattgcacgtgctcttgaccgcaagttcttccggttctctgttggaggactatccgatgttgctgagattaaggtatacacatgacaaaactatgattgaaatctgtagaaataataacatatcatcttatacattgtttaggggcatcgtcgaacgtatattggtgccatgcctggaaagatggtgcagtgtctaaagaatgtgggaacagaaaatcctcttgttctgatcgatgagattgataaggtagctagcttgttagtatttgaactggctttttggagtttgtagtcaaaatgaattagtttcgtttctttgttaaagcttgaaattctttgcaataagtgtctatggttccttggcagcttggagttaggggccaccatggcgacccagccagtgcaatgttggagcttttggatccagagcagaatgcaaattttctagaccactatctcgatgttcctattgacttatccaaggttttcattgccattttttcttctctttacatttttcatttgcaattttctttctttgtgatccaccaaattgaaggaaaaccggaagccattgatccgatctgagtattggtttcataataggaagtttgtgttggaacttaggtctaattaaatttcttgcaggttttatttgtatgcacagcaaacgtgacagataccattccgggtcctctgctagacagaatggaggtgatcactctctcagggtacattactgatgagaaaatgcatatcgctagagactatttggagaaaaccgcacgcagagattgtggcattaagcctgaacaggtctcactcacaactatttgctgttttctttattttattacggtttgaatgttataaaagattttgctcaagttgtttgtacctctttccaggttgatgtgagcgatgcagcttttctttccttgatagaacattactgcagagaagcaggagttagaaatctccagaagcagattgagaagatttttcgtaaggtaagtttgtttacaagtacactgaacattccaaacttcttacttggaccccgaggatctgaattgattgattttcttacagattgctcttaaacttgttcgcaaagcggcatccaccgaagtgcctagaatttctgatgatgttactactgacactgaagaaactaaatctttggccaagactgatttggaatctccagagacctctgcagaaggatccactgtgttgacagatgagttggcaactggggatccaacagaatcaacgactgagcagagcggagaggtagctgaaacggttgaaaagtatatgattgatgaatcaaacctttcagattatgtaggcaagccagtattccaggaagagaagatatatgagcagacaccagtcggggttgtaatgggtctagcttggacatccatggggggctcaacattgtacatagagacaacctttgtagaagaaggagaaggcaaaggtggtcttcatataacgggtcggcttggggatgtgatgaaagaaagcgcagagatagctcacacagtcgcgagaagaataatgctggagaaagaacccgagaacaagttgtttgcgaattccaagcttcatctacatgtacctgcaggagccacaccaaaagacggcccaagcgcaggctgcaccatgataacttcattgctatcacttgccttgaagaagcctgtaaggaaggatcttgcaatgactggagaagtcactttgaccggtagaatccttgcgattggcggcgtaagtgaaaattcacaccacaataactctgttttagcttcttagttaccaaattcttgtattaagcagtgtaatacagaaaatatctcttaatatcgctttgtcaggtgaaagagaagactatagctgcaagacggagtcaagtgaaggtgataatattccctgaggctaaccggagagattttgatgagctggcgagaaacgtgaaagaagggctcgaagttcatttcgtggatgaatatgagcagattttcgagctagcctttggctatgaccattagagaagtctttaggctgattttctatctcttcttgattgatttcaccattattattgatgtattatatatgtcctttctgtaatattatattaactagtgtaatttatatacgtatatatgcggttggatttaaggttttcgttatttcgaactttattgtaactggcttccgtgaattgaaaagtaaacattcgaatgaaacaaagaaaagaaagagagacaaaattaaaactccaaattcttccattatccaaaacaaacaagtccaaattctttattttcttcaaagtttccttatcttcttaattattgctaacaaggataataaaaaaaaattgtttatttttccagttttataattaataggataaaaataaagaaattcttagaaaatatctttgcatataaatacaagtctgtagaatgaatctcaaaaggacaagacagaaagaaagaaatctaatctcgtagttcgtaagacttgtcgactataataaggatgataaacgaaggtatttagctaatcctattctgtgattgtaatcatg

SEQ ID NO: 10247 - DNA, 3000 bp, Unknown
  misc_feature (1)..( 3000): cDNA_ID_2715280_gDNA_ID_2213639_Annot_ID_132221 3000 nt of promoter + ATG
ataagacattcccacgataaaatcgtaaaagaattaattgaaacaaattcatcggcttatacactcggctataaagccgagccgagattagtagacggctgaagctccgacagaatctttgatagagctgtcatggctcggacttgcatttccaaagccgctatgtaatctgctgtctcgtccaaaagctccggtaacgccgttctccggcaacccggcaccaacccacccaaaacccggacccgatttcccaccgccgataacttcctcctcctcccacttccaccacttcccctgatcgccgcagctaatgccgacgccggtttggtattcctacgccgcctcagactcgttccgaatcgactaaccaaaatggctcggctccaccgagttgcaccacgagcggtcgtcgcaaggactttgtcggccgtgtcccggactgttgcgctccgccgcgatcgttgaagagcgtcgtagagctttagggaatataccttctgcgccgttgtggctctccatctacgactaagatgccttaccggagcttcttcagagcttacccttgatcgacgtagagcctccatcagctttggagcgaaaactctttgtcctctttgcaatctccggcgaaaggggattgttttagtcccttctacctccggtgacgtggaaggattcgatccatttccttgttcagaagacattcacaagaaatctatagaaccacacttaaacaacgttttgtttttgtttcttgttctcttggaaaatttccaagaacagttatttatagagtcagagaacaatgttgagctctttcttattttgataataattttgagtaattggaggggatatctaattctctatatataaacatttgggagagattggagaagccacccttaaatcaattattttctatattttcttgggtttttcgaattgaataccattattttttatttatttttctttaataataatgtacgtctaaaatcacattggccaattatgattgaactggtgaatgaaaaaaattcagtttgaacttaatgcatttttagattagaaaaatgattcaggaacaaaaaatatcttttcttctttcgacgtcgaacgaaaatatctatcttcgttgcaaaattagatatttgaacagatattttactcatagactaaacttgaaactttttacatatctatttatgatggtgagcggcgtaaatttgtgttatgacgtggaatatttagtttgtagatttttagttgtgaaaagaacaaaattggcgatggaatggaggagtttgatgtaataatgtggagggcaatgattggtggcaatataaccaatagatcgaacaaatagctatcaaacaaaatttaacataaagaaacaaaaaaagctaatgagttttttttttaaagaaggaacaaaaaaaaaaggaaaagaataggaaaaagagaagatgcatgtgatggtgttttatttcacgaccttcacaccttaggcttagtggttgttgtggctatttatcatccacattttttggctcaaaatctctctattttttcgaaaaaagattttcagtatttggtgttttgtgaaacatataacatgttctttatacttttcttccttttttttagaaaataataatttgatttagttgatttttttcgaaaagcatagaattgggttttggattgcactagtcaatcagtttataagtggaaaggcaagttctatatatacatactaaataacattataagttttccttaaatatttttataccatgtcaaggattataactaatctaacatctatccgtcaaaagttacttaagggttgggaaacgcatatgtttcgtatttgtttaggctagtaagaagtaagaacatacgaaaaaaaaagacaaagtattagcaaagaaattaagaaacaaaagtatccaattagcaaagaaaaacaatgcaaatgtggggtttcaagcaataaacgtgagtcatgacagagagatttgcctcctggcgtcagacacgctttgatatcctcttcttaattttttcttccttttctgtttgtttatttattattcccaaatcaaatgattagttgttatcctcattgattattttttggttatcccaattcaggacaataatattaataatgatgacaatgatttgtttcatgaacaaaatattaggtatgtgtgcacttaaattttttctatcttttttttttttttggttatagacaaatctttctgaatattctgtcaaaaacatcgatatatgttagaaatcaaacttatgaattattaaacggagccgtacattgcatgcgaaacaaagaacaacaatatggaataattagagtactaattaagttatatacacaacatcctctcttttttttttcctttcaattttcacgtttttagtatttcattttgtcaacagttatactgattagcagaaagaaacaattcttttttattttttgacataaaaaaaatacatctgcttaatttgttgtatcatcaaaccggttcagtttcactttaaccataaacaaattcctcgaaaattccaaagaagaaagatagtaccaattggtaccgtaagggctcctgaaaatgaaaacaataaaagcccaggaccaagataaagtttattacttcggcccaaaatttagctaacgaccgattttttttcaaaccggtcctggtttggtttaagactagtaataagatataaatgcaatgaaacgacatcgttggaggcagtggatgtccttttcccaaaaatacgttttcttcctttttttttttttttgtttattaattcttgggaaggggtttatgaagggcttttgacaccaccagtcttcgtctacaacattcttcactttcgtacggtttcttgcctattaggctaagcttaaccctaatttcccaaattcgctactcaagatcttcctcccccgtcatg

SEQ ID NO: 10248 - DNA, 3000 bp, Unknown
  misc_feature (1)..( 3000): cDNA_ID_2715272_gDNA_ID_2213639_Annot_ID_132224 3000 nt of promoter + ATG
atcatctcttggagactaccactaacatcaacatagacattgatacaacaatcttgaaccctgaattgtcccagaacttctgtttatcccaagactcattgttaaggttttgcttctccgatataagatctcttatctctttgatctccatgtcccttctttcccctttctgtgctccattcataacaaaacagcaacaacaataaaactgataagaacactattgattcacaaacaagaagctacacgaatgttagagttatggacttgtatacttaccctctgcagctttcttgtctggcttcgagcttcttgtaaacagaactctagcttcaataccttcttcttcaaatcttgatcagttcttctctgtttctccagctgttattgttgtttcataaagaatgaaactttcactcagaatttagacaaatcaaacacaaacgtgcaatggcctttgttcaaatggaaaaagatggatgtacctgagattcgagttccttagtcttatgtttccattgacctgacattaaccttatctcatctttcagttttgtaatctcttcgtcttttacttcaactagcctattcatcctctcaaatttcattggagacacatcttctagaagtttctggagctcgctgtccatgccacctattcccgcttttgcaatggcctcagtaacctcacgctcgattctcctaacttcttctctaagctgcttttctgagcactctctcaagctcagacctctctgtagatcatcaagctgatgaccaagctgagtcatacggtcttcttgttctctgagagaacgtgttttgtcgtcaagttgttgctttagcattgagcattggatctttgtagattgagcagaatcagcacttgcctctgcggtttgcttggttgtatcaagctttaatctaaattcctccaactctttgataaactgtttcctcaaaaacaagatacaaattaagtaagtctaactaagagtatatatcattacaataacataaatttgttaggtaacaatgcattcgaccagaaattaggactaataaatcttaagcttatatcactaatacatcaatggatcacagctaaagttgcataatttatcctctagttgaatcgaattccaaaagactcaaagagctataagatattgtctacttgatctagataggattcaagaaccatataaataactctttgaactgatcaagtatttagaagtaaattgatatagtctaataatagattggattcataattatgaagagaccaaattgatgtgtaaggataaaccttatcagcagcagatgcagaagcttcaagctgacaattcctttcttccagtctcttctgcaatttacaaatctccatttccatattctttccccttttctctgcttcctgaacaaacaaacaaacaacagaaataaaccaaatcattcatttcaatctgattcaattattacaaaacttagaaaaccagcaaccaaataatatttgaccccaccatttaattacatgaacataaggaagagaatcactcagagaataaatgggattccttcaaaaaaaaaaaagacttacttttctagtaatggtctctttaagaaaagattgttcttgagaaaccaaacggcccctcacttgcttcagctccgtagccagagacaccacgtttcgccggaaactctctttcttctcatccaaatctctcagaagtggatccaccgtcgttttttcagaataagacatccagattcggctaattcagctcttgcatggaggcaatcacaaatctcaaaactctgaagatgaggagaagaaaaaagaaaaaaaattagtttttttttttgcgggtgcatgtgaacaatggtagttgaccattaatacagagaaaattaaatgaagagtctttcacaattcaaatctatataataataatcaaaacaatgatcgtgactttacatgagctatgacttgaagcttcaaaaagaaaggtcttctaagttttcaaaatcagatctctctgattatggcatgaatctaaatttaatatctcattttctatataagtatcttacaagaacagagaaatcaaagcgaatgcattaccaataaatgagaaataaatgaattggcttatttggccagagagagagagaaagagaaggagacaacgaaaatcagaaaagtgagtttgaacttcaaaaaatcaaactttccctccaaaatcctcggcaaacacaactaggacgtgcaaaagcatttgattttaagtaaatagtaatgcacatagttatatgtgatacattttcatgtttcaaactataatataagaagaacatgtgcatcattattgttatttggtaacaaaatgttataaacgtataatacgtattaatttagtttatttattggattttggtaagttaagcttgtgattaagggacatgtgtggatgggaaaaagagacagaaagatgcaaatgtaaagctcattttaggttcggacgctcacgtggcttttacaagtggtctccccacgttcggattttggttcggagtagataaagacaaaaaccgaagccgtgttctctcgtcttttgaccaaaacgccgtaataatccgtgaaagacgatgcttgctatccgttagatctctgccacgcgtcggacactacgttgcatataaagttacacatacgatgtataaatacttgattaaaattataaacttgtacagaaataggaattttcgaaaatgaagttttggtgtattaatagaaaccataatgcttgatgcgatcaaattagcggtaaactagttccataatccacaaacattttcttcctaatacagaatttcccatttctggtatcacaaaattttcagataaataacgaacacaagaaagccttttgtaatcttaggtcttggaccctgattatgaatgccatcacttttcttggaaattcaacgatg

SEQ ID NO: 10249 - DNA, 3000 bp, Unknown
  misc_feature (1)..( 3000): cDNA_ID_2715264_gDNA_ID_2213639_Annot_ID_132226 3000 nt of promoter + ATG
tcagcttgatgatctacagagaggtctgagcttgagagagtgctcagaaaagcagcttagagaagaagttaggagaatcgagcgtgaggttactgaggccattgcaaaagcgggaataggtggcatggacagcgagctccagaaacttctagaagatgtgtctccaatgaaatttgagaggatgaataggctagttgaagtaaaagacgaagagattacaaaactgaaagatgagataaggttaatgtcaggtcaatggaaacataagactaaggaactcgaatctcaggtacatccatctttttccatttgaacaaaggccattgcacgtttgtgtttgatttgtctaaattctgagtgaaagtttcattctttatgaaacaacaataacagctggagaaacagagaagaactgatcaagatttgaagaagaaggtattgaagctagagttctgtttacaagaagctcgaagccagacaagaaagctgcagagggtaagtatacaagtccataactctaacattcgtgtagcttcttgtttgtgaatcaatagtgttcttatcagttttattgttgttgctgttttgttatgaatggagcacagaaaggggaaagaagggacatggagatcaaagagataagagatcttatatcggagaagcaaaaccttaacaatgagtcttgggataaacagaagttctgggacaattcagggttcaagattgttgtatcaatgtctatgttgatgttagtggtagtctccaagagatgatgaattttgtaatgtataaatttagttgcagatagttgatgaggataatctaactcatgtatgtgtcgtcttcaggtctaatataacagccatgtacttaacataccattagtatatgagttactctgttgacataacagccatgtactttaaatactctgtgacgttatatgtttcgtattcaattctagtataattacataaacggcggacgtatatcaaacagctcccgtagctcagttggttagagcgttggtcttatgagccgaaggtcgcgggttcgagccccgccggaagcatttttgttttgttttccacaaggcccattttgaagctcaatttcaatttaacaaagcctaactctaacatgtaaacgttttcttctcggtagatatgtttcgcattcttataaatggtcggcgaaaattttcaaaatgtttactttttttctttccttgcatctcgacacgtggccccggttcatcctgtaatctttttggaatattccgatatcatatatgtgtatgcatgtatgtatgtatatttgatttctctaattacaaaactacccctactttgtcgtgtttcttactgtccccacttcacagctttgtccaaatattcaaaatgacccatccttctttaattattaatattcggttctttctttcgattaatttaagaactaattataaactatatatatatatataaatatttggctggaaatgtgattatatttatggctgttggttgttgaactagatactcataattttatagcagacaattgtatgacatttaggaagtaattattggacctatgtaagaagttgttcatttaacaaaagcacagattagaaaaaaactgccaaaatgtgatgtaatcaataaaaaataaagttcaatttagtccatttagctaagcaactttgacattgcgagtattgacttctttatttaaaaagttaggaagaaaatggttctgcgaatgtagctactaaaaagaatcaataattcccactaaaataaatgaaaaattctttagattagagtggcataattgctaaattatttatggttaatacataatatgtcagtccaacctataacaacttagtagataaaaaaaaagcagagaagaaaaacgtttaagtaggtataaaaatacgaataaagtgggagggggggggggcaaaagaagtttgaatggtcaaaactcgaaaaagaggaaaaaccaaacccaatgtactttcaaactccaatttactaactcccaagccaacactatctaatctatccccttttttattttattttatttttagatttaattttacgatatgactgtcaacagcgcattatagcaaacgccactcttctcatcaaaaagcagagccacatacattaacattacattagcttcctcatttttattcttattattattattcatcagaccaacaacaaaaaggagataaagagaagaggattcatcatcatcaatcaatccttcattttatggatctactcatatcttgattcttccttctatctctcccttttcttccatctctttttctctgggtttccccggtatgtttcagcaatctcttttttgggtcttcttttaaattctgggtccttcaaagttttgcatacaaaaaaattgtttctttttggtattttagtctcaaatccgatttcatgttagatttttcctctgtttagatcggcctagatttgtttattggccaatatgagatagatagatttctcaatgctctgtgtttttaacatctcttatcttttgttgtttgtgttgaaatttgctatcctctatggattgttccatgatttttttcttatttaggatgctataattttaaattttttggctgtctcctgctttttttttcgtgataattgttttaaatgtctcgttaaaatccaaacttttgcatgttgatagcttcaatatgagttctgggatcacctttattgagtttcaaatctgtgtaattgcctcagttaaactgattgtcttgtaacaaccaagtaattgtaattacatatgtatggtttatgaatcaagagctaacgcttactttgcttatggttaatgttgctgcaggattgagttttttaatctctgattgacagatttgaagagcgtgacaaaggaagaatcttttattaaaacaaattcttctgttttaatcttggg

SEQ ID NO: 10250 - DNA, 3000 bp, Unknown
  misc_feature (1)..( 3000): cDNA_ID_2715260_gDNA_ID_2213639_Annot_ID_132227 3000 nt of promoter + ATG
gaaccaaatctttttctaaaaacgttgttttattatttgttttagctaaaatggaattttttcttttacatcaatttcaaacatactcttactttcttctcatttctttccgttccccaccaatcttagcaactcttgcctaactaaggccactttttagttattttccaaaacacttctcattttaagcactaaaatattcaatgaaacaattatactctttgccccaaaaaaaaacaaaacaattatactctatgtattttttccacccaagattaatgagtagctgattttttatttattttttacgaatgtgaattatctaaaagctctctcaaatcattaacgtgcgatcaaaatttaaatttattacgtagatcagctaaattcacaaagatccgtgtcattcttgagttttcaatttatgcacgaggatttgaagatttttttttttaatctttcgaaactacaatagtagtatataatacttgaaatatacgcatgatattttatagccttgcggaatataaaagttaggcgttgtagtttgtaacaataatatattgaacgtaagcgagctagctagggaactaataatcccttacacactagaatagagatgatggctacagtaaattgcaattgattacgctaaaatcatatattatatagagtaagtataagaaattctctaatatggtggggataaatgatattatataaaaccaaaccatgaaaaagtgatagaggagagcaaacagtcaaaaagaatctgttggagaataaaaagactcaatattttaacatgacaacaagagttcttcttgcttctttgtggaatatatccaacaactacaagctatccctatatataactagtaattaatatctaatatgccatcttttcataaaaattatcctaatcttctttggtaatctttcacctataaactgcaatcccacagctaagtaatccacctccaccagagctcaatgcctagtttgaccagcaaaaacgtaatttttaacatgaattgggattattatatttgttagcagaaaaaaataaagtctcatgcatctaccaatccaaaaaggttcttataatttttagacgcgatgaaaatttatataagttcactattaaacgtatgagatagtaatttgtagattcgatttaaatataaaagttaactgtgttatgttggaagggtaaaaaattctccactcaactgttctttttcatcacgtgaaccaacgtacgtgaacgatagccaacagattgttaaagcttcaacatgttgtagaatcatttccttctttttatatatatatattctcataattattgttttgtattggttcgtcgcaatgctttaagattatatagttatattagctgtaatcaattacaatgattattagtttttattttttgtcttaaacgaaacgaatccatagcataactatacccctaaaaataaaacgaatccgtagtccatattccatattccataaacatatatcgctttctggtctgattctggcgttttttctttttgatgaaatcgtaaaccattcgttttgcgtagaatgggagatacgttatttggcttttagatggcacgatgtttcgaatgaatttggagattcggcaagctttgtccatgagagtcgggcacttcaagacgacgtgtaggtgattgctgctgacctataagctcgtgatgtcatgtctaatatcaatgttgcatctatgaaccgaagtcttcttttatcaaaagaaccgaagctaaaatttacacattgtatgttgtttttgtttaccaacaaaaaaaaaaaggtatcgtgtcgtagtcttagaaatcgcgcggtttcatcttcggaaacggaaagactataactataaaaccaatttcgtgtttttgtttttgtatattttgtttagacttcaaccaatttcgtgttcttcgtgttgtgtgtttttcacccaattttttcttctataaaagaagaaaaaaaaacaaattttgccttacgtttctaatttggggataaccaatagaactcagttacacttattattttatttattttatttaataatgagagaaaaaaataaatgcgaaagaagaaaataaaaaatccaaaggccaagcatcgtcaggctcttccctcttctttctcgtgctacttccgagagaattcgatcatacaaaacttcaaattttaggattagggttccatcgttctccgtgattttgaggtaattcgatctcccattcttaaaatcagcaaaaagaaaaaacttttggttctagggttcttgctgcccaattttgtaaattttgcccaaatcctgtgattcttccgtgggagctattcgacgtcgttatcttctatttcggatgtaattttacttttgatctttacttagtattgatgtctcggtgttaggtggcagattctatctatttcgaggttatcaatcttagggtttacgaaggttaggtgttgtggaatttggatagaatcattaaaatttgaaagctttgccccttttttctagagattacctccctttttgaattcaatcttaccctttatgtattgcaatttgatgatgattgtggtttccgtgagtagtagattcaagtttcaggaactcattgcttgttggttgagttagaatctgaaagtttcaagctttttagctctgactgtgcattcattattgagatgatatagttttaccatcgattcgattggtgaaacaaaagtttcttagtgattgtgatttgtgatatcttctatgtctatccatatgcttgttatgtagctttcactggaactgagagcttagatttgttgtgtttaggtactcttacgtacaaatttagttttattacgatttgtgagaaagcattaggaaccacttgcctgcattgagcttgaaaccaaaatcaagagatttgatggttctgcttgtttcaggacatg

SEQ ID NO: 10251 - DNA, 3000 bp, Unknown
  misc_feature (1)..( 3000): cDNA_ID_1442595_gDNA_ID_2213639_Annot_ID_132235 3000 nt of promoter + ATG
acaagaatagaaaaaaagaatgggctttttctgagctaaagaaaccaaaaaaggtgaaataaacgaagaagaagaagaagcagaggaattatttgttataaaaaaggattttctaaaaagagtttcatggctggattcacggttggagttttatttagaattttaaaaattgaatcaaaccactctcttgctcttatacgacaaagacagaagagaccatcttttgtttggttagctagatcttagttcacacttaaaaacgctcagcatcatcatcaaataaagcagacaaaaacagattgtatgaattagcacatggagaaaatgggtccattggatttgatatcttattggctctatcctgatatttccatctctagattagcaattcgattggatgatgtgtataaagctgatcaacttcatgaattgttatatataaaaaaagagataactagctattctttgtgttggtgaaagaataaaaacaaattttcattttacgtcatgacttgagcataacgaaccctaataaattatgatctctcccaactctgctttaatttccactttgggcagaactcagaagcatacgtgtgaaagaaacaatacacaactagtgcagttgggaaaatcataaccctttgtttctctcagaaaccactttgatatttacgagtgatgattgttatgtaacgtctacgacacctacacatatgctagcaatcatgtgttgaaacacgatataaaacattctcctaagttcacgatataactgttttgatttctttcgacgcaatcatgtcaattaatttacacaaactactaatttaaaggaaattttaattgctttaggttttactacttaaagtagtttcatcaatatttttttggttagaggtcatgttgatagatgtcgtataggaaattcactctacaaatgcttactataagtttaggttttaactcaaaatgtttcaacaaaataaaatcatatattttttactatcctattaaaaaagagagagggtctgcctaataaagaaatgcaacaaacataagaaaagaccaagtgtgcgttgaagaacgagaaaaaatggtcttggtctcatgcacatcaccacatgttgatcttacgccgtggtcgtccacttgcctcttgtttctgaatttttgtttagttgtccctgctttttcctattttttcctgtaagaaccctaatgtttccatatgtctcatttcttgttttgcataatttaatgggctcaatgaagttaatgggcctaagagtgctacgacccaatagcacttgaagatatgtccttcaaggacttcctaagctctgttcaggtcaacatgactaactttctgcttcacaggtttatggaaattaatcaaacatttggtgttttaatttgaacttttattttctttagcatgaactcatgagacttcttgtgtcaaagaagcgactaattataaacaggggagggacaaacaacagagattcatatttgagaaaaagaaataaacaaaaaagcatgagaacatgatgaattagtattggctaaatacaggacttaacatgaaggctatggtacgcgatatatgactcaaagaatggtgcagccgcttccactttcataggtagtaacagacacaacatcacaactgttgcagtaaggtggcttgcatacatgctttggtggttcaggtgctggtggaggctttggtttttcaggctctggaggctttggtggctcaggaggttttggtggtggtccaacgctaatgatcacaggtttctgtttaatctttttcagccttgttgctacgcagaccggatccattgtccccaccacggtaagtatactatttccttcatctaatgaaatatgattcacacctgcaccaaatctcatgttcaagatgatatgttaagacttaagagcacatatttcttgagtcttttttcgttcattaccttctatctctgtgactgcttccatgattgcgctgttgcattttccacagtttatatccaccttgatctcaactttctgctcacaaccacaacaaaaactcaaacattcggtgtcggatttgaaaaggaactagtactaggatgtttaccttgacagtcatgatggattagccaagatcgagaaaaatggattaaaggaatgaagaaggaagagaagaagttattaaaaacatgtgaagacaaacagagatgacagattggaataatgttgaagcagttgaggttgtgtttggtcagtattgttaattaaataatcaagagattacaccatctacgtgcttagatgcatgtttttgtataattgaataagaggttttgggaatttgcttagttggtattcagccaccatcttatggacttacttgggacattattgtggatggaatttgtttaatcttgaaaatttatgaatatattattgagtcccatattctatctaattttgtacgttcttgaccccaaatgtttatttatttattttaatattgtatatgttatgatcatgcaaatgcatggatagagaaattccaagccggtttaaggttttggttttatttctatcccggtttggatttagctgaaccaaacaaacctcttgagttctttcaccagtaaacaaccaaaatcatcaatcatttcgagtttggtgattattagagtttgaaggtgtttttgttatggtgagtgtcatcctataaactataggctaattaatgtgtccaacaaaacaaaactctttttaaacaccaaattttaaccaacgatcagaacacctaaacctaattatggcaaaattttaaaattaacacatctatggcccctctccataattatctcttctccattggttttccattggttaaatcttctttacgtagatatataaattgagaaacaatgttaaagtattttctcaaactcatcaataacatcttacaaacaacaacaatcaaca

SEQ ID NO: 10252 - DNA, 2528 bp, Unknown
  misc_feature (1)..( 2528): cDNA_ID_2715249_gDNA_ID_2213639_Annot_ID_132236 3000 nt of promoter + ATG
ttctttctttgttcattcgcctaattagtcgtgtaaatcaaaaataggagattcaccaatgagatgtaacctttcgtacgactcttaattaataaaactcccattaaaaaataaatataactttattgtgctatatatagcgcatcattagcgtgcaatatttctcaattccttaccacaaagctaaggataaagaaaataaatagtaaatggaagggtttcttcgctttcttgtagcgaaagccatcttattggctttagcatcttcatttgtatcttgttacgacccaagtcctcttcaggacttttgtgttgccgtcgatgacgctagtggtggtaatctctctaatttactatacatactccttaatatagttcctcaataccgtactaattatgatttatgagatactatatctttactctctaacatcaattagttaaatcaataacatcaataagatcttcatctatttatcagttttcgtgaatggaaaattctgcaaagacccaaaatacgtgaaagctgaagacttttttacttccggactaaacatcgccggaaacacaataaaccgcgttggctccaacgttacaaacgttaacgttgacaaaatccctggactcaacaccctcggagtgtctcttgtccgaattgactttgccccgggaggtcaaaacccgccacacacgcacccacgagccactgagatcctcgtggttgtcgaaggaacactcttagtcggttttgtaacatcgaaccaagacaacaacagattgttctcaaaggttctttacccgggagacgttttcgtgtttcccataggaatgatacattttcaagtgaacgttgggaggacgaacgcagttgcgtttgctggtcttggtagccaaaatcccggtacaatcacaatcgcagacgccgtttttggatcgaagccttcgattatgccggagattttagcaaaagcgtttcagctggatgtgaacgtggttaaatatctcgaggcaagattttcttccaattatgatcgtcattattaacaagttaagagaatgaagggaaatgtaccaaaatatgaataaaaatataaaataaaatgtattatagcgtggtgtgagaactaaaataaaacaattaagactgtaaaaaagaaaaagaaaaaaagagatgtgtcttttatagtataactttttaaggtaaggtgcttgaacttgattacaaaattaaaaaacacaattttgctatttattaatataattatggttgaaaagctggagtacgtgattttgattaatgattttgcaatcaaaaatctaaatagaggtatatttaaaaaacacaattttggttgtatcctctctctttctacaaaatgtttatagaactaaaaaattgttctataaatttagtatgatctttttattttattattattaacgattatataaaagacataatattttgtttgcgaaatacattcctacatggcggactgatcctgtttgtgttgtgatttgatgtttttgtgtcttgtatgctgataagtttatggcaatccactcaaacttaaggtcagatagcagagaaaacaagctaaatacccacccttagatataggtagtttttttttttttttttttgtatattttgtgatataggttgtcggagctaaaaacttcaaacccacaaaagaacattcttatcgaacaattcaaaaatagaaaaattgttcttcgttggtaagaaaacttggttggtaagaattgaaatcccgatggccgacatcatttttaattgggccggttctaggcccaaaccatatatcagcccaaactctagattttactgcataatggaaattcccaggctggaacttaaatggattatataatttaattaatgataaaacatattccttaatctcgactctgctgcgttgctttatcaactgaggaattttgaatttcatatctccaaagtaatctcttttccaaggaagatcagtacaaatcttaaaacccccgatcagagtaatccggggaactatctccgccgttgaattcagtctgagggtttctccgatttcagttcgatctgtgtccgggattctctctgtgttgctttctcattgcgtttacgattcttcttcccctttcaaggtacgctcttgttggttgcgttctaatcactctcaaattccgggttttggcttcattactgcaaattttccccttttattcacttgcttcgattcaacaattgctgaaagctaatcgatagttaaatgcttttgaatcgtgaaattcgtttcggatttagggttttttttctccgctataagcttcaatccttagtccactgggattcttgagcacctcccggagaatttaggagggaattagctcttctccagatcttgcttagctcttgtacaggtacttacctttagcatttctcttgtttagagtttgacgagtttgatcagaacttagttacgaattgtctacttttgtctcccagaatg

SEQ ID NO: 10253 - DNA, 212 bp, Unknown
  misc_feature (1)..( 212): cDNA_ID_2704744_gDNA_ID_2213639_Annot_ID_181169 3000 nt of promoter + ATG
ttctttctttgttcattcgcctaattagtcgtgtaaatcaaaaataggagattcaccaatgagatgtaacctttcgtacgactcttaattaataaaactcccattaaaaaataaatataactttattgtgctatatatagcgcatcattagcgtgcaatatttctcaattccttaccacaaagctaaggataaagaaaataaatagtaaatg

SEQ ID NO: 10254 - DNA, 3000 bp, Unknown; identical to SEQ ID NO: 10251
  misc_feature (1)..( 3000): cDNA_ID_1442595_gDNA_ID_2213639_Annot_ID_181165 3000 nt of promoter + ATG

SEQ ID NO: 10255 - DNA, 3000 bp, Unknown
  misc_feature (1)..( 3000): cDNA_ID_3038800_gDNA_ID_2213639_Annot_ID_181162 3000 nt of promoter + ATG
gatttaacttgtcgttttttgttatgtactcttcaagattactttggtcgttcctgttttattgtctaggaatgtaaataaaacaaaattaatgctagttaagctcagataaacaaagttagaactagaagatgtgtatgttctgtgtcggtagaaaaacaataaaaacaaaatatttgaatttagatatgtttgggcctttacacgtttgtgtgtgtgtgtttgttcacagtttgtttggatggaacattgcctggatatcacttgcaccgtggacatggatctggagctaatagctggctcattcaattggaggtttagtgaattatttgttgtcgatgaaacactagttaaagtcttcattgttgatgtttgatgtttttgtatcagggaggaggatggtgcaacaacatcaggacctgtgtatacaggaagactactcgacgtggttcctctaattatatggagaaacagcttcagtttacaggaatactgagtgacaaagctcaagaaaatcctggtttgtctcaatctttgtttaagttttgttcatgttagtgtaatgttaatattgaaaatcatatattctcattgtcatgtgctttacttctgcagactttttcaactggaatagagttaagcttcgttactgcgatggcgcttctttcagtggagatggccagaatcaggttgaaatcaatcattttttgagttactagagttcataagagacccattgttgtgatttggaacaacttgctagtttctaggcctttggaactctgtagtctataatcgtcaaggctgttattagccacagagaacgcttgatgtgatcttagttctgtagaattgagcagccattggttttgtgtaacatctgtgaactaatgcaaataaaattctttaccttaactttttcaggctgcacaacttcagtttagaggagagcgtatctggagagccgcaatagatgatttgaaggcgaatggaatgcgatacgccaatcaggttttgacacttaaccttctataagagtctgtatctcttccatagcataatatcaagggcaggaatggatttaactatttatattctgtcaggcacttctctccggatgctctgctggtggtttagcagcaatcttgcgctgcgatgagtttaggaacttattccctggatcaaccaaagtcaagtgcttgagtgatgcaggcttgttcttggacacgttagtttatttctcccaagtcaaagattgtattaaagctagttcattttcccttaccttagtaactactactgactcctttgtttctgtaattatagtgccgatgtttcaggcggccgcacaatcaggaacttatacaatggtgtcgtagaattgcaggttggattcctctttcttcacttgaaagtttcttactttacatttaaagagcacaagaaacttaagaaatcttcttcacaatttacagagtgtgaagaacaatcttccacgtatatgcacaaaccatcttgatccaacctcggtatcttatcttttgttctctcattctgatgctgttgcaaaccggtcattcgaagtcttgtgttttgataactcatatatctgtacagtgtttcttcccacaaaatctgatcagtcaaatgaaaactccactttttatcgtcaacgcagcatatgatacatggcaggttatgttttttctccctttgaaaagtgccacattgctactaaagaacagaaagttgatggttaggctgacaagtctctgtaatggtttttaaacagattcaaagcagtatagctccaacatcagctgatcctagtggattttggcatgactgcagactaaaccatggaaaatgtactcctgcacagttgagattcttgcaaggttgttctatagatcataaaaacttgtggacttcaccctttaaagcatcattgtatcactctaatcgtttaatcttttattcgagaacaggattcagggaacagatgcttagagtagtcaagggcttctcaatgtctagacagaatggattgttcatcaattcttgctttgctcactgccaaaccgagagacaagatacttggtttgccgatgattctcctgttatcaggaaaaaggtaaaacctcactcaaatctttcccacacaaacaaagtaacacacaaggaaagcctgtttccactttctagatcttgactttgtctatggaatgtttgtaggcggtggcaatagctgtaggagattggtatttcgatagagcggaagtgaagttagtcgattgcccatacccgtgtgacaagagctgccacaacttggtgttcagatgattgtttgactatgttctttattctctctcatatatacataccttagaaaatttctttctttcaaaaggaaagattttgtatcctttggtagtaaccaatgcctcattggtatatgattaagtgtatcgtggaaaatcataataaaaaaacaaaacaaaacaaagtttgcttaaaaagagttcaatgtaatcaatcacagagaaatgctctttcttttgttttgttttctaattttctttgcaaatgcaagtagttgatcaaatatattagaaatgtcaacattggtaccaaaagaattcaagcctaactaattcttttatgtattataagtgtccaacaaaagcagataatggataagaataataataaaatagtaaaagatagagagaaagtgaaaagagtaagaatatacagagtgtgttgacaacttgacaccctgtttttgtggggggtgtgagtgacagctatctagtgttccccactttgtgtgtgtatatgtgtgagtgttttttttacacctatcatttgctttcaatttctcccagtcaaaatactaacttcttcaacaacttctggaataataatctgaattcttgaagttgaaccctgtccattacttttctccttcttctcctgccttctgaatcttcttccatg

SEQ ID NO: 10256 - DNA, 3000 bp, Unknown; identical to SEQ ID NO: 10250
  misc_feature (1)..( 3000): cDNA_ID_2715260_gDNA_ID_2213639_Annot_ID_181155 3000 nt of promoter + ATG

SEQ ID NO: 10257 - DNA, 3000 bp, Unknown; identical to SEQ ID NO: 10249
  misc_feature (1)..( 3000): cDNA_ID_2715264_gDNA_ID_2213639_Annot_ID_181154 3000 nt of promoter + ATG

SEQ ID NO: 10258 - DNA, 3000 bp, Unknown; identical to SEQ ID NO: 10248
  misc_feature (1)..( 3000): cDNA_ID_2715272_gDNA_ID_2213639_Annot_ID_181152 3000 nt of promoter + ATG

SEQ ID NO: 10259 - DNA, 212 bp, Unknown; identical to SEQ ID NO: 10253
  misc_feature (1)..( 212): cDNA_ID_2704744_gDNA_ID_2213639_Annot_ID_132237 3000 nt of promoter + ATG

SEQ ID NO: 10260 - DNA, 2487 bp, Unknown
  misc_feature (1)..( 2487): cDNA_ID_2715382_gDNA_ID_2213640_Annot_ID_132238 3000 nt of promoter + ATG
aagctttgtcacttgacggaggtttatcactttcacgatatgatagaaatgctggttggatgcggttataagaaggggactacattattcggttatggttacgatttccgtcaaagcaataggtgatttgctaaacttctctgctatttacctgaattcctagttctcgagatcatttgcttatataatctcttgcaggatcgatctacttatactaggtctgaagaagaagctggaaactgcatataaacgttcaggggggagaaaagtcactatcatctcccattcaatgggaggacttatggtttcatgtttcatgtatctccatccggaggtattataatctccaacctttatgatcttcgacagattctagctgaagtttagagtttccccttattcaaacagaataatgagtgagactcttttttttcttgttggcaggcattttccaagtatgtaaataaatggattacaattgcaacacctttccaaggtgatacggtttatctatttgcaaaaaattgttcataagagaaatagctggtttcattggaaatgacttggatttggtaaacaggagcaccagggtgcatcaatgattcaatcttgactggagtgcaatttgtggaagggttagaaagtttcttttttgtgtcacgttggacgatgcaccaactggtaataaacctcatagtttcgggtttacttgcatcactttttttctttttgaagttacatcaaagctttagatttttatttcagggtccatgaaactcttgtttttactgatgaatctgtttttaatgtttggttttagttggtcgaatgcccatctatatatgagatgatggcaaatccagactttaagtggaaaaagcaaccagagattcgagtttggcgtaagaaatctgaaaacgacgttgatacttctgtagaactggaatcatttggcttaatcgagagtattgatctattcaacgatgcattaaaaaataacgaggtagcaaactaaacatactcagcttttgtttctcgtttccattggcttgagatgttatttggtcagtggatttataatcaaacatcttattatgtattgtagctaagctatggtgggaataaaatagctttgccctttaactttgctatcctcgactgggctgctaagacaagagaaattctcaacaaagcgcaacttcctgatggagtgtccttctataacatatatggagtgtcacttaatacaccctttgatgtttggtatgcaccactattcatcgctcctatattgcctgaggctttttttgtggattggtttatgaggagtattctcttgaatcatccaaactaagtttcttggtcgattccaaatgtctttgccacattaaaaaagctgttttgtttttcttttgcagttatggcacagagacttctccgatagacgatttgtctgaaatatgtcaaactatggtgagtgaaatatgactcttcttgaggaaaatgctttagacccttttaaatcctgaaacttgctgttctctacccagccttcgatttgttatctcttggcattccttcacttacaattatactttcatgtttgattaaaaagtctctgcaactttgtatcatgtttcagcctgagtatacatatgtagatggagatggaactgtccctgctgaatcagctgcagtaagctatactttcttgtttataccgatatgagttctcggttttcatgaagcaaatctgttactggttctcttgtgcacttgtttggaccttaacaaaacccttacgtttttacctttttattgcaggctgctcagtttaaagcagttgctagcgtaggagtttcgggtagccaccgcgggcttctccgtgatgaaagagtgtttgagctcattcaacaatggttaggagttgagcccaagaaggctaaacggaagcatttaaggactcacaaagtagttgattctggttaagtccaaagcctagtaaactaaaagatcttgtttgaataagttaaaatgaagaaatcgttattcaaagtgtggttgtaattatttctgctatttttattgtacgttgtgacatatgtatgtgcatgaaattgtagtagaaagaaaagtaatctcatcaaaaattaattgggagaagaataaaaactagtgatcataccttttttgcctttgtttctgagaacaataacaacaaatgttctacacgaaatcatcttctttgcttaaacatgcaaaatcactctcttgatttctgtttcttgagtttgtaaatcatagtaggctttgatactctcacacactttacatacaggtataccattctttcgtagttgtaacgaaagaaaataatttaatgaattaaaaaataataaaaatgtagactttcgtcaaaacgatttgcaaattacacaattctgagaggttccttcatctgcaaatgctactactgattcggtgatg

SEQ ID NO: 10261 - DNA, 3000 bp, Unknown
  misc_feature (1)..( 3000): cDNA_ID_1009053_gDNA_ID_2213640_Annot_ID_132241 3000 nt of promoter + ATG
ataggattttgttgaattagggcacatgatcttcagctatcgtctccaactgtggtttcttagatttcgaaacagagatccgatgaataaactctgccgccgagaactcttctatgtcttcaagattcagcttcggtccgatcagcctcacgtcatcattatcttcattttccggagacactctcctatgaccgcagtttttcgtgcgtttctttccggtgaggtagagcctagccatgtcggaagcgttggctgcagaagtggcacgtgtcatcggaaatgcgacgtacacatgacagcctccaagatcaagatcgtcgtcggcggcgagtgggataaatttacggcctactttcaccgacttggtgtcgacgaggaaatagcttggcatctccatcatgagctcggctgctttcgtcggcacgtggatgtcacgcactccaccgtcagggagaatcacttttgccaacggtgacgatgacgttttgtttagagcgcatgaaacgtagttgcccattgttattgtgttttttactagctatatcaagaaatcgaaagattttacgagtgaagttaaaattaattttggattttgagaagatggaagaagacaaacggaagcttaatatagaaaacgagtggaaattttatgcattataatagaaaataataatagtagtataaaatatagtgaagatggacagcgttgcagatagaggttgacattagatagttgaatccgcgtcttagcatataatatcattaagccgtgttttcagaaatctatggacattatttattttcagtttaacccgcataaaaaggtaatgattaagagatgataatgaagtcgatttcataatgttaaaactaaatttgacatttgtagtgttagtatacttggtttttctgatggtgtcgaatattacttcaaatattttgataaatttatggaaaaaaaattaacattattttcatctaaccaaaataatttggataataaaaagaatgcaaaaagtcaaaagctcaaaattattttcaattagaagaaagttatttttttaatgtgttgagtcaacgtagcttacccattttacacatcgtgaagagacggtgacagtattaataattttgttgtattaactaatataaagttccctaatatttaggggtccaaagtgtgaagggaaaggacgcacaaattattgtactacattattagtttaaccaaaatcaaatattatttatatagtattcgcttactcttccagttgttatcgcaaaatttaaatcacgtgtgggatccacggtcacttcttaagacacctgtgttttcggtttattgagttcaatgacgcgacggttccgttgtctatgggatcggactgttcttgttgcttcaaggcctaaccttttctttcagctaatgtatttcaaatttgattcctaaattcaaatttgaatgtaaacgggatacttgtgcttcttctactctaaagccatcatagctttttcataaatgaggacaaatttacccaaaacacctcctgttacaaattcgtataagtttgatactataattttttgtaaacaactcgtaagtcgtatataaaccatttaaacttcgcttgaaaaatcagagtaagctagtccaatttaaacgatatttaagcactagaatcataacggaaagatctttttatattgttagtgtaactaaaagatcttcttctagcgaaaattattatttcctttttatttcttgtatatttacaaaactctgaaacccgttagaggcttcaccaagattcaagcatcaaagccactatatatatatcactcacacttgttaattaattatcagtatttgtttcttcatcatgatgaaaccattttctctagtactcgttcttgtcctctcatcatctttagcaagtgcaaccgcatcctccttattctcgcctccacttccattttcgctctcttccatcttcggtgggattatcggtaacagtgataatagcgagttagctaggatgtgttttccagacctaggagacggagaagcctgcgtggcggaaatcttcggttcattctttagtcctcaaattacgataggaccagaatgttgcaaggccattgttgagatcgacgaagactgtgctcaagccatttttaaaccactcagcaattctttctttagtagttctgtcaagcagtattgcacttacatcaatagttgattgaattttctttaggtttactttagtgcttgttttgtttaatgtcttttatttgtttcttgttttctatgttttatcaacactcaacagtaacttcattttaataagtttaaacaaaattttgaattggaataatatttcaccgaaggtgttggtacgtgttccatcaatcaatgaataaaaaaaaataagccaataaaggaagaaaagttgaagaatcaaattcgcctttgctgaaagttgacaaagaatattacttttcttggagagcaagtgagataaagagaattcactaatactctacgtgtgcaaatacatatcttgaatcttctatggctttcatcagtacacaatttaagatttcgactaaaagaaaaccaaaatgtattcgctcacatcactttaaaatcatgttttcaatatcaagtatattaaataattcttttcaaactatatgaggttactgaaatgttatgcacacaaaagaaataaaaagacaaaactattcaaaagaaatgactagtcattaatactctcagtaacaaagaattttaagaaaagaagcgagagagagagacctagtagtttcaagaatctccccatagaagaaaaagacaatcattaaatatctcgaattctgtgtgcgccaataatattctccaaagtctaaaccatcaaaccggttattatatacatataaattagactaccgtaatcaatttctacttagagatcatcgagagggcaagagagaaaa

SEQ ID NO: 10262 - DNA, 3000 bp, Unknown
  misc_feature (1)..( 3000): cDNA_ID_2715371_gDNA_ID_2213640_Annot_ID_132242 3000 nt of promoter + ATG
gttgttgttgtaggatcttgctgggtagtgtgagcaatcatgtggtgacaaatgcaacatgtcctgtcacagttgttaaggctaattaaagtgtctcttgttctttaattggacccagttaataacattagtagttacgtgtgtcactcatgcattgttttgacatttatacgtttgttgccttctacaaatttgtgtgaaactgattggtactgtttcattaataaatttcagttaaatgatatttactctctttttgtttgtgatttgtgaacgttacgtaaaaatcacaaaaaaaaataattagtttttctaattcattcatgaaaaatcttcgtggactaaacaaaaaagatgtgaaaaaacaatccccatgtttgatccagattaattcgatccgttaatcaaaagatggtcttaatgagcataattcggggataaagtcgaatatagaaatagttgttgaaaagagaaatgtttggattgaatcttgtcagcttgatgtgtggttgatcacatgaccaatctatgtatggaatatggatgtcgtgtgtgctgattcattcagatatgacaagtggtggatgggataattcacgatatgggccagattatgagtttgttttaacttgaatggcaggccgaatcataatggattcatgatcattatgtttgatcatagcctagttggacttgtatccctagatcatgatcaaagtgggcttataaacatggccgagatgggtagttctaaatcaatttgttggatcagaagaaatcaagaaagagacagtcgttggagcttttctgatctgcttttggatgatcacccattagattgaaaattaaatttttcattctccgctcgatggctgatttgtaaacttgttccttcatgatagaaatttatgggctaaatacagaaagtgaacgttagaatttggttttgggtagaagaacaactatcatatgattaaagattaatcagatgatctaaagatagttttggtgagtacagttcggaaatatagccgttgatgcatgatgtgtgactttcaaaaatagaaatagccgttggatttaaatttaaggtcaatgaacaactgtcagatatgcttaaaattaatctaatgatccaagaatggttttggtcaatacttcgagtatatatagttgctggtacgtgatatgtgaccttgcttcaaatataaaacgagccgttgaattttaaatttgggtggatgaacaacgtactgtcaggtatgatgattaagattaattcaatgatccaaaatccaaatattgtttcggtagacggtggtacttaattagtgagactttcaaatattaaaaagagatgttgaatttaaattttagtttgctcaaaagaaaaagtttctagtaaaaacaaaacaaattatgtttaattaaggtatgtaatatggttatgcataagactagtgttgatgagatgattcacgatgtcgtatggattggattatgagtattcttaaactcgaatgggttgccaaatcataatggcctcattaatttattgtactaaactgaattataatatatgttcttgagcgaaaaaaatccataatttataatttcctatctagctatattggattgatccggctgttgacaatctggtcctgatttgaatcggtttctcgaatcatgcaccgtaatcgtagtctagccatttaggattgtatcactaacagtagtgtcactttaaaatgttggagatttagactatgaatagtaatataaaccgcacccaaaaccgcactgcaacaggtaacagtatcaaaatctctctctatatatatgtattttcgttactatttgaaccgcaccgcacttctcccacaccgcaaaacgcagtcatcattcggacccttaagacaaaaataataataacaatttatatagaattttaccaaaattgatgtcaaaaagagaattttttattattattttaaaacctaaaaactaatacaatatagagacgtaagaaaaatgccatcttttttctttcctcatgctacacacctttagatcaatgtttcctatagattttacaatttttctttccacattactaatttgagtatttgcaatctgttgaataagttgtcattgttcttaaaaaggtacttttcaataaattgtcatttctatctatataatcagtgatatctttccattctcttattttataaataagttagcataagaaaatatataggactaaaaccatttaattaatatttaaaacactaattatgaatttgtttaattttttactaaaaatttatctgattagcacaagctttttgtaataaagtttacaaacctttttgtttgtacaatagacatttagctagatatcaaaatttaacatataaacaatagaaaacatttatgacaaaaaacaatttagaaaacatatcaaaaagcctaattgacacttgacattgttgaaactattgatttaacacattgtattttcatattatatataaatttatattcacctttcaaaaatacatttaataattataaactaaataaaaaatgtttgtttgacttgttttatttcagccttaaaaataaatcgaccaataatatttagaaagaaaatcttatctcaataatttaagttttgcttagatttaatttatttgttcacctcaatgcattttatacaaaacaaatattttatatttaatacatatgtgaattaaatattaccttttaacaaataatgtaattaatatcttttaacaaataattttacccactcaaatagtaatatctatatttccccccttcttccctttttatgaattaatgtatattttaaaaaaatatccttaagaccaccctttttcccctataaatactgattaacttgtgccttaacaaaaacaaaaaattattcgcaaacacaaaaaaaattgttagtgaagaacaaaatggataata

SEQ ID NO: 10263 - DNA, 3000 bp, Unknown
  misc_feature (1)..( 3000): cDNA_ID_2715367_gDNA_ID_2213640_Annot_ID_132243 3000 nt of promoter + ATG
tttttgtatcacttgagttgagtggtatgattgtatcattttgaatttacgagtcaaaaattgaatttacaaacaaattttttctgtttaactaaaaaaaataaaactaaacactagtcaatgttttcttcgatttctataaaatggattaggaaaaaattgcgagtcaaaatttggttgacaaataaacggaagtattttttccccaaaataagtgaatgtactggcacaagaaacataaaaaaaatcttttctcgtatatatctaaattatttctcgatattcaagatttctaattttaaattttagaaacaaaattttcgttctatttctttttgtagttgcttattttttttttaatcaaaagtatgacttatttacaaaatgttcacaaaaatgttgctttttttttgtcaaaacacaaaaatgttgcttatttaagattatttggtcttatcctgattttggtttttggagtttgaaaaaaatataaaaataaatgaattaaggtcacaggtcatatataatttaactcatctactatgatgctagtctaatcagctaaaaatatgttaagctggtcggataatttttattttatctctaggttctaaccctatgacatgcaacattattttactacagtaaattgtttgatattggttgtatcacgtatagtttttacaataatgtgacgtttgatcaagttatatattatattttggcagtcataacgacaggagaagcaagaaggagtgtaatgaaattaggtgagagaatggtgaagaatttcaacgaaatgctgaccatgtccggaaaaattgactttccgcagcagtcgaaaaatggagtgagagtctcgattcggatgaacattgaggccggtcaaccacccggtatagttgtcagtgcttcgtcttctctcgcaatccctctcactcctttgcaagtcttcgctttccttcaaaacctcgacactcgtcaacaggttctttcttgatctgcatgatcatcaaaatttctcaacttaaatcacgtattaacaacaaaaacgtttacgtgtaacagtgggacattctttcctatggaaccgtagtcaatgagatcgctcgcattgtcaccgggtcaagtgaaaccaactgcgttaccattctccgggtacatgtatatctctctctcttcaacggtcttttaactattaatcgtttgttggcaaattatataactctaataacctataatcgtcgtacatgtgtatatatacattagccaacgcacgaagagaataatgacaagatggtggttcaagactcatgcaaggatgatatgttgatgctgcaagactgctacatggacgccttgggaggcatgatcgtgtacgctcctatggacatggctacaatgcatttcgctgtctccggcgaagtagacccttcccatatcccaatccttccatctggtttcgtcatctcaagcgacggcaggcgatccacggtggaggacggtggaaccttactcacggtggcctttcagatccttgtctctggaaaggccaataggtcgagagaggtgaatgagaagtcggtggacacagtgagtgctttgatcagctccactattcaaaggatcaaaggtttgctcaattgtcctgaatgttgagtgagggaatatgctgtggaagattctcttttgtttttgttttgttttgagatatttctgtcgggggattttatgacctcgattggttatgatggttttatggacatgctttaagtcttaagatatttccgatcggtaagattacagaccgattgatgaaagtaataaaacaacccatcctatcatgggtttttcttattggttttggttggtttattctattggttataataatttactcacagtttgaagataaatgcttgataataatgacgaaatcgtaaatgtgattgaacatttgataaagaagaatattcataaaaatacactaattatttagttatatatttcacgaaaaattcataagtttatgaatgtttcagaaaataaataaactaatttagctttcagaaagtaagatcagctaacttttttgcaaatacaaaaacagacaatctgtatattcttgaaactcaacattcttaaaattcttaataaactcttacaatattccaaaaaaaatcttaaatttttcaaatttcagattcataaatattttatttttatttttatatattaactttgataatttggaataagatataagaataacatacataaagtatgtattttgaaactactttttttagtaaaactagaaaatgttatacacacaataataaatatgttcatgagtgtctttttttttggtgtaatgctatgagcttttacatgtgaacatatagcgtttctgaaatcaaacttttacctccttttttttttaaaaccacttttacctccttataaattgatctttatatgtattctcttagaaattagtttgcagtttgtatgcatggtcttataaaaaatactattatttaatcaattttataaataacattatttataaatctcttaatagtttaaagttaatttggttctgtttatgtaatatgttgggctattaagctgtgtaccatttatttctaacacaatcaatagagaaatattttatataaaaaaatcaaattctattattattatttatttaaaagaactgaaaaaaggaaacaatatattgacggtaataagaagaagccggacggacatggaaaggtgacacgtgtatattgacaattggctcagataagacgacagagatatatatatttgcggtaacaccacgcatcgtcacttcatcaccactactcccttggcctataaatatttctctgcttttaatttccaatttgctctgattcattcacaaataacaatcctctcttcgtttttgtttttcttttggatccaaagctctcttaaatctgtaaatcaaca

SEQ ID NO: 10264 - DNA, 3000 bp, Unknown
  misc_feature (1)..( 3000): cDNA_ID_2715363_gDNA_ID_2213640_Annot_ID_132244 3000 nt of promoter + ATG
ggagtatagtaaatgccaaatttgttaaagaacaatagaatgtgaactgtagacttttgtttgtgtcgtctttctgtttgcttcaacttgtatcatctgcttaaaagagttgttgcattcgtgttttgatccttgtggtaggtcaatgagttcaaatcaattgagaagttcaagatattcaacacaaacaacctgtaagtagatcacgtccctaatgatagtaaaacaaaataaacttatttgatacacactaactgtgtaagtttacagatgggttaacttgaaggccatcaaaaagcttgtggaagctgatgcacttaaaatggagatcattccaaacccaaaggtgcctgcgtggctaatgcacagttttttatttctgcaattttttcattcattattatctaaccaaagaaaaactgcaaattctattcaggaagttgatggagtcaaagttcttcaactggaaactgcagccggtgctgcgataagggtatacatgcctgtcctagtggcacgttttgaaatatagaatgcaaactctaatcttttcttaactcctttttcgtgtgattctgtctcaaaacagttctttgacaacgctatcggtgttaatgtacctcgctcacggttcttgccagtgaaggcaagttcagacttgctgctcgtccaggtaaactctatacaccacgtttaacaacgcaacagagtaacaaatatcttttgaaacatttgattaatgatttaagttttctttcttccacagtctgatctctacaccttagttgatggctttgtcactcgaaacaaagctagaactaacccctcgaacccgtcaattgaattgggacccgagttcaagaaggtaaatgaagaaaatgatttcctgacaagtcccatttgtcatttctatcttgactcttgagcctcacttagtgtgtctgtctaacaggtggctactttcttgagccggtttaagtccattcctagtatagtcgagctcgacagccttaaggtgtctggtgatgtctggtttggctcttccattgttctcaaggtatatatgtaaattgttcattagttcacaaggtggtgttgatatttatatatgctcagaatggtttcttttggatttaaagggcaaggtgactgtggcggcaaaatccggtgtgaagcttgaaattccggacagggccgtggtcgagaacaaggtaatgtaacgaatcatggttatgttcaaactccggatgttttctttttcgccacaattatggttgaccgtttgattatgtgttgaaaaactaataaatttatcactcaaacttgaaatttggttttaggcggttatgatcttggttcaggattttcagagtaatcaccaaaatgaaaattaggattgaatttgaggttttatcttttcggctaaaccgaattggcattctacatctttagtttaaacctaaattattttgaattaaaacttaccattgtgttttttttacagaacatcaatggtccagaagacctctgaataaaacaaattcaagtcttcttccctctctcatggaagacacatcttgatactcctttaattggtgtgaaaagatcacaagtggcacagcaaagcaagtttatgaagaaagaataaataatgtttctttttctttttgcagcttagcaaagtcttttcctctttggactttattttaattttgctctttgaattttcccaaaacatcacatttatatgttcgattatatttgggttctatccacaatcatttttctttttgataatccactctttctttccacatgctctttgcttggaaactgatggagtactagtttattacatttatgtcgtctactaatttagattatgtcactgatattcatacagtgtgacatgtttattttcggttttcgtccgtttgatttgtagaattaagttggggactaattcgtatactaatgaagggaactaacacaactactacttatgaaggaaaatgcaagaatgaatactaataaataagacgaatacaactttaattagagttctcattggctaatttgtagaataatcgcaaattcaagttacttgtgtagaattactacatcaccaagattcttattcaaattaattgtcgcgctcccgtgtaaaattattctacaagattcttatgacttctagtatgtaataatttttgcttacgagttttggaaacaaatagatttaattacaaaggtatcattcaaatgaaatagaaaaccacatagtagcctaccaaaaaaaaaaaaaaaacatagtaagatgttcacatgcatacactacacatacgtgtattgaatcttattggtaatctaacatcgtagattcttaattgcactttttaattattgtttttaaaattttcctacttttgtttaaacatgtcacgatctaaagcatgagatagctgtcggttacttgaaaaagtggaataaaaatattatgtgtcattgagataatgagatgttacgtacgcgtccaatttattatgatctaatacatcttatcagataagctcttctttattttccatctttattcaaatcttgacaccaaaaggaaagaatattttttattcaaatctataactcatagattgcatctccttcttactttgtttgattagattgtattagcctctgtcttgtcttttggttagtataagtattgataaattcctttgaccagcaagatatcatcactaaaagattttacattaccaagccatctccaatatcatcaggtcggttttctctcgatatcaattggttacgcatgcatctatcatatcttaaagtttattcttctttcattattcttaacccaaattttaatttttatggaacttactaaaacgttgacgatgatccctactgctagtttgttttgaggcatgcattgaaagtactctttgcggtgttccctcatatattacaggtcaagtg

SEQ ID NO: 10265 - DNA, 3000 bp, Unknown
  misc_feature (1)..( 3000): cDNA_ID_2715342_gDNA_ID_2213640_Annot_ID_132250 3000 nt of promoter + ATG
tgattctgtgccacacccactgtgatttctcttatgcattctatgaattagagcttgtggatacagatttggtaatcagggaacccttttgtttagttgtgttcaatgtctggttattgatttccgggtgaaatccaaattgtctcataggtgcatttccctttttatacaaatatactgatgcatctgaaatctgaactagtagtatgtgcttttgatatgctttgttagacacaagaaccgatcatgaaccatagattgacccataccaagcaatcggcatttgtttactaaatgatcgattagcgtagaatagagtaatcaatcgtccttgaggttctagataattgagtttaagcgtggggtacatcctaagttgctttagatagattagggaaagaatactgatgatcatgtatttgcttctccatgaaccttgttgtgaaacacttcttttcttttcttttctttggctttcacatattctgagttctcgtagttggcttttaaaatgtttgaacttcggccactcttactttcgaaatgtatggacttgaagtagagattgagattgatgtccagtatcttagtgggaggagatacatagccatacttagctgagcagtgatcaaaggtgattttgatttacaaattataatatctggttgtttttggaacatgaacaatatgttagcatctatgtattaagttaacgaaataggaatattcctagcccacaaatctggctttgcaatctacccttagggtatatgattgggtggccctgattagaggaatattattagagtaaagaacaggttattctaactctgtgtcttaccagttgaagcagtagaaaattagttcatttaatttacgcaggaataaggaaagagaagaagcaaagtagaggaaaacattctacttgctctttggtgaagaaaacgtatagattcctccgtatttccatttttctccccaattagttacacatcttgatatgttttttcaaagcgatcatgtgctaaggggccttagaaacggtccataaatacataaaataaagttcatttatcaatcatggcccaaaagtctttgaatctgttcaacgtagttcgacacgtatcgttagattcgttacacagagattctcgatggcctcgttgttcgtgccatctgtttccacccaccacgtaaacaagtatttaaactccgtccatttcttcactctttccacgtgtcgtcatcttgttccatcattcccaaaatatcttatctctgacataaaaaaataccctacttattatataaagaccgcaaaaccagaacccatgttcatgggcgtgacatgttatttgacaaacagagctcattagataatgttttaaattcgaatatccattgcgtaaacattgtaaataaactttaataacgggccgactatataaacacattcattaaaataattatagtcgtataaatgccactgttctctcaactcttaatcaattagaagccgcttagaagaaaaaatgcactatcaagaacagatggagtctcttatgttgggtgaagaacgcagacgcggaaactacaccagagacgtagacgcggacgcagatgaaggtgttaactctccctcttcttttccaaactcccctgatgattcggaccgtcgcagttcttcttcttcttcaaggtaatgagaatcagaaagttccgcttttaacccctggctttagtaattgtcagaacaaaccccaatcattagggtgtattcttaaacaatcttatagtttaggggtataattaatttctgagatctttttcgttgtaaagaaactttttaatcttcctaccacgaatttatgtttgggaaattttgataacaggagaggattgtcgaaacattacaaaggtaaatcacaatcgttcacaacgttggcagaagcgctaactgtggaagatctcgcgaagcctgagaatccattcaacgcaaagctgaagcagcgacgagagagccctcactgtcgtagattatcaggatgcggcggcgcatcggagcgaaatttaagtgtccacgacgtttttctcgctgggaacgatagaccgccgcgactttccggtaacagaccgcctccgagagcccagacgctctcggcggctcatatttcggctttgctcactcgaacctaaaccggaagagaaccgggtttcgtttgggacgatgtttttcaaatcttttgttttctaatcttgtacaagttgttgttactttaaagtgttttgactcttttgataattttgtaagtttcagtttaatttagagagcacttaacagtatatatacaagtaactgaccaattgaaaatgttctgtatttttagatgtgatgaactaagaaaattaaaataatgttctgtatttttagatgtgatgaactaagaaaattaaaattgatgaattaagaaaatgaaaaatctaaattcttagagattgatgggctggactagaggagtcgcagttatctatattgggcctacaatgggctttcttaatttacagcctcttttttttgcggcaaatttacatgtctcttagctttcatatttacaaattttacccacttatactaactagtacaaattccatcatgtattttctttgtcattaaaatacaccttactttttgttttatccaattcatggcagaaattatatgtagaatgctaaagtctagaaatgttttggggtgtattccgaaataattaatagttaggtggttcttttgaaatttcttaatgattattgtataatgctgtcaagatgacgtggagacccatgggatgacgaagttttcactggcacgatccattcttcatcgattcaaactcttggattgatttcagagatcaaaagataacactttctcagatcttaaatttgtttgaattcctgctcttaaaggtttttgattgtgcaattttttcggtaacaatg

SEQ ID NO: 10266 - DNA, 3000 bp, Unknown
  misc_feature (1)..( 3000): cDNA_ID_2686506_gDNA_ID_2213640_Annot_ID_132251 3000 nt of promoter + ATG
tataatcaaggtcctactataggctaatccatttcatgggaattaattattgtttccacagaaaaatgagtattttctctctttatttgttgcttacttaggttaagaaacatcaaataatttggaagaaggaaagtagaaagagaaatagtgtttgataccgtgaagggaagagagcagaggcggtggcgcgtgtggaagcgcgtgtgttaactaggtgtttccttaagctggtgatcaactgaaagctcttcgatctggtggttgccataaaactgtgtttcttcgtcggagattacaagagagagagatacaggaaaatttgtttctactcaagattttgcttcttttagtcagtaatgtatgatgagtttaactccgtttaatgtgtgcttatatatatgcatttattatgtatgctttgaaagagattggattaggagacaaaacactatctgatccacgtgtctcacctaccaaacgttgccgtttcgcttttgacgccgttacttgacaaatcgacactgtgtgaatctaaagccgactttaaagaaacggactacttaatatatctatacttttcttttgggccgagttttagcaaattcagcccatttaagcccattttccctcttaatcgacgtgcgacacgcgttgaccgccacgtgtatcacgttccttacatcttctcttttcttccccagcaaaaaatgagtctgcaaaatagaaaattcaagctgcgattgcgaggaagagaagagacttcagatctagcttgatccggtgataatggcgctcgagtgggtggttttaggttacgcggcggcggctgaagcgattatggtggtgctattgacgatgccaggactcgacggactccgcaagggattagtcgccgtcacgcgtaatctcctcaaaccgtttctctccatagttcctttctgtctcttcctcttaatggacatctactggaaatacgaaactatgccttcgtgcgatggcgattcctgcacaccgtcagagcatcttcgtcaccagaagtccatgatgaaatcccagcgaaacgcgcttctcattgcggctgcacttgtgttctactggatcctttactcagtcaccaatttggttgtcaagatcgagcatcttaaccagaggatcgagaggctcaggaacaaggattgatcgtctcgtctcaggttcaattagtgtaatgccttttttggttatctttcccatttggctaggttttctctttttcaacgtttctgatatgtgtcttttatcttgtggagattgaaggattttatcctacttttctatgtttggattcttatttgtaaccagattgtgattgtttcttgttgaattttgattgactctataatcttctcttcaggataggcattatgcattaatgacacacacatgattgatggttttattgaattgattctgtgccacacccactgtgatttctcttatgcattctatgaattagagcttgtggatacagatttggtaatcagggaacccttttgtttagttgtgttcaatgtctggttattgatttccgggtgaaatccaaattgtctcataggtgcatttccctttttatacaaatatactgatgcatctgaaatctgaactagtagtatgtgcttttgatatgctttgttagacacaagaaccgatcatgaaccatagattgacccataccaagcaatcggcatttgtttactaaatgatcgattagcgtagaatagagtaatcaatcgtccttgaggttctagataattgagtttaagcgtggggtacatcctaagttgctttagatagattagggaaagaatactgatgatcatgtatttgcttctccatgaaccttgttgtgaaacacttcttttcttttcttttctttggctttcacatattctgagttctcgtagttggcttttaaaatgtttgaacttcggccactcttactttcgaaatgtatggacttgaagtagagattgagattgatgtccagtatcttagtgggaggagatacatagccatacttagctgagcagtgatcaaaggtgattttgatttacaaattataatatctggttgtttttggaacatgaacaatatgttagcatctatgtattaagttaacgaaataggaatattcctagcccacaaatctggctttgcaatctacccttagggtatatgattgggtggccctgattagaggaatattattagagtaaagaacaggttattctaactctgtgtcttaccagttgaagcagtagaaaattagttcatttaatttacgcaggaataaggaaagagaagaagcaaagtagaggaaaacattctacttgctctttggtgaagaaaacgtatagattcctccgtatttccatttttctccccaattagttacacatcttgatatgttttttcaaagcgatcatgtgctaaggggccttagaaacggtccataaatacataaaataaagttcatttatcaatcatggcccaaaagtctttgaatctgttcaacgtagttcgacacgtatcgttagattcgttacacagagattctcgatggcctcgttgttcgtgccatctgtttccacccaccacgtaaacaagtatttaaactccgtccatttcttcactctttccacgtgtcgtcatcttgttccatcattcccaaaatatcttatctctgacataaaaaaataccctacttattatataaagaccgcaaaaccagaacccatgttcatgggcgtgacatgttatttgacaaacagagctcattagataatgttttaaattcgaatatccattgcgtaaacattgtaaataaactttaataacgggccgactatataaacacattcattaaaataattatagtcgtataaatgccactgttctctcaactcttaatcaattagaagccgcttagaagaaaaaatgcactatcaagaacagatg

SEQ ID NO: 10267 - DNA, 3000 bp, Unknown
  misc_feature (1)..( 3000): cDNA_ID_3035749_gDNA_ID_2213640_Annot_ID_181210 3000 nt of promoter + ATG
tcttcagagtttcatggattttgtggatagagtattgtctcttcagggcaattcttccattcgtaagttctctctcaagtgtgaaactggtgttcctccagctcgtgtgaatcgttggttgtgtgaggtgctgcagcgtgatgtttcagacattgatctcaccattgatttgggatatggttattatctgcctgaagagttgttcgtgagtgagacactagtcaatctgaaattaaaaagtgcatttaatattgattggtggcctggagctgaaggcacttccttaccaatgcttaaaagtctttgtgtttacggtgtgagggttttttgtgatgatgagcttcaggagcttcttccttgtttccctgtgcttgaagaattacaaatgtctaatatgcagtggcttgattctgatgaaaccgtgtcaagtgcaaccctcacaacgctccatattactggcatccgctctgaaaatcctaagagcatttcttttgatactccaaatctgctttcctttgtctacactgattttgttgcggaggactatccattagttaatatgaaaaacttgtctctggctcgactcgcccttagagcaaatgacgatcaaatcaagcgagtaagagggccaagtaatgatttgttagagtatgatgtcgttcgccactttggcaatgtggtgaagctcatgaatggcatacaaaatgttcaggaacttcacttgtgtcctgatactctcgaggtcagattttctgttttattctttctgctctgctgagtgctgatattaattgtaatatgtctggttgcggtattgtcttacttgtttgttttcagttgctttctgtatgctgtgagtcgatgccagtgttcaacaacgttaaaaagttacttatttacagtgacgaggatcgaggatggcaagcagtgccagttcttctacggaattgtccacgtttagaaactctaatatttgaggtgggaatacaaaccatgaaactacttggacaaagcatgcagttcatacttaaccctgctgtcttgtttctgctttcagggtatcgtgcaccatgtgacagataaatgcggggatgcttgtgactgcattttccgaaaggacaaaggccgttcgctcaaatcttgtccagtgaaagtggtagagattaatgggtttggagtaacaatgaaagagaagtacctgatagagcatttcttggattacttttcgtgtttaaaggagatgaagatctatattaattgtgaagaggatggtgttacacaacaggttatgaagaaccgtgaagtgtctaaacttgtcttggatgagatggaagagtacaacgagttctatagttgcaatgtgaagctattcttgtgtaagaagaagtcgattccacaatgaaagtctctgaagaacaacgcctccttggaattcgacttgagtttagtgttctttaatcggcttgaaaaccgtctcaaaccagaccagttgcaaaacctgtatctgtttcctctttgtcttgatcttaccaacttttgtgtgggggattgttttaaagtgatttgtaatctgttttctttcggttgacttgttaattatctaatgatgttacttgaagtggcaaagatttgcaacattgatcagtggccataaaaactgacgattgtagcctaggatgattgattttgagtccagcacatctctatatagaaaaccatcgaattaaaccggtgatattgaaagaaccggataaataagaccaacgtcttcagttattgaactggtttggatgtcgacagcaggaacaataataatctttaattaaaccagaattatttggtggtaatttacttgctttccataacacatgcgtgattgacgttttttgacggacggtgtatagaaaacacacgttaaaataatcaacctaatattgcggaccaaaagaaattcatgctatcgataaaatctccaaaatacccctaacttccgcgtttccttactgactttccccaaagtaccctccgcttctcctttcccaaattttcattttttatacatcgaatcgaacgcgttatttataataataaaataaaatggagccttttaattcgctaccttgtccgaaaacctcaacacaaaaaggatttcaaaaggttaaaaagaaaaagaaatctccgccggtttcttctctcgccggcgttttgacagtcgtcgtcactgttaccgtctcaaaagcttactatttcagttataaaaaaaacaatcaaagagctaagagatcttcttctttcatcctcgtctttcttcttcgattttcttattattattttaataatttcctagagatctccacaataaaaaaattgggggttatcgttgccatcataacgtgtattagtaaagcagtagtagtgctgatgtatttgctcacgactaagtcccattcctcgtctcttctttttcttctccttaattagtttgggcaacacgatcacagttgattccttcacaatcgatttgttaaattaagaaatcattttcttctctctctctctctctctgtctaaaatatctatcggttgaagaagatctgaagcttaactttgctctgttacagactctcaggtactgtaccatccttgatctcttgtttcgtttgtgtgagagattgtcttatactcggaatgtggaaggatccagtagattttgaatttagattttccctcttaagcctctcctcttttggtggggttatgattttatcaattatcattacttttttgatgtcttttatggtttatttatgattagatttgttcttcttgaagctttagatctattgatgttctgtttgttcacctcttgatgatttggagttaaagatcttgtgtgatttgtaacaatgagtagaagatttgaccaatattactgttttgctttgtttcagggatctgccggctacaaagtccggtggatagtgttattattagacaatg

SEQ ID NO: 10268 - DNA, 3000 bp, Unknown
  misc_feature (1)..( 3000): cDNA_ID_1570947_gDNA_ID_2213640_Annot_ID_181209 3000 nt of promoter + ATG
ggtaaagaaacttcttctctttaaatagattccttacatagaactaaactataactttggaagaacaatgtttaacgagagattccccacatagctcgcatacatcttgctagttccttcttatcttctggttttccgggagagattattgaacttttgaggtcttaactcacttggtattgtttgcaggagctgttaggagctggaatactgttctgtgcatttggagtgatatgtgtcgtgtctctcttcttcatatactacattgtgccagagacaaagggtctcactcttgaagaaattgaagccaaatgtctctaaaaggttactcatcttagctccactttctgtgctgcttcattgcttgaggatctaaatcgcaaacgcaccagccgcatgtgtagtcactagtcagccatttatcgcggaattttcactgtttggatatcttttaaagaatggttgtatctagcggcaaaatttggtgcgttggaaaagttttaaaattcgaaagtttgcttaatttgtattttaaaacacgcattcaaaattttgtgattgtatgaaaataatgtgagattcaaaattttatgaaacaatattgtaacgtcgtcagtgattattattacacgaaacatattatgacgtcataacaagaaacataaataaggtcataaggaaatcaaatcattgtacgattcacaaaagcctataaatacaatcacgtcctcaacgtaggaagaacacaaagatcatcttttgtggtaaaggaacctaaaccggagagaaaaatggcaacctcaggcaatgcgacggtggccaataagcaggtcatactgcgagattacgtcaccggtttccccaaggaatcagacctcatcttcaccgattccaccatcgatttaaagattccggagggatccaagacggttctggtgaagaatctctacttgtcttgcgatccttacatgcgcattcgcatggggaagcccgatcccggcactgctgcgctcgctccacattacattcctggcgaggtacaaaaacgacgtccatagttcacgcatgttctagattgttacggatcaacacgattttgttacgtttcgagcttgtttgttacccacgttttgtgcaaaacaatatcactattaaaacagagatgaatttggaaacgttgttttcaaatttagaaacattgcaatgtttcttttgaatactgtgtgatctaagaaattgtacctttatgattagaagtgattttctcttacttacagtctctggtgctaaaggttttgatgttttgtttgcagccaatttatgggttttcagtgtcaaaagtgatagattctgggcatccagattacaaaaagggagacttactttggggattagttggatggggggagtacagtcttatcactccagatttttcacattacaagatccaacacaccgatgttcccttatcctactacactggacttctcggtatgttatctctgcttctcttttgttcatgtatgtaattcacttgatagtgagaaagctggctatatacaatgcttgatgtacctctctctatgattattggcatgatagaatggtcttagaagctcctaatcatgtagaatagttgttttggttgctaacatatctaataacttggtcaaaactctacaagtttcagtagtttactggtagtcttagaagcatcgctctgtttctgacaggtatgcccggtatgactgcctatgctggattttatgaaatatgttctcctaagaaaggagaaaccgtattcgtgtcagctgcgtctggtgcagttggtcagctcgtgggacaatttgcaaagattatgggctgctatgttgttggaagtgcaggcagtaatgaaaaggtaaccagaattttcttggactctagctattgatccatttccttatcaagagattcacttgtccccttttttctttctccgttgagttttgttataggttgatcttctcaagaacaaattcgggtttgatgatgcattcaattacaaagcagagccagaccttaatgctgccctgaagaggtcagtatactttgagaatgtaggagacaaaatgtgatatagagatctgattcaaaactatgatatctttcttctcacaaggtgtttcccggaaggaatcgacatatactttgagaatgtaggaggcaaaatgctagacgcagtgctcctaaacatgaaactacacggccgtatcgcagtatgtggtatgatctcacagtacaaccttgaggaccaagaaggtgtacacaacctagcaaacgtgatctacaagcggattcggattaaagggttcgtggtctctgattacttcgacaaacacttgaagttcctggattttgtgcttccgtatataagagaagggaagataacgtatgttgaggatgtagttgaaggacttgagaacggaccttcagctttgcttggactattccatggtaagaacgtcggcaaacaactcatagcggttgctcgtgaatgaatcagacgtctttagttggagaatgagttacaagaatttgtttagttgtgtcggaagtttattcttacaacttgaaaataaagcctcttttcataggcgtaactacaattgcatttttggttgtttattttgattctttcattggtctattctacaattttgtacctatagtaaataatataaactcacaatttttatacggatattctgagggatgtttttttttttgaaaaacaagttcaaaatatttcattattttcgatcagaatcaaaaatattttcaaaaatgttcgtttttttttgcattttccaagaaattaaaaaatcgaagaatatgtgcttcaaataagtgggcttatatgtactaaagcccaaataaatgcgttgtttggtacagcttcacgaacaatctctctctcgatagattcttcttacctctgaatttctcgttgttggaaca

SEQ ID NO: 10269 - DNA, 3000 bp, Unknown
  misc_feature (1)..( 3000): cDNA_ID_2715316_gDNA_ID_2213640_Annot_ID_181208 3000 nt of promoter + ATG
ctccttcatctgaaagaaattgaattgttggactaaattttcaaggaaggagaaaggagctgattttggctgcattcttgtatcttgttggagccattgtgactgtagtagcacctgtcttttccatactgataattggacgagttacgtatggcatggggattggactggtaagataaatcacacatctttattgtttgcctgctaaaatgtgcatcatgcatttgactaagtagttaatcatagtcaacctttccacgaatagctacttggtagaaatatgcttcacgctattactgaacatgtgttatccaatgcatccatatactaccagtctatcactcatagaccaacctggcagtgtttgcattcttctgtattcatatattggcttactccttcgatttattgattggtggaattcgggacagagtttacccctatatcgagacagtctgagatatataattcatcctattcttattctcctgtctcactctattttacgaagttgagagccattgtttataaatattgtttactgttcaaatcaagatgtttgttctactgtgagtgaatccatgcagctagggagtacaattttaagcattctttttaactggaaagttgatatgtttccttgcatttagaccatgcacgcggctccaatgtacattgcagagactgctccaagtcaaatacgtggacggatgatatcactaaaggaattctccactgtccttgggatggttgtaagttctcgaagctctgaggattttggaaatttattgccccgtttgaagttacagttttgattccctccattttgaaacctttctgtctaccaagttaaactgacacataattttgtgaaggggggttatggaatcggtagcctttggattacggttatttctggttggcgttacatgtacgcaacaattctcccttttccagttattatgggaactggaatgtgttggctaccagcatctccgaggtggcttttactgcgcgctctccagggacaaggaaatggggagaatcttcaacaggctgcgattagatctctttgtcgccttagagggtctgtcatagctgactcagcagctgaacaagtaaacgaaatattggctgaactttcccttgtgggtgaagacaaagaagctacatttggtgaattatttcgaggcaaatgcttgaaagctctcactatagcaggagggttagtcttgttccaacaggttggtgcagtcaattcatcaaacattccttaagaaaatgaacaataactaaatatatttttattttcgaatgacagataactgggcaaccaagtgtactatattatgcaccatcaatactacaggtttttcttttcatctctacttaagttgaattttttgcactaggaggaaactcgtgatagaaaatcttaacttctttttaccaaaaaattacgtgttagactgccggcttttctgctgcagctgatgcaactcggatctcaattctgctcggcctattgaaggtattcatattcttccatctggtttgacatgtcagatccttttagcaaaaaattatgaaaggattgatacgcgttgtagtacaactggaaatataaatgatatattcctttcgaagacttgatgtgatccttttactgttgcagttggttatgacaggagtttctgtgatagttatcgacagagttggaaggagacctttacttctttgtggtgttagcggaatggtattttatgtcttctattattaattgtttgttccaataagtttcgattacatgaatcggaagctaaacgatccaaaaatatactcgtgtgtaacaggtgatctcattgttcctcctgggatcctactacatgttttataaaaatgtaccagctgttgctgtagctgcattgctactgtatgtaggctgttaccaggttaaattttcttacagatttttctgatcaaagttccattccgtacaatgtcatctgcggctttgtattttcagtaaattttttgatatgatcttaagaggctttccatcaatcttgcagctgtcctttggccctattggttggctgatgatttcagagatatttcccttaaaattaagaggtagaggaatcagtctagcagtgcttgtgaattttggcgcaaacgcacttgtgacattcgctttctcaccgctaaaggtaaagaaacttcttctctttaaatagattccttacatagaactaaactataactttggaagaacaatgtttaacgagagattccccacatagctcgcatacatcttgctagttccttcttatcttctggttttccgggagagattattgaacttttgaggtcttaactcacttggtattgtttgcaggagctgttaggagctggaatactgttctgtgcatttggagtgatatgtgtcgtgtctctcttcttcatatactacattgtgccagagacaaagggtctcactcttgaagaaattgaagccaaatgtctctaaaaggttactcatcttagctccactttctgtgctgcttcattgcttgaggatctaaatcgcaaacgcaccagccgcatgtgtagtcactagtcagccatttatcgcggaattttcactgtttggatatcttttaaagaatggttgtatctagcggcaaaatttggtgcgttggaaaagttttaaaattcgaaagtttgcttaatttgtattttaaaacacgcattcaaaattttgtgattgtatgaaaataatgtgagattcaaaattttatgaaacaatattgtaacgtcgtcagtgattattattacacgaaacatattatgacgtcataacaagaaacataaataaggtcataaggaaatcaaatcattgtacgattcacaaaagcctataaatacaatcacgtcctcaacgtaggaagaacacaaagatcatcttttgtggtaaaggaacctaaaccggagagaaaa

SEQ ID NO: 10270 - DNA, 3000 bp, Unknown
  misc_feature (1)..( 3000): cDNA_ID_3035753_gDNA_ID_2213640_Annot_ID_181207 3000 nt of promoter + ATG
gatggctttgacggtggcgaagagtgcgttggaggcgattagagagaaaggtctcggcggtttcatgaggatgatccgagaagaaggcttcatgttagttctctgtctctcttttccaatctctcttcctctgcttaatttcttcaggattataccctcgatttcattagttagatcccaaataatctagaaatttacaagaattttcggtgtttgttgaagtttgtttgcaatgaatggttatcattcttcggtttttttcactcaaatgttaaattttcttgatgtgaaatgaaaatcaaacactttgtttttggtgaacatcaattttgaacggtgatggtgatgcttgaaattggcataatgtttctggttgcttataagtctaagatcttattgtttgtattccgaggtaatcactagtttatggaatttctctaattgcttctttcaattttttttcttcattgcaggagatgcctaccagatgggaacctcttgtaagtaatttatctttgataattagtgcttagtgtttcacttctttgtggattacgaatatgattcaagtggttgttcaagagttctttacagaccaagttcattttcatattcttatatgtgtatgttgttgtgtgagcgaacataattttgtcagattcattatactgtgaacagagctcgccaattcttgaacagcttactattctttgacttggactgctgatagatgttatgttagttgattttggagttcagtaaagaaacagtgacagtaaatgatggttggtattccagagatagtgtagttacatgtttgaaggaattgacaatattatgccataaggctattcaagttgatgaggaataagagctcaaagattggtgaggcctgttaatggtgatgaaattggcctacaaagtagtcttgaaacttgaaagatcttaagagtcaaaatttatgtgcctctttcaccaagtctataagctggatttgtcgttctcataggctctagatagttggtgcatttggctgaatatagagaaccttttcctcagatcatttctttatgcgtaatatacatataacatatacttagtgttgcttctatgttgtgtattgagatgttggaagcatgtatatatgggtcacatagtatatacacagtatgcttgaatattgtgtcttattaatagtttccccattctttatattgtagcttgctgttgagtcgtattttctgatcaatactgttttatttctatatttgatgaaggcaaactaaaatacataacataggagcgacacttgttggtgttgacaagttcggtaacaaatactaccagaagctaggcgatactcaatacggtatgtagttcctttaacttcatgttttacctatataaaatcatgctttaacctaaaaaaattgatgccactgtaggattcatgatatttgttactaaatattcagggaataacccttttaatattgacttcaaatgtttgtttattctgagtggtacagtcatggaaattgtagccactcactcagcatttgttatttgttagctcactgcatgtatcttaatagaatgtttagtcaagaggcttttacattgaaacaagcaatcactttgtgaacaggtaggcacagatgggtagagtatgcttcaaaggatcgttacaacgcatctcaagtaccagctgaatggcacgggtggcttcatttcatcactgatcacactggcgatgaggtaaaaccaagagccatttcaaattcgctgtctcgttcaatcaatagataatatattgccttgtaacttgataataaataccaatgtctctgtttcaagctcttgagtttgaaaccaaaaaggtatgggcttgagcataaagagaacttctctggagaaggtgatgcatacatctaccattcgaagggacataccttgaacccgggacaaaagaactggactcggtaccaatcatgggtacccaccaagactcagtaagaagatgatattttggttttacgctctgcgagactttctctcgagtgatttgttgttttgtttctgtgtcattttaataaaagctgtcttggatctaaagctggacaattgggtttcggatctggaattgtaattgttactgtgtaataatttgctgattattaagtttcttgtttcttcacctctggctaggaaagtagaaaagttctaataagtagaagtatttaaaaatatattaatcaaataacttcatcgagaaaaatatctttcaagattttttttttcttcgaaaatcttcaaagaaaattgaatacagagtttatgatctaaaaacaaaaaacaaaaaaaaaatcttccaacaaaatcttaatactattaatacatctaaatgagagatttttcccaaaacggattatgataaccagataaatcgaacgcagtgccagcaacaaaacgtttttaatggtaattaaaaatttaaacgagatcagcaccacgttttttaattatccttcttctgtcgtttttatggtcaactttgttataaaaaaaaattataatctttctaaacaaaaaaaaacgaaactggaattttgattaacagaaacatccaatatcaacatttaattggttttacaatttaaaaacaaaaagggtttcacagtttgactctctctatttatgctaacacactattaagactaatttcctatttttttaattgaaaatcagaatcttaatttgaaattaagctccgactatttaaagcttgtccactgttccgttaacatctataatcaccctggcatacatacttgtcgtctcccttcctcacgtttctctcctctgcaaattcgaagctccgttgagctcgaatcagagaagtagctatttcgtacaaccccagaacgatatatttttttctgggtttccttgaacataccacactcacggtcacgggatccataccaagcttccgtagcc

SEQ ID NO: 10271 - DNA, 3000 bp, Unknown
  misc_feature (1)..( 3000): cDNA_ID_2686506_gDNA_ID_2213640_Annot_ID_181197 3000 nt of promoter + ATG
tgttcatatcagtttcattataatcaaggtcctactataggctaatccatttcatgggaattaattattgtttccacagaaaaatgagtattttctctctttatttgttgcttacttaggttaagaaacatcaaataatttggaagaaggaaagtagaaagagaaatagtgtttgataccgtgaagggaagagagcagaggcggtggcgcgtgtggaagcgcgtgtgttaactaggtgtttccttaagctggtgatcaactgaaagctcttcgatctggtggttgccataaaactgtgtttcttcgtcggagattacaagagagagagatacaggaaaatttgtttctactcaagattttgcttcttttagtcagtaatgtatgatgagtttaactccgtttaatgtgtgcttatatatatgcatttattatgtatgctttgaaagagattggattaggagacaaaacactatctgatccacgtgtctcacctaccaaacgttgccgtttcgcttttgacgccgttacttgacaaatcgacactgtgtgaatctaaagccgactttaaagaaacggactacttaatatatctatacttttcttttgggccgagttttagcaaattcagcccatttaagcccattttccctcttaatcgacgtgcgacacgcgttgaccgccacgtgtatcacgttccttacatcttctcttttcttccccagcaaaaaatgagtctgcaaaatagaaaattcaagctgcgattgcgaggaagagaagagacttcagatctagcttgatccggtgataatggcgctcgagtgggtggttttaggttacgcggcggcggctgaagcgattatggtggtgctattgacgatgccaggactcgacggactccgcaagggattagtcgccgtcacgcgtaatctcctcaaaccgtttctctccatagttcctttctgtctcttcctcttaatggacatctactggaaatacgaaactatgccttcgtgcgatggcgattcctgcacaccgtcagagcatcttcgtcaccagaagtccatgatgaaatcccagcgaaacgcgcttctcattgcggctgcacttgtgttctactggatcctttactcagtcaccaatttggttgtcaagatcgagcatcttaaccagaggatcgagaggctcaggaacaaggattgatcgtctcgtctcaggttcaattagtgtaatgccttttttggttatctttcccatttggctaggttttctctttttcaacgtttctgatatgtgtcttttatcttgtggagattgaaggattttatcctacttttctatgtttggattcttatttgtaaccagattgtgattgtttcttgttgaattttgattgactctataatcttctcttcaggataggcattatgcattaatgacacacacatgattgatggttttattgaattgattctgtgccacacccactgtgatttctcttatgcattctatgaattagagcttgtggatacagatttggtaatcagggaacccttttgtttagttgtgttcaatgtctggttattgatttccgggtgaaatccaaattgtctcataggtgcatttccctttttatacaaatatactgatgcatctgaaatctgaactagtagtatgtgcttttgatatgctttgttagacacaagaaccgatcatgaaccatagattgacccataccaagcaatcggcatttgtttactaaatgatcgattagcgtagaatagagtaatcaatcgtccttgaggttctagataattgagtttaagcgtggggtacatcctaagttgctttagatagattagggaaagaatactgatgatcatgtatttgcttctccatgaaccttgttgtgaaacacttcttttcttttcttttctttggctttcacatattctgagttctcgtagttggcttttaaaatgtttgaacttcggccactcttactttcgaaatgtatggacttgaagtagagattgagattgatgtccagtatcttagtgggaggagatacatagccatacttagctgagcagtgatcaaaggtgattttgatttacaaattataatatctggttgtttttggaacatgaacaatatgttagcatctatgtattaagttaacgaaataggaatattcctagcccacaaatctggctttgcaatctacccttagggtatatgattgggtggccctgattagaggaatattattagagtaaagaacaggttattctaactctgtgtcttaccagttgaagcagtagaaaattagttcatttaatttacgcaggaataaggaaagagaagaagcaaagtagaggaaaacattctacttgctctttggtgaagaaaacgtatagattcctccgtatttccatttttctccccaattagttacacatcttgatatgttttttcaaagcgatcatgtgctaaggggccttagaaacggtccataaatacataaaataaagttcatttatcaatcatggcccaaaagtctttgaatctgttcaacgtagttcgacacgtatcgttagattcgttacacagagattctcgatggcctcgttgttcgtgccatctgtttccacccaccacgtaaacaagtatttaaactccgtccatttcttcactctttccacgtgtcgtcatcttgttccatcattcccaaaatatcttatctctgacataaaaaaataccctacttattatataaagaccgcaaaaccagaacccatgttcatgggcgtgacatgttatttgacaaacagagctcattagataatgttttaaattcgaatatccattgcgtaaacattgtaaataaactttaataacgggccgactatataaacacattcattaaaataattatagtcgtataaatgccactgttctctcaactcttaatcaattagaagccgcttagaagaaaaaatg

SEQ ID NO: 10272 - DNA, 3000 bp, Unknown; identical to SEQ ID NO: 10265
  misc_feature (1)..( 3000): cDNA_ID_3035771_gDNA_ID_2213640_Annot_ID_181196 3000 nt of promoter + ATG

SEQ ID NO: 10273 - DNA, 3000 bp, Unknown; identical to SEQ ID NO: 10263
  misc_feature (1)..( 3000): cDNA_ID_3035783_gDNA_ID_2213640_Annot_ID_181189 3000 nt of promoter + ATG

SEQ ID NO: 10274 - DNA, 3000 bp, Unknown
  misc_feature (1)..( 3000): cDNA_ID_3035787_gDNA_ID_2213640_Annot_ID_181188 3000 nt of promoter + ATG
ggggttttttgttgttgttgtaggatcttgctgggtagtgtgagcaatcatgtggtgacaaatgcaacatgtcctgtcacagttgttaaggctaattaaagtgtctcttgttctttaattggacccagttaataacattagtagttacgtgtgtcactcatgcattgttttgacatttatacgtttgttgccttctacaaatttgtgtgaaactgattggtactgtttcattaataaatttcagttaaatgatatttactctctttttgtttgtgatttgtgaacgttacgtaaaaatcacaaaaaaaaataattagtttttctaattcattcatgaaaaatcttcgtggactaaacaaaaaagatgtgaaaaaacaatccccatgtttgatccagattaattcgatccgttaatcaaaagatggtcttaatgagcataattcggggataaagtcgaatatagaaatagttgttgaaaagagaaatgtttggattgaatcttgtcagcttgatgtgtggttgatcacatgaccaatctatgtatggaatatggatgtcgtgtgtgctgattcattcagatatgacaagtggtggatgggataattcacgatatgggccagattatgagtttgttttaacttgaatggcaggccgaatcataatggattcatgatcattatgtttgatcatagcctagttggacttgtatccctagatcatgatcaaagtgggcttataaacatggccgagatgggtagttctaaatcaatttgttggatcagaagaaatcaagaaagagacagtcgttggagcttttctgatctgcttttggatgatcacccattagattgaaaattaaatttttcattctccgctcgatggctgatttgtaaacttgttccttcatgatagaaatttatgggctaaatacagaaagtgaacgttagaatttggttttgggtagaagaacaactatcatatgattaaagattaatcagatgatctaaagatagttttggtgagtacagttcggaaatatagccgttgatgcatgatgtgtgactttcaaaaatagaaatagccgttggatttaaatttaaggtcaatgaacaactgtcagatatgcttaaaattaatctaatgatccaagaatggttttggtcaatacttcgagtatatatagttgctggtacgtgatatgtgaccttgcttcaaatataaaacgagccgttgaattttaaatttgggtggatgaacaacgtactgtcaggtatgatgattaagattaattcaatgatccaaaatccaaatattgtttcggtagacggtggtacttaattagtgagactttcaaatattaaaaagagatgttgaatttaaattttagtttgctcaaaagaaaaagtttctagtaaaaacaaaacaaattatgtttaattaaggtatgtaatatggttatgcataagactagtgttgatgagatgattcacgatgtcgtatggattggattatgagtattcttaaactcgaatgggttgccaaatcataatggcctcattaatttattgtactaaactgaattataatatatgttcttgagcgaaaaaaatccataatttataatttcctatctagctatattggattgatccggctgttgacaatctggtcctgatttgaatcggtttctcgaatcatgcaccgtaatcgtagtctagccatttaggattgtatcactaacagtagtgtcactttaaaatgttggagatttagactatgaatagtaatataaaccgcacccaaaaccgcactgcaacaggtaacagtatcaaaatctctctctatatatatgtattttcgttactatttgaaccgcaccgcacttctcccacaccgcaaaacgcagtcatcattcggacccttaagacaaaaataataataacaatttatatagaattttaccaaaattgatgtcaaaaagagaattttttattattattttaaaacctaaaaactaatacaatatagagacgtaagaaaaatgccatcttttttctttcctcatgctacacacctttagatcaatgtttcctatagattttacaatttttctttccacattactaatttgagtatttgcaatctgttgaataagttgtcattgttcttaaaaaggtacttttcaataaattgtcatttctatctatataatcagtgatatctttccattctcttattttataaataagttagcataagaaaatatataggactaaaaccatttaattaatatttaaaacactaattatgaatttgtttaattttttactaaaaatttatctgattagcacaagctttttgtaataaagtttacaaacctttttgtttgtacaatagacatttagctagatatcaaaatttaacatataaacaatagaaaacatttatgacaaaaaacaatttagaaaacatatcaaaaagcctaattgacacttgacattgttgaaactattgatttaacacattgtattttcatattatatataaatttatattcacctttcaaaaatacatttaataattataaactaaataaaaaatgtttgtttgacttgttttatttcagccttaaaaataaatcgaccaataatatttagaaagaaaatcttatctcaataatttaagttttgcttagatttaatttatttgttcacctcaatgcattttatacaaaacaaatattttatatttaatacatatgtgaattaaatattaccttttaacaaataatgtaattaatatcttttaacaaataattttacccactcaaatagtaatatctatatttccccccttcttccctttttatgaattaatgtatattttaaaaaaatatccttaagaccaccctttttcccctataaatactgattaacttgtgccttaacaaaaacaaaaaattattcgcaaacacaaaaaaaattgttagtgaagaacaaa

SEQ ID NO: 10275 - DNA, 469 bp, Unknown
  misc_feature (1)..( 469): cDNA_ID_2714915_gDNA_ID_2213640_Annot_ID_181211 3000 nt of promoter + ATG
cttccttcatacgaggaggtcacagtaaatggtgaaaggaagtcgttggtaactttcttaacttggtttacatgatggttagagcaagtcgtttagagtgggttttactttttcagttgcataatattttcatgttgggattgaaataaaagtataatcacatgtatacaaaaaccaaacagtataacacgtcaaatcacattagaataattaattaaattttatcgataaaaatcaccaaaataccaataaattccgcactccgtctcttccagtctcagtcagtcgctattctctcatcgacgtttcattgccctaatttgaagattggcctctgtagcaaggtatgatgttgctctcagtctcaaaataaacaatctctctgcttcaatttcgagtggaactgtttggtttgggaaattgatttctttgctttgcgttgtgtatttttttctcttcagagaagatg

SEQ ID NO: 10276 - DNA, 3000 bp, Unknown; identical to SEQ ID NO: 10261
  misc_feature (1)..( 3000): cDNA_ID_1033038_gDNA_ID_2213640_Annot_ID_181187 3000 nt of promoter + ATG

SEQ ID NO: 10277 - DNA, 3000 bp, Unknown
  misc_feature (1)..( 3000): cDNA_ID_2715324_gDNA_ID_2213640_Annot_ID_132257 3000 nt of promoter + ATG
ctcttgactaaacattctattaagatacatgcagtgagctaacaaataacaaatgctgagtgagtggctacaatttccatgactgtaccactcagaataaacaaacatttgaagtcaatattaaaagggttattccctgaatatttagtaacaaatatcatgaatcctacagtggcatcaatttttttaggttaaagcatgattttatataggtaaaacatgaagttaaaggaactacataccgtattgagtatcgcctagcttctggtagtatttgttaccgaacttgtcaacaccaacaagtgtcgctcctatgttatgtattttagtttgccttcatcaaatatagaaataaaacagtattgatcagaaaatacgactcaacagcaagctacaatataaagaatggggaaactattaataagacacaatattcaagcatactgtgtatatactatgtgacccatatatacatgcttccaacatctcaatacacaacatagaagcaacactaagtatatgttatatgtatattacgcataaagaaatgatctgaggaaaaggttctctatattcagccaaatgcaccaactatctagagcctatgagaacgacaaatccagcttatagacttggtgaaagaggcacataaattttgactcttaagatctttcaagtttcaagactactttgtaggccaatttcatcaccattaacaggcctcaccaatctttgagctcttattcctcatcaacttgaatagccttatggcataatattgtcaattccttcaaacatgtaactacactatctctggaataccaaccatcatttactgtcactgtttctttactgaactccaaaatcaactaacataacatctatcagcagtccaagtcaaagaatagtaagctgttcaagaattggcgagctctgttcacagtataatgaatctgacaaaattatgttcgctcacacaacaacatacacatataagaatatgaaaatgaacttggtctgtaaagaactcttgaacaaccacttgaatcatattcgtaatccacaaagaagtgaaacactaagcactaattatcaaagataaattacttacaagaggttcccatctggtaggcatctcctgcaatgaagaaaaaaaattgaaagaagcaattagagaaattccataaactagtgattacctcggaatacaaacaataagatcttagacttataagcaaccagaaacattatgccaatttcaagcatcaccatcaccgttcaaaattgatgttcaccaaaaacaaagtgtttgattttcatttcacatcaagaaaatttaacatttgagtgaaaaaaaccgaagaatgataaccattcattgcaaacaaacttcaacaaacaccgaaaattcttgtaaatttctagattatttgggatctaactaatgaaatcgagggtataatcctgaagaaattaagcagaggaagagagattggaaaagagagacagagaactaacatgaagccttcttctcggatcatcctcatgaaaccgccgagacctttctctctaatcgcctccaacgcactcttcgccaccgtcaaagccatcgtcttccgctatcgctctctctctctcggaatcgggatttgatttcgttgtcgaaataacaagggacatgatgacgattgctaaacgcatcgttttgtatttgttgggctacgctttgtgtttacctgggccacttgctcgctatggccttccccatgatgatgtggcagagaagcatatgaatatacattttctactatgatttggtatatcaagaaatacaagatttaaatctgcttttcccactttcctcaaagcattagatcatacattcatagggttgtaattttgatttctcagtgaataagaagagatgatgtgtatttattcataaggagttgttcaaaaataaaaaaaggaaattcattttgtatatgttatcaaaaaaaaggaaatcactacgcattataaaacccaaaaaaaaaaaaaaaaaggccttttaagttttaacactacgcattccaatttgctatgcattagcttcatagctaaatctgtttttcccactttcctcaaagcatttgatgatcataacattaacagttcacttctcttcctctcttagtaaatcccattagccattttacaagctaagagtacacaacgtattataatcatatcttcacgaatggtaaactcgatttcaatataatgatagatctcctattgttaaggtttttccaagcttactccttagcttagatttcatgggatcaaatgaatactactacttagtaaagttccgtgttcaaaaaaagaaagaaagtaaagttaatatttggggaaaatgctattaattaattaatgcaaacataataatatgacataaatacataaatccaaaaaaaaaaaaaacactcaattttattttatataataatatcatacaaaatctaataatgaacatcattaaataaaaataataaagttctacaacttagtgattgaatatagcttatttaaaaataaaacttaataatgtttttttttgtaaaacctcaaaaagtgttggaaatttgattaatctatatgattgcatttcattttataataatctttccttaaagtaaatctttgaataaaataaacaatcctagtaaatatttgagtagcgtagactgtagagtatacaaattcaaaccctgaggcggtcaacgaaaaaaaaagaagagaaaacaaaattagaagtcaggcctttttctcagcgtcgcctgcgtcaatcttaagctgtctttcaaaaacctctctcaatatttaaactgcctctcctccgtaccgctctacccaaaaaaaaactctctccctctctctcgaactttgtctccctccattgatttcactctcgtatcgagtctcttcttctagaatttgcgcatcctctccgccatg

SEQ ID NO: 10278 - DNA, 3000 bp, Unknown
  misc_feature (1)..( 3000): cDNA_ID_3035753_gDNA_ID_2213640_Annot_ID_132259 3000 nt of promoter + ATG
tgaacccgggacaaaagaactggactcggtaccaatcatgggtacccaccaagactcagtaagaagatgatattttggttttacgctctgcgagactttctctcgagtgatttgttgttttgtttctgtgtcattttaataaaagctgtcttggatctaaagctggacaattgggtttcggatctggaattgtaattgttactgtgtaataatttgctgattattaagtttcttgtttcttcacctctggctaggaaagtagaaaagttctaataagtagaagtatttaaaaatatattaatcaaataacttcatcgagaaaaatatctttcaagattttttttttcttcgaaaatcttcaaagaaaattgaatacagagtttatgatctaaaaacaaaaaacaaaaaaaaaatcttccaacaaaatcttaatactattaatacatctaaatgagagatttttcccaaaacggattatgataaccagataaatcgaacgcagtgccagcaacaaaacgtttttaatggtaattaaaaatttaaacgagatcagcaccacgttttttaattatccttcttctgtcgtttttatggtcaactttgttataaaaaaaaattataatctttctaaacaaaaaaaaacgaaactggaattttgattaacagaaacatccaatatcaacatttaattggttttacaatttaaaaacaaaaagggtttcacagtttgactctctctatttatgctaacacactattaagactaatttcctatttttttaattgaaaatcagaatcttaatttgaaattaagctccgactatttaaagcttgtccactgttccgttaacatctataatcaccctggcatacatacttgtcgtctcccttcctcacgtttctctcctctgcaaattcgaagctccgttgagctcgaatcagagaagtagctatttcgtacaaccccagaacgatatatttttttctgggtttccttgaacataccacactcacggtcacgggatccataccaagcttccgtagccatggggtttgatcccgagaaccaatcgatctcttccgttggacaggtttcgcttttctcattatcgtcttcttttccccattcttctttcggtttaggtttccgatagcaaattgtactgatttttgttggttcttctcccggtcggctttgaagacttttgattgcaatgtatatcttagggtttggcttgattttagatatcctttttatgaagtgattgtggattttgatgtctctgtaatgtgtggagcttgtgaaaattgggatttcaattttaagaccttagcttctgggttttggaataacgattctatcctaaatctctctaatttggtatcaagtcactttctgatgcaaaattcctgaaactatatattatgtaggttgttggtgattcttcttcaggtgggattactgctgaaaaggaacctttgttaaaggaaaaccacagcccagagaactactctgttcttgcagccattcctccgtgagtctctctcgttctctcttgtttattagtcatcaatttgtggtcccagattgttttgtttatttgctatttattgtttgttactactatttctgctgaaagcaagtgggaatcttttggatatgcacatgatactgatttttctaaaagcatgctaagaacgtaagaacgtaacaagtcatttattgcaggtttctctttccagctcttggagcattgctttttggttatgaaattggtgcaacatcttgtgctatcatgtctcttaaggtaatggtttaaccttgtctaaaactgtgcttctatactcaagtttgatttttttagctttctcatatctttagcagttaaatgacgctacttcatagttcatgcctgcatttgcactgccattacgtttccttggatttctcctgcatagttgttatgcatgtacatctgttcgattgtctaagcctattaaattctgaatgactaatctgcttttgcctcagtcgcctactctaagtggaatttcatggtacgacttgtcttcagtggatgttggtataattgtgagtctacctttcttggatcttctacatgttggttattgcactattttttgttcttattttctccctaaattgggaagctgtgatctttcttgtggaaggacaaagaaatttgcttacgacaattttcatacttttgtgcagaccagtggctcactgtatggtgccttaattggctccattgttgcatttagtgttgccgacattataggttggtttttctcaactgtcttcatctgagtatgtagcagcagtctccttcatctgaaagaaattgaattgttggactaaattttcaaggaaggagaaaggagctgattttggctgcattcttgtatcttgttggagccattgtgactgtagtagcacctgtcttttccatactgataattggacgagttacgtatggcatggggattggactggtaagataaatcacacatctttattgtttgcctgctaaaatgtgcatcatgcatttgactaagtagttaatcatagtcaacctttccacgaatagctacttggtagaaatatgcttcacgctattactgaacatgtgttatccaatgcatccatatactaccagtctatcactcatagaccaacctggcagtgtttgcattcttctgtattcatatattggcttactccttcgatttattgattggtggaattcgggacagagtttacccctatatcgagacagtctgagatatataattcatcctattcttattctcctgtctcactctattttacgaagttgagagccattgtttataaatattgtttactgttcaaatcaagatgtttgttctactgtgagtgaatccatgcagctagggagtacaattttaagcattctttttaactggaaagttgatatgtttccttgcatttagacc

SEQ ID NO: 10279 - DNA, 3000 bp, Unknown; identical to SEQ ID NO: 10269
  misc_feature (1)..( 3000): cDNA_ID_2715316_gDNA_ID_2213640_Annot_ID_132260 3000 nt of promoter + ATG

SEQ ID NO: 10280 - DNA, 3000 bp, Unknown; identical to SEQ ID NO: 10268
  misc_feature (1)..( 3000): cDNA_ID_1570947_gDNA_ID_2213640_Annot_ID_132261 3000 nt of promoter + ATG

SEQ ID NO: 10281 - DNA, 3000 bp, Unknown
  misc_feature (1)..( 3000): cDNA_ID_3035749_gDNA_ID_2213640_Annot_ID_132262 3000 nt of promoter + ATG
gctatgtatcagatgatggaggagcgcttttgacattcgaagccatggctgaagcagcgagttttgcaaacatgtgggttcctttctgtcgtaaacacaatatcgagccgaggaatccggattcatactttagtcttaaaagagatccttacaagaacaaagtgaaggctgattttgttaaggatcgaagacgggtgaagcgtgagtatgatgagtttaaggttaggatcaacagcttgcctgactcgatcaggcgccgttctgatgcttatcacgcaagggaagagattaaggccatgaagctgcaaagacaaaacagagatgaagagatagtagagccagtcaagattcctaaagctacatggatggctgatggtactcattggcctggaacttggataaattctggtcctgaccattcccgtagtgaccatgctggtatcattcaggtacaatttgttaagttcagttgtttatacttatttggttaagggcattttatttcattcataactgaactggagccggagtttggttcagttgtgaattatcttataacaaattttcggttcgatttagtttgacaaattttggttactttaggtttacttattttgcttgcaatatggtttggttcagtttctatgccaactctaagatcattgtttttcaaaattttgataaatgcaggtgatgttgaagccgccaagtgatgagccattacatggagtgtctgaagggttcttagatcttacagatgttgacattcgtcttccgcttcttgtctatgtttcgcgtgagaagcgaccgggttatgatcataacaagaaagcaggagccatgaatgccctggtccgagcttctgcaattatgtccaacggtccattcatactcaatcttgattgtgatcattacatatacaactctcaagctttaagagaaggaatgtgtttcatgatggatcgaggtggtgaccggctttgctatgttcagttcccacaacggtttgaaggtattgacccatcagatcgttatgcgaatcacaacacagtcttctttgatgtgaacatgagagctcttgatgggttgatgggtcctgtttatgtcggaacgggttgtctctttagaagaatcgcgttgtacggattcgatccacctcgggctaaagaacaccatcccggattctgcagttgctgcttctctcgcaagaagaagaaaagccgtgtgccagaagaaaaccgatctttgagaatgggtggtgactcagatgatgatgaagagatgaatctttctttggttccgaagaaattcggaaactccactttccttatcgattcaatcccggttgccgagttccaaggtcgtcctcttgcggatcacccagctgtgcaaaacggacgaccacccggagctctcaccattcctcgcgagcttcttgatgcatcaactgtggcagaagccatagccgtcatctcttgttggtacgaggataaaaccgagtggggatctcggatcggttggatttatggatctgtcacggaagatgtggtcacaggttatagaatgcataaccgaggctggaaatcggtttactgtgtgaccaaaagggatgctttccgtggcacagctccaatcaacttgacggataggcttcaccaggttctccgatgggctactggctcggtagagatcttcttctcaagaaacaatgccttctttgctagcccgagaatgaaaatcctccagagaatcgcttacctaaacgttggaatctacccgttcacatcattcttcctcatagtctactgcttcctcccagctctctccctattctcaggccagttcatagtccaaacactcaatgtcacattccttgtctacctcttaatcatctccattacgctctgcttactcgctctcctcgagatcaaatggtcaggaatctcactcgaggaatggtggcgaaacgagcagttctggctcattggaggaacaagcgctcacttagccgcggttatccaagggctgctcaaagttgttgccggaatcgaaatctcattcacattgacatctaaatccggaggagaggatgtagacgacgaatttgcggatctctacattgtgaaatggacatccctcatgatcccaccaatcacaatcatgatggtgaacctaatcgccatcgcggtcgggtttagcaggacgatatacagtgtgattccgcagtggagtaagttgattggaggagtgttcttcagtttctgggtactggctcatctttatccattcgctaaagggcttatgggaagaagaggaaggactccgaccattgtatatgtctggtctggacttgttgccatcaccatatctctgctttgggttgccattaatccacctgctggttccactcaaatcggaggatctttcactttcccatgattcataggtttggtttctcaaaaattctctttctttagtcctttctaaagatggagacagagattggccaagaaacacacaagtatagttgagccaaaatatagagcaagtcaaagaacttctctcattgtcttttattttttgtttttttatttggttgggaaaggacattttttatttgtctttttaaattttgtaatcttttatctgttgatggaattatttatgctactactgttaattatttattcagttcaaattcaagtgccaaagttttgttaagttttaatttatttgctttcataaaccttttaaggaaaaggaaacaaaacgggtcgggttatcgggtcaagttatccagaaaccgatccaacacttgtcccgccgaaaccctacctaaaccttgagaaccttctcgtcgactttgagatttctaatggcaacagatattccgacttcgaatttcttcttctccaagccaatttcttctacataaatcacattttcttacagtattctcgaatctcgaagaaccctaagtctcgtttcccaggaataatg

SEQ ID NO: 10282 - DNA, 3000 bp, Unknown; identical to SEQ ID NO: 10267
  misc_feature (1)..( 3000): cDNA_ID_2715304_gDNA_ID_2213640_Annot_ID_132263 3000 nt of promoter + ATG

SEQ ID NO: 10283 - DNA, 469 bp, Unknown; identical to SEQ ID NO: 10275
  misc_feature (1)..( 469): cDNA_ID_2714915_gDNA_ID_2213640_Annot_ID_132264 3000 nt of promoter + ATG

SEQ ID NO: 10284 - DNA, 3000 bp, Unknown
  misc_feature (1)..( 3000): cDNA_ID_2715429_gDNA_ID_2213641_Annot_ID_132269 3000 nt of promoter + ATG
ttacaagtgtatttatctaataaatctggttcgttttctgattgtttcaagggtttcgatgtggagtttgtggaagtggtgcgaggtatattttcagcaggatcaaggtcaaagtcgttcatcacattcatggctagggagaaacctgatggacctcctgttgagtatcaagctaaggtttggtgtacggttgttcgaaaccagaactatcccatcctctgtagacgggctctcacaacaaagcctccaagccaaaactagtaaaggtatggtttttgacccagactttcttttgctgttgatactttatatagcctgaattgttgtgcgtatttggatatattaagttttagatttagaaagataggcagattaataaccatctcagcgaattgtcttggctcatcatttctgtcactacaattatctaacttggaggatagctgaagtgcattgtcttattactatttgtttccatgctagtgagtatagggattaagggtgagaagtatcttctgactgtttagatctatttgaaactgtaaactgtctgtgcatgacttcagaataagatatctctgtaggtagacaaggagatattttcctcttctaaagtgattctagaaggccatttttattagagtcttaagttgctgacttgtttttatcactgttctctttcgtctgggactggaaattagactagcagctgatcgagaagatggaattcgctggctgatgcagaggctggagttcgcaccaggtcatctaatatgaagttgtttgtattcgacttagtcgtactaaatcacttctattgtgttgtgccaatatttatgttttaggtacttatctctatgttagctaaataactggtctaagagacttcaaattaaatgtttgtgttttataactttggaagcatggcatgtgtctcctttgatgcagtatcctcgcttttgggatttctttcttttattatgttttcatattatgtatgacacatgagtaaaaatcaaacatatccatccatatactaatatcaattacaaggatctaacaaaatgtaaaatcatggtagatagaaaacaataactttaacatattcaagtgatcaatgtagcaacctttctttcttcgatcacgctctgtacgaagtcaagggcgaatggaacaatttaattggccactctggcaatgatgtagcaatttcactgcgtggtgtttgaacacttgcaacattgtgtttactctcactttcattttgctaatacatttgctcagctaaaaataaataatttttgaatttttcttgcgttatatatattgttatttttatgttaaattaagatcaaaataaataaatttagagagcaatttttatttaatttaaagataaacacttatggtcgcacaaatatttgtgatattggtttaaatcgataagaaccgtttttgttaatcaaaaccgggccaaccctaaaaagctaaacgccggttagactaaaagagccaaccgccggataaaccaaaaaaacaacggcgtttgttttttcttctccttcttcttcaccctgcgtcgtgctctctcgaattcccaggtcagctacttggattcgtactctcaaaaaaatattgctttcgcattcctcttgtggtttcgtttctaaacgcgagtttctcccttttctaaggtctgtgttgatcccacccaaagtagagagaattaaacctaactgttcccgttttattgtagaattactgtacatatagatttaagtcgtgatctagttgtcgagaggctctgtgcagttgcgtagttcgcttaccctcagaaacgggctttgctgagtgatgtcaattagtagctagttgtgagctctatatgcgaaagttgtgtatttgtctctgattgctctatttctgatttgataaatctcagattttagcaaccagtctgaatcaattttatgaagacctaagagacctagcaattcaagaagaccaccaatcaatcctggaggcatggtacgatctgagccttgtgttctgttcgctcagacctttgttcatcctcaattggacgaatatgttgacgaggtaaccttaatttttagttaatgatacacttcaaatactgccctgttcttttggctagggagtgcctatgttggattagggttctgttttactagagtctcttaaacctggttaggaaatgcttgggtgaattactgactacttttacgggattgtcggaacaacaagtattatatgtggtggttttgtcattcaatggcagaagttacttgtttggtttcacgcttctgcggatttattttatgtttcctttaattcttataggtgatatttgctgagccagtaatcatcacagcttgcgaatttttggagcagaatgcttcctcatcttctcaagctgtttctcttgtcgggtatgttctttttttgactgtgtgttcttatatttctttctatattttaaccattgaggatcttgaagtagtaatatccaccattagaagtcttgttgaaatgcatggtcccatactctgtagctgtgatctctattgactcttaatgttaagccttttttttggatgtaaaagttcacgattggctattttcttgtcactggaaggtgaatgataagaaacctaaatttgtgtagaaaatctgaataacccaaacttgaaactgtaacaaaaaactgaactttgcagacatgatatttcgatccagtggtttcgatgaaatgtccagagtccagactctaaagttcagcttctttatcattaataaactttagtcactttcagagaaatctagattttgagtcaattcgtcttctagaaacaaaaatagtgaagcaatattgttagctgaaccacttgtagttagattttcagctaaaatgccagctttatattctttgtgagtgacttaatgtctgacaacatttcttgagcgtgggtgatgtct

SEQ ID NO: 10285 - DNA, 3000 bp, Unknown
  misc_feature (1)..( 3000): cDNA_ID_2715425_gDNA_ID_2213641_Annot_ID_132270 3000 nt of promoter + ATG
agtcaattgtagtggtggtgttggaatgggataggtaaaggtttcctagcaacttgagatgcgagaagatattaaagtcaacttggccttggatgttgaaatgggaaaggtcaagtgtcctaaggttgactaatctggaaatagatgtagggattggacctctcaagttgttaccgccaagttgtaacactagtaaattagacggtgaagatatattcccaaactcaagagtgccgctgagttggttattgtccaaaaaaataagagttatagaaggaatggtgaagagagaggaagggatagttccaacgaaattgtttccacttgccgaaaaggactccaagatggagagtgaagtgatgttaggaggaagcgtgcctgtgaactgattgtgagagagtgatatctctgacaactttgtaagattgattacttcaagtgggaggttaccactaagcttattattatcaagacgtaaaatagacaattggttcaaactgccaaaagaagaagggatttcaccaacaaaattgttagtagataggtcgagaaaggtgagatacgacagatttccaagtgaagatgggatttcaccaccaaaattgttatcatagaggtggagagaggtgaggtgaaaaaggtttccaagggaagaaggaatccaaccactgaagttatttccagaaaggtcgagagtggtgagatgagaaaggtttccaatagaagatgagatttgaccactcaaatgattatatgaaaggtctagagtggttagaaaatggaaattttgaagcatagaaagattactgttggaatgaaaccagccatggaggcagctgcacataaggtctatctcgattacttccccggtcttagcatcgcaagtaataccatcccaatgacaacagtcgctgccattctcccatgactttgtcttcagaggacttggacaaccaaaacaaggcttcttaatcttaaactcgttcttgaactcgagaagtgcatctctttgttcgaaatgacataagtgtatattaggaacagcaaaaacacctcgaaaattagaaaagaacaagaagagaaaataaaaagtaataggaatgagactcattgacttctatgaggttttgcttctcctttaaaatgaaagagcaaaaatgggaattgtgatggttatatggtttcatgccaatctctttatatacataataatagactctgaactcgacaaagattaaaatcaactcagcttgtatttttaccaagtcttcttgacgttgaacagagagtagtaaaaagtctttgtccattaagcactacctcccataatttatggtccatgaaatgtcttcgtcttcttgtatgtttgcgttctttgccgacgtctttcatgactgggcctaacttaagtattttcacttttaattaacgaaagcccaattcggaatgcacctaacgatcatgattgctacttctttcttcggttccctgattttaagctttcttatttgcaaaacaaagtaaagattattacatttaaatagcataaaatcgggcctagttgatcttttactttgccgtcaattcatcaagaaacgttttcctcatgttttttcttcggcagaagttatatatgccgatgaaatgaatcctaattaaatttcgttaaagtaaattgtcggccttaggcccaaagctcttcttgtgtacccattgagccaaccctcatcaacaacagatggtcgaataataacatgggctttgatgatttctaatagaaaacagcaatggaaattttggataaagcaaaaatgcaagtcaaaacctacaaaatttagtatcgtccaaatattattctaggtaaggaatctcttaatccatgctccaaatcgctggtttgaaaacataaaataaactttcactagaaaatgcattaagataactgaaaatgtgaaaaggtaacccagaaaattttacctggttttgtagtatgtaattcttttggtcttctttattagtttttttaataaatatttatggccgttacattttcatctgaaacattcaaatcaacatctgctaaaaatagtaacttcataatcgttttatttcccactgattcatcattaaataaaaatatccagggatcagattataaccgtccgatgcaaaacattacggtacgcttgaccacagagcatagctgtctcacgtgctcacgcaatcataccaaatattaaaagtcaaaaaagcccaatagcagctgcaactaccaccagaagcggtcgagggtaatatagtcattacacaaaaagttctcacctccccaacgcgtagcctcttaactaaaaccaaatcaaaatacctttccccaattttggctcattaccaaaaaaaaaaaaaatagttgtaaatagagagaaaaataaggcggggaaaaggatcacgattcacaaaattagtggaaaaatcataagtgtttcgtcttcttcatcggaggttcgttttttttttctaattgttcttctctctcgttcttctgtgtatgtattataggagctgtaatttaattttgtattattattttttcgtgttttgactttttatttttctctcttttcattaaatttatgtgtttccaggggtgatttctgcatttggatagattttgatttctattataggatcggaatttaaacactagcatttaagtagtaattttgggtaactgtagaatttctatggtcggaatcaaatcgataccttttctgattttcaattacgtttcttgatttcttgtttgtttttgggttgatttgcagatctcgtgctctgaattcgagaattgaggtttgagatttctgggtgatttggtctaggctatataagtttttagaacaagacggagctgaaggaatcattgtgtttttggttgatgagtttagatttagattagtgccttagtggtttgtttctatatcttattttgaggagcatatg

SEQ ID NO: 10286 - DNA, 3000 bp, Unknown
  misc_feature (1)..( 3000): cDNA_ID_2685632_gDNA_ID_2213641_Annot_ID_132273 3000 nt of promoter + ATG
aactttcatgtttatagtataatgggcctccttggcccaatattctcgaaacattggactattggagtttctcgtcatcctcaaagcaagttattgggaggtgactcaaaatcacgttcttgaaaaattttccgagttaaaaagttaaacctttatttaattctccaatttgattttcgtttatatttctggctttcgtcctaatgaatatacactagatctcacttgtttttcttcatgtacgtaatcatttttgggggtggcacgactaatcattgcttgagttgatcttgatccaaatcttaggaagataatgcgcaattaattgaattttcaaccaaaaaatggacaaaaagactatcgccttgtaatgattgcaattatgatgcttctagtcttctagatactgtatcaagtatcaactggataataaactatttatcattttcttacaactaacaaccaattaaaagccactcaacatactaacatttccatagtccactccaatgattattgattattatgattaagatcagatgatgttctctatggattaaaaaaaaaaaactagcaataaaataacaagaaaaatggtcatgttgggactgggtgggagtggaacgagaggccacggcacacaaagtcacaaagaaagtgtcattatccggtgcaccgtcccacatgcgattgctggtaaccacgcgtcaatcagacgaatggcatgatccttttttagattgtgctcgctaacatggaccctacaaggaccgaactaatcaatgtggttctcacgtgcctcttttgccaattttaacttttctaacgaaaaaaatattactctgaaacctccacattcaattgtgatatgaccggcgtctggccctcaaaccgaaaggctctcctctgaatcctttgttgctctgtcccacgtgccagaaatatcatcttaaatatggtggtctttcgcaaccctgaatggcatttgtggtaattagttctaaattacgtgagacaatgcaaagattttgttttgcaccatcgttgccgaccacatcaaacaggtcatcgctctgggtccactcaccgctagtccgctatacacttgtgggaaaaggcttcttgtagtacagtttcgtcacggcgtcttattaattgcaaatctgtgacgttacggttttcgattcgggttactattttaatggaaatcttttgataatagctagagcctagagtatgtaaccctaaggttagatggtaataccgaatctacctaaatttttgttattttcggtttttcatgagatatatagactgcgtaatttaaaatctcaaaatttggtttcactttatttttatttttttttagtttcgaggtaggtatacaagcatggaccttttgacattatttaaaattttcataatttagaatcttcatgttaaacgtgtatggctacgatcttcggaactttattcggtttgtatgctcaaaggccaacgccatttattttctaattgattttttcccgttacggaaacaatctttttgcattattgaacttaattaccaaagtttatgaaaagaaacaataaagtctaaattggcctattttgatatactgatcacttacgcgaaaacatctacattgttatctactagactagtcattaactcgaagatagaatttcatttcttgaccaaaaaaaaactcaaaagatagttataatcacagattcattattgacttttgcttttaacactgtagccatttatgtactatttatacaaatacctaacttttcaaatttgtgatatttttcaccctacattttagcctataggttggatcattttgtcatattgcatcactgtttactagtaccaaacttaaatatcacacgagcagtaaatttgctatcaattttttcgttttcacaaacatatatctagtttccctaaccaataattaagttaaattgcattaggaatttaggatttataataaatagatatataacccactaacgacaaaagactatgtcttgctacgtctctgcctttattatcatgccacaagaaaataagaggggaacagagggagaaccccataaataaataaatttagagaaatatctaagtttggttcttccctgtgtctacccaccgtgatcatcataaaatggattgtgatttctgatttgtgagtctatctttctctactccattagcttcctctcccttggatggttacgtcactttctccgagcttacgtcatctatatccggtcttcacttctttttccttccattcctcagcagcattgcgtaatctatctggtgtgtgtgtatcacgtcacttcctcctagtccctctctctgtacgttcttgttgtgaaattgatttactttttgaaaacatttttggtgcaattcaacaatatttgtttcacagttcttattttatttttgtagattaaaaagcttaaatttcaaaaacaagaaaatcttgttttcacaaaaattaggcaaagggtttccaatttccagattgtttaacttgattttcaatttccaatttccgaatcttgcaacttgatttctataatgataagttatctccaaatatgttttcttaaaagagaaaactcgatttgacttcaagttgagatcatatccattattattctctatattacgtacaagttattatatattttataactctagaggaatgttagagcttgtgttaatggaattccaagtcagatatgaatattctcttataatcattattgtccttataactgttttaaatacctcaaatttatattttatcccctgtttttttcccgggaaaacgaatctcaaaaaacgaatttcctactttgacattattttatctccctcttgctctttgatataatgcaactatctgaaactctatgaatttatcatttacagagttcaagatcatatgatattttcactttctggacaaa

SEQ ID NO: 10287 - DNA, 3000 bp, Unknown
  misc_feature (1)..( 3000): cDNA_ID_2715413_gDNA_ID_2213641_Annot_ID_132274 3000 nt of promoter + ATG
ctggtaaagtgagaaatccgttaatccctagagaaactgtaatcgtcgcggtgattcggagaaattcttctgcttccgcggaaaatgtcactaacccagatcgtgaatccaatcatatatccatctcgcacaattccacggcgtttcacggcgatctcgccttttaaaaccctaagtccccaattttcccgccacccacctcacgcactgtctcgtagactcttccttccttctgtttcctctatatgggatgccataaccggcggcggagattcgaaccctcgtgaggccatcgcagcggttcgacgcggaatgcagctcttcagacaggtaaattggaaaattccgacaaacagaacttttctaacataagggactctttttttaattttggatccttgaatctgaccatcctattcgagatgctttttgttaaagggtgatgttgctggatcggtggcagagttcgatagagcaatcattttggatcccaggcaaaaggcatgtacgttttatctcataacacgatctctctataaagctttgaaatttcagtcgaatctttattgtttttgcttcatgggaacactaacatttgcttcatgacagatctttggcaacgcgggctttctctttactatgtagataggtacaagctcctactcactgactcttgttaggatttgagtttcttcttagaagactgtgaatccactgtcgaaaattttaaaaagtgcttgtttctattgtggactttggtctcatattaagtgatgaaatatccaacaggtttgaagaaggtgcagagcagttccggatagatgttgctcagaatcctaatgacacagaggagtccatttggtgctttatctgcgaggcgaggctccatggtgttgatgttgcacgaacacagtttctcgaggtttgtttttccttatgttaaagcttaccattccatgatcagtaataaagccggatatgagattttagaaagaattctttgtaggttggtagagattctcggcctgtgatgcgagaagcttataatctattcaagaatggtggtgatcctgaaaaggttttgagacatgtttcttgataattgatatcattgatttatttccatcaaacgatcttaatactctgattttgaaatacagttagtaaatgacttctctagcggtcaagcaagcgaatacttctatgcttctctgtacgcagggctctactatgaagctgaggtaagctcttgatcttgaatttatccaagacaatctccattgacatctattggcctattgctattcaaaaacaaacaatccttgagtaatcttgtttaagttacttgtctgattcttgttgtagggtaaatcagaaaacgcaaagtttcatttaaccgcggcttgtggatctccatatgggcagaggtttgaacccctatagcatattggtagcagttataaagtgattcgatggtctagtgtttttgatacttttcatcccaaatttgtttcaggtctgatgattatatggcttcacttgctaaagtccattgcctttgtagaaactggagctccggtattctttgaaccggttcatggttttgtggagccaacatattagttattaaggcccaatttttgaaatatcagcccaattaaaaattggacctgggtttgcgatttccaacctttatttatgggcatgaataaagaaagtaccattcacaaacattataacaaataggcaacattgtgccattttggagtaccattcacaaacattttaaccaaattattgtagaaattttcgtaccaagtatcttaatctggataataatttcactgaacgttctgtttaatatacattagttttatactggttgatcgtttgatactaatatctatgaacttaaatataatttaattgtatttgcgaattgctttagatgaacaacaacttttacgagatccaaaaattgttattccgtttttttgatggaaaggtagtatatatgttgtgtagacagattagtttagtaactatgttgaataagctatattttaattgtccggactgtactttatatctgtaaaataaatagttgaaagaaaatcatattgactagtattttttgttatggtttacttaagggatgaagaaaagtggagatggagactcaaatcatttttttttctcatcacacatgttgtaagaattaaataagtgtgtttgggaatattctgatctggcaaagcaccaaaaaattgggatattcttgtcgtctgatgcttgcatggcatatacttcgtacatcagcaactcctgcatcagcaaaatacaaaattatccctccatagtccatactaacagaaccggaaattaccggcgaatgttcggtacatgacatttctaaagtttattcaattttttttcttagtttattcaatcttaacatctattaaataatttaaaatgaaattcatgccaacgcgaaaatgattttcttatttattgaaacatcgtttttaatccatttttctgaaaaccgatacgaaaaagagaaaaaagttatttttagcaaggaaaagtttaagggtaaaatcgtcatttggctacttagtctgggacagttaaaaaattaaacaatccagagctcttgtccaatttggagacgatgtaaccaagttgcatatacacggcagggtagacgggagttaatacataccctcgatcttaaacgtacacgtgacaataatcgtacgtgtcatcatctcgaaacgcaacccggtcattcgttaaacctaacgtgacggaaccactccctttgccgttgaatgtactatttgacagactgatttaaaccttatattctaaataaaatctaaaatcaatagacacctatataacgtcgatttattgatcagtggaatctcgagtatttcggacatgcaatcgtgaacggcgagtttcgacgacggtttggggagttaatcgatg

SEQ ID NO: 10288 - DNA, 3000 bp, Unknown
  misc_feature (1)..( 3000): cDNA_ID_2715405_gDNA_ID_2213641_Annot_ID_132276 3000 nt of promoter + ATG
atagcacaaagcgatatgttatatatgttaagaaaggtgtgtataaagaaaatattgatttgaagaagaagaagacgaacattatgcttgttggtgacggaataggacagacgattattaccggtgaccggaatttcatgcagggtcttacgacattccgaactgcaaccgttggttagtattgatattttagttaattaaatcagtagttaattaattgattgattaaccttttttgtacttttcttcctttttggtttttgtcaaatttttatatatattagtgtgtctgaaaattagaaaagcatatatgctttctgcaatccgcaggctttcaagctttaagttatagtttttttcttctcataattcattcttttcttgtgctacaatatctaatccattacttaattgattgatcaatcttttcattaccttttaatattgttttggtcaaattttgtttactattgtctctgcaaatcatggaatattatatgcttttgctttctggaatctacaaactttcaagatttttacttttcttataaattatccctttcttatgttacaaataactactttttcaatatgtttttgttacttatgtatctaattaacatgattgaccattaattttggtttgatcagctgtttccggaagaggattcattgcaaaggacataacattcagaaacacggctggtccgcaaaaccgtcaagctgtcgcattgagggttgattctgaccaatccgccttctatcgatgtagcgtggaaggttatcaagacactctttacgcccattccctccgtcagttctatagagattgtgaaatttatggtacgattgatttcatattcggaaacggcgccgcggttttacaaaactgtaaaatctacactcgggtcccgctaccgctccagaaggtaacgataaccgcgcaaggaagaaaaagtccaaatcaaaatacagggttcgtaatccagaacagttacgtgctggctacacaacctacttatcttggccggccatggaaactttactcaagaacggtttacatgaacacttacatgagccagttggtccaacccagaggatggcttgagtggtttggtaattttgctttggacactttgtggtatggagaatacaataatattgggccaggttggcgatcatcaggtcgggttaaatggcctggttatcatatcatggacaaacggactgcattatcgttcaccgttggatcgttcattgacggtaggagatggcttccggcaacaggtgtcacattcaccgctggtctagctaactaattcaaaaaattttattttaccagaattattttagaattatgttattaatttaatcggttgtcatctatataatattcttgtttgagtagaaaacaaaaatcatgaatgtatagtgtatgtcagtatgtgtgtttaaatttataactttataaaaataaatggaaattatagactgcctgattatgcatctctgtaaatcatttaattttattcgtatctgatttaatttcattgattaatttcgcagtgatcgaaaaatatctccaaaaattccctgtcattttatccgtagatcttgtttgaaattttgagctgatttgaatcggacggatgaagaattataatatatgggctattggtctgccactaacttaaacgacttatttaattacgagtatccacgtacatcaatgtatttgtcattttcacacaaattaattcaaaccttacgtccggttaccaaaaaaaatatatatcaatttgaaacgaaaaaccaaagatcatgtataaatacacatacaattatacaaacatctcgaagtaaacttgtaaacatcaaccctgattaggacttagaggtcattcattacactttcctttttttgtccactctttctcatttttttatttttttattttgaatggatgggtgattttgctttgaagacattgtattatgcggagttcaaaaataccggacctggttcagaattatcatgtgattaatgaaactgaacctgtttggttcactgtctcgaactttatagttggagatagcttgttgccgaatatgggaactttttgtgtgtttatgtctctacctctgtgatctatatgaatgtggttgtgatcaaaattagaaagaatggtacatattgcataaaaataaatatatctcttctaaattgactagttaggtcatactatttgtcaagattcgtcaagaattaaatttactattcagtgcggtgaaaacggacaatattttcagtgtatacaaatgatttattttattttattttaagaccagagattgtttttaatcataatctaccaaaaaatcattataaattcgcacattgatgtatctagaattttaatatcgagaaaagggttttgataataagcaatgggaaaatcactatctttcaaaatcacaactgtaccgaatggtatgttaattagtagttaaaaaaacaaacacacaattaagacactgattaatccggtggagaaaagaacaaacaaacaaacaaacaaacatttattgaatccctaaaataagattaattattttccctaattagaaactcataaggaaacagagaagaccataaaaccacaagcctattttttgtcttttcaacagtttctcactagccggatttcccgccaagccttagaaaacagagcaaccaaaataacgaactcttaatttgtcataaccgttataaataagccatctagacaattatgaaaattgcacactcccaaggaggctacgtaaccttcgacggaggagtccataaaactcacattctcatttttttctcaaaagaacaacgaacagctcttatatttttttacaataattcttcagagctgtttaagttcaacaacaatttgattaagagaaaaccacataaatattaattagtgtaacgaaaaacacaaaacaaat

SEQ ID NO: 10289 - DNA, 3000 bp, Unknown
  misc_feature (1)..( 3000): cDNA_ID_2685795_gDNA_ID_2213641_Annot_ID_132278 3000 nt of promoter + ATG
acgctcaataatgcaccggcattgtcaaactctcctccatagtttggagctgagaatattgtgactaacctccgttttgcgaaaaactcatacccatcttccactacctgcaaacacgtccctcacaagtcaatatcttggaaggttctcataaaagtcttttcctttatgcccatattcacaagatacaacaaatgtcaaacatttctacagagttggaccatttggttctagttttgatcactatggaagtctatttacctgatggcctctgcaaatgagatcgagatcattcttatccaaaaagtcagcgactacatcggctccaaacgtgcaggagatacctcgatcgctatcagtccacccttcattcttctgatcaggatcagaccaaagtaaatcacaaagaagaccattgtctggaatctctgtaggcctttgaatctcccgaatctgccccaagttttccaattccggtgacaatccaccatgcatacataggatcttctcgtcaatgagagcagctaccggcaaacagttgaagcaatcggtgaatatcttccaaagccgtacattaaacctccgtttgcattcgtcatagaacccgtaaatcctgttgatcttagcatcttcatggtttcctctcaagagaaatatcttggatgggtaccggattttgtaagccaagagtaaacatattgtttcaagactttgcttgcctctatcaacgtaatcgccgaggaagagatagttcgctgaaggaggatagcctccgtattcgaatagcctcagaagatcttggtactgtccatggatatcacctgaattagagatcaaaacggaaaccattagtacctcataaaacaaagcatcagcagatttagaaacaatttgcagaaactttaacataaatccatcaaaatcaaaactttttagatcacccagatgctaaaatcttcaaacacacgtttcgacattaagaaaaaaagaggaaccctaatcaacacaaatttgcccccaattacaaatctcatctttttaaccccaatcgtgcaatacgactcaaacccaaatcatcaaaaccaaaaagccacaatattttttcatcatcaccacaaagagagggagagaaagagaaagagaccgcagatgcgaatgggggcatgaagctcgagaagattaggctgagaaaggaagatttgtctggcgttaacgcaaagttgacggatctcgacctccgaaagctgaacctgtttacctcctttaccttccaacaatctccttataatatcatccaatacacccatctccatcatcccttccatactcgtcatcattcttcctctgatcccaacctttttcaccagaatccaaaagggtttgcgccaaatcaggcgagaaacaatgggtctcgattaaataaagaaataatcagaaaatcacaaacttttaatgtttttgttcctttagattttcccgagaaaatgcgggaaacacaaaggggggaagaaagaaaagagaggtcaaacaaagggggaaggcaaaaccagaagcaatctctctctatatatctctctattagtcttaaaaactcagaggaggaaagtggatcaattggaaaagattagaattaataacaaatccggatttaaggagattattaattggagaaacagatggcgcagataatagctccttctcttctctctcttttgctgccagaaatttttggaatttatatttcaactctgttttaaatggctattcattacattaagagaatgatgtcggtccaaaaaaacataattaagattagaaatggaacaagttgagttttaactatatacgattattatatcaattaacaattatatttagcaatttctaactttgtttggtattgtaacaatggctactctacatgatgtaaaaatggatccaatgaactacaaaagaaaaaatgattggataaagaaagcaaaaccagtgcaattgatttggtattgtccaacagaactaaaaacatgattaaaaggggaagttgtcaaatctcaaaatagaaaaacgaagacgaagtaattagtgaaaccttctaaggcaagaattatggggtagtggacggacggtgatggaagaagaagatccagcctaaaaagaatgagacgtggatgattctcattggaactggtcaaagctccttacatacactaatttcctttgtagttaaataaattattcaagtaattgttgtcgggcgagaaaccgcgtcttttgaaaagttcgttttatggttatatttgtatacgtgtgagggtaatacttagaattcgtaaatgggttcccatcatgttccactacaccatcctaattatataaacagacagtgattagtaacattaattgatactttttctttctttttgggcgagtaaattttaacttatttgaaagttgattcataacactttctgtgacaagaaatcaacaataataggttaaaattgcgtaaacaagtatacttacctatgtattagtagtttacatacatgataacaagtatgaagtatactacacctaatatgtggttcattcttttttctaagcaaaataaaatatttcttttcttctagacggcatgcatcaatgattaaactatttcttgtatcaatataactaatcttttatagttacgtatataaaaggtttgtaagaaaatacatcagaaatgcttttttttcatgttggtcagaaaaagaaaaggaaaggctttctatggtgacaaataaaaattatataaatgggccaatatattacagaatttaagtccaaacttattgtggtcttatattcaaggcccatctcgtgaaggaagaaaataactaagcccatttcgtggaggaagtaagagaaccctaaaattgagttggtataaaaaccctagcatcagtattttcatgtagaaggtcggcggttccatcaccacaacgccggacgacaatg

SEQ ID NO: 10290 - DNA, 3000 bp, Unknown
  misc_feature (1)..( 3000): cDNA_ID_2715397_gDNA_ID_2213641_Annot_ID_132279 3000 nt of promoter + ATG
acaaaaatccgattacaaaagcaaccaagaagcaacagtactccagaatcaagtccaatggcggcaacaactttcttaaaccttgaatccacgactcttcctctttcctctggccttctcgaacttccttcccttggcccgaacatatggcttggagtgactgtgtggcacaccaggagcaggtccgaaatgcttcactgcttcacgtgaattcttaggtcctctaagaagaacctataacacaagaacacacaactatcaaattaaatatagtatccttaacaacttgaaaatggagaatagcagattggataagagaaataccgtgttctggcccaatggagctctgagagcgagctggtcaaaggttaagcattcacctccagctttctcaatgcgagcccttgctctctctgtgaacctcaaggcagtcactttcatggctggaatctcgtgtaccctcaaatcatcagttatagttccaaccaagacggcaatcttatcttcctataatatcagaacaagaggcaaaattcaaaatccaaagcatagacaatgtagagaattttgaatcaattatcgaacaccgccatgttacagactaagttcacattagcagattcataaactggacactgtatctaggaaatgtaacagattcaacatgacctaaaactaatttaaccataaagatacagtagagagagagggtttcaacgaattagtaccttgccagtcatgaactccacaagcctagatagagaaagaggagctttgttgactttgctcatgaaaagcctcttcaatatcacaccattgaacttgctattagttctccttaccagaaaccggtaaagctgcaaaatttcacaaacaaaattcagaacaattcactaaaataaaattaaaaaacctcttcaattggataatataaggcaaaggacaaagattgatgtttaaaattctgaccttgacagtaagcttgaggtagacatcatcagactttggagctgtccttttggtcttcttactcttacctccggcgatcagatcaataccctgcaataacacaaccaatcaatctcacaaacaagcatgaaagcaagatccaatctcaaaaaaactaagagagatagatcgttcacactctaacccgagactcaaatgtcagaaaaacaaacctaatacactatacaacatttaaaatgacaggaaacacccacaatctcttaacaacaagatttctgaacctttgatatcaaactaacaacagaaaatacttgtagaggaaagacagagagaaatgaagattgaacgacagaggaggagagaagtaccattgtcgtccggcgttgtggtgatggaaccgccgaccttctacatgaaaatactgatgctagggtttttataccaactcaattttagggttctcttacttcctccacgaaatgggcttagttattttcttccttcacgagatgggccttgaatataagaccacaataagtttggacttaaattctgtaatatattggcccatttatataatttttatttgtcaccatagaaagcctttccttttctttttctgaccaacatgaaaaaaaagcatttctgatgtattttcttacaaaccttttatatacgtaactataaaagattagttatattgatacaagaaatagtttaatcattgatgcatgccgtctagaagaaaagaaatattttattttgcttagaaaaaagaatgaaccacatattaggtgtagtatacttcatacttgttatcatgtatgtaaactactaatacataggtaagtatacttgtttacgcaattttaacctattattgttgatttcttgtcacagaaagtgttatgaatcaactttcaaataagttaaaatttactcgcccaaaaagaaagaaaaagtatcaattaatgttactaatcactgtctgtttatataattaggatggtgtagtggaacatgatgggaacccatttacgaattctaagtattaccctcacacgtatacaaatataaccataaaacgaacttttcaaaagacgcggtttctcgcccgacaacaattacttgaataatttatttaactacaaaggaaattagtgtatgtaaggagctttgaccagttccaatgagaatcatccacgtctcattctttttaggctggatcttcttcttccatcaccgtccgtccactaccccataattcttgccttagaaggtttcactaattacttcgtcttcgtttttctattttgagatttgacaacttccccttttaatcatgtttttagttctgttggacaataccaaatcaattgcactggttttgctttctttatccaatcattttttcttttgtagttcattggatccatttttacatcatgtagagtagccattgttacaataccaaacaaagttagaaattgctaaatataattgttaattgatataataatcgtatatagttaaaactcaacttgttccatttctaatcttaattatgtttttttggaccgacatcattctcttaatgtaatgaatagccatttaaaacagagttgaaatataaattccaaaaatttctggcagcaaaagagagagaagagaaggagctattatctgcgccatctgtttctccaattaataatctccttaaatccggatttgttattaattctaatcttttccaattgatccactttcctcctctgagtttttaagactaatagagagatatatagagagagattgcttctggttttgccttccccctttgtttgacctctcttttctttcttcccccctttgtgtttcccgcattttctcgggaaaatctaaaggaacaaaaacattaaaagtttgtgattttctgattatttctttatttaatcgagacccattgtttctcgcctgatttggcgcaaacccttttggattctggtgaaaaaggttgggatcagaggaaga

SEQ ID NO: 10291 - DNA, 3000 bp, Unknown
  misc_feature (1)..( 3000): cDNA_ID_2715393_gDNA_ID_2213641_Annot_ID_132280 3000 nt of promoter + ATG
tctctttgtggtgatgatgaaaaaatattgtggctttttggttttgatgatttgggtttgagtcgtattgcacgattggggttaaaaagatgagatttgtaattgggggcaaatttgtgttgattagggttcctctttttttcttaatgtcgaaacgtgtgtttgaagattttagcatctgggtgatctaaaaagttttgattttgatggatttatgttaaagtttctgcaaattgtttctaaatctgctgatgctttgttttatgaggtactaatggtttccgttttgatctctaattcaggtgatatccatggacagtaccaagatcttctgaggctattcgaatacggaggctatcctccttcagcgaactatctcttcctcggcgattacgttgatagaggcaagcaaagtcttgaaacaatatgtttactcttggcttacaaaatccggtacccatccaagatatttctcttgagaggaaaccatgaagatgctaagatcaacaggatttacgggttctatgacgaatgcaaacggaggtttaatgtacggctttggaagatattcaccgattgcttcaactgtttgccggtagctgctctcattgacgagaagatcctatgtatgcatggtggattgtcaccggaattggaaaacttggggcagattcgggagattcaaaggcctacagagattccagacaatggtcttctttgtgatttactttggtctgatcctgatcagaagaatgaagggtggactgatagcgatcgaggtatctcctgcacgtttggagccgatgtagtcgctgactttttggataagaatgatctcgatctcatttgcagaggccatcaggtaaatagacttccatagtgatcaaaactagaaccaaatggtccaactctgtagaaatgtttgacatttgttgtatcttgtgaatatgggcataaaggaaaagacttttatgagaaccttccaagatattgacttgtgagggacgtgtttgcaggtagtggaagatgggtatgagtttttcgcaaaacggaggttagtcacaatattctcagctccaaactatggaggagagtttgacaatgccggtgcattattgagcgtggatcaatctctcgtttgctcctttgagattctgaaaccggctccagcttctagcactaatcctctcaagaaggtttgtttccaccaagaactttcaaaagaccaagtagtccttcttttgataataatattggttagctcggatataccaaaatctgaatccaacaagaccaagccttttggacttgatgagtcatgacaagttttgttcttttggaaacttcacgtcataatgtaacacatgtttctctctatattttctctttttgatcaggtaccgaaaatggggaagtcttgaaacttaatacagcttattcccttgagagatttggtttcacaagctcaagctagcgctctgtgcatttcttcagatgtaggcaaactgcaatggagaagagaacctcaaaaggctactttacttagtcatcaaagaagaagcatcagtagaaaaaacaaaagagagagagagagagagaaaacaaaaggtgttgtccaaatattctgtgtatagttgcagaaacatctcttttctgcttctctagattttcatctccttttggtctgttttcttttatttggttattcttttaacaccttagtttaacttagagtgcctctcctcttttgcttttttctttctttcctgtatcatcaaattaccacatttcttaatcttttccatatttgaattgacttccatggtttggctcttacttttgtgaatcatctgcacagtaaaaacaatttccttttgatttagcagtacatgtctctctgtgttttttctcttccagcagtaatacatatactttttacagagcttacttttacacaatggcacgacttgttctctctgtttcggaattggttcttcttgaaactgattctccctctctcgtcgagttttcatagtagcacattttattctcaggcttttggtttaatttcataggaagatggttcaatccggtttactattaaaccgaaaaatctaaaaactagatttttcggtttatgaaatccacaaaccaaataatatagctgcataccaacccaaaatctcggcaaatcaatgttttccgtaaataaccttttctttatcgatgttgtcaggaacattaagggtaacttagtaatataacaattgcagacgttttagcgagcagaggatccccaaagccagacaaatcctcttccgtcgccgccgccgccgccgcaagtctcgtcggttagtttctgaatctctcgtttctaaatctctgatctttcgttggattcctgtgtttgaatctcagcttctctacctgggtttatgtctcagctcttgaacttgcttgatttctgcatttcttgttattttcgtttgtctttgtctctcgatccgtgtgttaccattactgtatatgatcgcataattcatctgtgttttgctttgggtttattgatctaacttaatctctatttccttggattgatatgtaatggtggaatttctaaagatatataggaaggaagttggagagtttctagcaatgtttatgtttgattccaatgttgtggttctcaatggagaaaaacattatagaatctctgagaaattttatattgaatagccaattgctacaggattcttggttcggatctttcagtttcagaatctatatgtgttttagagttgttttttctttgagctgaataggtttagagagccaatctttcacttgattttcgaagcctatatctagttcattggttcgtagctaaagagtgtttctgaatccttgctgtaccatctgtgttaatagggtttgaagtctatgtttgattctatctttattctagagagcttagatgttactttttaggataagccttaa

SEQ ID NO: 10292 - DNA, 3000 bp, Unknown; identical to SEQ ID NO: 10290
  misc_feature (1)..( 3000): cDNA_ID_2715397_gDNA_ID_2213641_Annot_ID_181252 3000 nt of promoter + ATG

SEQ ID NO: 10293 - DNA, 3000 bp, Unknown; identical to SEQ ID NO: 10289
  misc_feature (1)..( 3000): cDNA_ID_2685795_gDNA_ID_2213641_Annot_ID_181251 3000 nt of promoter + ATG

SEQ ID NO: 10294 - DNA, 3000 bp, Unknown; identical to SEQ ID NO: 10288
  misc_feature (1)..( 3000): cDNA_ID_2715405_gDNA_ID_2213641_Annot_ID_181249 3000 nt of promoter + ATG

SEQ ID NO: 10295 - DNA, 3000 bp, Unknown
  misc_feature (1)..( 3000): cDNA_ID_3035840_gDNA_ID_2213641_Annot_ID_181247 3000 nt of promoter + ATG
ctgcgaaattaatcaatgaaattaaatcagatacgaataaaattaaatgatttacagagatgcataatcaggcagtctataatttccatttatttttataaagttataaatttaaacacacatactgacatacactatacattcatgatttttgttttctactcaaacaagaatattatatagatgacaaccgattaaattaataacataattctaaaataattctggtaaaataaaattttttgaattagttagctagaccagcggtgaatgtgacacctgttgccggaagccatctcctaccgtcaatgaacgatccaacggtgaacgataatgcagtccgtttgtccatgatatgataaccaggccatttaacccgacctgatgatcgccaacctggcccaatattattgtattctccataccacaaagtgtccaaagcaaaattaccaaaccactcaagccatcctctgggttggaccaactggctcatgtaagtgttcatgtaaaccgttcttgagtaaagtttccatggccggccaagataagtaggttgtgtagccagcacgtaactgttctggattacgaaccctgtattttgatttggactttttcttccttgcgcggttatcgttaccttctggagcggtagcgggacccgagtgtagattttacagttttgtaaaaccgcggcgccgtttccgaatatgaaatcaatcgtaccataaatttcacaatctctatagaactgacggagggaatgggcgtaaagagtgtcttgataaccttccacgctacatcgatagaaggcggattggtcagaatcaaccctcaatgcgacagcttgacggttttgcggaccagccgtgtttctgaatgttatgtcctttgcaatgaatcctcttccggaaacagctgatcaaaccaaaattaatggtcaatcatgttaattagatacataagtaacaaaaacatattgaaaaagtagttatttgtaacataagaaagggataatttataagaaaagtaaaaatcttgaaagtttgtagattccagaaagcaaaagcatataatattccatgatttgcagagacaatagtaaacaaaatttgaccaaaacaatattaaaaggtaatgaaaagattgatcaatcaattaagtaatggattagatattgtagcacaagaaaagaatgaattatgagaagaaaaaaactataacttaaagcttgaaagcctgcggattgcagaaagcatatatgcttttctaattttcagacacactaatatatataaaaatttgacaaaaaccaaaaaggaagaaaagtacaaaaaaggttaatcaatcaattaattaactactgatttaattaactaaaatatcaatactaaccaacggttgcagttcggaatgtcgtaagaccctgcatgaaattccggtcaccggtaataatcgtctgtcctattccgtcaccaacaagcataatgttcgtcttcttcttcttcaaatcaatattttctttatacacacctttcttaacatatataacatatcgctttgtgctatgattaggagcctcgttgatggcctcattaattgtccgatacttcccttttccatctatcgccacaaccgtgtttggatgcatgacactggggtcatgacgcatcatgaggctctcgtcggtctccgtgagccactcaggacttgcgatgacgctctcgttcctagatgccttgaaaggcaaggcattgagctgcgtgtacatgtctaagacattgctcacaagctgagtgacttgtcttaagctacctttgatcaattcctcgtacttcctctctgttccttcaaacccttctagacacgtgtcttggttactcatggccgcgctaagccaggttttaagattgcctcctgctgcagcagcatcgtgagagccatcgtctagatctattcctcctcctccatggagtttgttcatctccagcatcgaccatgctagctctgttaccgagaagcctacaagctctttgcaatcctctatggcaacttgctcacgcgaacggatagataacatcattaccgttgggattctttccattgctaacttggctttgtcatgtgcttcctttaccgcagcacgtaaaaccgaatgcgggtttaacccgtgacccgattccttgacgtgtgtccagatgttagagacgcacaactcgtgagcatcgataaattggcatgctttcgcgacaagagaccgaaagttatcttctttgtatggttttaaaattgtggtttcatacgaggaagtgtgaacggacataagcataactaagagaagagcggtggtaatccccattttcctgataagtttggtttttttgtttaggttagcaaaagaaaaagaaaagatgaaagagtgaaagccatatatagaaaaaaaaactagggaagtttaggtattgattgttggtgaagaaatgttctttgcctctttgagaactgtaggaacaaattcaaactttaattttttaccttcttttgttactcttttctcaagccaaagttattctttcttcattgttcaaatctctcattcaatgctctctaaactagattctgcttctagttctagcgacttttacacaccctcctagcctccaaatagctttcaccggtacagttacagtattatctaatcttacccggttcagattgaaaccgacgcaatctcaagtaaaccgatagaatgacgggagaacaaccggttgagcttttggagtttacatcggtttattactttcttgttattttcttaacccattggttcatcaaagtgattaaataaaccgggattatccggattttaccgctacgttccttccctcccatttgtcatcttatcttctgcgattactggtaaagtgagaaatccgttaatccctagagaaactgtaatcgtcgcggtgattcggagaaattcttctgcttccgcggaaaatg

SEQ ID NO: 10296 - DNA, 3000 bp, Unknown; identical to SEQ ID NO: 10287
  misc_feature (1)..( 3000): cDNA_ID_3035846_gDNA_ID_2213641_Annot_ID_181245 3000 nt of promoter + ATG

SEQ ID NO: 10297 - DNA, 3000 bp, Unknown; identical to SEQ ID NO: 10286
  misc_feature (1)..( 3000): cDNA_ID_2685632_gDNA_ID_2213641_Annot_ID_181244 3000 nt of promoter + ATG

SEQ ID NO: 10298 - DNA, 3000 bp, Unknown; identical to SEQ ID NO: 10285
  misc_feature (1)..( 3000): cDNA_ID_2715425_gDNA_ID_2213641_Annot_ID_181240 3000 nt of promoter + ATG

SEQ ID NO: 10299 - DNA, 3000 bp, Unknown
  misc_feature (1)..( 3000): cDNA_ID_3035856_gDNA_ID_2213641_Annot_ID_181239 3000 nt of promoter + ATG
ttcaaattctggattgtaaaaatgttatttgttctgtaggtaattgtgaatctaagaatgcgtttgtgatctgatttggaataattttcactatgtatgtattaggtgatgtaaagagtccaagacttgtgccaaagcctcatggagctactttctcaatgcaatcaccttgcttggaacttggattttctcagccaccggtaaaaacttttccgcattgaaaaacatataatgaataagcctatcatgagtttcctttaatttgtttctgagtatttagtgtttgttggctgtttactttggtcatttagatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaaggtaacatatagaaactagtttgatacttttgtgcaaatgagattttattactgaattagtgtgtttgcttttgttatgtatgttgcagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaacctgatcctttaccgtttcacagtcaaacggagagagataaagaactcttgccttggtataaaggattttcctttttgccaatccgctttggctgtgaacaggcaaatcatctttggctcattctctattaaggtaacttcgccgtgaggtgaaaaaagctttgatatatttatcttcagtgtaaaagtagttaaaactggtgaagaacaatgatgtgtttggtcactaaacccacttgttccaactagtagtgtgtgttttaagaaaactctgttatctgattttgtagctctctctggctttgtgtgtttctcaaacaactgtaacaacttttaagttatgtggtttatgtaacatatttaagacctgtgtttttgtatatttggtcgaatttatgttattatttgcttattatccaggacttatacagcaaagacagagtaaaaaaaattctgttccaaatctaatggttgatcaatctagctatcgatccgagatcgaaaaaaaatcgagcaacgttcaaccactcaactaagacattccatttgtcaacatgtgaaacgatatattatatatatcctaaacaaccatggttagcttttaaccgcagttaatgttacatgtattaaacgtctaaattataaatagatggcggttttttcccaagtaaatctgtagtgaaaaataaatgcggaaatggctacaaaaaacgtaaaatatttagagtaaaaaaaaataaaaacgtaaaatatttagcactctataatataataagattatacttgaaactgcatttacttttgtttaagaataaatattaaataaatttaacattggattaggtatataatctattgtagtggccaaaatctataatatctttaagttttagatagctatatgtgatatccatgatatgattaataatatattagcaaatatgaaagaaaatattcatattctattactatgtttttactgtaaaatgatcatgatttttttttgatatttatagcttggataaataatataatattataaaataattcgcttagagtattagtaatactgttttatatatttttcgtagggtgaaaacaatttttctgtaatatatatttgtgaagttttgtattattgtagatgaagaagatattgacactctatatacaggattatatgtttttgaatttgtttttatattatagatgtagtattatggttatgattgcgtttttaatttttgtgttatatgtttgtataatactaatgacaaaatctgtatatagtctagtaaaatttgggcaattatttaaatgggtaaaaagtcactatgataacgacacatcagcatgacaattttgttaataacacttgaggataaagtttattttatagaatgattatcaatttatataggggatatcaatcgattctgataattcatcttggttggactttggtcaattttggttttgtgttggtagtattgtctgaaaatattatgaaattccagctgggttgaattatcaaatgaaaacaaaaatctaaaaccgagtgctagacttattgttttgtaaatagttgattggtgaatttcgtataaataccagtactaaactcattggtccttgttcgactagttcttgttgaactggttgttgaccttgactagcagcccgattcttagcccgttttgattcattggccagatttggtagcttgggtttttggtgtcttccacctatcggtcttcgtggttcatcgtcatcattcattgtaaaattcctgaaatatagaacataaaaactaataaatcaaattaaaacaatccatatgaccttaattaattagtaatcaatattgtgattcccgtaactaatgtttagtaatcaagttaagagaatctagacctgtaccatgacttgatatactcctgtaactagaatatatggtgagagagacagaaaatacataaataagcatgttagatatatatattgattgtactatcatt

SEQ ID NO: 10300 - DNA, 3000 bp, Unknown; identical to SEQ ID NO: 10291
  misc_feature (1)..( 3000): cDNA_ID_2715393_gDNA_ID_2213641_Annot_ID_181253 3000 nt of promoter + ATG

SEQ ID NO: 10301 - DNA, 3000 bp, Unknown
  misc_feature (1)..( 3000): cDNA_ID_3035864_gDNA_ID_2213641_Annot_ID_181234 3000 nt of promoter + ATG
gcaggatcactacagcagtgtggatcacaaagctaaggtcaagaaaccataaagagagcgtgaaaggttttcagatgcatttattaatgccaaaataaaaccttcaggtgccctggttacaatgatcatatgacaaaaaaaatattcttggggtttgtcctcacccaagaatcaaaccttgtttccagagtttttacagtattaaatattccagtgctaaacaggccttgatcaccataatttggactaaatccgactaatatctcttaaatatgctggacaaccatatattgagagtgaaagagaaggtggggatctaacaaaactcagtttggttcaaaacttacctgatcaaatggaggctgaggctttcctctgcaaagattagataaagtccaagcggcgtttacaagcatagaaagtttggctccatggtttaactgcaacagcagagaaggtagagctgcatgtccaaggactatatcacggcatctcggagagtctccagaaatatttcctaatgcccaaacaacctgattgtccaagaatacagaagatttgcaactgaactatgggaggggaacaatatactcgacaatacatatttaacctacaactatatttagtctaaaaattgtatcttctgttcagaaataatttttttttaaaatgatttccctctattgatcttagtcatcgtctttatctttgaactttatcaattgcagaggcaacaacaggctcttagcagtcagacaaatttgagaacaacaatagcatgcatgatgatcaatcaccacttcaatatacctgctcacggaccacatcatatggcgagttgagaagtctcactagtattgcaacagctccatgatcaatcaccacttcagtattctcagatgttccagatgcaatatttgttaaagcccaagccgcttcaaactataaaatttgttccacgaaccgaaacacattgaccttatgaagctaggggtaaaaccagattgcagattgaatgtacaggtgtatcgaagctaacctgaagctggggggagtcatcccatgttaggaactccacaaagcgtggaaccaaaccggcctgtataacttcttcaacacgtacgttaaacatttctaccaaaagaacataaaatagcattagagagagtgaatacatcgttatagctttagtttcatgtcaaactacattacagtctaacatcagaaactttgaaagtttgctgtggctcatctagcaatgtcaatagcttgattatgccttagcaaccaaggtatcaaatctgttagtaaataagttaatgggatgtctctcaccaccacaaagtaacgttctgatctgtgtagtagcctcaatcaacagatccctctcgtcagaccaaatacagcttatcaactgtaaccaatcgaacataccaactactcaaaatagaaaaaatgatccaaaatagaaaatgtaatctcccattccgagaaatgcaatcaccattatcatattccagaacatgcaaaagaaaaatcttcagttcaaaaataatatggaaagtcttaaccaagctatgtagctccttctgataattctagcactgtataaccaagtttcagaacatgcaaattcttcataaaccaaaatcaatcatgaaaggttagtagctcactctgagaatttaaaatgtcaggaggcaagtaaaaactctagcgatcatatatcgaaaattcaagcgtcaagtcaaatttcacaacgaacatgtcaagaaatacgaatctcaagacaaattacgaacaccaaatttcaaacacggaaaaccacaagaaacgccaaaatggatcgaaattggataggtcatttcaaaattcctaacactgaaagcatgcatctacgaatcagaaatcacatgtctccagaattgaactgtcagattcatcaatctccaggtttcgcgacgaaaatacaaaatgtgtacatatgccaaacggaccttctggtcaagagaatcggcggaaggagaatgaggaagagcctcgcgacgcttcttaagcaagctctcttctctcttagctttgcggatctcaaccatgtcgtcctctcttcgccgccgtccaccaactccgtcaaccaccgccttgtacccgctcctccgtactgacattgtctctcctcccttcatcttttgatctcctcacctccctaccaaatgatttcgacggttttatgcgaccaaaatcaaattcccacgaaacaggcccacactgaaaaaaaaaaaaaaaatttaattgttagggttaaatcgatatttaaaaacattagggagtcaaattcaaatttgtaagacaagttagggagaacaaagattaaaaaaaatgcgagcgcaagttgattcgttcccgcctaattctgtaacagatattatttcactattatttcgtgtcgaataaattgggccaatagcttttattattttgaaaaagttcacattataaaatattttaaatattgtatatatacacattcctgtgattatggtgagtttgatgatttcgtaatacataaaacagaagaaaagtattaaccataacaaattgcctttgctaaattgtgtgaattatgtaattttaagacaatcatagtgtgcacagtccttgatcatgcattatctgagcatagtccgtaacagagaagattccctgagctagaaaagcaaaatagaccatatctatctataagtcaagataaagtgttgtattttgtatagacatatcttagttgaaaagttattcttcgtaaaagttatttttctttctatttttggtcattttgttgtaacgaagtttttattttgactttccaccgcatattacctcttccgaaatacaagctctttaaacatcatagagattacgtttttttggaatataaaagcataataaaatgaaaacaaaagagttaggagagaaaaagggggaaaaaaaaaaaacgagatg

SEQ ID NO: 10302 - DNA, 3000 bp, Unknown; identical to SEQ ID NO: 9285
  misc_feature (1)..( 3000): cDNA_ID_1715608_gDNA_ID_2213642_Annot_ID_132285 3000 nt of promoter + ATG

SEQ ID NO: 10303 - DNA, 3000 bp, Unknown; identical to SEQ ID NO: 9286
  misc_feature (1)..( 3000): cDNA_ID_3035959_gDNA_ID_2213642_Annot_ID_132286 3000 nt of promoter + ATG

SEQ ID NO: 10304 - DNA, 3000 bp, Unknown
  misc_feature (1)..( 3000): cDNA_ID_1015752_gDNA_ID_2213642_Annot_ID_132292 3000 nt of promoter + ATG
gcttgctttgcggattttgccatagaaggatttgctaaagtgtagaaacacattgccccttcctttgccgcttgcttaataatctcgataagcctctcctcatcctcaacctgatcaatccccaacccaaaaccaaagtaatgacaattctcaaaacctaacactttcggtttaaaagtcaagttttttcttgctcagatgatcactaattgcaactagcattcactaagatataatcagtttccatgtaatgatccaattttatctatcctatgagcaattctactagcaacattcacagagaattctaagaaaggacatattttttcctgaaagtaagaagatttgattttcatttacccaggagaagagatgggtattcacagaagagccacgattcaacgaaaaatcttcgaattgtcccaaagcggcgttaacggaatgctctgccgtccacccagttccgtcggaaaccaaatatatagactttcccgccgttacctccacgtcgatcgccgtcgtcttcttatcagcctcatcggtcggttgggcttccgttacttgacggcgaggtgagttatcggaacggggaattggacggtcaagcttaacaccagatcttaaagctcggcccctagaccaccgattcaatttgggactaatcttcagcttcggactcgacgaacctgtcggaattggaggttcggaattaggctcgtgatggcccgagacgccgtgtaaattcatatcgccaaagtttatgataacttttttttttttttttttctgagcgacggttaaggcgttaaccgctaaattgcgttccgatgaaaaattgacgaaaatgtcctcactaattacttgggcttgaaaacagatatttgggctttaaaaagcctaagtaaaaagtgcccaaaagactcgtggaaacaataataacacgcgcatcgctagagcttacgtttgacgcgtatcgtcgaccacaacatcgatatcgatcgagccgacaaaagaaaaaaaattatgtgaacattcctcttctttcttttttggtttaaatgttaacattcctcttctttctttttttgtttaaatttgaagaatcctctttctctctcacaatcacacgaatcttgtcttcttttctctccgtctctttcgatacttggcttcaatcctgtgacgtcctgttctattgtgccttaatcgggtaatctaaaacagaacatacactatcagttttttttcgtgccctgcttctcgaagtttccgattgtgtggttggttgatacatatctcattgattatctttgttactgttactttcatctcttatctcattcaattataatctagggttcttacttcttctttcttccctctccgctaactatttggcctggacaccttttttattttttttatttgaatcattatagtaatcgtagctttgtagatttcttgctgtataaatctctagaaaatcgctcaacggttcacggaatgtgattcaagaatcttgtttatgtttgttctttgatttaggtatctaggttcgtgtgagaaaacagaacaatataatgtatccttgtggttacgttgctcaagtcaccaacttgtctcctcaagccactgagaaagatgttcataggttcttctctcactgtggtatcgtcgagctcgttgaaatcaccgggtaacaacaacgttcattgttcagtaaattattaatcattcttgaatctgtttatattttgtttcatgtctccatggatttcaggtgccaaggggatgcattaacggcttatgtaaccttcagagatgcgtatgctctggatatggctgtgttacttagcgtaagtcccttaattagctagaaatttccagtatgatcttcttggcattgattttaatgttgatcttcagggagctacgatcgttgatcaaaccgtttggatatcggtctacggtgtctatttacatgaatctaacaatctcagacaagaagaagactatagtgttacggtaacattaaaaacaatacttactaggttactttaggttataagccaaagattctcgaaaatgtttctttgtaggtgactcgttcagacgcgtttgcttcatcgcctggagaggccataaccgtggctcaacaagttgtgcagacgatgttagctaaaggctacgttttaagcaaagacgcgattggtaaagccaaagctttggatgagtctcagagattttcaagcttggtagcgaccaaattggcagagatcagccattaccttggcctcacacagaacattcagtcgagtatggaactcgtgagatcagcggacgagaagtatcatttctcggatttcactaaatccgcggttcttgtcacgggcacagctgctgtagccgcagccaccattacagggaaagtggctgcagctgcagcgactagtgtggtcaacagtcgttactttgctaatggggctttatggttctcagatgctttgggccgggctgcaaaagcagcggcccatatcggtggaggaggaagcaattgatgtaaaaagtctttgggcttccttggaaaacataaataaatgatatgtgaggttttaaagcataaaaggtgttgtgaaaagaaaaagaaaaaaaaaaccatcatgaagatatgattagtaacgttacatgatcgaaaatatttgaggcagaaactataaaataactttattacatgaactggagaatatatatgaaatataataataagcctaaagcttttaaaatattaaggatgggtcctagaaacctccctagcttgatcctttcctcattctttctctctctttctcttatatgagaggttgatgagatccacaagaaacacctaactcatttgatagtgatttccaaatctgcaaacaacaaagtatatttgatcatcactatactgatttcacaatccattaatcactgataggtttttggtggaatacatacatg

SEQ ID NO: 10305 - DNA, 3000 bp, Unknown
  misc_feature (1)..( 3000): cDNA_ID_2715524_gDNA_ID_2213642_Annot_ID_132293 3000 nt of promoter + ATG
ttcgtgcatgttcttccaattacgtcaatcatttgaccgcaacgttttaaccttttctaaactacgccatgtgttaccaattagcatcttattaatcatgtggatgaacagattgaatagcaataatcatccacataaattgacagtcgaaaaaaccttgcatgtttccaggttcatcgtttacttacaggaagaaaatatcactaattagttatataaatcgaagatggacacaaatctctgatcatctactttggataatcagaagattttttggtaattaccgaaatattcattcataaacgaatagaaagagtcaaaatagattaactaaaatgacattaagttttggatgacttttcttgaacttgctaaacacacccaaattgcaacgttgcaactaaatgctaatgacagatattcttttgttttatagactagtaataaaagaattcagagtagccacaattattagttttcgttatccttcatcctcttacattcgttgactaaaacatatgattcatcatgcctcggttggatttgttattcaacttattattatagacatatattactttattcacttgatactttatcgacactggtgtttcatcctctctacggtcaaaggagtgtgcttagtagcgttttgagatacgcggtaccgtagtactagtgtctctaccgtcatggtacagccgcagaatcacagccgcggtttcttcaatcgccttattcgtcacatctgcaagcgccacaaccccaagaataacacatgagaatactctgcctacttgttaactttttttcttactagcattaaaaggaaagaaaaaaacagcattttgagtagcaaatgagaatggtgtttaagttttgtttacctatcactgcccatccggggtttcgctcatagatccttgacgcgaaatctagttctttccgaacaagatcaatccccgagtaattgttctctgcctctgtatctacgcctagcgttttaacccttgttcttctaatcgcttgcagtacaacgagctggatcttcaaaccaaaaacttttctcggttcaacctgaaagagcgtcctgggtggttccacgcccatcacaaacggcacattagcaactttgtaccctttttgagcaatgtaagtggacaagggcgtcttccctgtccgggaaaccccgacaagaactatatcagccttgcttaagttctcaggtaaagtcccatcatcttgcttaatggtaaactcaatggcttcaatccttttgaaatatgcatcattgagagtcttgaccctaccaggtgctccacgtgtaagacctgacggagaaacacctaagtgagacgcaatcccttcgatgattggtcctagaatatcaaccgaaagcacacccaactgatcacaagcttgctttgcggattttgccatagaaggatttgctaaagtgtagaaacacattgccccttcctttgccgcttgcttaataatctcgataagcctctcctcatcctcaacctgatcaatccccaacccaaaaccaaagtaatgacaattctcaaaacctaacactttcggtttaaaagtcaagttttttcttgctcagatgatcactaattgcaactagcattcactaagatataatcagtttccatgtaatgatccaattttatctatcctatgagcaattctactagcaacattcacagagaattctaagaaaggacatattttttcctgaaagtaagaagatttgattttcatttacccaggagaagagatgggtattcacagaagagccacgattcaacgaaaaatcttcgaattgtcccaaagcggcgttaacggaatgctctgccgtccacccagttccgtcggaaaccaaatatatagactttcccgccgttacctccacgtcgatcgccgtcgtcttcttatcagcctcatcggtcggttgggcttccgttacttgacggcgaggtgagttatcggaacggggaattggacggtcaagcttaacaccagatcttaaagctcggcccctagaccaccgattcaatttgggactaatcttcagcttcggactcgacgaacctgtcggaattggaggttcggaattaggctcgtgatggcccgagacgccgtgtaaattcatatcgccaaagtttatgataacttttttttttttttttttctgagcgacggttaaggcgttaaccgctaaattgcgttccgatgaaaaattgacgaaaatgtcctcactaattacttgggcttgaaaacagatatttgggctttaaaaagcctaagtaaaaagtgcccaaaagactcgtggaaacaataataacacgcgcatcgctagagcttacgtttgacgcgtatcgtcgaccacaacatcgatatcgatcgagccgacaaaagaaaaaaaattatgtgaacattcctcttctttcttttttggtttaaatgttaacattcctcttctttctttttttgtttaaatttgaagaatcctctttctctctcacaatcacacgaatcttgtcttcttttctctccgtctctttcgatacttggcttcaatcctgtgacgtcctgttctattgtgccttaatcgggtaatctaaaacagaacatacactatcagttttttttcgtgccctgcttctcgaagtttccgattgtgtggttggttgatacatatctcattgattatctttgttactgttactttcatctcttatctcattcaattataatctagggttcttacttcttctttcttccctctccgctaactatttggcctggacaccttttttattttttttatttgaatcattatagtaatcgtagctttgtagatttcttgctgtataaatctctagaaaatcgctcaacggttcacggaatgtgattcaagaatcttgtttatgtttgttctttgatttaggtatctaggttcgtgtgagaaaacagaacaatataatg

SEQ ID NO: 10306 - DNA, 3000 bp, Unknown
  misc_feature (1)..( 3000): cDNA_ID_2715520_gDNA_ID_2213642_Annot_ID_132294 3000 nt of promoter + ATG
ttttacgttggttattactattagtgcaaaaccaaaaataaaaaaaccaaagaaaaaaacaaacacaatcaaattagaaatgaaagttgaattaaacaccttatttactatataaacacacatatatacttacttatatagatacatacctcagcaaggagtttcttgttataggcaagtagagaagcattgtcggatttaagagactcaaactgtttcttgagtgaatcataatctctctcgagctgtctagtcttccacctagctctcctgttttgaaaccaaatcgcgatctgtcttggttgcatccctaatgctttagctagttgtatcttcctctctggctccagcttgttaccaagctcaaagctcttctctaatgccttaacttgctctaattgcagcctcttcttcttctctcccagcatagtatgtgccccatcgtctgatagattctcctcatccaaggtttgattatgatcttcttgcacgttcattaaagacatagatctgttcatcatgtagtttcctcctcctatatacaccaacagaattcatgactcaaatctatttatgtggagaaatagtgagagaaagagagagtatagtaccattgaagagatgaggaggacaagaagggagctgatcttgactgttgtcttcatgaagttgttggaacataaaaccatgttgaggaaacgccatctctaatctcaatccagcttctgttgttggatcaaacacatacatgtatgtattccaccaaaaacctatcagtgattaatggattgtgaaatcagtatagtgatgatcaaatatactttgttgtttgcagatttggaaatcactatcaaatgagttaggtgtttcttgtggatctcatcaacctctcatataagagaaagagagagaaagaatgaggaaaggatcaagctagggaggtttctaggacccatccttaatattttaaaagctttaggcttattattatatttcatatatattctccagttcatgtaataaagttattttatagtttctgcctcaaatattttcgatcatgtaacgttactaatcatatcttcatgatggttttttttttctttttcttttcacaacaccttttatgctttaaaacctcacatatcatttatttatgttttccaaggaagcccaaagactttttacatcaattgcttcctcctccaccgatatgggccgctgcttttgcagcccggcccaaagcatctgagaaccataaagccccattagcaaagtaacgactgttgaccacactagtcgctgcagctgcagccactttccctgtaatggtggctgcggctacagcagctgtgcccgtgacaagaaccgcggatttagtgaaatccgagaaatgatacttctcgtccgctgatctcacgagttccatactcgactgaatgttctgtgtgaggccaaggtaatggctgatctctgccaatttggtcgctaccaagcttgaaaatctctgagactcatccaaagctttggctttaccaatcgcgtctttgcttaaaacgtagcctttagctaacatcgtctgcacaacttgttgagccacggttatggcctctccaggcgatgaagcaaacgcgtctgaacgagtcacctacaaagaaacattttcgagaatctttggcttataacctaaagtaacctagtaagtattgtttttaatgttaccgtaacactatagtcttcttcttgtctgagattgttagattcatgtaaatagacaccgtagaccgatatccaaacggtttgatcaacgatcgtagctccctgaagatcaacattaaaatcaatgccaagaagatcatactggaaatttctagctaattaagggacttacgctaagtaacacagccatatccagagcatacgcatctctgaaggttacataagccgttaatgcatccccttggcacctgaaatccatggagacatgaaacaaaatataaacagattcaagaatgattaataatttactgaacaatgaacgttgttgttacccggtgatttcaacgagctcgacgataccacagtgagagaagaacctatgaacatctttctcagtggcttgaggagacaagttggtgacttgagcaacgtaaccacaaggatacattatattgttctgttttctcacacgaacctagatacctaaatcaaagaacaaacataaacaagattcttgaatcacattccgtgaaccgttgagcgattttctagagatttatacagcaagaaatctacaaagctacgattactataatgattcaaataaaaaaaataaaaaaggtgtccaggccaaatagttagcggagagggaagaaagaagaagtaagaaccctagattataattgaatgagataagagatgaaagtaacagtaacaaagataatcaatgagatatgtatcaaccaaccacacaatcggaaacttcgagaagcagggcacgaaaaaaaactgatagtgtatgttctgttttagattacccgattaaggcacaatagaacaggacgtcacaggattgaagccaagtatcgaaagagacggagagaaaagaagacaagattcgtgtgattgtgagagagaaagaggattcttcaaatttaaacaaaaaaagaaagaagaggaatgttaacatttaaaccaaaaaagaaagaagaggaatgttcacataattttttttcttttgtcggctcgatcgatatcgatgttgtggtcgacgatacgcgtcaaacgtaagctctagcgatgcgcgtgttattattgtttccacgagtcttttgggcactttttacttaggctttttaaagcccaaatatctgttttcaagcccaagtaattagtgaggacattttcgtcaatttttcatcggaacgcaatttagcggttaacgccttaaccgtcgctcagaaaaaaaaaaaaaaaaaagttatcataaactttggcgat

SEQ ID NO: 10307 - DNA, 3000 bp, Unknown
  misc_feature (1)..( 3000): cDNA_ID_2715512_gDNA_ID_2213642_Annot_ID_132296 3000 nt of promoter + ATG
caccgcagaccaatgatagtcaactacattttgatgttaattaatctcaatcttctaaccacaaactcttataatattgcaagttagtttaaactacttacataattgagtataaaatagcttcaaccttcatcaacaattcattatcaatcgagcaaaaaacaaaagctaagagcaacaaactaaagattttttaagaaaatggcagcttctaagcgactagttgtctcttgcttgttcttagttttgttgtttgctcaagccaattcgcaaggtttgaaagtaggtttctacagcaaaacatgcccacaactcgagggtatagttaaaaaggtcgtgttcgatgcgatgaacaaagcaccaacacttggtgctcctttgcttagaatgttcttccacgactgcttcgttcgggtatgtttctgtaataagtgaaatgaataatgattttaatatatttcatgatgtcacgttcttaataatgtgagtgaatcgtgtatgatcaacagggatgtgacggatcagttttgttagataaaccaaacaatcaaggtgagaagagtgcagttcctaacctaagtcttcgagggtttggcatcatagacgattccaaggcggctctagaaaaagtgtgtccgggaattgtttcttgctctgatatcttggcacttgtcgctagagacgcaatggttgcagtaagtaattttcacataatacaaaatttctacatatatacaaatataatagagctctcttttaatttattatatatcctgaatatgttaatttctagcttgaaggaccatcatgggaagttgaaacgggaagaagagacggtagggtttctaacatcaacgaagtcaacttgccatcaccttttgataacatcaccaagcttatcagcgattttcgctcaaagggcctcaacgagaaggatctagtcattctctcgggtacgcaaaagtgaattaatgatatttactatagtctgaaaaatgaataattaatgatggagaatatacatgtttttctaaaggtggtcacacaattggaatgggacattgtcctttattgacaaaccggctttacaacttcaccggaaaaggagacagcgacccaagtttggactcggagtacgccgctaagctcaggaagaaatgcaagcccaccgatacgacgacggctctagagatggatccggggagtttcaaaacatttgacttgagctacttcacgctagtggctaagagaagaggacttttccagtcggatgctgctctactcgacaactccaagactagggcttatgtcttgcaacagataagaactcatgggtcaatgttctttaacgactttggtgtctctatggtgaaaatgggtcggactggagttcttacgggtaaggccggggagatccgtaagacgtgtcggtctgctaattaagagatatagaaatgaaaatatctcaatatatgtgagtttgattattattgtttgcttcttttattttgttgtcatccctatattaaatgtgattgttttcttgggtattgtttcttgggaataagctgtatctaaaatttataaaagtcttgaaagttcagaatgttattattaagttataacgtttagtcattttgaaaagccaaaaaaaaaaaaaactgaatcaccatggatttgaatattgagaccataattaagttaaacaatgtattttttattattaattaataataaaagttaagatttgaaggaaaatggttaaaaaccaccaacttcagcagaacatctgttccaaactttaagaatcctgggacgacctttagaggcaaatggtttgtaataataagtctgaaacaaaagattcctcagcaccatgtgacattcttggccatatatgatcattttcagacaacaatacctcgaagttggtatgttttgaagaatctcagacatgacttgatcgctacatttttctccccccatcaagccagcgcaagtcccggcaaactgaacaagttctgttgactgtttattaagcatgtctatattgtattcactcgtactcggagatcttgcaaacgtggaatctaaatcaatattgggatctatcaacggtttctcatcatctgccaaacttggataagcaaacagtaccaacgtggtgattagaacaaaagccatgtaaacgtgattatttttcttcatttttttattttataacttagcctcctctttcacctatttactccttgtaaataaaatttgtatgtgtatagagattatataccctaaacacacagtagtcaactgaatgttattaacttatccgttatattgtaattaataaaactacgttttgtttctttgtttgttttctattaacaaaaaaaatgatttactctataaaatttgacgtttttttttgtaataaaaaatatgttcagttacgttattactattttatgtattaaatgtaaaattgaaaaaatgctttatggaattctgaatttcttgaaaacaatttggagggtggcccaaatcatcaattttcttttaaggtatttattattcaataaagttttattccggagttatgctaaagaaaagagtgtcgatatctgtattttgtggacgatttagattacgaagaaaatctcgaggaataaaaatttatgtggcgagagatcaattgcatcataatattatgctcatgaatcacgcgagagtttatggtgatttcgctcattgtgtccccattctctcttcttttgtttgattcctcctccctcttggttaacaacaacttcactcacaaagcattcccttttttatttttatcgctactctccgacaaagccttcttctttggatcatctagtctaggttcggttttctcaattagctctgttcgatttcgcggatgaaacttgttcaagtttgtgtctgatctgctctgctctgctcatacttaaaaaaggaaactttatttttctgtaa

SEQ ID NO: 10308 - DNA, 3000 bp, Unknown
  misc_feature (1)..( 3000): cDNA_ID_2715508_gDNA_ID_2213642_Annot_ID_132297 3000 nt of promoter + ATG
aaggagacgagaatagagctgagaatctcggatcatcaagttcagcagcaggtatcttgtcttccgaaatatcagtctttccttttttagctttccgtttaatattataccctttcagaccattaccatctcctgcattctcatcagctagtaacaactcaagctccgctctacttttttcttccgctgctacttcctccttctttgtctttccttctttcttcttcttcttaagaggaggttcctccataaagaaatcgtcatctccatcatctttcactgcctttctatcaatgttataatcgtcgtcatcatccggagaagaatcatcatccttctgtttattcttcctggctctcttcttctcgcgtctctgccttagatatgtttcccacaccgattctgactggttgtctttctttttaagaatctctttgctaagatcttctaaaccggtattgaatgttacctccatatcctggtcattctcctcctccaggtctttatcagaatcaacatcttcggcttctattaaagctcggtacttatctttcttcttgtccttttttttactctggttaataacttcattgcccaagtcgtcttcctcatcagaatcactctcatcagaagctaaaaactccttcatctcaagatttgccaactatgatttgagaaaattttatcagaacaataacactacaacaatggagatgcttttaagcaagcaattaagcctaatcacataaattataaacccgtatacagacctgttcaggattgaatttctgatttaaggtcttaatccggtgcggttcatcttcatcccaagaaagattaactttgctcatctgcagagctcggctctgaaaatctaaaccttcataaccagctggtgcctatatttttataacaactataagatcacaagtattcacaatgaaaccaaaagatctcaagtaaaaggaagtagcggtaacacacctcagatgcaatatcacgaggtggatgtttgaattccatggaatccggaataaatcttaggtcgagcttgtttgatgatctctcaaactcaattccatcacatgatttgtacaagtaatctgcagtagcacttgaatcacattcggcaacagcgaaataatacctgaagcaatagtaaaagcagagtttcagtaatagtccctctccaccacatatagcttaagacgggcagattcgaacttactttaatctacttatttcataggcacgtagcttctggttgatgacatcctcatcttcctcctcttcttcatcttcatcatcactagcgtcattctttttgtcgccatcaattaccggcccatggatttcctcctctttcattcgctcaagtccgaactcagatggatagaccgcaactgacaaaatgcgcccatcttttggcagaaacgaattcaacactacgtacaagtctttagcctaagtaacaaaataagatatcatccataagaacaactccaaaaatcacagagcagtgactctagagtctagacaaggcagagaaagaaacaagctctacttaatcttagattcgttccataaccatagcaaagatattaacgtcaaagaaggccaaattgaaacaaaacatcatagattgagagaacttacagagacatgtctccaatccatgttaacgatagccagtctatgagtttcttcttggataagcggtatgttctcttcctagaagccatcatcatcatcatcaccaaatttgcaacatgagaaaatcaattacttgtcaaaaactagtagaagaacaaggcacatgaatcaaagttgagcaatttaccggaatttctggtccctcatcttcatacatagcttcatcgtcctcatctgtatcatcctcttcttcttcctcctcctgcgaggataactcttcagagtctgctttctcatcagattcatcatccaaagaagcaacctttagctcactctcactctcttcctcagattctacatggctagatttttcggatttcaaatcatttatctctgtctcactcccgctctcatccccagattcctcctcagttttctgcttaccttcatcttcaattcgataaaactctcgaagcgaatctttgccagtgcctcctgttctacgcttgccacgcttatcgacaggagcagaaccagtggcaaatcgcttatcattgaacataggctggaatctggagtcaatggcgactttggagtcacgcctccgcatcctacggaatttagggtccgtgtgcgccgacgaaaaccttggatccttaatcatttcgtttccttcctctgcgactccactggatcctttagcttcttcaatgctctctcctttcctttgcttcttattctttgaacccatcgttagactgattcaggaacaacggagcttctagggttttaggactctggtagacgaagaagaatcggaaaattagggtttttatatgtctgctcaaaaaaaaaaaaaaaaacatgacgtcatgtgtaaaaaagagttatctaaaaaagcctgcgtgtcactagacgaataaacttactactattcacattgattccgattggatttggaacctaaaacactaaagagattaaaattttgaattcttcatcatgacgacgacgacgacgattcagtctcctctctctacacgttgaatttcaatcggcttcacgaaccttcaacctcgtgcggatcgaaattcgatcagtttgtagtaaccgacaagttccgaagatttttcatctgctggatttcgtcgatcagattgaaaccgagcttttcaatcaggtgacttggatatttctctacgttatgctcgatctgaagaattgggattcaaatctagtctcatagatcgattctgattaaactcgtggagatccaatctctatcactagttcgattggattgttgtttgttatcttcaaggcctctctgtgtttgtgagtgagatg

SEQ ID NO: 10309 - DNA, 3000 bp, Unknown
  misc_feature (1)..( 3000): cDNA_ID_2715504_gDNA_ID_2213642_Annot_ID_132298 3000 nt of promoter + ATG
aaaaaaaagaaaattactaatgaaattaggatatggttagtaaattgtagattaatgatttggttttgtatattattgatgttggtcatctagatataaaagtaaagacttacttagtccatagcttctatcgcggctgaggatgtcataccatctcattctttcgcaatatttcttgtatacatggtcatcttcaactccttgtgtttgaatattctctatcgtaaccgaatcttggagcgctgaatccaagcttgcaatagataaaggcgagggatgatctcttttgctagaaactagaaaagatagatcattctccacgtctgagtttacaatttcttcttcttcgtcatcgttggttaaagaagcttcatcttcttgatgtattggcatagtttgaatttcgaactcaagattcttctccatgtttacaccatcaaaaatgtcaacgtcgtgttcctcctcaacctccttagcatcaagaagctcaacaacatcttcttgatcatattcatagaaaaaatcatccacatcttcttcttcttcaagaatcttgcctttttgcatagatatacgaacttttaaatgactatccacttgatatttaaacgaaaagctaaatgcaggaaccgggttatgagtacttgtagagagttccaagttatcaagggtattcttgatctcttgcctagactcaatatgacaagtaacctcctttttaaacataatgactcggaaagaactactaactagcttagagaacgtgaacaagaccgatgaaaaggcgttgtaaagagcttgaaagggtgggagaagccataaaaagaagagataaagccatataagaagttgacaaagaaagagaacaagagggtgcatgtataatttcatgtaagacgatttcaagaaaccatcttgaatcactatggattctatcattagccaacatgctgagagtaaagccatcaaatgtctgagagagagatgagagaggggggagagagagagagagactcaagagagtgtctttataaagaagaagaagaagctgctgagaaagagccttgttgaaatatttcccccaagactaatcattaataaataaagttggtaaaaggtcaaattgattatcttgagtgttctttcctatcagttccaagactttggttttaaacatgtttggaactatccggatattgaattaaacttgttcaatttgtaacagaaaatattcgtctttagtgaattaactaaacctataaggccatgtattggctataatcatcttttttaattaaaagagccaacttgaccctccatagttgtaactgttaatcacttctcaagctccatcacaacgcacatatgaagaacatagaaaactaacaaacacacatgatgatgttcttcaatgtaagtaacatctctttcgcaaccttcacaattgaaaacctaaccagatcataccatattcaacatcaatatctatttcgatagggctcgatcccgaatgcgaaaaaaagcaagcaaatcagagagtataaccaaaatgttcttcactataacctggttcccacaatatccttacaatgcttattccaattgtacattatttaaacacatggactataacatatataagtttttgtaaaagagtgtgtatgagagaataaaactaaccgaagaaaagtgtagtgatccaatctcatttccaaagattgaacctttttttatatatataataactttgttcgcttattcatttcttgatcttcctctgctgcttctttggcccggaaacgactaatctccttacagaacaaccacacctcgctctgaaaacaagcacggctcgcccattaggcggagccatcttcttcagctcagcttccaattcacggtgatgaacacgaggcaactcaaacattcccctcttgttgctggagctcttgacgcattcctcagtctcaagctgaatatcaaactcaacagctttcctaaggcctttacaattcggtttgccgcatctctgcatagtacacaagagtataacaagccaagtagagatggcagcacagaagatactcaaagctaatgatccatacacaatcgggttctgcaaaatctcttgtttgactaaaagagagagatctgaaaagacctcaatcgatttgagggtgatgagtttgacgtaagggaagaagaggaagccgcaggcggtgatgaccgcgataaggatcacgacgtcgatagcagcggactgagatccgtcgcagacagggaatttggaacaggttggtgatgatgaagatttattacgggtgtttctggatttaggtgaggagtgagacatgatcattgggtcgacggaattgcagaccgagattgagctatgcaaatataccatctcactcacaaacacagagaggccttgaagataacaaacaacaatccaatcgaactagtgatagagattggatctccacgagtttaatcagaatcgatctatgagactagatttgaatcccaattcttcagatcgagcataacgtagagaaatatccaagtcacctgattgaaaagctcggtttcaatctgatcgacgaaatccagcagatgaaaaatcttcggaacttgtcggttactacaaactgatcgaatttcgatccgcacgaggttgaaggttcgtgaagccgattgaaattcaacgtgtagagagaggagactgaatcgtcgtcgtcgtcgtcatgatgaagaattcaaaattttaatctctttagtgttttaggttccaaatccaatcggaatcaatgtgaatagtagtaagtttattcgtctagtgacacgcaggcttttttagataactcttttttacacatgacgtcatgtttttttttttttttttgagcagacatataaaaaccctaattttccgattcttcttcgtctaccagagtcctaaaaccctagaagctccgttgttcctgaatcagtctaacg

SEQ ID NO: 10310 - DNA, 3000 bp, Unknown
  misc_feature (1)..( 3000): cDNA_ID_2715488_gDNA_ID_2213642_Annot_ID_132302 3000 nt of promoter + ATG
tcccaatccttattcattcagattgtggaatctaattttctactatgatgtgatttgctaataagttatgatgataccaacaaatgcttcttcttcatatgcagataaagaagaattcgcagattaaggccgaagcaaaggctcatcactaaaccaactcttcttctccttctcaataagattatgaagccaagtgattgttatctctaaatgtagttcttttcctccttaagctatatctccctcggtgacattttttccatctttctgtttttttaatcaaaatcttctgtctgacaaagcaatcgtatacccgttttggtttaaacctgagttcttctttggtactttcctgctattcaataaacaccatatttttatcatcttaaccagataaataatttataaaaaaaaaaaaaaaaaaaaaagaatttttattgttttcaattaaaataaataaatatccgccgtggcgcagagttaaaagtaagcagttggctattcaggacgaccaatgtggtcactgcttggtggcaagaacaagttgtgttcgagctatacaaggtcgtggcttcgaacattggtcacactcacacattcgctgtctctctttctcacgtaatagaggcattcttaaatgcctttttctgttctctttcattctctacaatttattaagttatttgaacttattgtagaaacctaaatgtttgcacccaaaattaaaggttacaagatgagtatcttctttgagattttgagaagagtttctctatatggcgttctatgtctagtttgaataatcaaatcatcatttatattcccatcttgaaactttaaaatcactatccatagaatattcaaaaccataccatgaacactacaataatacaatactatataatatattcatcattatacttttaatgggagtcatgggacacgcagtaatcggttaatttcattgtgttggtgctttcttcattggacggatgagaacttaaagaataaattagtatgattttcaacatttaaatataaataccacttgaagtgtttttgtggtccattggctaccatcaacttgaggtatattaagtccctatatataataactaactaacataagttttggatttaaattactaaaagggtaaagaaaatataatctttactattaatagaaaataaataaatatttttatacaatgaggatattatataagtctaaatcctgagttaaaacctcaaatcctatgtttttttgttgtcattgcttggacataacatattgtttcgaccaaaaacaaaaaagaacataaaatgttcttaagattcaagttctttttcatatcaattaagaaataacttacggcatctttaatttatgtttgttttgatcaatcacataattatagtgaatagtatatttttagtgctattacctatccttacaaatccataatcgaatttcaaagcaacgcgacctaccctcaggtctcaaaacgcacgttcaccaatacaaagtggcattttcgtaaataacattaagaaaaaaacaaattaaaacagttttgtaataagatcaataattatatattattagatgactcggataagccattcggctttggtctttttgttattgccaacaattaagctcaggcttacgaaagtgattgtctgattgacgttttctttttcatttccttttttggtccctgaatacaccttttgagtttgaggtatatctgtcctctttcgaatctttttcttagtgattcctgattattaagaccatctccatcaatggtttctcattaaaaaactgttcaatataaaaataaaatataatcaaaaagtatgagagagagtagaattagtctttcaagtgagaaactctgagaaacccataaaaacacttgtatatcatctatttgtcaaatattattttattgttaaaatttaattatataactaatatttattaaaatacttatatcttttattttttagaaactaagaaagtatctcactgatggagatgcccttaatacaattcggtttgtatttatttctatttttcccgtaattttatgaccctgtaaaaaagttaccgtgtttttttttcacttttcttacatgacataattaattacaaagtatccatcaccacacaaatcaatacaaagctttttgaagtgtgatggtgtgtttatttaaagactttgaagtttggacccagaccattatcacacaagtggaccttattttatatttcgggtccagttgttagaaatttctttttacactgaattcattaattaaaaaaacaattatttaattagtacattttgatcgttcgttttcatgctacatttgagttttaaatagagaaggtctcaaactcacaactatttttttgactttaaatgtataaattagctgcaactttaacaaattgtgagtagttgtagttgcctagattctatttgaagactacagaccttaaaaaaaaaaaaaaaaagaggtcatagtcaaaaacaaaaaaacaccacatttggtaaatttatgatgtgttctctttttaaaaataaaataaatttcatgtaaaaaatctgtacgttcaaaatatctcaggtgattaatctgtaagtacaaattttaattttcaacatgaaattgaatgtttaacaataatgagtagttggaacttggattgaaaactcaacaacaactcattgtttggataagtaagtagaaatctggcaataaacgtattctatttttgtaacgtagaaaattagaaaaataatagtaagaggaaaaggcatggtttagtctggtcaagttaatgtaaaccagagtggttaaaaacaaaacgacaaagcaatttggcttcttaaaaacccgcccatggagaaagccctcacgcacctctaaaccacaaacaaaaagagagagaagagaacgagagaatcattgagaaacgaaacaaca

SEQ ID NO: 10311 - DNA, 3000 bp, Unknown
  misc_feature (1)..( 3000): cDNA_ID_2994643_gDNA_ID_2213642_Annot_ID_132304 3000 nt of promoter + ATG
tgagtaaaacatgttccatatattgtaaaacatctcaaaagagcactcactggttgtttagttattaacaaagattgtttctcggtggtttaggttcttgctggatgcatctgtggttcactgaagttggtttcagaaattcgcaatctgcatcatgtgttgggaggaacacttaacccagtaaattacttgactgtctcatttatccctcttattatgctgttaattcatgaattctcataaaaggtttgttaacagaacgctgcgtacctaatcatccgaggcatgaagacattgcatcttcgtgtacagcaacagaattcgaccgcttttagaatggccgaaattttagaggcacatcctaaggtatgcaatatctcttttttgagtaaatatcctgacactatccaggtgagtcatgtgagtaaatatcgatgcaattttgatttgcaggtgagtcatgtgtactatccaggccttccaagtcatcccgaacatgaactcgccaagcgacaaatgactggttttggaggtgtggtcagtttcgaggtaatatgatctatcaccaacctaatctctatctactccagattagcatttaagtatgatcctgaacaccttgattatctttcttgggtagattgatggagacattgaaacgacaatcaagtttgtggattctctaaagattccttacattgcaccatccttcggtggctgcgaaagcattgttgaccaacctgctatcatgtcctactggtatgtctttggcaaaatcgaacaaagttatctttgattccatatgcttccgtctttgacaaaatcgaacaaatttccgatttctaatgggtggttttgatttcagggatctgccgcaagaggagagactaaagtatggaatcaaagataacttggttcgtttcagctttggagttgaagactttgaagatgtcaaagctgacattcttcaagctctcgaagccatctgaaaatgacacatcacacaaaaacgctgtcgtttctttgtcctttatttatctctctttgctgttttcagtcaccgtaataatgatgtctttgaactattgttccgcgacatttacgttccgaaataatcgtgtactattatgatgtttgttgtgctatataataaattctgtttagttcgttttgcgtcttaaagaggttaaattagataactggtcccatgtgaacgaccattgtggccattgctttgtggtaagaactccttgtgcttggaacctcaaggtcacggcttcgaacaatggtcatgaccctctagcttctgcttcttcttctctttgtttcaacaacatataaggcattcataaatgcctcgtctttttttgttttctttcctttcaatacgtagttcgatttcgatttcgatttgtagatctcagcaaaatccatgtcttgagagaatgattaatgggcctttttaataagtccactgataaagacgagagcccaaaacgtaattgtattattatcttctttatttgcttttaaattttaaattgacattaagacaagactaacttttgcttgtcaaatccatgtgttgtccagcgggtaatcaacccaaagttccggatccggacccaacagtaagcaacattttacgattcgttgtttttgaatcccaatgaaaaaaaagatggttatttttaaggaatggaaaaatcgagaaaaatggtatcgtgtcgcatcgaggacttattacgtatggcgagagagctcaaaccaaaagatcaccgcctcgactgattcatcttttctcctggtatgtattttggaaaattcgtctcttgctttttatttgatccagatcagaaaacgttgtgcagattgattctgggtttatcagttccttaccaccatagtactctccatgttcttctcaattgtaaattcctttcctttttgtgtgtcaatttacacatatctgatatcttcttcgtgttgctcccaaattttgcagattcttggcaggcttctcttggtctaagtgaatttggagttatgcttctgtcagcacttttaacttcagtgggaatcaatcttggcctctgttttctcttcttcactttgtattcaatattgagaaagcagcctagtaatgtcactgtatacggtccacgtcttgttaaaaaagatggcaagtctcagcagtcaaatgagttcaacctcgagaggcttttgcctactgctggttgggtcaaaagagcattggaacctaccaatgatgaaatcctctccaatcttggcttagatgctttggtcttcattcgtgtctttgtcttcaggttgattgattcattgagcatctgcttcaagtttgactttttttttgtgaaacttcaatgcttttttgtttggcagcataagagtgtttagctttgcatctgtggttgggatcttcatacttcttccagtgaattatatgggaacagagtttgaagagtttttcgacctcccaaagaagtctatggataacttcagtatctctaatgttaacgatggatcaaataagtaaagaactcgaagctatgcttaaacagtatcccgatttctacttgtccgtaaccgatctcttatgcttgtatgtgttttgcttcaggctgtggatccacttttgcgcaatatacatcttcacggcggttgtttgttctctactttactatgtaagacgccttttgttttgtccatccattctactttatatcgcctatatgggaacataaaataatgtttggactatctttgcaggagcacaagtacattttaacaaagcggattgctcatctttattcatccaagcctcagccacaagaatttacagttctggtcagtggcgtccctcttgtatccgggaacagtattagtgagacagtagaaaactttttcagggaatatcattcttcctcgtatctttctcatatagttgttcatcggacagacaagttgaaagttctc

SEQ ID NO: 10312 - DNA, 3000 bp, Unknown
  misc_feature (1)..( 3000): cDNA_ID_2715477_gDNA_ID_2213642_Annot_ID_132305 3000 nt of promoter + ATG
attgaaacagtctttattagcaggagaggtgagaatttgtctttttgtgactacttgcattcttcaacatattcattcctttttttttggcaaacccttttaggaagttccagctgcttttgtttcctttaggacaagacatggtgctgcaatagcaacaaacattcagcaaggaatagatccaacacaatggctaactgaggcagccccggagcccgaagatgttcattggccatttttcactgcatcgtttgtgagaagatggatctccaatgtagtggtgcttgtggctttcgtagctcttttgatcctatacattgtccccgttgtattggttcaaggtcttgctaatcttcaccagttggagacttggttcccttttctaaaaggaatattaaatatgtaagtaaagccctatttagataaagatggttcttcgtttcaattgaacaattacaaaatcttcttttttttcttatgattgcaggaaaatcgtgagtcaagtgattacgggatatcttccgagtctcattttccagcttttccttcttatagtaccacccattatgcttctactttcctcaatgcaaggattcatttctcatagccagattgagaaatctgcatgtatcaagcttctaatctttactgtatggaacagtttctttgcaaatgtactgtccggatctgccctttatcgtgttaatgtgttccttgaacctaagactattcctcgtgtgcttgctgcagctgtgccagcacaggtaaagaacacaaaattcagtattgaggtttccggaattcccttttcgtaccacgagtcatgtttattgtttaatctttggtgtaggcatcgttctttgtatcttatgttgtgacctctggatggactggtttatcatcagagatcctccgtttggttcctcttctttggagtttcataacgaaacttttcggcaaggaagatgacaaagaatttgaggttccttcaactcctttctgccaagaaatcccaaggattctattttttggactcctcggtataacttacttcttcctttcgccattgatactgcctttcttgttggtctactattgtcttggatatatcatctaccgcaaccaggtaacggaaccaatctcactcctaagtataattctctgttgatctctgataaaatcatataggaatcagctacacatattttcgttatatggaatctcacttttatcttctctttatatgtgatcccttttctaaattctcgaatagcatctttaaaccgaaagtattttttggagcttcagtcatgacataaacgttacatcaagaatccattttctcgtcacataattctttttcttcttaatgaatccattgcaacttgttgatagaaataacatcacctttttgtgctgcagctcctaaacgtatatgcggccaagtatgaaactggtggaaagttttggccaatagttcacagctatactatcttctctttggtactaatgcacattattgcagtcggattattcgggcttaaagagcttccagtggcatcttctttaacaattccccttccggttctcacggtccttttcagcatttactgccaaagacggtttttaccaaatttcaaatcttatcctacccaggtaaaggctttagagaaatagttactcatatttttgatccaatggaagaaaaatatggctagataatcttttattcctaacctaaacaaaacaaacagaacatgatgcatagtcctttattacattacagcatctactctaaacctttatatggtgatgatggatgttttacttttgcagtgtctggtaaacaaagataaagcagacgagagagagcaaaacatgtctgaattctattcggaactcgttgttgcttaccgagatcctgcactttcggcatcacaggactcgagagatatctcaccttgagatcacctttttacttgagctattgaagtttgcttatgttgaagctgttggtttactatacctggtgcaatccatgaaagaacacactaaaccggttgtcttgtacattgggtcttaaccgagaatcaagcggtttttgtcttgtacatttgcttacacttggcttgtgtaaaaaagaaaaaaagtttatgtcaatgtatctctctaaaccggtttaagacggtacaaactttttgaaagatgccaaaacaaaacggtggttaataattttaccacagagaatatttagcaaaaagatgatgactagatgccacgtccgcatgggggtatatattgtaattagtcgtaactctgggggtaatttagttaaagattgatccgtttatggaaccaaaaatcaaataatttcgtctttgatacttgcttgcgccttataggctacaggagcgagagcaatgaaagcgagaggaagaatctatcaataatttctgggtttaagctgatctctggatcttcctcaattttactttttcagctcagaaaattttgggacttttttttgctgcattttttggttccgaattttctcctccgccttttttaatttttggtaagtttcgatatctctcaattttcttatttcggaaataaaaaaaattctcgcccttttgcaaatcaatggattgatcttgaaatcgtcatttctgaatcgggtacgagagatccagtaatcctctgcgattgaattattattagggttcatattccgaattggggatagtctgaaaattgctattttaagctctcttcttagtgttggttggtttattctggataataaaagggatcctaattctcgctaaattctcatgttcaaacgagtagatgagtttaatttagtttcttcaacgatcgatcacagaatcttcaaaagtgtaaaaattacttgctttttgttcctattactcttttgcagtttgttttgtgtgttgtgtactagtagatctaatatctctctctctttttttgtagaga

SEQ ID NO: 10313 - DNA, 3000 bp, Unknown
  misc_feature (1)..( 3000): cDNA_ID_2715473_gDNA_ID_2213642_Annot_ID_132306 3000 nt of promoter + ATG
taccttcttccaaacaattagtaatacactaatactagtagtctactatgcaaaacaaatatatatattacacttaacccatgattagggtttaatctagtcatgtcccaaacagtggacaccatgattagacactttagcctatcaaatccctagattttttatttgtatggtttaaattaaaaaataattaaaaattaaccagctagtcagactatttagtttattgactaaagctggcagtttaaattgtatcatttgttcatcacatcgaaaatgacgtgattgtaaactaatctgaccacgagatttgatcatttgaagatgtttaattttatagttcaaacccataaaagaattcactttcaattttaaattattgttgttgtggtactttccggattttcgactatgtaaagggcctaaattagttagataatagcttgacccttatccaaaagtcaaccacacgtcccgacaaaacaaacagctcttgaagggtttttttggtcataagatttttgttccccatgtttcttcaaacatcaaaatctttacgatattaaaattctctgaccccaactttaggattatattttttatttttgactattttcttgcaaacatagatttcaatttctttaagatgtatccatgttaaaattatctaaaaccaggttacaattcttgacccttcttgtctcgagtttaagtaaacgtcttagtcgtttggatacaataccgtatatatatcaagaaatgtcaaacctttgttaatgttttcatttagtttcagaaaatagtttcaatatacttgattcccttttctgttgcgtccataacaactccatatcgagtgaattctaaaataaattttttgagtttatatatatcgattcgaatagtaaaatctaatttgaaaaatatggaaacatgattaagaaaatggaactgatactttccgttattcataaggtatcaataggctgttccttaggtgtcaaaaaaagaataaaatagaaatactcattgcaaaaacaaatgtcagttaattagtttaagttgattcctttaattctctcaaaactctgaagaacatgcaaggcagacactagttatgttttgtttcagcaaatccgaaaacataatttatgaaacgcaaatcgttggccgaatattcccaaaattacgttattattcattatgtcatttaatatcaaagagattagatctgtataatcagacttagtatactttgattttgagtcttttgacaattttcggcttcaaaatttcagtttaggcacaggaaaaatactcataatgattcgaacggtgtaacatatagtatcaataaattgaccaaagtcatgccgcaatatatatgttaataattagcgaatgatcaaaattatgattttggaatcaaataaatccttttaggatttttttttttgtatccattcaaaccccagtctgcatggagatatatttacacatatctcacatacaaatcctttatttataacaaaaaagttataaatggcatagtagttattctaatgttaactttattcatcttcttctcaaatgggcatcatatggtatacaaataaaataatcatagatgaatcaacgcataagctaatgagataccattagtagattttcgaaactttggtgaagcaataactagagagaccacacatagtagttattctgttggctattttagttaattgaagatgatgttctgaactatattataacaaatgcaagttggtccttttgtgtttggctcataaaagaataaggtgaatgcttattgcctattccatatctcacatttaatatcgacctgtaaaaatagtgaacaaaagaagatcaaacatatacttggaaccgtaaacagttctatatccaacacttatacgatcgacaagacgacgtacaacattatttttactacatagaaccatacacgataaacataaggctctagtgctctaccatacggcctaatatatattttcgatttatttatagtatactacaatagtttgtattctttggaaatcaaagtccgaacgtaacatatacccactaggtcaaccattgactcaaagaacttaattacattatacttacacttacattcgtttaaactaaaaagtgcattttgtcgccattggagttattgcctcgtagtgccggtcttgtgaggcaagcttcggaaaagaaaaaaaacaagcttctatatatgtgatccatttaagttattgatattcttatcacatatataatggtttcaatataataacccactatttcactactaatatcaaataaaacctagatttgtatcttctgatgattattgttgttttaagatgtgagagagattaacatggatagtaagactcgtgacatcaactcgaactttaaaaaagaaataccaagtaaataattttccgtacctgataatataaagaaagtattgattatggttcactcaaatacttaacatcaatttacaacaaggaaaaagtctagtaaacaaccgaatattgttggtccacaaaatttactatatgttaatgtacaaatagcaactaagatggcttttacaagttaaacaccataaatttggttattccatcaacctgttaaacaaaataatttaataacaaaagatgcaagttgaatatttttcataagactaataaaaaaaagatagcttaaatgcgaaaattaattagaacagagagattggaccacaataaattagtaataatattattattaaagaaattccatgtttagcccgtagacttttgaacaccaatgtcaaggctgcacgaaatcgatctaagaaaattagacattgaaacagaagactcttgtctctttgtttctctctgtatatatacacacagtaatatccatatctagagagatctacaaaaattgagattaaagtaatttatctttcagaaaatg

SEQ ID NO: 10314 - DNA, 3000 bp, Unknown
  misc_feature (1)..( 3000): cDNA_ID_2715467_gDNA_ID_2213642_Annot_ID_132308 3000 nt of promoter + ATG
acactaaaaggataaacgtgttcccaaacatccttttgtctttgatgtcaagtggcaatgcgacaaaattgcaacttattattatatcacctatacatgacaaaacttcaattattgtttagttactttctcattctacgtatattttgttttaatacaaaaaggtatcggagctcatttctcttacatccattatctaaagaccgttatctgataagtatcttgatatttttgatcggtgtatataccattttcgtaaaaatgtaactaaggtactttagtttggattcgaatctagcggaataaaactaccattttccagctgattagaaatttagaaaacgatcagctgtttggactttgggttagatttcttttttgagtttttttataaaaaaattaatttgtgtggtgtgagctaatattttttttttggtatttgttttgttgacagcgcaaagcgagcaaattcttatagtaagtgataaatatagtcaaatgttctaaagcaaatactaaaatgaacgtggaaatttgatcaactgatgaaacaagtcaaatgctctaacattcctttttcacacgtttatatcataaaaatctataaccatacaaaaaatgtgtgttcaagaattagtaagattttgttttattcaaagtgttaaatgatcgttcggataaattttgtagttattcaagggaaacatcagattactgtacatacagtgtcggtaccactggccaaagtcatctgtatttgcatttattaatttttgaaaaacaaaatacatatttttgtcaacaatcaaaacatacagtacatacatatcatcgatatggacaagtaccatttatgggtccacgatgaaaaggatatctaacttacaaatcgaagcccaagtttgtttgtttttttggtcggtcgaagcccaatacataggcctaataaagttttacaagattgttcagttgttttttcaacacatgatttttccccctaacaaaagcaaaagcatgaacaaacaaattacaactacaaaaaaaatcgaagcccaatacataggcccaaaaaagtttttaaagattgttcaaacaaattatattacaattgtttatttcgacaaatgattccccccctgaacaaaagcaaaagcatgaacaatctccaaagacacacacacacacccgagtgtagaatgactagagaaagatccaagaacccaacataataaaagagtaacactaaaactacaaaagagcttcactttgcgaagatatcaatcgaatcggatttcaccgataacaatcgttttctctttaaagattgttaccacaacctcagtaccgtgtcccaactgctgcgaaaacagctactggaataagaaactgataggcaaaaccggagaccgagaaggttcttcttgcactgttcttgttaggtgctgcagctggtggaggaggcggtttctcaactaaaacagcgagcttcatacctccgtaacatccaccaccattaccactaatcagatagtaatgccttgtcacattgagatgaaccaagtcccttccagctccacgactccaatttgcgatcgggttattgggattgcagcttatgtagttcgtctcgttcacttctataacgttgtattggtttctctcatatacaaaatctgaccagacacaatgagaatgaaacactatataagtcaacaagattcatgatttgagatcttactgaagtacagaaccagaacctaatctatttccaattacaaaggatgctgtgaaagaagcatccttttttttaataagaaaacagagctagtgaagaaactagtggtcctttttcaaagttgtaaaatttgaaaccattcatttgccaactgatgtaaaacgtatattaagtccgaaagcctgtgataacaagtatcaataagagttagagagcgtacagagccaatcgtcgaggtagaaatgtttgtcctgagcccaaatggtatagttgatattaggattccagaacttgttatcacccaccgtccacctcttcgccgtcacattcgtcgccgccagcagaaaagccagcaccgcccctgcaaccaaaaccgcaactctcgccatcgatcagtactctaaaaaaaaaaggatgagtcgtcgtttgtggggggggatgggtttatcgaagttcaatctgagagataaatatgtctctttttcagggaaaagatctctctagatccgtaattccttcgactaaccttcgaaattttaattaaacctcgaggttgacgaaaagtacaagataagcgttatgtaattaaccaaaagtaatattttccttttcattttggtcatatttcttaccttttttccggatattaatttcctttttttagtcatccagttggtctcaattgcttaatcataaagtcaggatttatttacttaaataacatagtattgaaataaaacgaatcttataaaaatgtgtttaatcgatgatacttttaaaagttgtaactatatacagtatactgttgatagccgttggggaatttcacattttgaatgccatgtcacatatgacaagtagcttttcgtgttctattattttccatcatagcttccacgcgcaagcttgaccaccgccattaaacttggtaatttagtataattcacatgaatgaattagtaattttgttaaaatgtgtaaattaaaaaaaagaaattgagaaagttctctaatgttcctttcagtttgaccaagaatatattcttaatttgtttcctttcttttgacgtttcaaaatgatataaacggagtaacattttatgtccacacaatatttcttgtaatatccacgtaggatgaaatatccatttaaaccggtccacgtgtccagacatcagcttctagttccattgtacaataataataaaaaaaccttacctgaactaaaaaaaaaaaaaaaaacgaactgagaagcgaagaagaaa

SEQ ID NO: 10315 - DNA, 3000 bp, Unknown
  misc_feature (1)..( 3000): cDNA_ID_3035915_gDNA_ID_2213642_Annot_ID_132310 3000 nt of promoter + ATG
aatttcctttgttttcttcttaatccgattgattcagagcattacgtatcactcttgctcaacagttattgctcagtctccggcgatttcttttgcgttttctcgagaaaagtaacggaagatcgattctttcaactatttctaccctcatactcttcgccaatcatctcgtcttccaacaagcttcgttttaatggaagaacaacaagaatttgagaaacccatcttcgaattccgtcctaagaagctcagaacctctcgagtttcgagaaatctcatgaagaagactggcttcagagaatctatgaatcattacgaagagctctcttgcaactacggattgagggaaaacccgaagaaaacccagaaatctttactcgatcatcgattctgtacgaggaggaggagaaataaaaagatcctgattcgatgcaaagaatgcgggaaagggtttctttacgagaaatgtctgtttaatcatctccaagtgacgcattctgaagaatctacaagaagaagcctgttttgtaggtttagtattgtgcagaggagaaaaagatcgaagagagtttccaggtacaagaagattcttcctcgattctctgtttcttcttcttcgtgtactatgtttcctgtttctgtggatgatggaggattattagaagtcgctgagtctctgattctcttgtccatgagtggtggaaagttcgtgaatggtttggaacattttggtaaagctctgggttcgactcagagaaaatttgaagacgggttattgagaaatgagcagagacttgttggtgaagctctggattcgaatccagaggtgaatttgagaaaagatggagactttgaatatgggcttttgagtaatgagcagaagaaacttgtggggataagcagagcatctgttggaacatcgaaagagctttcgggttacttggcaaacaagaagggcagagaagatgatgaattgggtcagcagaaacaggctggagcaagaatacttagagaagaaactgataacgaacagaaacttgttcgtcaagaaactgcatttgaagattcagtatcaggatttgagatgaatatagagcatcggtgtgggctctgtcacaaggttttctcgacttatcaaactcttggtggtcatcagacgttccatagaatgagaaacaaatccaaaagtcaaaccaagagatgcagagaagaatcgatagaagctgaagctgggattaataatggttcagtgacgttgacaataagtgcagagtttgctgaaggctgtttaggtcagtacatgctttaagaggttacaagaagtgtcaccacacgagagcaaatgatggagagacctttagattccatgtggatgtttctatggttactagtggaatatttgagcaggagtactgaagaagaagatcccctctaatgaataatgaagttttggaatttttgttgttgttgttgtctaatggagttgtgacttgttgtattttcatacgtagagaggtttcgtctttggttttctcaaatggtttggtattcaaagttgtacagcaacttgtagctgtgttatggttttagcattaatcgttctttcaaatctttttcccttaagtttgtgcattttgaatgtgttactaatattttgaattacaacaaaatcttgaggagccgaatacaatcataaacaaatcagatgataaaaactcgtaaatcgtttctaaattgtattcaactatacaatatattggtaatgatattgcaactttaagttgagagatcatactggaaaaagtacagtatctttttttttttttttttttttgaccgtatcatatcgtgtcggttggtcttcgcattaaaattaaaacttttcaaaattagtatgacgaatattcattataaatgaaactaaatacacattcctttcttgcgtatattaaatgactacgacagaaagataatcgtacgatagttttcagaaatatttgtgaggtgttgaaataatattagagtttcctaattgtatacttttcttcttctttttgcagccacttatttctatttatgtaaagaaaacagctgttaagaaaatattttacgtcgataagaaacaaaacaaaaacacttatttcaagtttaattataggaatatcagatccatcagaattctgaaaaatttgcacgttattagtctatctatattttctcaaactttctatcaaaattagataattgtttttggaaagaaaaagagcaaaactattcgattgggcatgaaagtcggaaagaatctataattagcaatatacaaaaaccctaaactcaaggtcaagacaccaatctcaaacacggttttatcattagaattaaaattttgattcccatttataattgagatcttttattaattacgttttttttttcttttcttttttcggctgtgcgtgcattagttgtttagatccaccggcgaaatcacttaaggaaaaaaaaggcttgatttttcttcttctcctctcatcttttttgtcttcttcttcttctttgacaagctcattgctttgtctttgatcctgcttgtatcacgaattcggaggacaacccatttcgattctcgtatcgaatttcttgaatcaaagagacggcgggaatctcaaattcagaattttgctgggttgtcgtaaatccaaatgcggtctgagagaagactacaaattataagaagagcgaatcggagtctaacatcatcggatttgggagctacgactagatcgagaatcgaaaagcaatcatcgagatcggagaagaagaggaatcgcgtagggaggtgatgttgtttggttggggattgggtggaattagggttttattggattcgattgatctgaatacaacagcggggctgcacgaacaaggatgcagcttcacatatcgcctagcatgagaagcattacgatatcgagcagcaatgagtttattgatttgatg

SEQ ID NO: 10316 - DNA, 1709 bp, Unknown
  misc_feature (1)..( 1709): cDNA_ID_2715453_gDNA_ID_2213642_Annot_ID_132312 3000 nt of promoter + ATG
cttctcaaaagctttaactagatgcatcactttaccaaattcaggtatactcattctcgcttcttccaatactttttctcttctcctcttcatcaaagaaaccctagtttcatcagaatctccaaattcgacttgttcatttccatcctccaaattctggctggattctccaatttctgatacggattctcttcgattgttgaagaactcttcctgtgacgcccgtagagtttcgtatgctatacagacacatttcttcatattggaaatggtcttagctccacatttgcaatccacagacgcggaatcattcttctccttccttgaattcttcttcaccaccacgaacctcctctctctgatccgattccgtggtgagaaaaccgccggaacaggattaggcttccatttcggattcttctgcgcagaagatttactcgatttctcgagtggagtcgagtgtgagacgaagttagggttagaattctcggagaatcgtgaaacctcttgagccttggattgaaaactgatcggatccatcaccagagtctcgtgtttagcattcttcaaattcgtcgactccatcgaaagatgagagcagaaaaatgtgagaaattagggttttgtcttttcgagtgagtgaagggaagaagaagaagagagagggagaggagggaattgtctgaccgttgcgacttgtgaggaagctctcgactttgtatgtaacggctcgctcagtcatttactggattttcgtaattactacgattaattgcttaatttcaaaaaaaattagtttaatgctggaatctaatatgtttgtttgggctggcccaaacccaattgttaaactgatctgaaatgattgttatacaaaaaaaccggttcgtgaaccgcattgtctcatcgatgttcaatactgtttccaacaaaaagattgttgtcctcgagttcgccttcaagaaagacacgagagagactccagccattgacgtctgcaaaggtttgttaggagacaaggcccgaatcagcatctatgatccacaagtcacggaagaacaaatccaaagagacttaaccatgaacacattcgactgggaccatccacttcacctccaacccatgagtccaaccactgtgaaacaagtctcagttgcttgggacgcttacgctgccaccaaagacgcccacggaatctgcttgttaaccgagtgggacgagtataagacgcttgactatgagcggatttttgaaaacatgcagaaaccagcgtttgtcttcgatggcagaaatgtttttgatgcagagaagctgaggaagatagggtttattgtttactctattggtaagccgttggaccagtggcacatgcctgctcttgcttagctcagactctttgccctttctcaagatttggattgtttttctctctgttgcttatatcaaataatttgttctgtttcttcttgacgagatattttcctatacttattatgttggttagaacaagagactaggtttggttattattgctaactacattttcatatataaagcttttagtgattctgattactgattatcgtggaaaataaaagagatgattaatttccaatatttgttataattctcaccgttcacgtgtcccctcgacatcgcatatataacaaaactgcccttgattccggcaaagagaaagagagaatatg

SEQ ID NO: 10317 - DNA, 3000 bp, Unknown
  misc_feature (1)..( 3000): cDNA_ID_3035904_gDNA_ID_2213642_Annot_ID_181318 3000 nt of promoter + ATG
ttctcctctgcacaatactaaacctacaaaacaggcttcttcttgtagattcttcagaatgcgtcacttggagatgattaaacagacatttctcgtaaagaaaccctttcccgcattctttgcatcgaatcaggatctttttatttctcctcctcctcgtacagaatcgatgatcgagtaaagatttctgggttttcttcgggttttccctcaatccgtagttgcaagagagctcttcgtaatgattcatagattctctgaagccagtcttcttcatgagatttctcgaaactcgagaggttctgagcttcttaggacggaattcgaagatgggtttctcaaattcttgttgttcttccattaaaacgaagcttgttggaagacgagatgattggcgaagagtatgagggtagaaatagttgaaagaatcgatcttccgttacttttctcgagaaaacgcaaaagaaatcgccggagactgagcaataactgttgagcaagagtgatacgtaatgctctgaatcaatcggattaagaagaaaacaaaggaaatttttggtttttcgtagttctctgggaaaatgagaagagaggtagagagtgagagcgagcaagagagaaagtggaaacagagagatcaataagcactgagagaagtgagagcagctacggaagaagaaaggggcactttcgtaaattgctttgcctataagaagtggaggagaacttttgtttcagttagaaggttcgacgtgacaaatggtgactgctgtggcaaggctttgggcttttcatttgttaaggcccttatttggtgacttgatcttattttgtgaatgttcaggctgaagcttgtgtcattataatctcacagctatgtctaacatcaaatgatcaaaattatcaatatcacagcaacaaattattccataagacattgaagaggaatcatcacaatgcagaaaaaacttgggatctgggtcacatgctcagctatttttattcaaagcacttaaataaacatttgaaaagaagagaaaaactaaaacaaccaaacacacctctctttgtaagtttgtgtaattcatcatcagcagcagcacaatgcggtataagtggaatcatcaggccttgacggtttcttctgcagcagcagcattagtctttgcttgcttctccttgtagtctctgaccgcggacttgatagcgtcctctgcaagcatactgcaatgtagctttaccggtggcaacctaagatgcttagcgatttccctgcaaatttaagaatcccaaaacaatgactcattcatcaaaatgttaaccatatcactagatttgggatattccaagcactagaacagagttagagataacaatcctgacgatatatctaagagacatgattttgatggttaaaaggcacttacgcgttcttgatggtcataacttcgtctaaggttttgcccttgatccattcagaagctgaaccaaacaaatatacaaattataacctgtctacatctacctgactctgatcatgagcctcttaacgaatcgatcaaaattgaaaaccctgattcgaaggcataccaacggaagatgaggcgatagcggagccacagccaaaggtcttgaatcgagtatcaatgatctgacctgaatcatcgaccttaatctggaggctcatgaggtctccgcaggcaggagctcctaccaatcccgtgccaacgttagggtcattcctgttgaaggagccaacgtttctagggttttcaaagtggtcgattacattctcgtggtataatcgacgacctaaccctagaggagacgcctgtaaccctaggtaagcctttctcgacgtttgccttagcatcatcatattctctctttctctttgccggaatcaagggcagttttgttatatatgcgatgtcgaggggacacgtgaacggtgagaattataacaaatattggaaattaatcatctcttttattttccacgataatcagtaatcagaatcactaaaagctttatatatgaaaatgtagttagcaataataaccaaacctagtctcttgttctaaccaacataataagtataggaaaatatctcgtcaagaagaaacagaacaaattatttgatataagcaacagagagaaaaacaatccaaatcttgagaaagggcaaagagtctgagctaagcaagagcaggcatgtgccactggtccaacggcttaccaatagagtaaacaataaaccctatcttcctcagcttctctgcatcaaaaacatttctgccatcgaagacaaacgctggtttctgcatgttttcaaaaatccgctcatagtcaagcgtcttatactcgtcccactcggttaacaagcagattccgtgggcgtctttggtggcagcgtaagcgtcccaagcaactgagacttgtttcacagtggttggactcatgggttggaggtgaagtggatggtcccagtcgaatgtgttcatggttaagtctctttggatttgttcttccgtgacttgtggatcatagatgctgattcgggccttgtctcctaacaaacctttgcagacgtcaatggctggagtctctctcgtgtctttcttgaaggcgaactcgaggacaacaatctttttgttggaaacagtattgaacatcgatgagacaatgcggttcacgaaccggtttttttgtataacaatcatttcagatcagtttaacaattgggtttgggccagcccaaacaaacatattagattccagcattaaactaattttttttgaaattaagcaattaatcgtagtaattacgaaaatccagtaaatgactgagcgagccgttacatacaaagtcgagagcttcctcacaagtcgcaacggtcagacaattccctcctctccctctctcttcttcttcttcccttcactcactcgaaaagacaaaaccctaatttctcacatttttctgctctcatctttcg

SEQ ID NO: 10318 - DNA, 1712 bp, Unknown
  misc_feature (1)..( 1712): cDNA_ID_2715453_gDNA_ID_2213642_Annot_ID_181316 3000 nt of promoter + ATG
cttctcaaaagctttaactagatgcatcactttaccaaattcaggtatactcattctcgcttcttccaatactttttctcttctcctcttcatcaaagaaaccctagtttcatcagaatctccaaattcgacttgttcatttccatcctccaaattctggctggattctccaatttctgatacggattctcttcgattgttgaagaactcttcctgtgacgcccgtagagtttcgtatgctatacagacacatttcttcatattggaaatggtcttagctccacatttgcaatccacagacgcggaatcattcttctccttccttgaattcttcttcaccaccacgaacctcctctctctgatccgattccgtggtgagaaaaccgccggaacaggattaggcttccatttcggattcttctgcgcagaagatttactcgatttctcgagtggagtcgagtgtgagacgaagttagggttagaattctcggagaatcgtgaaacctcttgagccttggattgaaaactgatcggatccatcaccagagtctcgtgtttagcattcttcaaattcgtcgactccatcgaaagatgagagcagaaaaatgtgagaaattagggttttgtcttttcgagtgagtgaagggaagaagaagaagagagagggagaggagggaattgtctgaccgttgcgacttgtgaggaagctctcgactttgtatgtaacggctcgctcagtcatttactggattttcgtaattactacgattaattgcttaatttcaaaaaaaattagtttaatgctggaatctaatatgtttgtttgggctggcccaaacccaattgttaaactgatctgaaatgattgttatacaaaaaaaccggttcgtgaaccgcattgtctcatcgatgttcaatactgtttccaacaaaaagattgttgtcctcgagttcgccttcaagaaagacacgagagagactccagccattgacgtctgcaaaggtttgttaggagacaaggcccgaatcagcatctatgatccacaagtcacggaagaacaaatccaaagagacttaaccatgaacacattcgactgggaccatccacttcacctccaacccatgagtccaaccactgtgaaacaagtctcagttgcttgggacgcttacgctgccaccaaagacgcccacggaatctgcttgttaaccgagtgggacgagtataagacgcttgactatgagcggatttttgaaaacatgcagaaaccagcgtttgtcttcgatggcagaaatgtttttgatgcagagaagctgaggaagatagggtttattgtttactctattggtaagccgttggaccagtggcacatgcctgctcttgcttagctcagactctttgccctttctcaagatttggattgtttttctctctgttgcttatatcaaataatttgttctgtttcttcttgacgagatattttcctatacttattatgttggttagaacaagagactaggtttggttattattgctaactacattttcatatataaagcttttagtgattctgattactgattatcgtggaaaataaaagagatgattaatttccaatatttgttataattctcaccgttcacgtgtcccctcgacatcgcatatataacaaaactgcccttgattccggcaaagagaaagagagaatatgatg

SEQ ID NO: 10319 - DNA, 3000 bp, Unknown
  misc_feature (1)..( 3000): cDNA_ID_3035915_gDNA_ID_2213642_Annot_ID_181314 3000 nt of promoter + ATG
ctttctctcttgctcgctctcactctctacctctcttctcattttcccagagaactacgaaaaaccaaaaatttcctttgttttcttcttaatccgattgattcagagcattacgtatcactcttgctcaacagttattgctcagtctccggcgatttcttttgcgttttctcgagaaaagtaacggaagatcgattctttcaactatttctaccctcatactcttcgccaatcatctcgtcttccaacaagcttcgttttaatggaagaacaacaagaatttgagaaacccatcttcgaattccgtcctaagaagctcagaacctctcgagtttcgagaaatctcatgaagaagactggcttcagagaatctatgaatcattacgaagagctctcttgcaactacggattgagggaaaacccgaagaaaacccagaaatctttactcgatcatcgattctgtacgaggaggaggagaaataaaaagatcctgattcgatgcaaagaatgcgggaaagggtttctttacgagaaatgtctgtttaatcatctccaagtgacgcattctgaagaatctacaagaagaagcctgttttgtaggtttagtattgtgcagaggagaaaaagatcgaagagagtttccaggtacaagaagattcttcctcgattctctgtttcttcttcttcgtgtactatgtttcctgtttctgtggatgatggaggattattagaagtcgctgagtctctgattctcttgtccatgagtggtggaaagttcgtgaatggtttggaacattttggtaaagctctgggttcgactcagagaaaatttgaagacgggttattgagaaatgagcagagacttgttggtgaagctctggattcgaatccagaggtgaatttgagaaaagatggagactttgaatatgggcttttgagtaatgagcagaagaaacttgtggggataagcagagcatctgttggaacatcgaaagagctttcgggttacttggcaaacaagaagggcagagaagatgatgaattgggtcagcagaaacaggctggagcaagaatacttagagaagaaactgataacgaacagaaacttgttcgtcaagaaactgcatttgaagattcagtatcaggatttgagatgaatatagagcatcggtgtgggctctgtcacaaggttttctcgacttatcaaactcttggtggtcatcagacgttccatagaatgagaaacaaatccaaaagtcaaaccaagagatgcagagaagaatcgatagaagctgaagctgggattaataatggttcagtgacgttgacaataagtgcagagtttgctgaaggctgtttaggtcagtacatgctttaagaggttacaagaagtgtcaccacacgagagcaaatgatggagagacctttagattccatgtggatgtttctatggttactagtggaatatttgagcaggagtactgaagaagaagatcccctctaatgaataatgaagttttggaatttttgttgttgttgttgtctaatggagttgtgacttgttgtattttcatacgtagagaggtttcgtctttggttttctcaaatggtttggtattcaaagttgtacagcaacttgtagctgtgttatggttttagcattaatcgttctttcaaatctttttcccttaagtttgtgcattttgaatgtgttactaatattttgaattacaacaaaatcttgaggagccgaatacaatcataaacaaatcagatgataaaaactcgtaaatcgtttctaaattgtattcaactatacaatatattggtaatgatattgcaactttaagttgagagatcatactggaaaaagtacagtatctttttttttttttttttttttgaccgtatcatatcgtgtcggttggtcttcgcattaaaattaaaacttttcaaaattagtatgacgaatattcattataaatgaaactaaatacacattcctttcttgcgtatattaaatgactacgacagaaagataatcgtacgatagttttcagaaatatttgtgaggtgttgaaataatattagagtttcctaattgtatacttttcttcttctttttgcagccacttatttctatttatgtaaagaaaacagctgttaagaaaatattttacgtcgataagaaacaaaacaaaaacacttatttcaagtttaattataggaatatcagatccatcagaattctgaaaaatttgcacgttattagtctatctatattttctcaaactttctatcaaaattagataattgtttttggaaagaaaaagagcaaaactattcgattgggcatgaaagtcggaaagaatctataattagcaatatacaaaaaccctaaactcaaggtcaagacaccaatctcaaacacggttttatcattagaattaaaattttgattcccatttataattgagatcttttattaattacgttttttttttcttttcttttttcggctgtgcgtgcattagttgtttagatccaccggcgaaatcacttaaggaaaaaaaaggcttgatttttcttcttctcctctcatcttttttgtcttcttcttcttctttgacaagctcattgctttgtctttgatcctgcttgtatcacgaattcggaggacaacccatttcgattctcgtatcgaatttcttgaatcaaagagacggcgggaatctcaaattcagaattttgctgggttgtcgtaaatccaaatgcggtctgagagaagactacaaattataagaagagcgaatcggagtctaacatcatcggatttgggagctacgactagatcgagaatcgaaaagcaatcatcgagatcggagaagaagaggaatcgcgtagggaggtgatgttgtttggttggggattgggtggaattagggttttattggattcgattgatctgaatacaacagcggggctgcacgaacaaggatg

SEQ ID NO: 10320 - DNA, 3000 bp, Unknown; identical to SEQ ID NO: 10312
  misc_feature (1)..( 3000): cDNA_ID_2715477_gDNA_ID_2213642_Annot_ID_181309 3000 nt of promoter + ATG

SEQ ID NO: 10321 - DNA, 3000 bp, Unknown
  misc_feature (1)..( 3000): cDNA_ID_2994643_gDNA_ID_2213642_Annot_ID_181308 3000 nt of promoter + ATG
gctacctcgtctgcatctgcggtttcttccgccgcatctgcagccgcagcctcgtccgccgccgccgcccctgtggctgccgcgcctcccgtcgtgctgaaaagcgtcgatgaggaggttgtggtggccgaggaggggatcagggagaagataggtagtgtacagctgacggattccaaacattctttcttgagctccgatgggagcctcactgttcatgccggtacctcctagatccaccagattcagtcatttcatatctgattttgttgttggagattgataaattaggttttacacaggtgaaagattaggccgtggtatagtgacggatgctatcactactcctgtagtcaacacatctgcctacttcttcaagaaaactgctgagcttattgacttcaaggtccgttgattgattcagtctctttcttttatggattagaataacacctattaggttgaaagaatctcttactagttttattgactttgtttatcttcaaaaaattgaattattgtaggagaaaaggagtgtgagtttcgagtatggtcgttatggtaaccctacgactgtggtacttgaagataagataaggttattattattttatctttaataatgtgttttataattgcacttgcctttcctgaagattatgttgttgatgcttttggatttgtttgattaatatattgctgtagtgcacttgaaggggctgaatcaactttggttatggcatctgggatgtgtgcaagcactgttatgcttttggcattggttcctgctggtggacacattgtcactactactgattgctacaggaagactaggatcttcatggagaattttcttcccaagttggggatcactgtaagaagatttccattgcatctaaattttttaattactgtcttcctttttccaattccagtttttcaacttgattgtttaacatcatgtttatgtccaggtcactgtgattgatcctgctgatatcgcagggcttgaagctgcagtgaatgagttcaaggtcagttctgtaacattattgtcctttttacagttggaaagagagtatgtgtctcaaatttattccgacttgtctggcaggtatctctgttcttcactgagtccccgacaaacccattccttagatgtgtcgacattgagctagtttcaaaaatatgccacaagaggggaactctggtttgcattgatggcacctttgcaacacctctgaatcagaaagcccttgctcttggtgctgatcttgtcgtgcactctgctacaaagtacattggaggacacaatgatgtgagtaaaacatgttccatatattgtaaaacatctcaaaagagcactcactggttgtttagttattaacaaagattgtttctcggtggtttaggttcttgctggatgcatctgtggttcactgaagttggtttcagaaattcgcaatctgcatcatgtgttgggaggaacacttaacccagtaaattacttgactgtctcatttatccctcttattatgctgttaattcatgaattctcataaaaggtttgttaacagaacgctgcgtacctaatcatccgaggcatgaagacattgcatcttcgtgtacagcaacagaattcgaccgcttttagaatggccgaaattttagaggcacatcctaaggtatgcaatatctcttttttgagtaaatatcctgacactatccaggtgagtcatgtgagtaaatatcgatgcaattttgatttgcaggtgagtcatgtgtactatccaggccttccaagtcatcccgaacatgaactcgccaagcgacaaatgactggttttggaggtgtggtcagtttcgaggtaatatgatctatcaccaacctaatctctatctactccagattagcatttaagtatgatcctgaacaccttgattatctttcttgggtagattgatggagacattgaaacgacaatcaagtttgtggattctctaaagattccttacattgcaccatccttcggtggctgcgaaagcattgttgaccaacctgctatcatgtcctactggtatgtctttggcaaaatcgaacaaagttatctttgattccatatgcttccgtctttgacaaaatcgaacaaatttccgatttctaatgggtggttttgatttcagggatctgccgcaagaggagagactaaagtatggaatcaaagataacttggttcgtttcagctttggagttgaagactttgaagatgtcaaagctgacattcttcaagctctcgaagccatctgaaaatgacacatcacacaaaaacgctgtcgtttctttgtcctttatttatctctctttgctgttttcagtcaccgtaataatgatgtctttgaactattgttccgcgacatttacgttccgaaataatcgtgtactattatgatgtttgttgtgctatataataaattctgtttagttcgttttgcgtcttaaagaggttaaattagataactggtcccatgtgaacgaccattgtggccattgctttgtggtaagaactccttgtgcttggaacctcaaggtcacggcttcgaacaatggtcatgaccctctagcttctgcttcttcttctctttgtttcaacaacatataaggcattcataaatgcctcgtctttttttgttttctttcctttcaatacgtagttcgatttcgatttcgatttgtagatctcagcaaaatccatgtcttgagagaatgattaatgggcctttttaataagtccactgataaagacgagagcccaaaacgtaattgtattattatcttctttatttgcttttaaattttaaattgacattaagacaagactaacttttgcttgtcaaatccatgtgttgtccagcgggtaatcaacccaaagttccggatccggacccaacagtaagcaacattttacgattcgttgtttttgaatcccaatgaaaaaaaag

SEQ ID NO: 10322 - DNA, 3000 bp, Unknown; identical to SEQ ID NO: 10310
  misc_feature (1)..( 3000): cDNA_ID_2715488_gDNA_ID_2213642_Annot_ID_181307 3000 nt of promoter + ATG

SEQ ID NO: 10323 - DNA, 3000 bp, Unknown; identical to SEQ ID NO: 10309
  misc_feature (1)..( 3000): cDNA_ID_2715504_gDNA_ID_2213642_Annot_ID_181302 3000 nt of promoter + ATG

SEQ ID NO: 10324 - DNA, 3000 bp, Unknown; identical to SEQ ID NO: 10307
  misc_feature (1)..( 3000): cDNA_ID_2715512_gDNA_ID_2213642_Annot_ID_181299 3000 nt of promoter + ATG

SEQ ID NO: 10325 - DNA, 3000 bp, Unknown; identical to SEQ ID NO: 10306
  misc_feature (1)..( 3000): cDNA_ID_2715520_gDNA_ID_2213642_Annot_ID_181296 3000 nt of promoter + ATG

SEQ ID NO: 10326 - DNA, 3000 bp, Unknown; identical to SEQ ID NO: 10305
  misc_feature (1)..( 3000): cDNA_ID_2715524_gDNA_ID_2213642_Annot_ID_181295 3000 nt of promoter + ATG

SEQ ID NO: 10327 - DNA, 3000 bp, Unknown; identical to SEQ ID NO: 10304
  misc_feature (1)..( 3000): cDNA_ID_1015752_gDNA_ID_2213642_Annot_ID_181294 3000 nt of promoter + ATG

SEQ ID NO: 10328 - DNA, 3000 bp, Unknown; identical to SEQ ID NO: 9287
  misc_feature (1)..( 3000): cDNA_ID_3035956_gDNA_ID_2213642_Annot_ID_181288 3000 nt of promoter + ATG

SEQ ID NO: 10329 - DNA, 3000 bp, Unknown; identical to SEQ ID NO: 9286
  misc_feature (1)..( 3000): cDNA_ID_3035959_gDNA_ID_2213642_Annot_ID_181287 3000 nt of promoter + ATG

SEQ ID NO: 10330 - DNA, 3000 bp, Unknown; identical to SEQ ID NO: 9285
  misc_feature (1)..( 3000): cDNA_ID_1715608_gDNA_ID_2213642_Annot_ID_181286 3000 nt of promoter + ATG

SEQ ID NO: 10331 - DNA, 3000 bp, Unknown
  misc_feature (1)..( 3000): cDNA_ID_2715543_gDNA_ID_2213643_Annot_ID_132317 3000 nt of promoter + ATG
attaaactgacaatttcaataaaccaaaattgaaattctcggttcggttcgaatgaaaccttttgtaggtcgtggtcgtatatagttggacacttgacaaatctgagcatttcctttttgcttacagcggaaatatctgaaccaacgcgatgccgtcgacgcagtccttgaccgtcgcagcgaagacgctacgaaatcggatcttctctaggtctggatctacatccgccggtccgagtcggtgggcgacgccaggtcacgaggagcgacctaagggttactttatgaaccgtactcctccggcaccaggacagtcgcgaaaatgggaagattgggagcttccttgttacatcaccagcttccttacaattgttatcctcggcgttggactcaatgccaaacctgatctttcaatcgagacttgggctcatcagaaagctttagagcgtcttgagatggagaagctcgcgaccgctggagattcatctgattaagcatcaccgttggatctccggttgcttgatttggtatgtccttattctccgggagttgaggagtttttttaccgtttaatgatgatgataacgaagactggagagttagggtttcgtttggcccttgaactttgtttcaattctcctttgttttgtcgataatgatgatgttcatgaaataagtgttcttttaactgtttagacgcaattgccttcactctctacttcttattacaattctcaaatttggtcacttttgatttactcatttctcaaatgattcaatttcgactattgattgctgcattactaattggagaaagagattaaacgagagttgtatgctgatgttgtgtgcttctcttccttagttcatggcttgtttatgttctctgtgaatctcaggtttgcttgtttcactcagtgcagtgcatattgattagattaatagctactttatgttagtcgattcttatctctttagatcatcttttttatacttgtcatttgttgtagtagtagtgataagctgatagtgtagctctaactagggcatggattgttcctttgtgttgtagacatgttcgtgattataggttattgcagcgtgcacaataagttttgtaggctttcaagtggttggaatggcatcagccattgttagatgcaacactctagatttcagttttgtcatttgctgtattttattaggctagcgtttggagttttcatggtgtcagctattggtagatttgacacactagatttcagtttctttgacggtggtgtttattaggtttctacttagctgagaatagcagatgagaatgttgatttcgatcttatacttggacaagtctggagttgaaagtaacttcactagatttgggtagataatgttttagaaatcatgactgcttacctctatctctatagattttggtcgattaatactatactgcctttgagtactactattgctcatagtttcccaaatcctttgtttagtttcctaaagtgtggcttcatattcttctcttttaagtacaagtactttatgctggtgttggctttttagcaagcttgtgatcttcatctcatcctctggtttcatacatgatgattaaacaaaagaagagactagcgattaaacaatagaagagactagagtagtagcttaatttgttgtttgccttagttgagcaatctcgtgtcatcaaattgcatcacatagagagggatcttgtggtaattacttctctctgtgtagttgtgtttcccgagagtacaattctgtaacactgtctggaaccattaggctaggtctaagaagagacattatcacgacactcttcacatgctttttttttttatctctggagacccaagaagagtctagtgtaaagccatgtgaagaccatttgtcatctatccatttcctctgtacatcaatcagatgttttcagtttaagaaggaaaaaaaaaaaaactcggtagtcgtatgtaaatgtaagtcggtgtcggtcggtggagttgaagccaaataatcaataatgtttaggacgaaagtgaaaaggtcaataacggtcaattaaaagtaaagtttatttttctggtaatgtgaccggttattcccggtaaacacacgagccaccgacacatacttccatgggtcacgaccacgattgcagtccgtacacgatccatgtttttatttatttaaacgcaccataacttcccgcattcggatctcccatagcaaagacagagagagaagtaaagtagctttattatggattacagataaaagacaggtaatctcaatgacgcaaagataaagacaggcaatttcacttcagtgatgcaaatctgacagtagacttcactcttgtgtatattaaagtaaccgtcttgaagaggaaggaagataaccaagtgaatttcgtgatggtttcattgtaaaacaccactttttcaaattctctccttctcttggtgctctgtttctgttggagatttcagtcattggtaatctcttcttctcttctctagtcctcatggttgtttcatgctctgtttcttttctttgaaactgatagatagatcgttggatactttagaaaatgcattttattggttttatcaaatcaagttaatttactcgttcttgtaaaatccctatgtgaatgcacccatttttctattttagcaactatggacaagtagctggggcctcaactgctactgtaggatcagacaaaaacatagcaagtgccaattatgtcattttcctcctccattatttgctgtcgttttcaggaacaggaatatatcttagctgtgttttatcctttcgctcatcttgcaaaatggaaatctaaaaatctttacttcttgaagattgattatcacagaattttggtttctttcttgtctttgtagggttacacaaatcttcttggattgttttctcacgttgctttggctgtattgagagagtttcacg

SEQ ID NO: 10332 - DNA, 3000 bp, Unknown
  misc_feature (1)..( 3000): cDNA_ID_2704665_gDNA_ID_2213643_Annot_ID_132322 3000 nt of promoter + ATG
aataaattgtattatcatattttaaaattttgatagcagtatcatatgtaactctaacattctatgtttagagatgaatttatctatatatatctacttggataaaccaatttgcaccatactatttgcagcatatgagactaactaactcttgatacactgaaatgatggtagacaattcagtctatatatgcgagttaactcctaataccgtgaaatcataataggcaaattcagtccacaaattttttacgtaggattttgatattttccactctttatatatacagtctataatcttcaaacctatcacctataaataatctacaatctaccatttagtcaacaatggtgaaatttctaaaccctcgtgaaagtctacctatctcccaaagtttctaattctatctacttcacatttttctccacccaccaactaaagtataagccttggaaaaacaatcaaaataagaaattctataagtcctttattccttatataataaatcataagttagtaaactcttttgttcacttttcttttgcatccaccgaagaaaaaccagcttcacaatgagctccaacgacagagatcatcgcaggttcaactctgaccaccactcattctggcctaatccgtctacttacgatcttaacagcaagatcatgcttgccgcagtggcttctttatctggagttatcctcatcgtcttcgctcttcatctttacgcaagattcgttctccgacgccgtagagaagctttccgtggcctccccgtcattttccgccacccttttgagatgcctaagcgtggcctcaatcccacagtcatcgcttctctccctactttcactgttggagccactgatggcgtggctgcctccgctactgaatgcgcagtgtgtctaagcgtgttaaaggagcaagacaaggcgagagagttgcccaactgcaagcacatcttccacgtcgactgtgttgacacgtggctcaccacttgctccacttgtcctgtttgtcggactgaagttgagccaagaccgagacttgagcctgagccaagggaaggaccagtcggtactgcaccgcagttgttggtggaaaccaggctgaacttgactgtagaagccgcatcctcttcttcctcagataacaaaacagttgtatccccggcttcgcgattaaattcgtttaggaaaatcttgacgagggaaagatcttcgaacaggatcaaccattcttgtcctgaccaagatcgtgtggcagatcttgagagacattgagtcgacatatagatacatattatgcatataaatcatatacacatatcgataatctttaatttatacaatatcctcctttcttttttactatatcatgctctgtttttggttttagatagttttgtgtaacggaacactaaatatatgttagtcaaaagatacatctggtgcagttcatgccattcaagttaactattcacagtggtagacagtacatatcagggctccataaaagatgcagaaccattttagttacataaaactgagggagaagagagatcataaaagggttaccttcaatcaccaatcggaagctaaacctgttggataatcagtgtcattgtcacaatgtggcctaaaatgacgaagggtgacaaccagctgctaaacatccgccttgctcggctcaatctgagaattctggtgcagttgctccctgcattgaagtggcatctgcgatacttccattgctcactcccttactgcacaccagatttcaacagcatgagtgtaactattactatactcaatgaaacgaagcctcatggagaatgagaacattttcaaaaaaattgctttaatagtttttgaaacttcttctatgttctgcagtaactgcatcatattgataatatgaacaatataatcaccaagatcaaaatcaattgtcgaggagaagtgaagtaacttcatccttctaagccagaagctaatgaaaaaaacaaaaaaaagatttcatttcactcaaaagttcaaaacccatcaaactagaaatcattttctaaaagaacctatgatggatcaaaattgctccaaacagactataaatgagacacacacacaaacgctaattggcaatacaaatgtggattacttaattaccttgaaggaaacttgcatgttccttgacctgaaaacgaaaaattgcagaaaaagcatcaaactttcaacattttcaattagcaaaagtcataactatctgctagacattgatcctgaaagaaaatgtgaacttactaggattgagagaagtaacagctgcgttgttactaaagttgcaagcttcatctgcgagaccattccatcagataatagttattgaatacatacgaagccatcttcactatatccaatggatcgtagcaggatccaccttgctgaatctagacgcaatcagctcctctgggaccacaagcccagtcaatggccgtttaaagtgttgaatcctcaacgttgttcttcgccacgcaccaaagctccgtctctaatacctccccaccaaactccgcagtagcagcaaccgtaatgaggagaaatagagagattcattaggaagcagtgaggctgagagagagaatacacgatcattttccgagagattgatcgattttgtactcggagatttcgaagaggaggaagagtgtgaatttgaaagagtcgaatagatgttggagtttgttgtgattaatgtaaagatttgggtgaataatgtaaaatattttaattcttaccggttattgaactcggttatactgatttgggccgtattaaactccggcccatatacatatgggcctctaatgaagtgtttttagctgctctgtttttgatgacggagcatattaattatggttaattagtaaacaaaaagactctttagctccttaaccttttcaatttctgaaagaggaggagatcggaaaacaaaacccagtc

SEQ ID NO: 10333 - DNA, 3000 bp, Unknown
  misc_feature (1)..( 3000): cDNA_ID_3036011_gDNA_ID_2213643_Annot_ID_132325 3000 nt of promoter + ATG
tcatcaacccatctctataataatgcaatctttatcactttttgtctttcttaatactcacatacacatgcaacccactttctctaatcctaatttctagcttctatactgcacgtaattctactacacagtttcatattgtataacaacattagggatgattgaaattgacaaatttataaccaataataacacaattaataaagttaaaaaattataacatcgttgttttcttttaaaaatcttctcttgattgaaaaaactaggaaaataacacatatactgttgaacactcttgataaaaaaatcatatggagattttttcaactttaatttcattttgacttccaataaatttaagcctaatactatttaataccattagcctgaatgcaatcacaatctctagctcacgtactgctcagctaaacatgattatactagatataattttgaagtacaaatactagctaatcaaaagaatttagaggtagcctagtcgaagctccaaatcaagaacttggttgggattcctcaaactcatcccaagctccaaccccatgacttgatcatctttcttattcatcagatccccacggcttatctcacatcttactgaatgacatgcatcgatggcacttttcttgatctctctgctacatacattgctcttgttcttctctctgtccatcatcaaacctccatagctagtagtactgtccaaaagatcaaaccgggcagaaggaaaaggagtggttttggatctctggttggttagggaaggctcaagatgagctgttgttgttgaagaggaagaagaagagctaaaattagggttagggtttgcaataggtgtgtggtggtgaggttcgaagagccaagaagggatctgcctgagttttgctctgtctcttctatgaacattcatgtggcctccaagtgcttgagcagatctgaactctctcctgcagaagctgcaagtgtaattcttgggaggccatgggatcagcccagcttcgtaattcttgtagtgattcatgatgactctgttgtcaccattaccgtcttctccttcttcttcttgggttttgtctctgttactaaaacttgccaaatgtgttctcttcatattttccaacagatgatgatcaatgctggtggtgaatgatgaagatagtatgatactcccctgcatgaaataaactaagatgttatgtatgtatatattaattcaaaagtgagaaagaataagagtgggggatgatgaaaaccgtatagatagagatttttgagtttgatgaggaactaaggaagaatgtaactacggaggagttactatgtgttatatagagtcaaaagggaaacaaaaacagaaggtggtttttatccttacttgaggaaggaggtgcatgtacggatgatcatttattagggtttaagtctgttacatgtttggtcagatatattggagaataatgagtataggctaggctatgttcgattagatatcatgagtggaaattatttaaaaaaataaaataaaaagagagaaagaaagagacaaagaggtagtttcatgattaagagggagagaaagaggaattgaatagaggctacttaactcatgatgctcatatgcctgcaatgtgtctgcttgttactataattggaagttacttgagaccaatgttattgtggtatgggaactctgtgttgcattaatattttgtgtcaaaatcttgcagggagataacttgccatttcattttcatcatattccatctctggctccacaaatctcttcattatatatatttgaacatctattatatacacacaagatagcctaaaaatatgaacatgtgtttagttttttgatatggagagattgtagtgaatagtgatggagggccaaaagaaaccaaaactattactaattgattttgacattgattagaagaaactgtaaaggaaagaaacaaggcttgtgtatgcattaaggacatagacaatgacgtccctgatgtcttcagagttattgcagcttatatccataactaagaaaacttacatattactttaaaactaagtaataaaccagtaacgctaacaatcgtatgccacatctagacaagtgtaaacaaaattggtggatatagaattataaccctatcagcatatcaactttatgggttgaggaactcaatttcggttgtcaaatatatattgtgtgacaaattttaacttatcaaattttattctcattccttaatcaagcattaaagttttctcaattgaccaatctctaagaattgaaaaaataatcttcatctagttaatgcatatctattgaatttggaaaatttaaaagtttttttttattaattttgtttttgggaaaatcataaaagacaccctcccctcaatagaagatgaaacgcggcgtttcataaataaaaacgagaaaatcaaaatcgtcgctctctgtttgctggcgtaacttagccttgttcttcttcttcatcgcgatatctccggtgtcttcttcgtctccatcagaagaagaagctctctgtatccatccatatcgaaaaagtatgaactttatccgaatttcttctcaattttatggatttattagtcagactcatgttagggttttgttcgatttcatgaatttagggttgaaattttgcttgtttgtatagactctaatggaactgatggtttgttttaggattgggttgatctaaaaaaatgcttttttgctttgttgttgtcgtgaattctgctcaataccttccattaagtaatcagttttggtttgtgatgaatagccagagatcggaggaaggagagagagataccaatctctgttgctttggttttaaggtaatgtgtttgtttccttcctcatgagaatcggaatattaaggtattttgtggttaagattttagttgatttttgagaatggttttggtcagggtttagaggagatg

SEQ ID NO: 10334 - DNA, 3000 bp, Unknown
  misc_feature (1)..( 3000): cDNA_ID_2704652_gDNA_ID_2213643_Annot_ID_132327 3000 nt of promoter + ATG
tgatagagtttgtcatccttcgaccaaagaatacaaaagaaaattgagatgtatcaattagtgtgcgaggaacctataaatttaatctttggaaacgcctggacatcgaagcaccagtggtctagtggtagaatagtaccctgccacggtacagacccgggttcaattcccggctggtgcaatttttttaacaaaccaacgcccaacatcgtaatgaacctatgtgggctttaacggcccattttgcttttcagtccgtaaacactaggccttttttatgtgttatgttgtccttcctcccaaccacatgattacactccttgagttcaaaaatttctcttatgtttcttttaccgattgtttcatttagttattcttaccaacatctactggttaaaatttgcatatagccatgggaattcaaatatctggaactgaaattcgaaagcgacgatgcaatgcaaataaaatataggatttatttgtgaactaaaaaagtattttaatgatatttggaaaaatcgagaaagtccgaatgggaattgtaagttttaaacacaaagagacatttttgctttagtcaggcgtgatggagaaaactcccaagggatttagttttccctcgagttaagttattatgtcattaaacattcttctgtaatttatgatctaaaccggaaaagaaaaacgggttagcgcaaactgcaattatctcaactaattcttaaataacagtaattatgatcccattgctcaagtgttttagtagtcttttaacgtttagttatgttacttcactgttccagtaatacgtcctaaattatctcgtacttcaatttagattaccatgaactacaatgttaaattgggattatgggaacataattactaagatgttttgagacaattaaaacttttaaaatattgacaaataattagtatattctttcagccgatattgatttgaatttatctttttttttttctggaacatccaataaaattaaaacgattagaaaatggcttagcatggttcatgcacataaatgaaatacataaaaatgattttatttcactaaatataattcagctaactcatttgcaagtttgataacatgactgtagttgagaaaaaaaatgaaactatagttaatttggtcttgtttctcaaattttcggttgcttatttgatttttttttatttacatgataacaaacttaccaactataaccatatccgagtaacttttaaagtacacgagcactaagtgaagaaagtcacatgcgtacactaatcctaattgaatcacacgatttctctcgtgtgcaaaatccgtaagtacataatattaatacttttttttgtaacatattaaattctaataatctcctcaggtgatttgaatcctagtctgtaccagctacatactcactccatgtaaccaaatattcctaagccacctaagcagatccagcacgatcaatcaatattacgagctttagtgtttgttttgtcataaagggagtttaattagcttataattacgcatttaacaattatacttacataaatgggcttcaaatacattcatggcattagcatttgtcggtacatctttaccggcatttgccggttcatccggtccccacacttcacgacaaacagcagcagttccgatgtccggcgttcggcggaagaacttataaaataacttttctaaaattaaaataaaaataaagaatgaatgaaagaagatagacaaaattgattattaattgagtttgctttgaagctccaagaaccaaacgtatccgggtataaaataatacgagataaagtgatagaagacctaagactacctcattactaaaaatatggatatttttctatacaaatccacgaatgaaaagaaaaagaagttggactaattaaattgaaatccaataattgtaaatataatattaaaacccaataaattagaagtctcatgttgcagtctccattattgattgtctccttagaatccaacatgtgaccctccattgtctaccattcacaccctttggctcactcgataaatttggacattaattgcattcattttatttgtaagaaccagaatctcagtagatgttatttgtgttgagtaaactgttgttatttatagactaggctattcttcgtatacactttgatactgatttttagttcatcatctatctaccgactaaatatagtgtttctatgtggcttctcctcaaatgtcaaatttatttctttaatgttgtttgagtttcaaacttgcaaagtgcaaaccaattttggttgttatactaaaaccacacatataattaaagacacccactatagcataaaattcgtcgtgtaagcaattttactatagtctaaactccataaaaggacgtcgaaaaatattgtgatattggaattatagtgtcagtttgtttttctttgggcaaatggattgtagtttcattatatattacaatttataaacgaaacgataagtatggctcatactttagtgatggagaattaaagtattttatattcagagatgacacaatatggtagaccaaaaataactaattaaaatagtatcatattagatatttatatgtgattgtaaatttgatcattgagtgaacattttaaattagtatgcccaagaaagaaaagaaaaaaaaaaaactctttctctctcatgataatgttccttttataaaatccacccaaagacaccaaacacttctccatcatcatttcatttcttgttctttttccaccatcaccatttcctagttcgctcgtgcacatctccgacgatcccaattctaaaatcatcacttcttccaatcttttcaacatctcttcaaaatatccagtcaacaaaaaaaaaagtacttaaaacaaggaaaccccttctttctttttgtacatataacataaaaatcatcacttttttgttcgtttcgccg

SEQ ID NO: 10335 - DNA, 3000 bp, Unknown
  misc_feature (1)..( 3000): cDNA_ID_2704644_gDNA_ID_2213643_Annot_ID_132329 3000 nt of promoter + ATG
tcccctgtgagtccttggattccacgaaggaagagatccgattaagagaaagactgaaagacaataatatatgttcatcgtttctttttttgcattcttctttcaagttttcctttagaatatatattagagaatataaactaaattaggtgttagagaatataaactaaagatagattcatcattagttcgaaggtagaatcacatactagctagtagctctaagtacaaaaccaaacccattttggttttcatacaattaagctcattaggaaccctttatctcctgcaaagtgtatgttagttctgttctcgatccaaatcgtacaaatgtggtatatatataggtggagagatcaagtttaagcttggaataaaaatatattcttatcacaaacgaaggagctctaagaactcagcaaataatgtttaagaaaaaaaaaaaaatatatatatatatggttacgtcccctctcactaaaaagggcttgagacaatgtgtgagtgtattcgaaacaggcttacggagattagtctcttctcctaaggtgccttgcgtcacaagtccttgattttcagttaactttctctttttcttatctcaatctcaagaatccgaataataaaactaaagatttcttatgataaaacagagcaatcatgcgacagttaaaaatattatgaaattctacatgatgagtttattaacgacatttttttttaattaactaaagcacggatctaaacacttttgagttttgactttttcatttgattttcttccttctttggaattcttttaattaactttttccttgatttcaaacgtcttcatcaagtatcatatctcatgaataagttaaacgtaaacaaacaaaaaagtatatatattgtatggaaataagttatgagaatttttccattttgattccttaataaggctttttacttctttttttttgtttcaacgtctctttttattttttaccattaatgtaagcagtatcaacattacagctccaaacagcttctgatctgtaactgctaatcctctgtttttgtcttgacttgcaaggtgaccgacgtacggaattgggctcaggacattgcctcttagcaagcttcaagaggaaggatttttggagaataacaaactgatcattagagtggaagttaaagtagctgaagaaggatatttaactgggaaggagatgtttgaaatcaaaggttttgaagttccttcttctcaggtaggttaaggagcttcacgtattctttttctttcttgctttttctggataaccagatgttgttgttgttggtaggttatttctgtgagccagcttttcatgaaacacccagacattgcaactggtttcaaactaaatggcaaaggtctgaagacagcatacatgagtcttctcctcagcctcatcgagacgttgcgaaggcctccactgagcttttctgatattgagttaagcaaggctaacagcacgttgagggagctgacagaagcgggctttaagctggattggttaaagaaaaagcttgaggaggtttccttgaagaggaagaatgcagtagatgatggttctcgtgtcaaacaagtggaggaacgcatcaaaattctgaaggttgacattgtcggaactcaaagatgagttgcaatttgagaagactagatctgctgctgctaatcaacctttgtcgtttgatgacattgtttaacatcaaaatcaagttttgtgtttcataaatatctctgggatttttcattactctttgaatccagttttcagttataagcttcaacctgtgtaataaatagctgcacaacaaaatgcaaaacgaaatattcatagtatctcaaaatagtttttttgtgacttctaaaatcacacaactttcagaagaagaatgacgaaacataaattatagaggaggaacatcactactattttcattttttcagccaatcacagcgctcctctatacgcccactcgcacctacttcacgtcacgcgctcaattccatacccattcgcaccaacctcgcgttgagcgcgtgtcatcaatttctataggggtaaacccacaaaatcatgtctatttctattctactcgttttgattccaaaagagcctcgcgtgaccccaaaacctttttttctgaaaaccatattaactctaatgcaaaccaaacccaaatcaatttcaatttcaaaaccatgtaaaccgaaccgaaatcataacaccaaaaagacaacctagcaatatactcatatatcgtcaatttcactattaatccaacgagccagtttattgcgatgacgtttctaatgcttcctaatgacatgtttttaacttatgttgatcgtttcatcctctgtttagtcctgaccacttttcttagttcaaatgttttgattgaaagcaatgaaacccaaacatagtttccttgcaacaaaagctttttactttataaacatgcataatttgatcattttatttaagtttaaattttcgagtctctttgtttctcttaactttgttgatttgtgtttattctcctctattacgtaactcaaccaagccctaaatttgggttttgacttgtataggaagaaaccaatcagggattttcaaaggccttacaaatacagaattatggttccaagaaaatgtttgagttaacgagaggttaagttctaaagaagtttatgacatatttggtttgttgattcattgttcaagtttttaattattctggtatccttgtttcactaaacgtcgtctacagagactaaagttttctgtttcttaacccctctctatgaaataaacagagcaaatcctctgtttctagcaaatcctctgtttctttgaccaaaagacgtaaataccctgattctttactttaaaattcaccggattttaaatggactgataagaaaaggcccaataaagcccattactcattgctgaataagtctggatg

SEQ ID NO: 10336 - DNA, 3000 bp, Unknown
  misc_feature (1)..( 3000): cDNA_ID_2704640_gDNA_ID_2213643_Annot_ID_132330 3000 nt of promoter + ATG
attagatgttacatctagttaacattattacatttttttcttgtgcatgcaggttaaatcagtgagttggatcttcgtgaagcatccagacactgcagtacatttcttaccaaagaacaaactggtgaagaaagcacatatgaatactctcctctgcctcatcaagacactgagaaagcctcctctaagtttgtctgagactgagctaagcaatgcttacagcgagttgactaagttaacggaagtaggcttcaagctagactggttaaagtcaaagcttgagaaggcttccttggagaggaagaaatcagtttctgatggttctcaggtacaacaactgaaggaacaagtcaagaatctggagcttactgtgtgggatctcaaagttgaactagaaaaggagaagatcgttgctgataaagttttttcgtttgagttcatagattttttcataaagagattctttctctcttgtttctcaatctcaaaacattaattaactatgttttctgtcaaagcttaaaaaggtttcattaattaacaaatctccaaattactaaattacttatcagccaattaaataaaagaatatgatttttcaagattttgtaattgcatggattgtaaatataatcagattaatacttgttccccctttttcgtagataaggattatctttatatttaattttgaggttttctttcttccactaatcagatttcgtgtgtgtctagatctccgcctacgattcaaggatcaaacaaatctccaagtatttcgtctgttttctcctccctcgaagaactaccaaaaccttaaaaagtaaacagatggggacgcaattccgcaaagctttaactttgacggtaaccaacttctcccaaaagagctctccgataaactctcctcctttcccaagcggtggctgcaattggtaagagtctctctttagctagctttcttaagtttcttctctgcatgcaacaataataatcttattgttgtttttgtcaggtatattaaattttatcccaagggaagtgctgatgataattacttgtctttgttcctgtcccctgatgatcctaaatcacttggacttaattggaaaaggagagctaatttttactttgttttgctgaatcaatcaggcaaagaacttcatcgaacacctggtacgtattttaactcatcttctctctgtgtgactgtgtctctaagagaactacacacatcttatctgattgaagatgaagaaaacttgaagttacacttttgtttttgtcttaacagaaataggtgatcaatggttttgtgatgactcactaagctggggttttccacagacattgcctcgaaaaaagcttctagacaaaatctttcttgataacgacagattcaacattgaaatctatattaaagttattgaagttgttgaaggatatcatatgtttccagcttcattcactaataagctcttaagaagttccttagagtatccagataagtctgagaaggaaactgtggatatcaatggtttcaaggttctttcttctcaggtaagttgcttttttggttttttctggttgataaaaaccacacaagattcaaactcaaaattcatttttctttggcaggttacttcagtgaagcgaattttcgaggagcatccagatatagcagaagatttcagatcaaagaaccaagtagtgaagacagaatacatgagtgtccttcttagggtcatcgagacaatggctaaaccgccacagagtatttcagagactgagctaagcaacgttcatagcgaattgaccgagctgacggaagtaggttttaagttggagtggttgaaggcaaaacttgaggaggtttgcgtggcgtttaagaaagcaaatgctgatgggtgtcggattcaacaacttgaggaacacgtcaagaatcttgagcagactgtgtcagatctcaaagttgaaatggacaaggagaaggctaaatctactgctaaagttttgtcgttggaggatacattgtctgatctcaaaactgaactgggtaaggagaaggcaaagaatgctactgctactgataaatttttgttgttgaaggatacttattctgatctcaaagttgaactggagaaggagaaagccaaatctactagtgctgctgctaaagttttgtcgttgaaagaggctttgtctgatctcaaagttgaactggatgatcagaagatagtaaattctgctacaactgctaatgttttatcgtgggaagatgatgatgatttattttcacatactaactgtttaggaattcagcagaagacaaatgcctacaaaagaataaactgaaataactgtttatgttcattgatagtttcattaatctcgtgttctgttttttcacatcaaaaatgtaaatttattatatcaaacttataaacagacattactctgttcttgattgtgtgtttgccattcgcatccgcctcatgaaagcaaagcatttggaatgatttgtgttattataacaaatcatatgttattcatatcatatatttttttaagtcttctaatatctaatattattaaattagtgatctggaaaaaaacttaaaaatccaatgttatttaagacattttcatttttaatgacttttaaagatttagatattttcttagttaaaaatacaaatatctaaatcacatggttttaagtgggatttggggagatttttcttggttaactttcttgaattcattgaaaatcatataaaaacacattaaaaatcaaatcatttaaaatatagggttgactacacccctagattttgtttccctattaaaataggatttataagcctaacaaaaaaaaaaaaggaattataaagtctttttctttccgtgtctgacttataaagcaagaaccaaacaagtctcttgtccctcactggaagaaccaaaccctaaaattacgaaagcgttcttgagatgatg

SEQ ID NO: 10337 - DNA, 3000 bp, Unknown
  misc_feature (1)..( 3000): cDNA_ID_2704628_gDNA_ID_2213643_Annot_ID_132333 3000 nt of promoter + ATG
cacacaaacaacttaaagctgatcgcccgagctcaccagttggttatggatggatacaactgggctcacgtaataatgaaactataaacctttctttgcatagctttgcaaggcttaagattctgagctcatttttactgtcttccctatcaaacaggagcaaaaagtggttactattttcagtgcaccaaactattgttaccgttgtgggaacatggcctcgattcttgaggtcgacgactgcaggaaccacaccttcatccaggtctttccccaaatcccacatgtcttgtctgctaatgaaactagtgtagaagaatgaccaaagctaacttgagtatataaaatgtgagtgcagtttgaaccagcaccgaggagaggagaaccagacgtcacccgaaggactccagactatttcctgtgatcactggacacagactcatctcaatcagcagctgcaggcacccacaagtgaaaagtcacagttggctaactctagattctggtcctatgcattgtgttcaggttgctctgtttaaaattcaacttagtgcccaccaccggaatatagtgtgtattataggcgaagaaggcttcttatcttcctctataaccaagaaaagaaaaaagatacccattatgaacattgttttgttgatgttattagcttcttcttcttctcccttctgcatcagaatgtggtttcatgtgagaaatcttctaattttatttcacgttattcgttcttgaacatctctgatttttgaatagaaccttgaaattgttatgtttatttgttcttcaaagcttgatataataacaatagtcgctgaacgcatcagatcagccactcaaaatgttcgactgtgaaccttctcttgacttgcaatctaacggcattgaaggctttgttgtactcatggctattgcattgagaatgagataaataaagaacaacattgagactcagtgcagactggaaggagcaaattgatagacctctaaatgaagagctcaatgagaaagctcctgagttggtgctgagctggatagacaagtgttttaatgtatagagtcgtaatccagtctaaatacaaagtagctgtgggaagtagaaggttaaaggttgttgtaaagggaacacattctactttctcgggacttttctttggtcaatcaagaattggtgcttgtttctatcagtaactgaacaaaaccagagagtatgagtttgatctttaccaaacgcaacaaggcatacaaaggcaaatccatagtaatgacaaaagatatctaagaaataataagataagtaatacatttgcttaacaacaaagaacaatatagttcttagccaaaaaacataaaaaaacaatgaacaatatagttgagaacaatgtgatagaccaaaatcttatgtattcattcatcaaaagagaacagtttatattggaattctaaacgttttgcctactattgaaggtttcacaagaaacaaaacaaaccaaagactagaaaacaaagtgtaattcaatagtctacgttaacatgacgtgttttcgcaccgaagacaataatatataaactgtgatgacagaatatggagtcatggactatgtaaggctaaactagattatggagtcatggacgaatgaagagtttttaatttcgtgaatttcataaataatgtgagcctcgtaataccactagttgtagacagcggttctttggtggtcgatattgcatggattatgcggtccactccacgatctaattattacaactatatacatatatttatatatcatgcactatatttgtattttacaatcttaaaaccataacatatcaaaacactttgattagtaacttttgtaattttataagcttcttgtgatttttatgtgataaaacataaacgacaccaattcgtttttttttgttttcatacatattttctataatatctgtcaggatctaataattaatatactgctctaaaagtatatatcatatcaattgtctccaagttttggtgaaacacctcaaactcaagttaataagactattttggttgtattcatgttttttttttggctatgttccattctgcttacttcttaaaacaatgtagtgtccaataacagcataaacctgataagaataataattatgcgtgtagaattttggtgaaacacgtcaaacttatttaacaaaacatatatgtttcatttttttttggttaattttttcccaattttttttattttgaaataaattttcggatagtgacatataaccttatgtagtctgtcaattgtcatatttttctatttccatcatcctatatactttacctttgttaaaactccttagataagaacttccaatattttccttacctatattttaatttccagttttatatatttagtacttaaaaaattcaaatggaaaatatgtttgactctaattagacacatataatatatatttccaaatagtaaattacaaattgagaaactcatgaacaatagtgcatccacgtcgttatccaagttggatttctttctaaaacaaataattagacctttaaaaaaaaatataaataggtacttgttaaaaagtaggagagcccacaaataaggctttggccgcttctgcttggactctccaacaaaaatcaaactctttaaaaaaacaaacaaattgaagagcgattatacgatcacggagaactcaagatccggtgacgaatccaacttcttgtgacggagctcaagtcgagagagagaagactgtactagtagtagtagctgtggatttttgtgtcatcatcggagatcggaatcttcttcttcttcttcttcttggagcttctagaagtggagagaagggggaagatcaagcgacggatagtgataggttttgctgtatgtcagtggattgtgttgaaactgattttggtggatttggagaacttgtgaaccctattcaatg

SEQ ID NO: 10338 - DNA, 3000 bp, Unknown
  misc_feature (1)..( 3000): cDNA_ID_3035992_gDNA_ID_2213643_Annot_ID_181359 3000 nt of promoter + ATG
gattcatttatttcgtttttatgttggtttatgaattctaatagtcaaaagacctagtttatctgcgtcatttctggatattttttcgttccaacattaaccaacaaatcgtttatccttacacttaccatattttcacgtttgagatggataatttctcaaagaaggatgcagcgatacgaactcatccatttagatttaaatataacattattgtaactggtttctttatttatctaattaatttgatgaagaatatataacatttaaattgatcttttgtttatgtattagagatgaaattaacatatgtatctaaattgaaatacatatctgtcattaaaattattagtaattgtgacaaatgcatcattatcacaactaaccacacaagacttttatgaaagaaaaaaaaaatgttcatgacttagttataaagaggaataggattatatttggttaattaattattgcttctgactttgttttaaaaatattaattttcagcttttccttatatcttttgagatagggttttaaaaagttttgttttattttcaatgtctataaatattaaacagacgtgtgagattcttccaagtaacaaaagcctaagaaagcgtctcggaagagatatggagaatcatgagcagacgagtttcacgtttgagatagataacttcttggagaagggagatgcgatatctcctatattcataagcggcggatgcgaatggtaaaacgagcagaatcagttctttagctttcttaaactcgttcactagactcaacaaaaacttgttctcgaagatcgatgtatcttattagtttgtatgtttagggtttaatctttgtatttttttctttctcaggtttattagggtttggcaaattgaagatcacttggctgtgactctgagcgttccgaatcttgaatccttacgatatggatgggaaaggagaaccaagtattcattcattgtgttgaatcaatcaggcagagagctcgaacgaacatttggtaattaacttcaactatatatataatatatgtatcttattgccgaagaagaaaggttgagaattttattttgtttttttgtttgcctcacagaagtagaaggtctcttctgtactgaattattagaatggtgtcatcccaaagtaatgcctacgaacaagcttcaagaagtttgtttagaaaataataaactgatcattgaagtccaagtaaaagtacttgaagttgttcatgaaggaggggtaacaactgagaaggagatgttcaatattgagggtttcgatgttctctatactcaggtatgttaagtatcccctagtttcttttttagtacttagagctcataatttcctctggattgtttttcgatcatgttaacattgattttgcttaatgttgtcaggtgtctcgggtcagctggcttttcgtggaacatccaaacattgcagtagatgtcagaataaagaaccagttggtgaggacggcatacattaatgttctcctcggtcttatcgagacactagacaggtctccacggagtctttcagagactgaccttagagacgctcacatcgagttgagcgagctaacagaagcaggattcaaggtagattggttaaagaaaaagcttgaggaggtttccttggcgaggaagaatgacatttctgatggttctcaggtggaagaactcgaggaacatgtcaagaatctcaaacttgagctggacaatgagaagattaaatcttctactgcttctgaaagagttttgttgttggagaaagaggtgttagatctcaaaattgaactggatcggacaaggagaggtcagccaaatctcctatatctaaagttgcgttattgaaggatgctgcagattccttcccacttctcgttaaccagctgcagattccttctcgtttgagttcataatttttttataaagagattctttctcacttgcttctcaatctcaaaacactaagtcactagtttttcaatttaggaaaaaattggttaatatattcttgatccaaagagattttgcctaaacatctcatagctggggacaataattctttgtctcagttcttatcacttttttcaagcaagtttgaatacctagtcttttttttttccattccctgacttgtttttttttatatcatttttggttacataatagaagtatataaccaacgcagtctcactctttgtatttggtcactacacaactatattattactaagttcattgatagttctctgtttttttaaaatagatcaaaacgtcccctaaggtgccttgaaacacaagtttttaaatgcaaaacagaggaaacaaactataggtaattgattgcgtctcttcttctatctcaagaattcgtcccaccaaattaaactttgtaaattattagaagaggagtgacagatattgctacaaaaatagactttccaacaaacgttgcaaaatgaaataaatacaatcgctatttaggagtagaaaatccatagttattaatttttatttatgttttccatatttttaaccataatttggttattatttataaaagcaatttcatttataattaaacctttttgaaaatattatctaagagaaaaaaaagaagcaaaagttacttttatcctaataaaaaaccgcatacaactgatctgtaagttttggaatttaaataagataataagttacagatctagttaatataattatgactaattgtattaaactttttatatgaagattttggtctagttatctcgtttgattaattattacgggttcggttttcctatattaagagtaaaaatttaagaaaccattttgttaaacttgagagttgagagagcagcatcttttagcaaatggagacagaattgaagaaggcttttacatgggagattgataacttctcccaaaggaacgatcatgcataaactcggaaaccttctcaatg

SEQ ID NO: 10339 - DNA, 3000 bp, Unknown
  misc_feature (1)..( 3000): cDNA_ID_3036000_gDNA_ID_2213643_Annot_ID_181357 3000 nt of promoter + ATG
gctagtagctctaagtacaaaaccaaacccattttggttttcatacaattaagctcattaggaaccctttatctcctgcaaagtgtatgttagttctgttctcgatccaaatcgtacaaatgtggtatatatataggtggagagatcaagtttaagcttggaataaaaatatattcttatcacaaacgaaggagctctaagaactcagcaaataatgtttaagaaaaaaaaaaaaatatatatatatatggttacgtcccctctcactaaaaagggcttgagacaatgtgtgagtgtattcgaaacaggcttacggagattagtctcttctcctaaggtgccttgcgtcacaagtccttgattttcagttaactttctctttttcttatctcaatctcaagaatccgaataataaaactaaagatttcttatgataaaacagagcaatcatgcgacagttaaaaatattatgaaattctacatgatgagtttattaacgacatttttttttaattaactaaagcacggatctaaacacttttgagttttgactttttcatttgattttcttccttctttggaattcttttaattaactttttccttgatttcaaacgtcttcatcaagtatcatatctcatgaataagttaaacgtaaacaaacaaaaaagtatatatattgtatggaaataagttatgagaatttttccattttgattccttaataaggctttttacttctttttttttgtttcaacgtctctttttattttttaccattaatgtaagcagtatcaacattacagctccaaacagcttctgatctgtaactgctaatcctctgtttttgtcttgacttgcaaggtgaccgacgtacggaattgggctcaggacattgcctcttagcaagcttcaagaggaaggatttttggagaataacaaactgatcattagagtggaagttaaagtagctgaagaaggatatttaactgggaaggagatgtttgaaatcaaaggttttgaagttccttcttctcaggtaggttaaggagcttcacgtattctttttctttcttgctttttctggataaccagatgttgttgttgttggtaggttatttctgtgagccagcttttcatgaaacacccagacattgcaactggtttcaaactaaatggcaaaggtctgaagacagcatacatgagtcttctcctcagcctcatcgagacgttgcgaaggcctccactgagcttttctgatattgagttaagcaaggctaacagcacgttgagggagctgacagaagcgggctttaagctggattggttaaagaaaaagcttgaggaggtttccttgaagaggaagaatgcagtagatgatggttctcgtgtcaaacaagtggaggaacgcatcaaaattctgaaggttgacattgtcggaactcaaagatgagttgcaatttgagaagactagatctgctgctgctaatcaacctttgtcgtttgatgacattgtttaacatcaaaatcaagttttgtgtttcataaatatctctgggatttttcattactctttgaatccagttttcagttataagcttcaacctgtgtaataaatagctgcacaacaaaatgcaaaacgaaatattcatagtatctcaaaatagtttttttgtgacttctaaaatcacacaactttcagaagaagaatgacgaaacataaattatagaggaggaacatcactactattttcattttttcagccaatcacagcgctcctctatacgcccactcgcacctacttcacgtcacgcgctcaattccatacccattcgcaccaacctcgcgttgagcgcgtgtcatcaatttctataggggtaaacccacaaaatcatgtctatttctattctactcgttttgattccaaaagagcctcgcgtgaccccaaaacctttttttctgaaaaccatattaactctaatgcaaaccaaacccaaatcaatttcaatttcaaaaccatgtaaaccgaaccgaaatcataacaccaaaaagacaacctagcaatatactcatatatcgtcaatttcactattaatccaacgagccagtttattgcgatgacgtttctaatgcttcctaatgacatgtttttaacttatgttgatcgtttcatcctctgtttagtcctgaccacttttcttagttcaaatgttttgattgaaagcaatgaaacccaaacatagtttccttgcaacaaaagctttttactttataaacatgcataatttgatcattttatttaagtttaaattttcgagtctctttgtttctcttaactttgttgatttgtgtttattctcctctattacgtaactcaaccaagccctaaatttgggttttgacttgtataggaagaaaccaatcagggattttcaaaggccttacaaatacagaattatggttccaagaaaatgtttgagttaacgagaggttaagttctaaagaagtttatgacatatttggtttgttgattcattgttcaagtttttaattattctggtatccttgtttcactaaacgtcgtctacagagactaaagttttctgtttcttaacccctctctatgaaataaacagagcaaatcctctgtttctagcaaatcctctgtttctttgaccaaaagacgtaaataccctgattctttactttaaaattcaccggattttaaatggactgataagaaaaggcccaataaagcccattactcattgctgaataagtctggatgaatccagtcggtgagctttcgttcttttcctccggttttggttttccgatttgcttgccgccgataatctccgactttaatgctccgccgtgtcttcgaagttgcacttacttaaagctttttctcttccgccgtcggctttggaaggatccttctctttgaaaggtggattctttttggccggagaaagccaattctgagctcgccaatg

SEQ ID NO: 10340 - DNA, 3000 bp, Unknown; identical to SEQ ID NO: 10334
  misc_feature (1)..( 3000): cDNA_ID_2704652_gDNA_ID_2213643_Annot_ID_181355 3000 nt of promoter + ATG

SEQ ID NO: 10341 - DNA, 3000 bp, Unknown
  misc_feature (1)..( 3000): cDNA_ID_3036011_gDNA_ID_2213643_Annot_ID_181352 3000 nt of promoter + ATG
gaatgtggaataatttaaagacatttttctcaacaatgagaaaattgttttcatttttttcacgcacacataccattaagtgctttcacgacatgcatgagaaatgctagatatatgtaattatacataaagatgtgatggtgagtgtaaaagatgaaaacattaactattcatgagtcaattgatcatcatccatctttatatgtttcatagtaccactttgtcgcatgcgtctgtgtctcatcaacccatctctataataatgcaatctttatcactttttgtctttcttaatactcacatacacatgcaacccactttctctaatcctaatttctagcttctatactgcacgtaattctactacacagtttcatattgtataacaacattagggatgattgaaattgacaaatttataaccaataataacacaattaataaagttaaaaaattataacatcgttgttttcttttaaaaatcttctcttgattgaaaaaactaggaaaataacacatatactgttgaacactcttgataaaaaaatcatatggagattttttcaactttaatttcattttgacttccaataaatttaagcctaatactatttaataccattagcctgaatgcaatcacaatctctagctcacgtactgctcagctaaacatgattatactagatataattttgaagtacaaatactagctaatcaaaagaatttagaggtagcctagtcgaagctccaaatcaagaacttggttgggattcctcaaactcatcccaagctccaaccccatgacttgatcatctttcttattcatcagatccccacggcttatctcacatcttactgaatgacatgcatcgatggcacttttcttgatctctctgctacatacattgctcttgttcttctctctgtccatcatcaaacctccatagctagtagtactgtccaaaagatcaaaccgggcagaaggaaaaggagtggttttggatctctggttggttagggaaggctcaagatgagctgttgttgttgaagaggaagaagaagagctaaaattagggttagggtttgcaataggtgtgtggtggtgaggttcgaagagccaagaagggatctgcctgagttttgctctgtctcttctatgaacattcatgtggcctccaagtgcttgagcagatctgaactctctcctgcagaagctgcaagtgtaattcttgggaggccatgggatcagcccagcttcgtaattcttgtagtgattcatgatgactctgttgtcaccattaccgtcttctccttcttcttcttgggttttgtctctgttactaaaacttgccaaatgtgttctcttcatattttccaacagatgatgatcaatgctggtggtgaatgatgaagatagtatgatactcccctgcatgaaataaactaagatgttatgtatgtatatattaattcaaaagtgagaaagaataagagtgggggatgatgaaaaccgtatagatagagatttttgagtttgatgaggaactaaggaagaatgtaactacggaggagttactatgtgttatatagagtcaaaagggaaacaaaaacagaaggtggtttttatccttacttgaggaaggaggtgcatgtacggatgatcatttattagggtttaagtctgttacatgtttggtcagatatattggagaataatgagtataggctaggctatgttcgattagatatcatgagtggaaattatttaaaaaaataaaataaaaagagagaaagaaagagacaaagaggtagtttcatgattaagagggagagaaagaggaattgaatagaggctacttaactcatgatgctcatatgcctgcaatgtgtctgcttgttactataattggaagttacttgagaccaatgttattgtggtatgggaactctgtgttgcattaatattttgtgtcaaaatcttgcagggagataacttgccatttcattttcatcatattccatctctggctccacaaatctcttcattatatatatttgaacatctattatatacacacaagatagcctaaaaatatgaacatgtgtttagttttttgatatggagagattgtagtgaatagtgatggagggccaaaagaaaccaaaactattactaattgattttgacattgattagaagaaactgtaaaggaaagaaacaaggcttgtgtatgcattaaggacatagacaatgacgtccctgatgtcttcagagttattgcagcttatatccataactaagaaaacttacatattactttaaaactaagtaataaaccagtaacgctaacaatcgtatgccacatctagacaagtgtaaacaaaattggtggatatagaattataaccctatcagcatatcaactttatgggttgaggaactcaatttcggttgtcaaatatatattgtgtgacaaattttaacttatcaaattttattctcattccttaatcaagcattaaagttttctcaattgaccaatctctaagaattgaaaaaataatcttcatctagttaatgcatatctattgaatttggaaaatttaaaagtttttttttattaattttgtttttgggaaaatcataaaagacaccctcccctcaatagaagatgaaacgcggcgtttcataaataaaaacgagaaaatcaaaatcgtcgctctctgtttgctggcgtaacttagccttgttcttcttcttcatcgcgatatctccggtgtcttcttcgtctccatcagaagaagaagctctctgtatccatccatatcgaaaaagtatgaactttatccgaatttcttctcaattttatggatttattagtcagactcatgttagggttttgttcgatttcatgaatttagggttgaaattttgcttgtttgtatagactctaatggaactgatggtttgttttaggattgggttgatctaaaaaaatg

SEQ ID NO: 10342 - DNA, 3000 bp, Unknown
  misc_feature (1)..( 3000): cDNA_ID_1032307_gDNA_ID_2213643_Annot_ID_181350 3000 nt of promoter + ATG
caagcataaactccgctcctgatttccatgaccaaaaactcagcagcaacttggatataacttctcagtatgattatattttctccgaagtgcgtcaggaactagataacagcccttccactaagcttgattcttctgaagagattgacaactttgctgaattttctactccatcaagtgtccgtgtgcctccatctgcttttctgggacctaagtgtgcactatgggattgcacaaggcctgctcagggctccgagtggtacctggattactgcagtaactaccatgggactctagctctgaatgaagattcgcctggcacagcacctgtattgaggccagggggcatcagtttgaaagataatctattgattgatgctcttcgtgcaaagactcagggtaagaatgttgggatcccagtgtgtgaaggagctgttaacacaaaatgcccatggaacgcagcaggtgagagcattgtcccactagagcccagttttgcttctctctttgttttagttcaacatttcgttgcctctttgaaaacagaagccttatgtgagtttcttacttttgcctgacccttaattttttgtacttgcagagctatttcatcttgaactggttgaaggcgaaacaattagagagtggctcttctttgacaaacctagaagagcatatgatagcggaaaccgaaagcaaagatcacttccagattacagtggaagaggttggcatgaatcaagaaaacaactgatgaaggaacaagaaggccagaagagatcttactatatggatccacaacctccaggtccctttgagtggcatctctttgaataccaaatcaatgaatctgacgcatgtgcgttatatcgcctagaacttaaagtaggaaatggaaagaagagtcctaagggaaagatttcaaaagaccctctggctgatctgcagaagaagatgggacagtttaaagtggcttcagacaaaccctctcctccaaccaaaggtcgtaaggagtgaagttagctattggtaatctaactcaagactcctgcaacaatagctccaagttgtctccagcattctacaaaagagccatcgccacctctgttttctttttttttttctttctgactgtattatgaagagataggatctttgatgtgttgtgttaatatggacaagtctggtctttgccctttttcttgatagaatcgtagatgggtttgtaaatttttgcattttatttttctcctttaaaaccacaaggattttgttaacgaagtggtgtattcatatttcaaaggtacatttgcaacaccattgattctttattccaattcttatctacgtgtgtgtgtgaatgaaacttgaaaccaatacaagtcactaatgctctcagattatgtaattgggctttactgggccgtttataaaattgggctagaaaaagggagacagcagacgacaagagcatccttgttctctttaaaccctaaattacaagcaaatcaccaacagagagagtaatggcgaaaaattctggtagctcgtttgaagcagagaaatcagagggaaagtgtgttacgacgactactgaagcacaagtaattcaaaattctggctgatgaattatgtatttgattttacgtatttgtaattcactaattctcactgattcatacaatttgtgtcgtaaatgaacagcaaagtagtcaacctgttttgagcaaggaagaggagaaagtgagagatagctacttgttctgctgtgaaaatttctacactcttcctgagatgatcaatttcatgaaggagattcatggtgtagaacaaaccactgtgacaaaggttttcagggaacttttaaaaggtagaaaagctgaagcatatctcagagaatctcagaaaagaatgaaggcaagaacaacaacaacaacttgaacagaggaggatgaggcttaggttgctctaatttgaaattctttggtttggtttactggttagtaagaaatagacttgtattgtcacatttttttatcatattttgaggtccattgctttgggtgtatggaccagactaggacaaatgaataggagatgcaaaagggtaataatggagaagtcagtcttgttggtctattcttgtccgagtccatgatttttagagggagaactagaaggaggaactaaaagttgtttaggttaatggtttaggtgctaagtgttggctctgtgtgttacttatgactcgtgggatctaatgtcttgtgaaaaatcacttgtgagataaaatggacatagtctagagaagaaggtatataagaagaaaagcagtcaacttaactacaaaatcacaacggctcacaactgttttatgttgtagaagttggttgcttcttagagtggttcattcttcattaccagctaaccgcaaataaccgtgacttgaagtctttcgaattacacttctttcactcgtggttcaaacttcttctgttcaagttgttatgccttctccagccattacttgatttcaaaatggtgttgatggtctcattcttgaaggcttggatgtttctcaactttttgctcttgaacaagagccaagaggtgatgggactccgtagtacaaacacaatttaagaacgtttgagtaagagttttgattcacattgaaaaaaaaacttagaagaaaaaatgaaccaaactaaaataatcaaattaatttagtttattaatcaagaattaaatcaagttttaataataacctgaattgtagattttttttcttttcttaatagtcgaatactgaacactgtagtattaaatgaaaactcaaagcccaatataattcaaagcccatcgaatcaaatatctggccactccacttattcttaacttgaaacttaaaagccgaaatcgtaaagagagaatctggtcggaataatccactcgaatcttaaaacgacgtcggtttaaccaaatgcgagtcaacggatg

SEQ ID NO: 10343 - DNA, 3000 bp, Unknown
  misc_feature (1)..( 3000): cDNA_ID_3036023_gDNA_ID_2213643_Annot_ID_181347 3000 nt of promoter + ATG
gttttatactataggaaatcttcaggacatggtcaagaatctacaaggttttgcaacttttcttgggaagcttatttgttttgtttgattgtctagcaaactgatacaaaaacaattgttgttgttgttgtttccaggtatgaagcttgttttcgctcttcagatggtttttatcggtttcttagtgatcttatggatgcttaggagtcgtgctcggtctaagagacgacgctatctgctgaagaatgtacctcccattaatagatcagctaactaactccctggaacttgtattatacttttgtgaagcttttacgtggaacctgagtgttaaagccacatatgtcaagtgtcattactagctatacttattcagtgtgagattgtttgttcctagttacataattgtcttggtcttcatgtttattaagccttcagatcctcagaccatagtaggtaccgatgagtcttatcacaagtaagatagtcacatgatctgcagattttctagaaaatggatggattcacaatttgaatgatctcatggtgaattattcgactgatataaggttttatgaaaatgaactcttgtttgtttctcacagacaaaatcaatatacaaaaaacattacaagccattgaagagaagagagaaatttacagttaaaaaatcctgaaaaaatgatttgtaaactcaagattggaaacatccacaagttgcctttggaacaattctaatggcccagtattttagcagccgtttcttcttgcttctccacgcttaccttcaatcattgcacttctttcttctgcttccttgtgagtcactgaaacctaattcatcctctctgcatactcctgctttcttcttctctagttcctcctgcagtgaaacaaattcacaaacacttcacttctcattgttctcaatcacattgaaacagtatcagctctctattgctaagtttattttacctccattttcttgagttgcacttcgacagctgctttcttcacttctcaacggaaaactagtcacatagtttagtttaaggtcacctctaacgagtgaagcagaccaagatttcgccagtgcagattctgtaagaattttcattctactaaaacataaacagcaatatgccaagccttaacacaaagagtgtcacaggtaaacacatacagagcaaatgcatgattctgtcataaagcttcaaatttagctgtaatatattacctccatggatgtgtattgaatcgtaaataggccgcttctctctcgaaacaagaactagcaatggtagcctgatgtcaacgtatgttgtatgaatcaagtccccagtgcaacttgaaggtaaaagaacttcttcacactgttaggtcgaaaggtgaaacttaaagcttatgtactagacaaggcgatggaacttcttcacactgttaaggacagacttagaggtaaaagaaaaacttgagtagctcatggagtttagctagaggttggtcgctaagatatttgtaaactgaagatgctaatggttatattagggatgatgatcttgaaggaattatttggaaatgacataacagatgatgtgtgatttcctcctttaaaacaaaatcgtttggttttgataatcatgaaaatatttctatgagattactgtccgacacacatttagagaaataattcactgactatatattccgtaaatacatgtacatataactttctcaagtttgatttataattttaacatttcaacaaaacaaaaaaatatagattccgttaaatattcctatcgatccggaaaagtaaaaaattggacagacaaaatatccaaaattatacgatttaagagagaaaaaaaaagtagcaagtgtcctacatgtgggtgtggtctgggacaaagcaaatatagaggggaaaaaaagagtacagaaaacaaatcacatggactcacacatcaacattatactcttcactctctctccactcgtccactaccctactttctccatgcattgtttagccctcctcatagcagtgatggtaacaagataatccattaccatggtgaaagatatgtgataaataagctaagtcgtcggatttgttttccaataaattaagtcatgtttatcaactcgacttaattctattattctatatatagatgatactgtgtgctattaactcatgtattcattgtacttgcttgacgtaggtttacatgtaccaaaattattaattgacacatatgatttgcaacaaatacgagatattgcatttacatgaacctatcgaaaaaccattcataagaaagaaacgtattaaccattcaacaaaagaaaggtcacaagaacacgtgcttgcttgattcctcctccaaatctctttacatagattaaaaagaaaaaaaccagtggaggagaatttccagttataccgttgagacctttagcctcacttctcaagacagctgtttcatagctgtccgatctcaatatctccctccatgtggccctactcagagagataaattaaacactttgatcacatcgaatttattatgttctttcataagattttacataatatatatctcatgtatatatatatatatctctatttatctccttcattaattctgtttttttacttccttctatttatataactatcatttgttaaacatagccattttggttactcttgttccgttttcttctttcttcctctccttccttttttcttttctctatcttcttcatatggttcatgacattgatctaattccacttcccatttgtctccacatttcgtttctttcctttgttttttcatctaggtttttggttttctgaattggatttacgttagtttatcttgtacttattaattaaggttttttttttttccttcctcaatcctgtaaattcagatttgctttctttggtaatcttttggatcaagatccatctattttttcttcaatg

SEQ ID NO: 10344 - DNA, 3000 bp, Unknown; identical to SEQ ID NO: 10332
  misc_feature (1)..( 3000): cDNA_ID_2704665_gDNA_ID_2213643_Annot_ID_181346 3000 nt of promoter + ATG

SEQ ID NO: 10345 - DNA, 3000 bp, Unknown
  misc_feature (1)..( 3000): cDNA_ID_3036031_gDNA_ID_2213643_Annot_ID_181338 3000 nt of promoter + ATG
tctccgaattgtacccatcggagcttcgttttctccggatcagccatacagagagagaaacagctccgattacaaccgaaactccagaaatcagagaaacggttactgaaccggtgatctgctgcttcttctcctttgcgtcgtcattgctgattacactagggtttggtttctggagttcttgagtaccttccggctttgcagcgacgaaatttggggttttgattttttcacacggcgtttgcaatgggaagccacagagatgagagtttccagcgaatgcgtttggtccttgattcaacagagatcccacctgaggtacttttccggtgagattgttgtgactaaaatctaagctgacgtgaactcgaaatcgaccgtacgacggtggaatctcgccggtgaattggttgaaagagaaattcaaggttccgacgaggcttccgagttcagtgagtgactcagggagtgaaccgttgagatgattggaggagaaatcaaggtggttgagtgacttcatggacttgatttgggccggtattgggccggagagtgagttgtgagagagatcgatgtaccggagcttggttgcttcgaagagacgaaccggtatggttttagagaaattgttgtgagctagatcaagccggtttagcgagttgagtaaaccgagttctgatggaatgtaaccggagagactttttccgaagagtacaagagttgtgactcggccgtttgtgcagacgattccggaccaatggcaaggagtcgggtcggattcagaccagtgggtcattactcgggtcgggtcgttatcgacggcggatttgagagctaggagagataaaccgtcggaattgagagaggagcaaaagctcatgcagagaaagatggaagaaacaacaagtgaaagaatcgatggtaacttcattttttgcttaggatataggaatcttgaaactttttggttgttaaagaagctacaaattacagatgattcatatagtgtgaggcaacgagaagttgcagaggaaaaacggtaaacagtgaagacgaaggagaagaataatgggagatttgaccgaggtatgattcttttatggtttcatgttagcaacgtggtgtaatgtagtcatgatcaattttttgaattcttgtccatatactatggtttgaaattttaataatatatacactacagttctaattaaaaatgtgatatattgggatttgcgttttgggtttttgacattttgtggttatttttgaaactttttgaagtttagttattgattgatgcaggtgggttgttgttacatttttaatttgtgtgtatccgttggtgatatctagggtcactggatttttatagcattaaaactatatataggtatcaaaaaaaaaagttacaacaaatttgggatacaaaaaataaacaaagtgttatcttaaatgctatagtctatagaatcttaactcgtataggacctcttcactcttgagccatgaaaaaactgtacagtcccactgggtcgataattgttttacttttacaagattcagcagtaactaaaaaaaggattaaaatatgtttaagaataattgaaaataatcgaactcgacctattgcatatgaatttgaattggatagaggatgtcatatttattcaaattaaaggagggaagagacggtagagagtggattgtgtcagagaaaaatcattaaccaaccgacaaagtaaccacacaaagatgcatttgaaaatatgccacttttggctcctctactcctagtcttaatgggcaattccgaaatatacacgaagagtcacaagtcccattgttgttgggttagcactttgtcacggcccaaattcaacttattcacaacatcaaataaatatatgcatcatatcatcacatccgacttttgttaacaattacttttttcagttaaagaactttcaagaggaaatagtagtaccttaaaatcctacaaaaccttgtcgtgcaagaactgggagggctacaaattgcggtcaatgtacgcaaacatcttaccgtttttggtacaaacactagaactccaatgcagtgagtgagatgggccaattttggcaatctcaatcaacggtccatgtggcccaataaatcactaaaaacggccgaatttttagatccatgtaacttaaataattggtggggacggaaagtcttgtcgttttcatttattcgagtgtggcactctgattcatctcaagcttattttttataaaaagagtaattttagaggctgaacaataacgaccttgaacaaaataaaataaaataagagggtgaacaacgaccagtcaaaatttgaaaatttactcaccagagtctataaaaattaaaaaggaaaggaaaaaaaaagaatgaatcatagtgaaatgaccttatttatggctccaactatagtgattagtaaccactaaaccagaaaaaaacaagtgacccattacacagggattaaaaatactaccgaataaagcccaataggcccaattcaaaagcgtctctctatcatcgtctctccaaaccccataaattggatatttcctttctctaaaaatttggctttattaacagacgcactccaaagctaacgttgctttcttcccactccaaatggctcttgtgctctcagaacacacacagatataataaactcttaacgaagaagaagactttttcttttcttgagcaagctctgagaaactcacagagagggacagagagagaaatatttcattcgctactctctttaataccgccattgatgcaacctccttcgcgttaactgtcaaaatactccccaactgacaaaaattaaattcctttttttctctctcgattttaaaagctctaaaaggaacgagttgatcaagtcggtcggttctggttatcactgaatttcattcaactcggtttattccggtttaagtgtgattttcccggcta

SEQ ID NO: 10346 - DNA, 3000 bp, Unknown
  misc_feature (1)..( 3000): cDNA_ID_3035977_gDNA_ID_2213643_Annot_ID_181364 3000 nt of promoter + ATG
ccaacctctaacgcacgaagactcgcacactttctcacaagagctctgagacaagcactagtatcagcatccggaggagtgtccactgatgcacataatgctactacccatttgcagtcgctactctctaaaccgctctccttttcaccaaacatatccgctttctcagctttgatacccgtgtcactgagtccattccttgtatctctgaaaccatcccaccaaatgactcatcaatgtttgtgtggggacgtttactgaatatctccatgagtacatctcctaaagactcgttgccattttgttttaaagcctgtgaaaaacccataaaacttaaagtcattacttgtccgttaagagaaacactgataagtatgcaagttggaagaaaggaataccagacgaatgtgtgagaagtcggaaagcaacgagtcctcccattccttcaccggttgcaggtgctctgggaatttgtggcatgtaaacactttgctctttctctctgtacttgcttccacttaccttggctacttttacatttggaattcgcttagcctcccaccttaaatgatggaaacaacttaaccatatatgcctaaatgcagatacacagaaagattgaaacagagtgacatatatacctgactcgtcttaaatattcaatcccgtcttctggtggtccagaatcgaaatcaggttctccatccacagcaaacgcaggcctcaaaatgctattgtaatcgtcattatcttcagttttctcctcttttacaacatagtcttcttcaagtagttaagtcatcaattccttgcctaaatgttctcatgaagaaacaaaaagtcacattttcttggaatctcagttttgatttctattgaagaaaccaataaaaacaaagaaaagaactaagcccatcaaaaagatttagctttcaaaggtattgatttttattgaagatgtatgaacatgtacaactttttagccgataaaatcatggccatacacactttgaaccaaacaaactctctagacccctttaaacaatctgaactaaagaatctatatacagaaagaatgtattgtttcttagaaaaggaaaaattggtgaacacaggatttatgaaacacaggcttcgacagatttcttcaggtcaatgtacaaagagacgggttcgtcttggtacagccgatatgggacctgtggaaaagaaaacaaacggcccctatcaaaaagatacttaggaacaaccactgctgaaagagtcgcagacactaagcccgactggatttgtcactttgagatgaccattagagaaggaaatcaccataaaaccgtagcaaagaaaaagccatttgagtgacacacacaaacaaaaatgcagcagatatagcttaaggttatacatgagctaagtaatcttaacttggagtgacatatttctattagacctaaaagtttcctcaacatgttcaactaaaaacaggcaacaccacaaaatgcagcagctaagataaaagtaaagtaagtggagggttaccgaggatactcttgtgattcttcaaaccttcgtactcagtcaccagctcaggtaggagtctagcatacaagtcactccacagtttcttctgattcgcaatgtgggcatacctcatcgactccatttggttcctagagtacattatccgcaactgcttcccattcatttctccactgttacgaaagtcagaaactttggttgacgcattcctttcaacaatgctagaagcatttcccttatcaatcggtttctctactccaactttcttatgctttcttggtgcatccttatcagtgtgtgcagttactggtctcttagaatgatctttacctttcttgtagaaaggaacaacatcaaacaacgcagtatcatcaaccaaatcaatattcacagatcttccaacaaatgcattatccttaactctcactctttccaccttctcacgctgatctttagacccatttccattcttttcgatcttatggatatcagaagccctagcgagcgtgtccccatcattcttcttctcagtctcccaaagtatttgaacatcagaatcttgtcccttcttctgagagttcaaaatttctttcatatcagagatagaaccgacgcaatcatcctctatcttgtacacatcatctccaaattgatcactttctgtagaaatctcagagacttccttaatctgttgcagttccttattctcttcaagaaacgtggaaccatctccgatttcagcgaacaatattatcttctcagcctccacaatcctctgaccatcagaatcttgtcccttcttctccgagttcaaactttctttcatatcagagatagatacgacgaacccatcagtctcaacaacatcctttatcttgagcacatcatctccaagtcgatcgccttctgtagtagaaatctcagagctttccttaatctcttcaccaaccttattctcttcaagaatcgtggaaccattttcaggtacagagactactactactccaggacactccacattcatcgccacggtttcttcaagagtcgtttcggagaaagaaatgtcaatagaatccgaatggatgatttctccatccttctcaaaaacagaagtaaaaggcgaagactttacttgcttctttgggcttatcatctcttcaacagagtcgtcgttctcaaccggcggcaaagaaacgatctttagcgagtcttctgcaaattcatcccgagaaatcgaagttttccccgacccaatactttcaccggtatcaaatctcgtcgccatcacagagataaaaaagagagagcgagactgtgagactagagagagagagctttatgaagcgaaggcaaaagtctctcgagacgattatataagctgaaaccggttcagttaaaccgtagaagttagtattaaaccggtgatggctattgcaccaattaaagtagaggggtattatg

SEQ ID NO: 10347 - DNA, 3000 bp, Unknown; identical to SEQ ID NO: 10337
  misc_feature (1)..( 3000): cDNA_ID_2704628_gDNA_ID_2213643_Annot_ID_181363 3000 nt of promoter + ATG

SEQ ID NO: 10348 - DNA, 3000 bp, Unknown
  misc_feature (1)..( 3000): cDNA_ID_2994291_gDNA_ID_2213643_Annot_ID_132334 3000 nt of promoter + ATG
agactcgttgccattttgttttaaagcctgtgaaaaacccataaaacttaaagtcattacttgtccgttaagagaaacactgataagtatgcaagttggaagaaaggaataccagacgaatgtgtgagaagtcggaaagcaacgagtcctcccattccttcaccggttgcaggtgctctgggaatttgtggcatgtaaacactttgctctttctctctgtacttgcttccacttaccttggctacttttacatttggaattcgcttagcctcccaccttaaatgatggaaacaacttaaccatatatgcctaaatgcagatacacagaaagattgaaacagagtgacatatatacctgactcgtcttaaatattcaatcccgtcttctggtggtccagaatcgaaatcaggttctccatccacagcaaacgcaggcctcaaaatgctattgtaatcgtcattatcttcagttttctcctcttttacaacatagtcttcttcaagtagttaagtcatcaattccttgcctaaatgttctcatgaagaaacaaaaagtcacattttcttggaatctcagttttgatttctattgaagaaaccaataaaaacaaagaaaagaactaagcccatcaaaaagatttagctttcaaaggtattgatttttattgaagatgtatgaacatgtacaactttttagccgataaaatcatggccatacacactttgaaccaaacaaactctctagacccctttaaacaatctgaactaaagaatctatatacagaaagaatgtattgtttcttagaaaaggaaaaattggtgaacacaggatttatgaaacacaggcttcgacagatttcttcaggtcaatgtacaaagagacgggttcgtcttggtacagccgatatgggacctgtggaaaagaaaacaaacggcccctatcaaaaagatacttaggaacaaccactgctgaaagagtcgcagacactaagcccgactggatttgtcactttgagatgaccattagagaaggaaatcaccataaaaccgtagcaaagaaaaagccatttgagtgacacacacaaacaaaaatgcagcagatatagcttaaggttatacatgagctaagtaatcttaacttggagtgacatatttctattagacctaaaagtttcctcaacatgttcaactaaaaacaggcaacaccacaaaatgcagcagctaagataaaagtaaagtaagtggagggttaccgaggatactcttgtgattcttcaaaccttcgtactcagtcaccagctcaggtaggagtctagcatacaagtcactccacagtttcttctgattcgcaatgtgggcatacctcatcgactccatttggttcctagagtacattatccgcaactgcttcccattcatttctccactgttacgaaagtcagaaactttggttgacgcattcctttcaacaatgctagaagcatttcccttatcaatcggtttctctactccaactttcttatgctttcttggtgcatccttatcagtgtgtgcagttactggtctcttagaatgatctttacctttcttgtagaaaggaacaacatcaaacaacgcagtatcatcaaccaaatcaatattcacagatcttccaacaaatgcattatccttaactctcactctttccaccttctcacgctgatctttagacccatttccattcttttcgatcttatggatatcagaagccctagcgagcgtgtccccatcattcttcttctcagtctcccaaagtatttgaacatcagaatcttgtcccttcttctgagagttcaaaatttctttcatatcagagatagaaccgacgcaatcatcctctatcttgtacacatcatctccaaattgatcactttctgtagaaatctcagagacttccttaatctgttgcagttccttattctcttcaagaaacgtggaaccatctccgatttcagcgaacaatattatcttctcagcctccacaatcctctgaccatcagaatcttgtcccttcttctccgagttcaaactttctttcatatcagagatagatacgacgaacccatcagtctcaacaacatcctttatcttgagcacatcatctccaagtcgatcgccttctgtagtagaaatctcagagctttccttaatctcttcaccaaccttattctcttcaagaatcgtggaaccattttcaggtacagagactactactactccaggacactccacattcatcgccacggtttcttcaagagtcgtttcggagaaagaaatgtcaatagaatccgaatggatgatttctccatccttctcaaaaacagaagtaaaaggcgaagactttacttgcttctttgggcttatcatctcttcaacagagtcgtcgttctcaaccggcggcaaagaaacgatctttagcgagtcttctgcaaattcatcccgagaaatcgaagttttccccgacccaatactttcaccggtatcaaatctcgtcgccatcacagagataaaaaagagagagcgagactgtgagactagagagagagagctttatgaagcgaaggcaaaagtctctcgagacgattatataagctgaaaccggttcagttaaaccgtagaagttagtattaaaccggtgatggctattgcaccaattaaagtagaggggtattatggtaatagcaaaagaaagagctcgaaagatacaaaccactcgcttctctcctcacgcgccttctcaaaattcgatcttctttcactgcacacaaagcgaagagacaaagaagagagagagagagagagagagagagagagagagagagagagagaaagtgggggaaaaaaggcgaagaatacgcagattccatccaatttagggttaggacttcccctaatttggaaacctagtcctgtttcctgatctgttttccggatcggacgagagacgaattaacgaaaatg

SEQ ID NO: 10349 - DNA, 3000 bp, Unknown
  misc_feature (1)..( 3000): cDNA_ID_2704167_gDNA_ID_2213643_Annot_ID_132335 3000 nt of promoter + ATG
ccacatcggtcatcggggtcagaccataataagtcacacatcggcccttcatggggcacttcttgaactcgatcaaaattccttatgttgtcaagggtctcgatagatggagataatccaccatgaaggcaaaatatttctgactcaacctgcagggaaaaaacataatgatttgatgattcccaaaaatttgtgtagaaaataccaacgatttagtcagataaggcatacatgaaatcttccatatataacagatctccattctttgcatttttcagaatactaacgtcttgcaattgatgtgacactagcaaaagaaatacgacagcacagtacaaaagtactactttggttccaaataatactgccagcacaagacaaagaactgatcatctatattaattgactaccggacgaggatagacttatatgtgaacccccactaacaaaaaaggaagaaaaatgtgagacatgtatgataggtactaaccaaggctgtcagaggaaaatagtcgaagaggtctgtaaagattttccaaacatttgcgttgccgtacctaaaaaggaaaacatggtttgttaaatttattgcaaaatctatatcccaaataagctgcaaactaggatgtgtaagattatacaacatagaacaatactataagcaagtaatcataagcccaaaggattaacagaaacaggaagtaaagaaagaaaagacaattttggacaggctaccatacacacatacaatgcaacagcaaaaatataaggacaatagtaatgctaataataattaaaaaaattgtttaaatgcattagaaaataaggattttttttccagtataaggattttttccaggagactcactttcgtagacattcatcataaaatccataaacctgagtaatctgcgagatggaagaaaaagaagaaaagcctgtgtcagattaaaatagtaatatgataaaaaaaatgtgcacaaaacgaattttgtagacaaaacagagacttataaaaaaggaaattgtgtgtcaaccaagatctcaacgatggaaaagactggatacacaatgaagtactgtatttaacatcagaaggtgaatttacaagtggaaccagagtaataaaatcataaagcattagtctacctgacgactttcatggtttcctctaagaatagtgattcgctgaggatatcgcatctttaaggcgactaacagctggaaagagaataagaaagagaaacagtatcagcatacttcatagtcacacccaaaatatatacattgtaaagaaaaaaatatccgtcaagttaatggtatcttgttaccaatataaaaagacaatgactggcttgccaatcagcctactcttaaatgaataaaaaaaggaagtctaaatatttcatcttcgtaccgtaacagtttcaacagaataataaccacggtccacatagtctcccataaacaggtaattggtatcagggcactgcaaaaaagagaaaattaatactttgtaagattggtagagctatttgtagagctctgtatattttatagatgttaccattccccctatacggaaaagctctgcaagatcatggaactgtccatgaatatcaccgcagattgtcacagggcttttcacaggctgcatgcaggaaatagaaagaactaataaattcatggctagtagcacaatctaccacactgaaaatagaatcaccaagtgtggtgaaagaaattgctcaaccaaagagatatgcaagaccaggaactaacctgaacattgctttcatccattaagatctccttggctttctcgcataatgctctaacctaaggaaaataaaacaatgctgcatatgattttcacctctttaacactctcaagacatgcagctaataaccactatcaaacacatgacatagaaatatatacttagagaaatcaacttgacacaggcaacaaacaggagcatcaattaagaaaaaaaaaaaaccaacaagtattgatcagctattgatacgaaaatattaaaaatttatcagtccataagaatcccgattgacattaccaggcacataaaaacacgagcttagatgtgattaatcactatgctaagaatccaaatcagccaaaatttaacatcaaaccatagaagcaaagccaattctccaacccatagaactgcggtgacaaatgagcttccgtgagaacatacatgccaagatctaataacatttcctgaagatgttcatttagaaaaaaaaaaaaaaatcgaaactttccaaatcaaatctgataatctcgtacccaaagaaacctcaaacacagaaaaaaataccactccactcaaaaaaacaaaaaaaacagatccaatcatcgataaaaacaaagtagagaaaacgtcaagggctaaggtctaaagagaaagttgtaggcacctgttgctccgagagaggcttgcactgcatgagctgcgagatctgctcatcaagatcaatggttgcgtccgtcggaatagaattcgcgcccattttcgttaattcgtctctcgtccgatccggaaaacagatcaggaaacaggactaggtttccaaattaggggaagtcctaaccctaaattggatggaatctgcgtattcttcgccttttttcccccactttctctctctctctctctctctctctctctctctctctctctctcttctttgtctcttcgctttgtgtgcagtgaaagaagatcgaattttgagaaggcgcgtgaggagagaagcgagtggtttgtatctttcgagctctttcttttgctattaccataatacccctctactttaattggtgcaatagccatcaccggtttaatactaacttctacggtttaactgaaccggtttcagcttatataatcgtctcgagagacttttgccttcgcttcataaagctctctctctctagtctcacagtctcgctctctcttttttatctctgtg

SEQ ID NO: 10350 - DNA, 3000 bp, Unknown
  misc_feature (1)..( 3000): cDNA_ID_2708714_gDNA_ID_2213644_Annot_ID_132336 3000 nt of promoter + ATG
cgactacagctccatgagacattctgatggaccttacggcgagaatatcgccgcgggatgggtccaacctaaggaccaaatgagcggtccgatagcggcaaagtattggttgacggagaagccaaactacgatcatgcgaccaacaaatgcaaagatgtttgcggacactacactcagatggtggccaatcaatcgttaagtctcggatgtggctcgttcaggtgtcatgagaatgagttgatttatattgtatgtaactattatcctatgccagtgggtgatgagaatacccgtccttattgattatattgatgcaaagaaatgatccatatggtaatgtgatttgacaattattaatatgttaagttactgatcaatatatatgtataagaatataaaaccaagtttatgatatacattggtttgtataagttgctgctgtgaaatgattcagaataaaatgtgatgttcaattggttaaacaaattgtgattacatatatttgatataataatatatgaactttttgttatagatgatttataatattttcgtaaattatattcggagttattttcctttgtatttagtccgttggtatctagagcaattgtgaaaatgagtagctaagacatgaaaaattgtgcatttagataatgatggtttatgtttctttttgaagagcatgcccaatcaatatacaaatagacacagctctactgctctagcagaaaatatggagcaaatttctgtcttggggagctttatgctgcggttaaagcggctatgagactctaagcatcctagtagagtagataacgaattctatagactatatagcgtgtggacatcaacatgtctttaactttaaaatgattaaaagttgtctaatgggtcggtttaatagcttatcatcttccttattttaacttctaagtactagagttaaaggaatcaaatgatgcgtatgctttaacttttcaagaaacacaatgatgcatagttttaagacactgtaactgtaagtgcaaatgaaccaaaaatgatgctttaacacgacgttgagttttggggaatcatttcatctgacatatatgggaggacatgttttgtttgtatatcgaaattcggaaaatgtatggctaagtgggaatattggatatcacataacttattagaatcagaagagattgcaaatttgtccaagaagcatatatcaagacactgtaagcgcaactctgaaaatttcattgttgatcaaaaatacaatatagtatgtggcaactggcaagtcatacaatcacatttgatcgtactagtgagcagagccatgccaaggttaatggttgacggaggcggtcaaaattttttttctccaactaaaaaaaacgatgcttataataatagaagtaaaaatgtctacaaagataaattgtcatatgacgaaaatacgaaaaaaaacaaaacataaaaatagttctaaagcgtaattcttcttcctttcttcccaacaaaatcattagccaaacgttcaaagtcaacttctctaaccaatgctctttcgatagataagatcgccaagtcacttaacctttcttgtgacatactcgaacgaagataagattttatcaatttcagctttgaaaaacttctttccgcagatgcaaccgaaactggaattgtcaacaatacttgataagcaatccatgaattaggataacaaccttcaactttttgcaagaagtctaacacttcaataggcctcctaacttccttgggtaaagcttctcttagaatttttagttcataaaagagatcactagcaagaatatctgaatgtgttccatgagttaaagcatctttaaggttggtacaagatgccatcaaactatcatcactcgccgactgcaactttttcaaatcaaacaaaaacccaaatatttgttcatacctttggaattgttcgaatcttgtctcaagcgagtaaagagcttgatccatgatttggatgaagtagtcaattctgtaaatttcgaacataagtgttacaaaatttctgattctaatttgggggaaaactacaacatgtataattaagaattacatcaaaccataggatagaacaaggataaataaagtatcaaacttactctaacgagtcaatgttaatacgttcaaggctcaagagtaacaggattagaaaaagtcttgtggaaagagacggcgattaaaaaataaaggaagaggattctctaacctaacttaataatgctttgttctgtttgtttccttattctttggatttttttttatttttattttattttcttattatttagataaatgcaaatgatctgtaatattggtctattaaactaagagtatcttatagaaaaatatgcttctaagttttttttcaaaaattttggacgtaagcgaaggtttctttcttatgccttgaggcacggctctgctagtgagttatagtttcaatgaccaaggagttccatgcgatacacaatgcaccaaatttggtgtgaagaagtaaacgtaacttatcaattgttcgaatttctgtggattttatgcaatcagtattcgtaaagtaacttggttttataagtctgttctcaatttccatggcatcaaaagaaaacgtttagtctgtttacttcgttatctcataatccaaattcaacggccacgatcagctagactactgtaaatcaggtggtcgtgacagcacaagatcaacgatctgagttcttccttcttcgctcatatgctaaattctgattgaaacatctgacgaattcgttcttcccctttctaatttgattctccttggaacaaacaagctctgttacagagatcagagtcgaatccgtaacaccattgttgattctctaaagcatctactgatttcaatcgtgaaattagccggtggtgcatggaagctcctttagcggagagttagtttcaattttgattcatcaatg

SEQ ID NO: 10351 - DNA, 3000 bp, Unknown
  misc_feature (1)..( 3000): cDNA_ID_2704766_gDNA_ID_2213644_Annot_ID_132339 3000 nt of promoter + ATG
tgttttctagttaaagaaagtacatacaaaagtgccttctaacccatgttatatgaacttgtatatgtcaagggtaaactatatcttaatctagtttgtctgtgggatcaaatcttaatttatagatgctcttgaaatcactttttcttgtacgtcgaagaacaattgatttttgtaaaacatacactttggaaatgcatatgcattcgaattgaaccattgcttttgtttgctattgtcaatctaaagtgtgaaaagcttggagattgtaaagttgacgctaaaactgtaattttgtattgagttatggtcttattgaatgagatgtattattgatagtgatattctgtttatatacaagagtaatcggaggactaattagatcaattagatgagttttcttgatctgtagaatatcaagtttccttattctatcaatttcttgtcctggatttacactatgtaaagagtttttcaacattaggaaagtgaaaagaataagatataaaacgttccaaactccgtaaccccaccaaagcaacttctataaatacgttagccaagaaaatgctttcttttacgacacaataagttccaaaacaattaaccacacaaatacaaaatgaatgaaatgtcgttctttggttatagtttcatcgtagtagcattattcttcgatttaactcaagcctatcgtcacactcccgctcaaccgccaaaagcaaacgcaaacggtgatgtcaaaccgcaagaaacgctcgtggttcacaacaaggcccgagccatggtcggagtcggaccaatggtgtggaacgaaactcttgcgacctatgcacagagctacgcacatgaacgagccagagactgtgccatgaagcattccttgggaccattcggcgagaatctagccgcgggttggggaacgatgagcggtccggtagcaactgagtattggatgacggagaaggaaaattacgattatgatagtaacacgtgtggtggtgatggtgtgtgtggacactacactcagatcgtgtggcgtgactcggttcgacttggttgtgcctccgtgagatgtaagaatgatgagtatatttgggtgatttgtagctatgatcctccggggaattacatcggtcaacgtccatattagtgattggattttattatactgaatcaacaagattactatatatggtaattaatgtgatttaagaaaaattcatactataacattttgtgtccttaaatgataaaagcatatataaatgcacactagtttttttaccatcaatgtgagatatgtttccatgatatatcaaagttgttgatttgattataatcgacttcagaattcttacaaattttttctttcatttcgctctacagcaaaagaaaacatggacagtttaagattgaataacagaaaaaccctagaacaaaatagaacattttcaaaatatgtgaaatatctttaatacagtatatagcactttaattcaatatacaaaacatataagatttaaagttttttttttttgccaaactttaaagttgaatttttattaataatatttttagaaaaggaaagaaaagaatttccatataaagacagtttcaaaagttgaatctcgtgttgggagatttaaaggaccctcctaaagagctatattggacttctaaacgataccactactttcctaaagttgttgttttgtttgattaacccaaaactctaagagaatatttctttctcggtgggtggaaatatcgttaccctacatttatctcaaccatgaataatcaatctcaccgacattgagtatctacttatgaatcgagttatatatagttcacgtgcgtagtatgtttctctttactgagtttattaaattgatcaaaaccatattgttagaggtatttatcggtttcggttaagattgttctttattattacaaagcgttgtacgttttctcacgggtgtgctaaaagttccaattcgttagagaacgtacttaaactcgtaatttttttttatttttttttcttgattatcttccactccaaatccaaaggaaagatcgatataagttcaattacgtaagaagtttttaggcataaggtttaattcgagtccgtgactgacaaattgtttcttttttttatatatactattttatcaaatatttactatttatttaatatataaacatacatgtcaaagaccaatcagatccagtcaattactagaacattttttttttggtctaatgttaaattcagttactagaaaccatttgactactaagcatatttttttactctacattacaaaatattatcccacaatgatcttcagaaatggtttacatacgtcgaacaaatatcacgggtgttaaatgaaactcacgagagttaatagagattatatatatacgcgtacgtaactaagaagactaatcaaaattccgattggagattaacgaacgtttttcactttgactttcttaattaattaattatttaccagaatttcgttaaaggatttgtaaggaaacatctaattagtgtgtctcagagagcaaaattcttcttaatacgaaaatagtgtctaaaaatagatttctgttactgaacaatctttatgggaatacattagtgatgaagtagaatattttttttagtgataacttaatgataaatatcttttgttactctaaaattagaatctcatcctaatttctgttaatttaagcaatttcgaagagcaatatataggttttactatttgataatttaacaaaaagaaaaacaacttcgtcttctttttttggtttaatggtgaatattgaaaacttaaaaatagtcacgaagctcttgttttgtttgaggcttacaaaaggagatgaaaacccatcagaaaaggaatctgataagtcctcacgaaaacatagttagttccaaaccaattctacaacaaaaacaaaagagagaaaatg

SEQ ID NO: 10352 - DNA, 3000 bp, Unknown
  misc_feature (1)..( 3000): cDNA_ID_3036089_gDNA_ID_2213644_Annot_ID_132341 3000 nt of promoter + ATG
gcttcacaattcaagactctgctgccgtagaagaggatttcaagtttctatgcgatcttttctggtcaaacggagacggattgcctttggatttgatcgagaaggtttcgacgactgtcaagagtatacttccgctgctgcgcacggatacagattctttgattgaacggtttaaagcagtgtgtctggagaatcatggttctgacagagggaagcttccgttaccgccgacttctggtccgtggagtccgacagaaccaaacacacttttaagagtattgtgttaccgttacgatgaacctgcgactaagtttctgaaaaagacctataacttgccgaggaagctaacctgagagtgacctacttactacattggtacaaaacccggtttagtttgaagtgtggaatatattttggttaaagcggctagcgattggtatttggcaaattaaattacttgtacaagaaagtagaaacgttttagtgaaatattcttcttttgtactaatcaaaagcttgtgggctttgttatatgttgtcaactgttataaatttgtatatttaatacctttgtttttcatctttctttttcaaatttatcagatttctgattgataattcaagattgcaacgatggttcatgaaatggtcctttaaaaactcataatgtttatgtgatggataacatcagatatatgatgatatggttgaaacttgaagtattctaacttgaagtcatgattcatgatccgtttaacaacgtttgaaatgagtatcagaaaatgattatcgtagatatgaaacttttcctgcagacacgttctagtattttgctaaaataatagtttgttgcttattcaaccaaacaaaaacacttgttcaagtagcgcaatatcttcgatagttcgattcattattatgatacccttcttcgacttctttgatttcctcgagttcttctccatacgtcacatgactcacatcgtcagcgatttcatggcaatgttacatgtggtggacgacatggagtatccgcgaccgcgagatgatcttgaagaggtgtttgctttatgaatgacgatgaatcggctctgttttcctgtttccaacggttgtaatcacaccatcatcgttgtcttcatctatactaatattcaaatggtcaattataaagcccaataagctaactaagcccaaaaatgaaaacacacggactcagcccatacaaattttaacacttaaggctaatgggtctgtcacgtgcggaatagactgaaaacagagcatcgcacgtgccgcatcaaaatttgaaatcacgacgacttcaaaaaaatcccaaatggtaagaaaaaaataaaaagttgcagaaaaaacagaaaaccctcttttctctctcttctctctctctcgaggaagaaaggcaacaactatggaagctatgcttgtggactgtgtaaacaacagtcttcgtcattttgtctacaaaaatgctattttcatgtgcgagcgtctctgcgctgagtttccttctgaggtaatcaccctcttctttcactctctctctctgattttacctctctaattcaaattctgtaaatcgaagctcttggaatggtaaatttgatatttttgggtttgtaattcctctgggtatctatgaattcgtcgaaagtgcgtctctttttggatttggaattcgatagcttcactgtgttcttcgagattgattttggtttcttaccttttagccctttgttttcaagatccgtgtgttcaattaggagatgaattcgtgttcttttctctctcttgttgaatttgttttctctagtagctgtgctcaatgctcattactgatttggtctttggaaaatttgcattttgagggttaatgacttttgtccatatatgtgatctcaagtttaagtatttattatccttggaacttagctatgagtcaactgttagaggaatgtctctgggattatctcaagctttgttaaaatttgggttaatacagcttcaatagtagttgagaaagtattcattcattcagcctttggtctggaatattttcaacattcgtagtggttgtccagtttctagcttcagttagtagaaatcatgtcaataaatgattggcctttttgtttgatcactttctgaattttcctcttatataggttaatttgcagctattagccaccagctacctgcagaataatcaagcttacagtgcatatcatctgctaaagggtgcgtggcattgtttcttgacttgttgcttgttagccttttagtcagaattttgcaccttcttttgttaggtcgttttgattatctttgtatatatattttttttttgttatgtaaaggaacacaaatggctcagtcccgatacttgttcgcattatcatgcttccagatggaccttctcaatgaagctgaatctgcactctgccctgttaatgaacctggtgcggaggtatttaatgttctctggtattttgcctttattcgcttactgaatgtcattttacaaaaacagtgtgtcagtttctggaccttatttattgatttagttcagtgaagataacaacatgcttctgattattgtgcagatcccaaatggtgcagcaggccattaccttcttggacttatttacaagtacgttttttgttctgtctatgcattttttcttgattctgaatggcttagatgagatgattcctcatatataacagtgaccttttaggtatactgatagaaggaagaatgctgctcaacaatttaaacagtccttgacaatagaccctctactttgggctgcatatgaggaattatgtatattaggtgaacataatccgttttctgcatacttcacagatatgttatggttctcttacacttttctgtctgctcaactttcaggtgctgctgaggaagcaactgcagtttttggtgaaacagctgctctctccattcaaaagcagtatatg

SEQ ID NO: 10353 - DNA, 3000 bp, Unknown
  misc_feature (1)..( 3000): cDNA_ID_2704774_gDNA_ID_2213644_Annot_ID_132342 3000 nt of promoter + ATG
tatttatattaaaattatctgaaattgatttttttatatatagtcattagaacaaattcgtttatacataagataataagtatttacgagcccaaactttcttagctaaacaattttaataaatgttatttgcacttatgaacaattgtgtttatttgacgtaactttgtgttaaaatattaatgatttttttttgtttttttatcgcacatttatgtattggcagttatttttttgtgtttcaattttgtttggtggatcggttttgttcggaggagatgacgacatattttttgctacttttggaatctctttttgtttcatatacaataaggagaaataataggtgggactatacagagatattaacgaaatgaccggaatcgttgccgtgtataaactaaccagaatcattgtcgtgtagaaactgaccagaatcgttgccgtgtagaagaatcgcagaatatttcctcctcctctcagtctctgcggcatcgtttcgttaaagttgacagacggaggagaacatcaatagaagaacaaaaatcttcaaactatcgtcgattaaaagcaaatcgaagattagataaacaataatttgaagatttcgatgaaacatgtaaatatggtaaacaatatcattaaccaaaatgcatatttttcatagatttttattttctccctaattattttttggtaaaaatttatatgaatccttgctttttgattttcttaattatcaagacagtaaaattgtcacttaacaaatttgatctacagatcactttcatcaatttggttttaaaaacagtggtaaaaaatattgatgatgcaatgtctacatatatgttcatttgtcttttagaagttgttttattctttataaggaatttgaaaaagattatacaactcatcgagagacttcacgagttgaatcttttcagttttcaatattatgatctcatgtaaattcctccccgatgtaattttttctttcatccccatgtgttttctagacttacaggagatttgttccaagcacgtaaacacaattggcaaaaacaggttcggtcactaggccaaatgcagattcttttactagttggctttagggacctagttcgaatacgaaatctgatatcaaaaaatagttttggtgattcatatataatataataagtactactgtttacgtaaaattgaagaattcaaatgatctcattcaatccaatgattatattttgtcttgtataattctttaattatggttatttgaaaatgaaggaacaaatatattgattagaagaataattaaacaatggtcaacaacggcctcaccacatgataatattaaagaatatctcgtagtacttgaccaaaaaaaataaaaatagcttaaatgtatttagttgaatcggtacttggtattgccgtgtgtgggaaagaaatgttgtcaatgctaaataaatttgccgtgtgaaaaattcaatcaatatgaactctagaacccataatggtagaaagtcttcgactcttggcagagaacaaaacaactattgaaattgtcttcaaataacaacattatcgaaaacttttcaactctagatctagtaacatccaaaggatatgatgctacataggtcttctagttcgaatcacaaagcttgctccaaatcacaaacttacgcatctcagtctccaacttagcggattaacaaaaacttaatttataggtcaaatatcaatttgcaattaaatgaaaacatatttgatctcttccaaatttgagttaattttgatttcccattataacatttagacattaatgagggctggacaaaatattcgttcgatccgcttcgattcggtattcgatttgatttgattcgaaaaattcgaatatccgtaagattttggaccaaatcaaatagaaaaatgtagtattcgtaaaaaccgaagcaaataacaaataatgtttttaagataatcgaatatccgcttcgatccgtatctatcgatatatatttaaatatatagttatatctatatatagatatcataaatagtttatgtattgttgctatcttatatttttatgttaaaatatttatttgatcatttttctctcatgttatatcttgatcaataacatcttaaactatcgggttttagtttttggaattagtttgataacattttgttgaccggtgataataacaacggttatgtttggtatttagaacttattttgtaagcatgttaaataataactttaaatatattatatggttatatagtttacaaatttttttaatatttatatgtatcaaagcggatatccgcaaatatcacaaaaaaatccggatattcgaaatttcggatatctagaaattttcgaatcaaagcaaataacaaaattaagtattcggttaaaacgaatcgaataacaaatatcacaatttttctggatatccgcttggtgcccagacatattcacaatccctaatctctcttctactattgattaaattttcttctcctgaaaaatatacaaataaaataaaaacatgtgcatttggtaccaaagacaacacctttctcaagtcttctctttcatttttttgttgtcgccgtctggttttactttttttctttcttcaaaatcattcattctttaacatcaagcaagaatcaaattctgggcatactcaaattcttcatctttttaatatatatttttgccaagaacaagtcttttactttatctctgcagtttttgtttgctcctttgtgcatttggtgatgattcaatcaatgattgtctcttacctttgatctaatcgtttccgcaaaattctcttctcgttttttctgatttcaagctcaacaatctcaaaataatcaatttttggtagtgtgttaaatctgagaagggtttttgggttttgggtataaagcttgttactttgatctttattttgtgaattcgaagtggaaatg

SEQ ID NO: 10354 - DNA, 3000 bp, Unknown
  misc_feature (1)..( 3000): cDNA_ID_2704778_gDNA_ID_2213644_Annot_ID_132343 3000 nt of promoter + ATG
aagaatttgagtatgcccagaatttgattcttgcttgatgttaaagaatgaatgattttgaagaaagaaaaaaagtaaaaccagacggcgacaacaaaaaaatgaaagagaagacttgagaaaggtgttgtctttggtaccaaatgcacatgtttttattttatttgtatatttttcaggagaagaaaatttaatcaatagtagaagagagattagggattgtgaatatgtctgggcaccaagcggatatccagaaaaattgtgatatttgttattcgattcgttttaaccgaatacttaattttgttatttgctttgattcgaaaatttctagatatccgaaatttcgaatatccggatttttttgtgatatttgcggatatccgctttgatacatataaatattaaaaaaatttgtaaactatataaccatataatatatttaaagttattatttaacatgcttacaaaataagttctaaataccaaacataaccgttgttattatcaccggtcaacaaaatgttatcaaactaattccaaaaactaaaacccgatagtttaagatgttattgatcaagatataacatgagagaaaaatgatcaaataaatattttaacataaaaatataagatagcaacaatacataaactatttatgatatctatatatagatataactatatatttaaatatatatcgatagatacggatcgaagcggatattcgattatcttaaaaacattatttgttatttgcttcggtttttacgaatactacatttttctatttgatttggtccaaaatcttacggatattcgaatttttcgaatcaaatcaaatcgaataccgaatcgaagcggatcgaacgaatattttgtccagccctcattaatgtctaaatgttataatgggaaatcaaaattaactcaaatttggaagagatcaaatatgttttcatttaattgcaaattgatatttgacctataaattaagtttttgttaatccgctaagttggagactgagatgcgtaagtttgtgatttggagcaagctttgtgattcgaactagaagacctatgtagcatcatatcctttggatgttactagatctagagttgaaaagttttcgataatgttgttatttgaagacaatttcaatagttgttttgttctctgccaagagtcgaagactttctaccattatgggttctagagttcatattgattgaatttttcacacggcaaatttatttagcattgacaacatttctttcccacacacggcaataccaagtaccgattcaactaaatacatttaagctatttttattttttttggtcaagtactacgagatattctttaatattatcatgtggtgaggccgttgttgaccattgtttaattattcttctaatcaatatatttgttccttcattttcaaataaccataattaaagaattatacaagacaaaatataatcattggattgaatgagatcatttgaattcttcaattttacgtaaacagtagtacttattatattatatatgaatcaccaaaactattttttgatatcagatttcgtattcgaactaggtccctaaagccaactagtaaaagaatctgcatttggcctagtgaccgaacctgtttttgccaattgtgtttacgtgcttggaacaaatctcctgtaagtctagaaaacacatggggatgaaagaaaaaattacatcggggaggaatttacatgagatcataatattgaaaactgaaaagattcaactcgtgaagtctctcgatgagttgtataatctttttcaaattccttataaagaataaaacaacttctaaaagacaaatgaacatatatgtagacattgcatcatcaatattttttaccactgtttttaaaaccaaattgatgaaagtgatctgtagatcaaatttgttaagtgacaattttactgtcttgataattaagaaaatcaaaaagcaaggattcatataaatttttaccaaaaaataattagggagaaaataaaaatctatgaaaaatatgcattttggttaatgatattgtttaccatatttacatgtttcatcgaaatcttcaaattattgtttatctaatcttcgatttgcttttaatcgacgatagtttgaagatttttgttcttctattgatgttctcctccgtctgtcaactttaacgaaacgatgccgcagagactgagaggaggaggaaatattctgcgattcttctacacggcaacgattctggtcagtttctacacgacaatgattctggttagtttatacacggcaacgattccggtcatttcgttaatatctctgtatagtcccacctattatttctccttattgtatatgaaacaaaaagagattccaaaagtagcaaaaaatatgtcgtcatctcctccgaacaaaaccgatccaccaaacaaaattgaaacacaaaaaaataactgccaatacataaatgtgcgataaaaaaacaaaaaaaaatcattaatattttaacacaaagttacgtcaaataaacacaattgttcataagtgcaaataacatttattaaaattgtttagctaagaaagtttgggctcgtaaatacttattatcttatgtataaacgaatttgttctaatgactatatataaaaaaatcaatttcagataattttaatataaatagtattgccaaaaaaaaaaaaaaactgtaaagtttctcatgtaaatatttttcctccgctaccaatgggctttaaaccaggctgattgtcttacgaagtcagctaataatggggtttgaaaacaaatgggctttaaaacaggtgggcttatgcgacccattatgtttgtttttctcacaaattcgtccccatagtttcaatcctcctccacaccaagtcaccaactgtggatgagtctctctaaaaccttggcttccttcgacttcttctgttttctccggca

SEQ ID NO: 10355 - DNA, 3000 bp, Unknown
  misc_feature (1)..( 3000): cDNA_ID_3036081_gDNA_ID_2213644_Annot_ID_132345 3000 nt of promoter + ATG
atgggtcaagggttgtcaaggttccgtcttgtaactatgaattgagatgctcgtttttgtctcaaagagggtattatcctgatgctcttgataaggccaatcaagatagtttcgctattcatactccttttgggagtaattcggatgatcatttctttggggtttttgatgggcatggtgagtttggtgctcagtgttctcagtttgtgaagcggaggttgtgtgagaatcttcttagacatggtaggtttcgtgtggatcctgctgaggcttgtaattcggctttcttgaccacgaattctcagttacatgctgatttggtagatgatagtatgagtgggactactgcgattacggttatggttagaggaaggacgatatatgtggcgaatgcaggtgattccagggcggttttagctgagaagagggatggtgatcttgtagctgttgatttgtctattgaccagactccttttagacctgatgagcttgaaagggttaagctttgtggtgctagagttcttactcttgatcagattgaaggcttgaaaaatcctgatgttcagtgttggggtactgaggaagatgatgatggagaccctccgagactttgggtgcctaatggaatgtatcctggaactgcttttaccaggagtattggtgattctattgcagagacaattggtgttgttgctaaccctgagattgctgttgttgagctcacaccggataatcctttctttgtggttgctagtgatggcgtatttgagttcatctctagtcaaacggtggttgacatggtaaggtattcttccctccgcagtcttgtttcatcacagttccctaagtagaggaagaagtctcacaaaatttgaatgtattctttttcaggttgcaaaacataaggatcctcgagatgcttgtgctgcaattgttgctgaatcatataggctatggctacagtatgaaactcggacagatgatataacaatcatcgtcgtgcacattgatggactaaaagatgtaaagaaagcttttggttgttgactgtatatcatcttttcttgtgtttgttaatggctgaggttagatattgaatattttgtaggatgctcctcggcaattgtcgagtacaggaactcaattgcagcctcctattccacaagttgtggagcttacaggttcggaatctccttccacctttggatggaactctaaaaatcaacgtgtgaggcatgatctatctcgagctaggatacgtgccattgagaattcactagagaatggacatgcttgggttcctccatctccagcccacagaaaaacctgggaagaagaagtaagagtgcttgtctgcttcgtatttgctcaaccaatcaggaatgcctcaagtcattcttatattcgaaggctaaatgctggattttctcgtgcaggcacacattgagcgggtgttgcgtgaccatttcctcttcaggaaactcactgattctcagtgccaggttttgttggactgcatgcaaaggcttgaagctaatccaggggatattgttgtgaaacaggtcgaagcatattcctccttgttgcagattctccaacatagattcatcaataaacatatgatatcataatctctctggcttattcttttgcagggtggtgaaggggactgcttctacgttgtgggtagtggagaattcgaggtcttagcaactcaggtttgttctatagtaactcgatttgacttgtgaccagctttgagcattatgatcatgtgcttaaccggggtgaatgttaggatggaaagaacggtgaggtacctaggatcttgcagcgttatacagctgagaaacaatcatcattcggtgaactcgccttaatgtgggttctctgcacttttacttttagaaataatcttcttcaggtgaagacgtactctctgtctaattgagtttcttgtgatatttgatggtgccaggcataacaagccgcttcaggcttctgtacgtgctgtagatcacggaacattgtgggccttaaaaagagaagattttcgaggaattttgatgtctgagttttcaaacttagcatccttgaagcttcttcgttctgtcgatcttctttcccgtcttacaattttgcaactaagccatgttgcagagtctctttccgaagcttgcttttctgatggacaaacaattgttaccaaggtgaagttaattttgctttttgtaaagactaaataactctactccaagagattctttcttacacgtttctgtgcatgtataggaccaaaaacttcagggcctgtatgttatccagaagggacgcgtaaaaatatctttctgtacagaggtgttggagagtcaaaatgtttcaagccttacaactggaatcactaacgagtatgacaatcttgaaatcggaacagaagtctccatagaaaagcatgaaggaagttactttggtgaatgggctcttcttggcgaactcaaagattccttaagtgtggttgcagttggcgaagtggtttgtgtggttttaacaaaagaaaatttcgagtcagcggtcggccctctgaccaatatttcagatgacggtcccaagtatggcattcttcatgcttgtatttgtttatttttgtggttatcgttgactgattccatataatgtttttttttcaggacaagacattcttcattcgagctgtcaaaggaatctgcaaaagttaccgataccacagctcttgctaaagccactcttgcagacctggtaagcaatcttactctacatcaatcttaaaacggtgctcctcaacttacactattttggtttatccaggaatggacaacatgcttgagtacaacagactgtagtgagattgggctcgtgcatttgaaagataaagaaaatttgctcagcttgaaaagattttcaaagcaaaaggtgaaaaagttaggtaaagaggcacaagtattgaaagagcggaatctgatg

SEQ ID NO: 10356 - DNA, 3000 bp, Unknown
  misc_feature (1)..( 3000): cDNA_ID_3036055_gDNA_ID_2213644_Annot_ID_181394 3000 nt of promoter + ATG
caagtagacaataactttctaagaatttatgttattatcactaatcaacaatttaattattcaaatattaacacagtcaccgagagtacgtacttcagacggtgagaaaccaaaatgagtttctaaataataatataaattaaatattttcataaattaaattatcaatttttttttgatgaaaaagatagacaattatagacacataatgtctcaagagttttttgtgagttattcaaataagagacaaaaattttagaatttctcacttttctctcttatttttttttatattttattagtaattaagagactcccattaaatatgttctctcttaatgtctcattgtttcagttcctacttcctacaaaatcataatttggtaaagaaaaaaagctacatacaattgcataagcatatgtagtctataagacgagatatatatgataattttcggaatattattacttagcattttgtttaaatataaccacaatcaggctttaatttcagtttttgtcttgtcatttgcatctaacataaaatattatattttactctaaagaacaaaaacgcaaatcattattattcaatcaaaattttttacgacttttttatcaggagataatatttttttctattttgcgttttgtttaatttaaagtaactttgatggtaaatcaaaatatattttagataggtacaaatcattttagcggacaaaaaaaatgtacaacagcaagagggtgatttagcaacaaaatttagcttgaaaaaattgatgtttatagattatgtctaaatctgaataaaagaataaataattaagtttgatagatcatgcaagagggtggtttagcaacaaaaataaacatattaccctgtctcataaatcattgagattatcaataaaaaaaacacccaatttctgtcttaatattgtccccaccaatgtgagtccatatctgattctctgtttctttcttccctacttggaattatataaaaatatgtatatacatattaatgtgtatatatatatatatatgtgcgtgttcccatatcaatgataaatgctctttatcaaaaggtaaaatgattataaaaaaaaataagttgtttcattttatttgttgttttcaatgcaaaatttattattattttattatttttgattcttgaaattctgcaactttttattggttaaattattttaaaatatgtaattaaacatatttttaaaatttaagaaaacagaaactaaatgatcttaatcaatgtaccaaaatcttaaactagaacaaaatagaaacaaaagaagtattatagaagaaattaacactttgttcactaacttgactactataaatgattataaattaacactttatgtagcattcgacttttctgtttatagaagaggagactcacttaagtctttaatatcatgtttgcatatgttgtagtcttttgtttttaacatctttggattgacatggtctattctatagccaatatctattatgcaagataacacgatttagtggagtcaaactctggtggaaaaagcggaatcaaatggatttaaccacaagactaaaggaatatttcctgcaagatatatgtagtcttaaatctataatttagcgatataaaaaaggacaatttttaaatatgatacttaagtttttgtttatttctttaaaaataccacttaatgtttggtttcttaaaataacataaaacttaaatttaacttccaacattcaaaattaaactctaaactttaaacactaaaccctaacccctaaaaacaatatcttaaaattaaaatggtcaattcaaacttaatttttttaattctgatgaactcttgaaaatcaaaattgaagtataatatttttggaaaacaaaacttttggtggtattttgacaacacaacttgaaagtgtgatattttgctacaatactcctctagaattcgaggctcccttaaaacaaaatattattttcgtgtcagtcatatttttttgagacatttctcaaaataccacattttcaagtcttattgctaaaataccatttcatccggtattcgatcttctatcaaaagaaaattatattcatgtaggatgtctaggtttggtccagacaagttaaatggtaatctggtaacatgcgattcagttatgtttaagtgttaatcagttaatattctaaactcggaataaatgtgtgatgatccttgaatataaatttattttgtaatacttaaatatatttttaccaaaattaaccggatcattggataaagtttataaaataatttttttttgatgataatgccatgaaaacaatttatagtacggatgagaaacaatgaggctgattattttatctccgtcagctacaaatgatctcagacattttgtttttatgttcaacttggttttttattcagaggttaaaaaatgggcacaagtttctattcagacacatacacacataaataaaatagagaattcactgttaaagttagttgacacaatagtaaatgcgatacatgctagagtcacggaagaggcaaaaacaaactccaaagagagacatataagaaaaagacaaaaacccttaagaagcttatcacattcttaaagcacgaaaattcagaataagattcagtcatcctttagcacaaaaaaaaaaaaaaaaagatccagtcatccaatactagttccccagaaataaaggtgatatatttttttttttgagaagcctatccagtaccaacctcaattctctaggttagatatagtctgggtagtatatatgtttcttcactgattagtaatctctgtgtgtagtacacttactcactagtgctactcttttggatctttctggggtttttcttttggttataaaaccagaagaagaagataactgtttgttattttaatacttaccattatcatcatctttgtagagagagagatatg

SEQ ID NO: 10357 - DNA, 3000 bp, Unknown
  misc_feature (1)..( 3000): cDNA_ID_3036059_gDNA_ID_2213644_Annot_ID_181391 3000 nt of promoter + ATG
tcaaaacaattccatcatatttaagcaaaaaataactaattatagtatatgttttaaatgatttatactgtaatatttattattgtcatttttgtttgttacatacgtcttcgaattatcacattaaaagagaaaattattctaacgattatatattttcccaagactgcacccaatgttaaatctgatatggaaaataattttcttacaactttcagatttattttaaatataaaagttaagcaaaaactataatatatatatatttgagatttctatatgagataaagttctaaaataaattaaagtttacaaaggcagagaaatgaagattcataattaggtcaggtgctaagcacaatcctcctctaagaaaattttggtcgatacatttttagctgcagtattttatttcaccataagaattagtaacatgttggaaacaaaacgtacctgagatcaaaagaagagctagacagagaaatgttagaccatttttttcttcgatcaacaatgtctctctatatataccacattttatactattccctaatatgtaaaacgatattgccatttgtcatgtgattattattagggtgggattatctttgattatctttttgttataaagtcaatgcgacagtaatatgaaagacacaaggacgcggatacaaattataatctataagaaaagaaaaaaaattatttttaaaagggctaaaagaaaacaaggttattcaaataatattgacaaattacacttctcgacaaatttttctgtgttttttggtttctctattcgctcagattttgtgaaacgtctcttctgattttttattttttcctatcgatcggccaaaggtttttgaatagtcactttaagattcatttccaatcgaggccaaaggtttatcaagagtcgatagaatctgcggcattgacattcccccggaaacaacaatctctgcagatgaagaatgagtatacagtgttcagtatctttccacaaaataatttgaatgctatataacaaacgataaatgtatctagtatagacaattagattctgaaatctcaccaattccttcccggacagagaggtttggcctgataacgtcattactgttgacaagtagtatatctccaatgtaaaggtggttcgtgggaacgtatacacagcaaagttcctcctcggttgggtagttctgcaagaacgaatagcattattacattgggtaaaaagattacgaaattatggtaaaccatataactcgaaattgtttgtatcctcaaggagacgttctggaaagaataacaaaatccttgagcaaagtattttcactcacctggagaacaacagttgatgtaatgaagccaaatgcatattcacctacacggggatgcctgatgattgcaacttccttgaaagcttgtgtattttgatctgtgatgagaaatggataagaacaagatgagataggagatcaacttaatgttgagaagcaaaacaagatttttataagcaagctagaccaggcgatatggcagtgctgatttgcttggaggcgttgtagatgtgacgaacaaatggcatccgcttgataaaccactctcccaagttcagaaccgatgcccccaaccacgaagacatgaacaccccaaccaagaagatgaatgcaatggaagtcaaaaaaccgaaacctacaaaacaataatcaaactcattgtgggaaaccgatatcaagttgttaataggataaagaggggccattcaaattcttaccaaatatgttgattccaagtagtgcatatattggagagaagaatccatcgacaaagtgaataaaccaccatgttgtatagaaagtaactgcaataggaagtaggataacactgcaaaaagcaatggagacttaaaactaatctgtggaagttttcatcaaatgccaaaatttcaactcttccttaccagcctgtcatgaacttctttgacgcccaacccctaatgaacaagcttaaagtctgcagaaaagagctaaagcatcaggccacaatgctctataagttatacatgcttgaaaacatgaatgagcataatacaaagactcaagaatctgaatgattccaaccacaacaacttggaatgcaaattcatactctactcaatcacaactaccaaacttatctaagcaagtgttcttgtgatatactgaatctagggcaaaacaagttccaagattttgaactaaggggagacagaatcgaccaaatctatgaataactatcatccaattctactgttagtttcgcatgaatcttgaaatgagaaaacgaagaacacgtttttagatcaggtgacaaaaactagacctcgtggccggattgatgcgaagaagaagcagaggaagaagaagaaggcttcgaagaagaaccatcgtctttgtcgccgaaatcagcgacgggaatcagaagctctcgatctctttctcgattggccataacaattgtcgtgtaaagagagataaaaccctaaacctagaaactcaccgagagttcgaagattgtaaatcacaatctagaagctagttgcgaaacagaagaaccacctcgaagatcctgagatttgatgatgatgattgtgatgatgatgaatgacagatagagaagacgatgaaattgatttttgattcgatttccccaaatggcaaaagaaaagttccttacctgtaccgattgaccgtaccaactaccaaaccaacgaattgacttttacaaaacttaaaccgaaattaaagataattaaaccgagttattgaactaaaccagataatagcttaggttgaatcagttttaaaaaaatttgcgatacctaaggcccactaagtttttcacatcgtaaaaaggcctaaaataataagcccactttaatcatctcctcccgttatcagattaaaagatttgtttctccgagagcaagaaacctcagagagacgaagcaca

SEQ ID NO: 10358 - DNA, 3000 bp, Unknown
  misc_feature (1)..( 3000): cDNA_ID_2704802_gDNA_ID_2213644_Annot_ID_181388 3000 nt of promoter + ATG
tgggctgttgcgaagtaggccaacccgttttgtcaccaatactcccactagatcacactttcaatattattttaaatatctatgctgaagaaatattttctgatttggttaatcagcttgtgaatgagtattgcatgaaaagaggagtttcattgtcatcgacggacaatcaaaaatcaaatcctaacgaagaaccgatgaaagatttgagaagtagagggctttgtcttgttcccatctcatgcacactacaagttggcagcgacaatggtgccgactattgggctccggcgttcggaaccactctccagtgaactattcactttctgttattttatttttggtcagccaaaaaaaaatagtagatgttataacatcatgagcaaccaatcaattgagaaaacatcaaaatgagtttccaaatttgattgctcatgatgctatactaaaaccgattggttttggcgtttggcctttgagcattttcagttgacgagtatgagatggcttgttgaatcatgtttttcttactttaataggaaactttatttattctcttaatgtatatgttggttctattttaattttattattgttataatagaatggttaaacagttaaagatgttttcatactaacttcatcactaggtttaatcgtttaagatgttttaaagaagcaagaaatgttgtcttcggaaagaaaacagatgtacttatagatactttctgttcccaataatttagagactaatgatttcttttataaattgtcctaatcaaagtttcgtttgttttagttgtctttttagatttctcgtgcatggtctcagctcagtttatttttagacacttcagacatctcaccatggtattggaattggtagtgctcaattggtgggtttattataagccctttgctccatcactataattgggtttatggactttgaattaaattctacaggcccatgggtttatggatattgttttcagcacatgtcaaatgtcaatatatgaaaaattcaatgtggagaaacttctggtggcttcataaagagtaagactgcatttcctgatagtagtagtgtactggtgtggatgcagataacgttattagaaatcaaaattgaaaaggtagctatttttaggtcacatattgtatcattaatagtcattgttcaatgatgaaataatgaaagactaaaactcttggattgagtcttagagatctataatgtaacttagggcattagcttagccttaatttcacatggtcagtgctttagtgttgtgcaaatgaacttgaggaagaagcattagttggattgaagttttattagtatgcttatatatacttttgtaattcctcatatagtgaagtgtccttcaacgtattaaaacataaaatataaaatggtttgagacttgtaatatcttttattttcatgcaaatttttttttaaaaacttttataagaacaaacttagcagttggtctctagcacaatgagtttattgtagaattttgtggaatcaaatttaagatttaattaacctgaaaataagtttaatagatttgtgacatcaaatttttaaaatggaatcacagtcttacgttttcattccatctctaaagtatgaaggaaacctgtaatgaagcttccatgccacctaagttgtacaaagttcttatctagcctaatgaataaaacctaaaaattaaaccaactacaaaagttcaaacatgaaaagcacataggaaaggatctaatcccgatgtcgaacatcatagttcactcatatgattttcagttttcgttggtcttgtgtgttttaagtctttttaagtcttgtgtgtttattggtaccaaaaaattaaatattcttctaaaatttacgtatctaattaaaagagaaaatatatataataaatcttttaactattggtaataagtgttaaaacaaatctcaactttataatagagtaaatatcaatgttctttttgttgaccacgcaaaatagacctgaaattagtcaactttaactatactattgtattaactaaatgttaatttttagttatcaatttattattttgagaagataatcaaactgttaactaaaaataaaagtcactttcagtttctataaatccccaaaaatcaattataaacccaaactcttcctcacttcatgtttaaagtttaaaccaaaaaaaaaaaaaaaaactcttcaaaatcctgattttggggaagaacatagattcgcaaatcgattcctcttcatcacgcaacatcaacaaaatagtcagtttcgattccttttcttacttagattttttgtttttgtttttgaatatttaaaactattggggcattttcgtgagtaacttaataatttgggccaaaaccgttattttaaaacattacttctctattatgtagtagtcacgagtgatcggatcggacggtgaacgatcgacgaaacttcaaaccttatatgaatagtaatcgtcagatcaacgtatttaataacaaccgtacgatcaaaatgtctgtgaaatctaaccgtcgaatataatccagaaaattgaaatttcaaaacatgtataagagagggaggagcagctctcgcgaagacgaagaagaagaagaaaaaccccaaatttctctgttttttttcgttgggtggttcctcagtggttaccaaatctctcttcttcttcttcgtcagaagctaaaacctttcaaaaccctaatttcatctatctatctcaataagtctagatcaaaaattcgaatttcaaaatcccgttttgagttttagtagattcggtttctgggttttcgtagaaacgggattaagggcggattcagatcttgaaatttttgtgtgtttctcaaactgattataaattttggtttttttttttaaatttcgtgtttgaaaaatagggaaaatttctgggtttcttctgagaaattcgaattttttggag

SEQ ID NO: 10359 - DNA, 3000 bp, Unknown
  misc_feature (1)..( 3000): cDNA_ID_3036067_gDNA_ID_2213644_Annot_ID_181387 3000 nt of promoter + ATG
attctactccaagaattatttatattattatttttaattcatttttgcaaacgaaaaaaaaatccaccgtttcgccttctagtcgggattgaatgcgtcaccatgaaatcatgctttaatcatattctgcgtgagtgggaaaacaactatttataagtacatagtactactttttggattaaatatttccctccactttaaaccagaggtgcatactgcataatataggtaaccttcaaaaattgttagtattttttcttactctaacatgctcaaattacaagaaaaaattgcatatatgtatggtgatttaaagccgatcctttaaatgtttccacggttttcgttcatgagcctcattgtatatatataatatataattttagcacgttggaatgagaaagaaaattgataatggataagttttattaacataccaaaataataaacttgtttatgttacatgaagttcaaagaggtagcctctaaaatgaagaatacttaacagaataagcaaatatacatttttgttttccttatatttgattaatcccacaaagatacaaattactactattaattaagcaacttatcttagagggataagtgaaccatttgctttgaaatggaaaaactttgctttagttgatgtctatatatctatgaatttgtttccctaacatgttttttacgtcaatatttttaatctatatctgacacaatcaagtagacagttattatacctaacacattatcaggtagtctatagactctataccattttaaatgtttaacgcatgtaagttaatcacatactctatgatctggtggtttatttgttaaaagtgaatttttattctccaatgaattaatgatatcaagacagagcaacaactaattttaattagtttttttttggtataagaagagtcatataaacttttgagtcatttaaacgtaattagctttgttaaatgaaattcctttttaagtgggtacgtataaaaccctacgcaacgcatgttgatccatttaagtcaccatcaacaaaaagaattatataaatcattggttggatgaagaaattattatatgaacaaaaacaggacaaatatcttaacaaaattaaattctctgaacttatcgtataataaattagtaatttaaatcacatcaaactgaactaaatatatggaattaaaagggtttaaaatacatttgataatttgatgtaagaaatatgcatagatgcaaaatacttgttatatatgtgggaaatatcaaaaatttatattcgaatatgttatacaccgtacaaaaaagtcttcgaatatataacccgggtcaccttttctcttatggcaaaaaatataaccccttttctgtttctaattttaaaattttgcattcttgattctgagctcatagttcgatgaaatataatctagagaaaaaaaaaaaacataattcgattaaataacaaaagcacctttccctccctactttatgcataaagctaaagcatggacaaaaatgaagtatagaaaaatgaattactgattataacagtctttcttaattaatctagtaaatatttatacatagtactgtattacataaacttacacacttaggtttatctgtatcatggttagattatcgtaaagactaaagactataatattgtgttcatgaattagaaaacttattcctccgttcatccaaaattagttaatcgttatatcgaatatggtccatatgggcatccatattttcagaagaaaagaaaaaaagaaagtaaaagcatgttaggggaaaaaataaaaaataaaaacagagaaaaaaaatcgagagagggagagagaatggtgttaaatacataaaaaacccatcattgacatgtatcgattgctcaatttgtttgtctctctcttcttctttccttttctccaaaaactagagcctaaactaaagcatcgagaaacaacaaatcttaaaatcttttcatattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgtaactccctttctctctctctctctctctctctctctctctctctctctctctctctctctctctatctatcgttcggatgttttctatgtataaacggttttgagttcttggatttgttttgtaatctaattcgatcttataaagtttctttctcttttttttttctttctcatgtatacataatctacttatattatttcatataaacaaacatgatctaatatggattgtctttgaatgaaggggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgaggtgggtcaaaatagtgaattattcagatcaagatataatctttaccaaatattaattaacatctccatattttttctttatcaatgaatatatctgaattttgtttctgtctatgtgtgttcatgaagtgtaatagctcagag

SEQ ID NO: 10360 - DNA, 3000 bp, Unknown
  misc_feature (1)..( 3000): cDNA_ID_3036077_gDNA_ID_2213644_Annot_ID_181383 3000 nt of promoter + ATG
agaaaagatgtggcgaagagaagtgaaaagggcagccacgttaaggcatttaatttgaataataataagactaaaacaaaaaaaaacgtaaagccttttgaggttatgaatgcgaaaatggtccctcacgagtcacgacctaatctcattgaaatttatttagcattatattgcgtcgtgtctcattacccttttttgcttctcattattacttaattattattattctctatatatatttctccactaacctgtattagttaataacctttcattgcttttgtacggtagatcataatatgctaagatgtttcaatgattgaaaactcaacaaagaagacatagaaaaccaatataactaactagataaacatataatacaagtagttatttctaatatttgagtgactgcaaccgatatacagaagcgttctaaattttattaagacaatcatgtttgaaatgatgtcaataagaatcatgattcaaactttacaacgtaacaatattgcatgcaaaaaacaatttagttacgaatgaaccatatagtctcgaatattagtttatgttattataaattatttagaccaatattggttatatttattacataaattcactagaagtctgaaactgattatttatttttatagtgtgtttttatctaatttttatttttagtgttggttatatacaatataatttatatagagaaaaattggtaccggtggaaagtccaccatcgataaaaactgtctgatgtccatccaaaaactaagccgacatagagttgtatttggtcggtatattagacgtacatgtatatttatctttccataaggtttcttttgaatataaagttgtgtatccaaatgcagattcttttatgctttatcttaagtcatcttcgcattttattttggtcaaaagaaagttagaagataagagaaagtttttgggtcacacatacgaaagaaacgtaaatggcttctcatgcctaatagcgctttctacgcttgtggggtatttgattggatatacgtcacaactcataatacgtagttgtttactagcttatctgtacatggactccacttctatatgatatatatagaaatgccactaatatacgtacgtatccacaataagagaattataatgaatgtgagattggtaagtagtatcacataatttaagggtgtgaaggttaattaacggtaggttgttctatattatatatggttactcacgtaaagtttttaacaaaatatacaaattttaaaatgtattacttaaccaatctctgttctcatgagagtagtttcgcttattcaaactgctaccaaatattatctagtagccttttctaattggtatacaaatacaaattacacgatgtgatagacactttattgtttgtgcatactacctttagagtaggcactagccaatcatgataaaaatggcaaatctaaaaaatattaagcaacatggtaaatataaaagatttaggtgacaaaactgaaaacagaagaaaaaacttacgttttaacaagtgttattaaatgctggttttggactaaaagaggatatgggtttaatgaaaaaacttaatttttaggaaaaaaaaaaaggtggaatttgagtagaatacaacaaaaagtcttagagtttgattggtaacacaaaactttagctgttacggaataatgtaaaactgtacaaaagagctgtaaaaaaaaattgtatcaaaaagctgagagtaaagcttttcgtaacgcttttgataaagtttttgtaaatggtaattgtcaaagctgtacaaactgtactgttttgataatgggttaccattcaaagctttaaattttaaatcgcatgataacctgtaaataattattttgaatatatgttagactttattattattggttaactatgttctcttgattgaaaaaaaaatagatttgtaactcattgctgttttttttttttaagaaacaaatagagaactatataaaaatataagaaaacgttggttttgtccaagaaaaaaattgttgggttttggtgggtggcaatagaagatgccatgtacatagtgggaacaagtagccttacgcccataacatgtcggaacatcaccaataaatttctatgttcaaaaatatcattgtaacaaaaagtttttcgaatttcttctcccaacccaccataaaaacccaatcaaatgcatgtgaatgttcttgttcatttgatgaggtcaagatcaagaagccatgtaatctagaatacaacagtacacatgtgacttgttacagttttgaactctcgttcacagttttgcaagttcttaccaaagctatagatgcctctcatcccatgagccttcatcacctgatgggcttattaggtttacaggcttgactaaactctagagcctatacgtatagaagaggcctgactaaacgaagataatgaaataagcccacaaggcccaaataattaatatcttttattctttttggcaaaatgaaaaatctgacttatgggctttttaacatttacacatttaacttcatgacccaatgaagacccgacccgtctggtaatgacccgatccaacacatgagtaaaccttcactgaaacctcgaaactcctccagaagcctaaaaccttcaccaccaaatcggtgcctccttgaatagtcgccgccgtcgtctatcatcgccgcttgtgactccggtgagtattcttctgctctattgagtttattttggttgaagctctatgagatgtacgtgggtctggttttcatttctgtttcttaatcgctcgaattagcatttgatagctactgagattttgagttttctgatctgccgaataatcttcgccattgtagtgtagatgttgtgtgccttttgattagattacactgagaaattggattgttttcgtgtttgtagatgagaagctaggttattgaatcagagatt

SEQ ID NO: 10361 - DNA, 3000 bp, Unknown
  misc_feature (1)..( 3000): cDNA_ID_3036081_gDNA_ID_2213644_Annot_ID_181382 3000 nt of promoter + ATG
ataccgaccaaatacaactctatgtcggcttagtttttggatggacatcagacagtttttatcgatggtggactttccaccggtaccaatttttctctatataaattatattgtatataaccaacactaaaaataaaaattagataaaaacacactataaaaataaataatcagtttcagacttctagtgaatttatgtaataaatataaccaatattggtctaaataatttataataacataaactaatattcgagactatatggttcattcgtaactaaattgttttttgcatgcaatattgttacgttgtaaagtttgaatcatgattcttattgacatcatttcaaacatgattgtcttaataaaatttagaacgcttctgtatatcggttgcagtcactcaaatattagaaataactacttgtattatatgtttatctagttagttatattggttttctatgtcttctttgttgagttttcaatcattgaaacatcttagcatattatgatctaccgtacaaaagcaatgaaaggttattaactaatacaggttagtggagaaatatatatagagaataataataattaagtaataatgagaagcaaaaaagggtaatgagacacgacgcaatataatgctaaataaatttcaatgagattaggtcgtgactcgtgagggaccattttcgcattcataacctcaaaaggctttacgtttttttttgttttagtcttattattattcaaattaaatgccttaacgtggctgcccttttcacttctcttcgccacatcttttctcacttataaagtgtcattaaatacgagtgtgttagattttgctgtgttttttttctttctttaaactaatttttttttaggtttagataattaggttcataactttctaggtctgatgactacaaaaggttagtttagtcgtcctctccagtacttaacctttgctgatttgtattcaaatctagtaaaatgtacgtgtgaactataaatcattaatattgttttgtggtaatatagttcttgtgtcatcattcgaattcaaatccacatactaaatgttgttgatagaaaaaacactactcaacaaaattagtagtctaacagtttgttctagtgcatgttatccttctactaacatttgagttttatttcgatgaaatgtatatttccaaaaaaagaagaagttatatctcaactagacatacaaaaactaattctaaataggcatggacaaattatccaaattaaattggaccaaactcatctgattcgaaaacacttttttcattaccatttttgttttgggttaagaagtatcatctgactaactcgatctaccaaaactaaaaaattcaaatttgattaacaaattgacgccaactttaaaattttgactcttaagattttagtatttaatcaactttcattaaaagtaaaactgaaacttagtagaattaatcaaatttatatcgaaattgaactagctagtatctatactagttttctcaaaatagccataataactaaataatatataacctgaattattagaacaccataaaattgatatcctttatataattaaagagagttattatgcttatgtggcaagcctataagttttctcaagatttttatttatttaaatctactattacatttgtcaaacacattttcttatcctcattttctttaacccacttaccaaacacacctaaatttcttccaatatatagagttatcaaattttgaattttttttcaactttccttattattactaaattaattatttcaaatttctatatattaaatgcttagattttgtttaatgcacattaattagaatataaatcattcaattatatgacctaaattaacaaagtttaatactagaaaaaacagtagtctacttttttttttggtaagaacattagtttacttttaaaacattcttttatttttttcccttcaacaaacatccattctaaaacattacaaccaaaataaaatgtcatagtaaacaaaaagatataaacctaactataaacaaactattctggtaaaataattatcttttatatatatacttatatttatattttatatattttacaattgagaaaactatacttaaaattttataggttaagatcggcccatgcataacatttgctcttaccaagtattttggttttaattcggtcttctttaaaatacctgaaccaaaacaaacagaatttattttggtttaaattcggattcttattttaattatactttaaatccgaattatccaaaccgatcctttatgaatatcctaatggtaggcctaattcaattgttgtaaatacaatttggcatcagtccaaagctttagcttaatttgttcctctatcccaatcactcactctccagcagctattccattggctgtaacacatacacaacaacaccaaatcataataaaaataaaaatcattcattagttaccaaaaactatcaatatttttttattttatcccttcttcttctctcagcaacggttcttacttgaagtagatcgagagaacgaacttgtctttcccaaatttcttcactttcaaatttctgttatcaaagaatctttagagatttttccgggatctttctttttttttttctttctctgtcaaaattttcgttataaagtttttgtattgattcactcttttaactctccgattccatttctcttttttttttcccaatctgcaatctccattagattccccagtcacattatcttgtctttttcgaaattttctcgaggaaagtttgatactttcgaggaaagtcatgagcttttgaacaaaagaaactgtttggacttccgttactatctccggcggtttctgaaaaaacttcaatgattcgttgaataagtagcttactttaagggttttgtgttatcttcatctctctctcagtgatg

SEQ ID NO: 10362 - DNA, 3000 bp, Unknown; identical to SEQ ID NO: 10354
  misc_feature (1)..( 3000): cDNA_ID_3036085_gDNA_ID_2213644_Annot_ID_181380 3000 nt of promoter + ATG

SEQ ID NO: 10363 - DNA, 3000 bp, Unknown; identical to SEQ ID NO: 10353
  misc_feature (1)..( 3000): cDNA_ID_2704774_gDNA_ID_2213644_Annot_ID_181379 3000 nt of promoter + ATG

SEQ ID NO: 10364 - DNA, 3000 bp, Unknown
  misc_feature (1)..( 3000): cDNA_ID_3036089_gDNA_ID_2213644_Annot_ID_181378 3000 nt of promoter + ATG
gaaaaagaagcatgtcgattcagggcgtgatcgagttgatacctatatcaggtcttcgttgcgtatggcttttcaacaggttcgtttatatttctttttctgttgatctgatttcgtatctgcagccatttatgtagctttattgttttttgtttgtaatagacaaagaggatggtggaacatagcaagaaatcaaaatcccggcagagcacgaataatcttcctgctcttgcgattcttgcagaggatattggtcatttagcttttaatgagaaggcgatatttagtccaatcttgaagaattggcacccgcttgcagctggtgtggctgcagctacgcttcattcgtgctatggtaccgagttgaagaaattcgtctcgggtattactgagttgacgccagatgctattagagtactcactgctgcagataagcttgagaaggatctggtgcaaattgctgtacaagatgcagtagatagtgaagatggtggaaaatcggttataagagagatgcctccttttgaagcagaagtcgttattggtaaccttgtgaaatcgtggatcaagatccgagttgataggctaaaagagtggatcgaccggaatctccagcaagaggtatataacaactttaaagatctttcctggtttttgttccttttaagagttttattcatatattgattggttttgtaactttctattgtaggtatggaatccgagatcgaataaactcggtatcgctccttctgctgtggatgtactgaggatggtagatgagacattggaagcgtttttcttgttgccgattcttttgcatccagttttacttcctgagctaacgtcaggactagacaagtgtatgcagcattatgtatcaaaggcgaaatcatcctgcggtaagcagttgattgtttagtttttggaataaaaaagctcacgctttgttcatttcacttatggagtttctggttttgtttttatatggtttctattaggctcgcggaatacgtttctacccgttttgcctgctttaacaagatgcacggtcgggtccagactacatggtgtattcaagaaaaaggagaagccaatggtagcttctcacaggagaaaatcacagctggggacgggtaatgactcggcggaaatacttcagttctgttgcaggatcaacactctgcagtatatcaggacagagatcgaatcatctgggagaaaaacattgaatcgtctcccggaatccgaagttgcagctttggatgctaaaggtaaaatatttgaacagtcgattagttattgctcgaaaggaatacagcaattgtctgaagcaactgcttacaagatcgtcttccacgatctgagcaatgttctctgggatggtctgtacctcggggaagttccttcctcaaggattgagccgtttcttcaagagctcgaacggtgccttgagattatctcctcatcggttcatgacagagtccgaaccagagtcatttcggacatcatgagagcttctttcgacgggttcttattggtcctccttgcaggtggaccatcgcgtggcttcacaattcaagactctgctgccgtagaagaggatttcaagtttctatgcgatcttttctggtcaaacggagacggattgcctttggatttgatcgagaaggtttcgacgactgtcaagagtatacttccgctgctgcgcacggatacagattctttgattgaacggtttaaagcagtgtgtctggagaatcatggttctgacagagggaagcttccgttaccgccgacttctggtccgtggagtccgacagaaccaaacacacttttaagagtattgtgttaccgttacgatgaacctgcgactaagtttctgaaaaagacctataacttgccgaggaagctaacctgagagtgacctacttactacattggtacaaaacccggtttagtttgaagtgtggaatatattttggttaaagcggctagcgattggtatttggcaaattaaattacttgtacaagaaagtagaaacgttttagtgaaatattcttcttttgtactaatcaaaagcttgtgggctttgttatatgttgtcaactgttataaatttgtatatttaatacctttgtttttcatctttctttttcaaatttatcagatttctgattgataattcaagattgcaacgatggttcatgaaatggtcctttaaaaactcataatgtttatgtgatggataacatcagatatatgatgatatggttgaaacttgaagtattctaacttgaagtcatgattcatgatccgtttaacaacgtttgaaatgagtatcagaaaatgattatcgtagatatgaaacttttcctgcagacacgttctagtattttgctaaaataatagtttgttgcttattcaaccaaacaaaaacacttgttcaagtagcgcaatatcttcgatagttcgattcattattatgatacccttcttcgacttctttgatttcctcgagttcttctccatacgtcacatgactcacatcgtcagcgatttcatggcaatgttacatgtggtggacgacatggagtatccgcgaccgcgagatgatcttgaagaggtgtttgctttatgaatgacgatgaatcggctctgttttcctgtttccaacggttgtaatcacaccatcatcgttgtcttcatctatactaatattcaaatggtcaattataaagcccaataagctaactaagcccaaaaatgaaaacacacggactcagcccatacaaattttaacacttaaggctaatgggtctgtcacgtgcggaatagactgaaaacagagcatcgcacgtgccgcatcaaaatttgaaatcacgacgacttcaaaaaaatcccaaatggtaagaaaaaaataaaaagttgcagaaaaaacagaaaaccctcttttctctctcttctctctctctcgaggaagaaaggcaacaactatg

SEQ ID NO: 10365 - DNA, 3000 bp, Unknown; identical to SEQ ID NO: 10351
  misc_feature (1)..( 3000): cDNA_ID_2704766_gDNA_ID_2213644_Annot_ID_181376 3000 nt of promoter + ATG

SEQ ID NO: 10366 - DNA, 3000 bp, Unknown; identical to SEQ ID NO: 10350
  misc_feature (1)..( 3000): cDNA_ID_3036093_gDNA_ID_2213644_Annot_ID_181373 3000 nt of promoter + ATG

SEQ ID NO: 10367 - DNA, 3000 bp, Unknown; identical to SEQ ID NO: 10361
  misc_feature (1)..( 3000): cDNA_ID_2704784_gDNA_ID_2213644_Annot_ID_132346 3000 nt of promoter + ATG

SEQ ID NO: 10368 - DNA, 3000 bp, Unknown
  misc_feature (1)..( 3000): cDNA_ID_2704788_gDNA_ID_2213644_Annot_ID_132347 3000 nt of promoter + ATG
taagatgtttcaatgattgaaaactcaacaaagaagacatagaaaaccaatataactaactagataaacatataatacaagtagttatttctaatatttgagtgactgcaaccgatatacagaagcgttctaaattttattaagacaatcatgtttgaaatgatgtcaataagaatcatgattcaaactttacaacgtaacaatattgcatgcaaaaaacaatttagttacgaatgaaccatatagtctcgaatattagtttatgttattataaattatttagaccaatattggttatatttattacataaattcactagaagtctgaaactgattatttatttttatagtgtgtttttatctaatttttatttttagtgttggttatatacaatataatttatatagagaaaaattggtaccggtggaaagtccaccatcgataaaaactgtctgatgtccatccaaaaactaagccgacatagagttgtatttggtcggtatattagacgtacatgtatatttatctttccataaggtttcttttgaatataaagttgtgtatccaaatgcagattcttttatgctttatcttaagtcatcttcgcattttattttggtcaaaagaaagttagaagataagagaaagtttttgggtcacacatacgaaagaaacgtaaatggcttctcatgcctaatagcgctttctacgcttgtggggtatttgattggatatacgtcacaactcataatacgtagttgtttactagcttatctgtacatggactccacttctatatgatatatatagaaatgccactaatatacgtacgtatccacaataagagaattataatgaatgtgagattggtaagtagtatcacataatttaagggtgtgaaggttaattaacggtaggttgttctatattatatatggttactcacgtaaagtttttaacaaaatatacaaattttaaaatgtattacttaaccaatctctgttctcatgagagtagtttcgcttattcaaactgctaccaaatattatctagtagccttttctaattggtatacaaatacaaattacacgatgtgatagacactttattgtttgtgcatactacctttagagtaggcactagccaatcatgataaaaatggcaaatctaaaaaatattaagcaacatggtaaatataaaagatttaggtgacaaaactgaaaacagaagaaaaaacttacgttttaacaagtgttattaaatgctggttttggactaaaagaggatatgggtttaatgaaaaaacttaatttttaggaaaaaaaaaaaggtggaatttgagtagaatacaacaaaaagtcttagagtttgattggtaacacaaaactttagctgttacggaataatgtaaaactgtacaaaagagctgtaaaaaaaaattgtatcaaaaagctgagagtaaagcttttcgtaacgcttttgataaagtttttgtaaatggtaattgtcaaagctgtacaaactgtactgttttgataatgggttaccattcaaagctttaaattttaaatcgcatgataacctgtaaataattattttgaatatatgttagactttattattattggttaactatgttctcttgattgaaaaaaaaatagatttgtaactcattgctgttttttttttttaagaaacaaatagagaactatataaaaatataagaaaacgttggttttgtccaagaaaaaaattgttgggttttggtgggtggcaatagaagatgccatgtacatagtgggaacaagtagccttacgcccataacatgtcggaacatcaccaataaatttctatgttcaaaaatatcattgtaacaaaaagtttttcgaatttcttctcccaacccaccataaaaacccaatcaaatgcatgtgaatgttcttgttcatttgatgaggtcaagatcaagaagccatgtaatctagaatacaacagtacacatgtgacttgttacagttttgaactctcgttcacagttttgcaagttcttaccaaagctatagatgcctctcatcccatgagccttcatcacctgatgggcttattaggtttacaggcttgactaaactctagagcctatacgtatagaagaggcctgactaaacgaagataatgaaataagcccacaaggcccaaataattaatatcttttattctttttggcaaaatgaaaaatctgacttatgggctttttaacatttacacatttaacttcatgacccaatgaagacccgacccgtctggtaatgacccgatccaacacatgagtaaaccttcactgaaacctcgaaactcctccagaagcctaaaaccttcaccaccaaatcggtgcctccttgaatagtcgccgccgtcgtctatcatcgccgcttgtgactccggtgagtattcttctgctctattgagtttattttggttgaagctctatgagatgtacgtgggtctggttttcatttctgtttcttaatcgctcgaattagcatttgatagctactgagattttgagttttctgatctgccgaataatcttcgccattgtagtgtagatgttgtgtgccttttgattagattacactgagaaattggattgttttcgtgtttgtagatgagaagctaggttattgaatcagagattatggctgcttcaatttcaagaaggatttttcgcacttttggatccttttcagctctaggacgttcctcttcaccaagtattatctcattttccaagcttcttataaaatatgtttgtttcctggatctctgattgtttctctcaacagatttgtctgcgaatacatctggaaatggtttagcttctcttactaatgatctaaaggttggtgtgtttagttaatgtcactttctcctttccttcatctgcatattattgagttctacttactactacttgagtggtcatcttcctgattttgag

SEQ ID NO: 10369 - DNA, 3000 bp, Unknown; identical to SEQ ID NO: 10358
  misc_feature (1)..( 3000): cDNA_ID_2704802_gDNA_ID_2213644_Annot_ID_132352 3000 nt of promoter + ATG

SEQ ID NO: 10370 - DNA, 2285 bp, Unknown
  misc_feature (1)..( 2285): cDNA_ID_3036051_gDNA_ID_2213644_Annot_ID_132360 3000 nt of promoter + ATG
atgctatgagtgaggtaggtttctggtaccattttccataatacgagatgttgaagtagggtttatggttgcttgtttatatatgtggtaatgcagttattcggattcgatgcaacttttaatgaatgtatgttttgcatcaattgtaacaaatgatttgtatttactgtattgcccagctatctctctcccatgtgccattgaaaggttttaatatattgaataacaggtgcgggcaactgctagaatgtgctacagaatgtttgcaaaaacttggccggatcgttctcgccggttgttttcgtcctttgaccctgtcattcaaagggtaaggcttttcaactctctatattctgcttattatcatcaatgaggcttgataaagcattccatatgttctcagctaataaatgaagaagatggtggaattcataggagacacgcctcaccatctgtccgtgagagacattcccagccttcattttctcagacgtctgctccttctaacctacctggctatggaacatcagctatagtcgctatggatagaagttcaaatttatcatctggaggatctctttcttctgggttactcctttcgcaatcaaaggatgtcaataaaggttctgaacgtagtctggaaagtgtgttacaatcaagcaagcagaaggtcagtgcaattgaaagtatgctccgaggactgcatatatctgatagacaaaatcctgcagcccttcgttcaagtagtttggatctaggtattgagtttctttccttatgaaagtacagtttgtttttgaaacgtcctttaacatgagctaagatatccttgcgcagctaaattgtcttctttttcccctagtgcaggagttgaccctccatcgtctcgtgatcctcctttccatgctgttgctccagcatccaatagtcacacaagtagcgcagctgctgaatcaacacatagtatcaacaaaggcagtaatcgcaatggtggccttggtttgtcagatatcatcacccaaattcaagcttcaaaggactcaggaagatcatcttaccgtggcaatctgttgtccgagtctcatcctactttttcatccttgaccgctaaacggggctcagagagaaatgagagaagttctcttgaggaaagcaatgatgccagagaggtgaggcggtttatggctggtcattttgaccgacagcagatggatactgcttatagagatttgactttcagggaatcaaacgctagccatgttcccaatttccagaggccacttttgaggaagaatgtagggggaagaatgtctgcaggccggaggaggagttttgatgatagccaactgcaaattggtgacatatcaaattttgttgatggtccagcttccctgaacgaggcccttaacgacggactgaactcaagttctgattggtgtgccagagttgcagcttttaattttctccaaactctgctgcagcaaggcccaaaaggtgctcaagaagtaattcaaagttttgagaaagtaatgaaactatttctccggcatttggatgatcctcaccacaaggtcgcacaagcagcactgtcgacacttgcagatcttataccatcttgccgaaagccttttgagagctacatggaaagagtcctaccccatgtgttttcacggctaattgaccctaaagaagtagttagacaaccttgctcctcaaccttggaaattgtcagcaaaacctacagtgtggattcccttttacctgcattgcttcgttcactggatgaacagagatcaccaaaggctaaattagctgtgattgaatttgccatcaactccttcaacaggtacgctggtaaccctgaaatttcgggtaatagtggcatcttaaagttgtggctggcaaagttgacgccattaacccgcgacaaaaataccaagttgaaagaagcttccattacttgcatcatatctgtttacaatcattatgattctgcgggactgctaaattacattcttagtttgtcggttgaggagcaaaactctctgagaagagccctcaaacaatatactccccgcatcgaggtggacctgttaaactatatgcagagtaaaaaggaaaaacagagaattaagtcttatgacccatctgatgccattgggacatcatctgaggaaggatatgctggtgcctccaagaagaatatattccttggccggtattctgggggttctattgacagtgatagtggcaggaagtggagttcttcccaggagccaacaatg

SEQ ID NO: 10371 - DNA, 3000 bp, Unknown
  misc_feature (1)..( 3000): cDNA_ID_2704816_gDNA_ID_2213645_Annot_ID_132362 3000 nt of promoter + ATG
ccacctatagtttatgtaccatctaagttactagggatgtgtctatattcatttggtatatagcaaatgttttttccacaagaaacatagacgaaacaaattttcaataaatgttatgtgtgttctcacatggtatcaacgttacacattaagaaaaaaaaaatcaacgttacaaaactttgagtgtttgtttatttgtctttatttgaccatggacgagaatggcatcacatgaaatgtctctaccaatggttatgtgctatataccaccaatattcataaatatgatttatcagaactttacataaaattctgctatcagtattttttatttatttaatggtaataactatgctgattaaattttaaaatcagtatcaattaagaaaaacagtgattttgtggactgatatattggtcgacaaccgataaattgatcgttcgtgattgatgacatgtgaactattttgtatttttgttagtttcgtggatcatgaacacaaataatatgtttttcactacaaaatctcactcagtcggatttttctttttaaacttgtaaattgtacaaaccatacaataagaggctatctacggtccatcttcccgcagaactttcattatccttttgtaacatactggcagttacatttaaaaaaactgtcaagattacttgaaatcattcggtgtggtgccttctaaaaacctcccaatgctcaaattatatctttattttattttattgtggtcaaagtattacgatgttcttttagtgattcagtataatgttcatagtttttctgttaaaaatatcatagtaattatagatcgtttttatggggaaaaaaaaacttagtacatagtaaaagtagttaataatctattaaaaaataatatggtttggacctttttgcacccactaaaatatcagtatataactaagttaaatctttaaattagtaattacgaattgcttgatgttaaattaaagtgttaatgagtttttcagaatttaatttaacatgataaataataaaataatctaaatattaaagagtttattagaaaataggcatttgtcttggttatatatttattttaaggtatttccttacatgattttcgaaagaggtacttttctcttgtgaaaagtcatccttatcctcctctcatttgcattatcttttacccaattgaagcaataagtcgtgtctgtttcctatattcgatatttgcatcaccaattgaagcaataaatcgtgtgtgttccctatattcaattgaaacaatggcgatatatgcatcatcttctaaatcgccactcctgcaaagacaacaactcggattttcaagaatccaagtttttatatggaaaatcactgagagagagatcattgtgagggatttaaaccggtttcatcatttcaagaatggacttgtggtgattactggtaatttgaaaaagacaggtgagacgatattcaaaaaccggtttcaactcattgttatttgtgaaccgatttattcttggtataggaagactctgggtgggaaaagattccaactttgcttacgaaggttaagtcgcaacaaagaaagcttctttatttccgccatggacacagcctatcgtagtcatgtggacagaactgaaattctctaaaatcagaaccgaaattccacaaaatcagaactaaagttccataaaatctataaattttttcgattgggttccctatatattatcttagggtttagtattgtgtaattaaaaagaaaaattaagtttgcttgaaaaacaaagaagaaatcgatttaatcagattttgcaactatgttcgataaagaagaagaagaaagaagacgatgaagaagaagagaaggaaaaaaagacagggacaaaattgtcccgattgaagcaataaatcgacactgttgtattcaactgtggaaaatacctattttgaaataactttatttaaaatgcctattttaaatataagctcaatattaaacaccttgaacttatgtgtatttattatttgtgtgtacgggaagcaataccagaaaatgaaaatctcttttatttattgacaatccataatcctacaaatcctctaacttctagacttatgccgttattaaatattttaatatatatatatacatatatatttttaataattatatttaggaacgtcttttaatttatctccgagggtacactttttttctttatctcttttgtttttatctaaaaacaaacttttaggatattacctcacgaaaaaaacaataaattattcgtctagcaccatcggaaaaagacaaaagacttcgactaccccactcagtggcacaatcctgtaatttctactaaacattgataccctttctcgaattcatcgtgttctttgtttttaataagatggtactttttcctcatttttcaatctttttttcaccaagaagcagagaaaagaaacattaaagcagagaaaaaacaaagacaaataatctccatttgctttcttctccatcttcttctaattttcttcaagttttatcaatggctggtgttactggaatcttaaagcttgaagcttggagcatcttgtgaagaagattaactagtttcttgtatttttcttttctggggttttgagtttttttttctcttccttattaccggaagtaatggcatgtcggagtatgatcgcttttagtttagatcctgaaagaaaacaaagtggaggacttaggacaaaacaagctggaagaggatcttgccgtggaagttagtctttgttcaaatccattttcctcttaaagaatgtaataatgggtttttattgattgttgtagatttgttaaaaagttttgtttttagacctaaagtttcgatttttttcttctgggcagtttgaaattgcactgttgcaagtgaaaaagtttgttcttgttggagcttaaagaagagagaagagaaagagaaaagct

SEQ ID NO: 10372 - DNA, 3000 bp, Unknown
  misc_feature (1)..( 3000): cDNA_ID_2715566_gDNA_ID_2213645_Annot_ID_132368 3000 nt of promoter + ATG
catcttacgtgaacactaaaatttatatccatcacgtttagattaatcacccatctttcgaagcaaataagttccaatatgagcttagaggacataaaactagtttagagaaagttacacggatacaaatttggatatatagtttagttaggatatgattttattgattttattatatattttaaaaataactaaaacgttaatgatgacgtaagctaataaagtaatagattagaaattgcaataaaaaaatataatgtatttaataaaatagattcatcgacaaaaaaataataaaatagattcatataaaacttgtattacacaaaagaaaatatcttggcgcaagataataaaataattacaaagtgatttaaattcattttgattgccgtcaaaaacaaaaattcattttgataagttattacacccaaaaaaacaaaaacaaaaacttattggcatgcggggtacaaacaccgaggaagatatcgaaacacgtgtttaaaaatgaagagacgatttattaagcatcaatgagagaacttcagagctgggtttgagttctgtccaataatacataaccacgttatcatttttgtcctttactatctcattacactcttctgttattcgcccaattcttacagtcattgtccacgtcatcctttttccctctgaagccgccaaatatcaaaaaacacaaaacctttacccgaagcaaagtagctgcacacttgccatttataaggcatgtttcttcatctaaagcaaagtattttcgagttcctgagccaaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccaggttttacttcggttttctttctctttatgtttactttggttcactaatttgaatgtttgtgcctataaaacagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggttcttaaaactttcattttgaataggttgagttttaatgttttgagatatattgaaatttggatttcacaggatgcattagtggtgtgccggttaagaaaaaatgctgattttcgggctagttcgacccaaaaaatggaggatggtgttgtgcaagacgatggctacgttggccaaagaggtggtttggagaaggaggacaaatcctactatgaatctgagcatcagataccaaatggtgacatcgcagaatcatcaaatgttgttgaggtcagcttgcttttgaggaatgtgtcttttaacgatgtttaatactggtaaaattatccgctccaatcttaatcgaaaccacattaaattcaatatagttccgaaaacagaaccgattaagaaactaaaaccaaaccaacaccatagtaccatactataacggattcatagtacattagatttcactaaagttgttattttactaaagcagattctaaacttaaaacgtaacaaaccaatatatccaatgtttggtttttattttggctactaatattataactcaatagactaaaccaacacttgggctgaacatccttagttttcttgtactggtagagtttagagtttgtaactgaagttgatctctttctattgcgatgcaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtatttggtctatggcaatatggcatgttgagctagtcttaacaattattcaaacttgtgtacaaaccaaaatttttatggaaaagagaatattttcggatagtaaacctttataatctgggtgaaagctttgggaaagagatgatagttccgtgaaaatagagacaacaaatttcacatatagtaaatgtgaataataccaccatttccttaagttttgctgtttgttgtattagagattgcaaagtgatattcttagttatatacaattgtaataaattatacaaaatccataagtaaaataaattattttagactatgtttagatatacaaaagtttcagttcaaaatataaacgcctgagaatcaaacaaatgttgtttgtagttttttatatttataaaatagtctaaaaatatttttcttacttatggattttttatactatattaaagttttatatatgtaaaagattactctggaacctctaatacaacaaatggtataccttcagaaaaaaataaaaaataattgtgtgtcatacaataaataaaaataataaggtgaaaagatttgctttctgttttttttggtggctgaaaaaaacaatg

SEQ ID NO: 10373 - DNA, 3000 bp, Unknown
  misc_feature (1)..( 3000): cDNA_ID_2704840_gDNA_ID_2213645_Annot_ID_132371 3000 nt of promoter + ATG
ggtaccacaaagggatgccattaacaagactgatacaatagctttgcttcccatctttcttcttttttcctttcgtttgtcttggctttggtttagactttagacttagattcttgggatggttttagatatggaagaaattttagaatttataggatcaggaaacaagattttaatcaatacatcgacaagtaacagatcagtctaaagttttgtttcaaaatgtaactcatgtttaggtccaccgtattaatttttattacattaagttaagttgactaatgtaaatgtattgtgtttactagttcaaattatgaaacagaagatgagtaagttataatattcttttgacccacttaattttttgggacttaatttactttctttatgtaaagattgatttgtctaacccctagtgaaggtagctaaacgtggttcaagttctatattgtggattggtataattacaactgcaaaattgattagcacatgtcatgtgcgttctatggaggcaattgaagtcaaatcacaattaaagatataaaaacttcctcgtccactacaaatgttaggctaatttcattgtcttacaaatataattctgtttgtcttctatgtacacttcatcttccatttcttttttcttaagagatataagtaactactggtttttgttaattgttacaaatttgggtctttggttggcaaatctggatcagttgaagtagaaaagactagcaacttggtatctttgaaaactttcgatacaaatgtttacatatcgtgagtgtataattccaattttatggaatcttcaaagataaaatgtgattgatccatatatagatgtatataaattacaatcatgctataacacagtcgataccctataagccgaatacacctaggtaagcttagattatgaatatgttcttcaagcgggccgactgttaaattatctaacaattggtgttttagttatgcaatgaaatgaagatattaaagacacgaagaaacttgtgaagagaacaatatgtcattgactcattatgtggagacaataagacgaagcctaatcgtccacaagagtcaaagattctcaagtcgcgtgacgtgcatatggtcaaagactcatgctaagtacgagtctctctctgccacgcaaaacaaatagaatgctccaggtcttcttgcctaacattatggaactccttccacatagtcaaatcaagagatttagcaaccggttcatgatgactcggctcaaatgcaaatcctctaatttagaataatgaatactcaagctcccaactctttcatatggcacaacaaactcagtgtgtagggtaaaaataactccccattttcagtaaccccaactagttttctcaaaaagtaaaatctaacaagttgcggaagacaaaagataagattaagaataacttgtgttatcatgagtcatgaccaacacttgatatagaatatttgttttgttgttcattcccaaaatagaacctttttattattaggactactgattcatattctcattttcggcactaaatgtggtggaatgcacctgacacctatgacttaatttaagaaagtgttaggtgcaatgctgaaaccgatgatgtggcgttcgtcgtcgaggatatcgagtctctcggtggagcttgcaccggggaggtcagagaagacttggaattgacggaggctaccaaaaaagttgctcattttgagtttttccgagtttgatccttcctggaaacaaaactcaaatgtgattttgttttatagtatgggtagatatatgagttttgaatattcaacatcagagccaaataccccaaaacttaaaagtgatataaccatatatctaatcacttgaaagatttgatgaacaagcagaaagagcaacttttttggatgaaaagtattgtattgcttttgcattgatatgatcttcaatatacaaagcgaaagtcggatccattttagtattttcatcacgaggatgatatgcatctttacatcatgtgatacatataaacatggagaaatttttattaaaatgtttgctaattgaagattgatggtgtcattagggattgataagcgggtcggggtaacgttgagtgcgaccattgtagggaaggaatgcccttctgaccaaactggatacatatcactttgcacaacttgaactactagcgaaagaatgaaattagttggaagatacatttctaatacaaaactacaattctgtcaagtaaatgacaatataaggggtttcggagaagcacaccttttgcttcctcattcctaatggtcatagagaagacggtagttttcattttttttggggatacacacaacatatatctctgaagaatatgattgcctcttagttcactgatcatatagaagcatataaagaaaaatcaagttgctttggtctagtggtaaaggagagaaaagcttctgccacctggatttgagtattattggccaccggagttcgaatataaacctttacgatcacctgagttataaaaaaaacacacacacaaggaaaaatgtatgaaaaaacaataatcactgagaaatgcatttaaaacttttacaaacaactgattcgatttattaaattaattttgtttcttacaatgttttggaataaaataatccttacaataattcgatttattaaagacaaaaaaaactagaatcaaagctaacatgatagagagaacttgcttcgagggatagccgagagaaatcccgatgaggccaaagatcatccgtactagtggcaaattaccatagattggtcaaaacaattattagtcaaaatagcaataagtttgactcttttggtttgatatgactagcaaaaaagatattagtcaaaatagcaacacattttttagtatttgactcaaatcagtatatatatagctatatttataagtggacaaaatgtaaataaatttaaca

SEQ ID NO: 10374 - DNA, 3000 bp, Unknown
  misc_feature (1)..( 3000): cDNA_ID_2710477_gDNA_ID_2213645_Annot_ID_181419 3000 nt of promoter + ATG
tcccaagttcttagacaatctaacaacactttctagtttgttgcaaattagatccaaaacattctccaaagacaacacctttactatctctacttaaccttctgatacaaaaacacaacaacgttctctgcattccgctagcaatcatcaagattcccaagttcttagacaatctaacaacactttctagtttgttgcaaattagatccaaaacattctccaaagacaacacctttactatctctacttaaccttctgatacaaaaacacaacaacgttctctgcattccgctagcaatcatcaagattcccaagttcttagacaatctaacaacactttctagtttgttgcaaattagatcggaaacatttcccaaagacaacacctttactatctctacttaaccttctgatacaaaaacacaacaacgttctctgcattccgctagcaatcatcaagatttttccaagttcttagacaatctaacaacactttctagtttctagcaaattagatccgaaacattccctaaagacaacacctttactatctctacttaaccaatatcgaaccaatatcgaaacacacatgaaaactgaaacaaagttgcagagtaatttagctcaaattcctctattttcttggaaacgataccgggaaaaaaaaagctataaacttgaccacataacacacaaaacccaaatcaatttgacatttttagcctaaaaatcaatcaaaagaaagggatcgaaatgaaataaaacgatcattaaatggcgataatcgaaaccctagaagttgaccacagtatggaaaagctcaccggagatttcagcagctgagaataccgattcgagatccgtcagagatagaacaagtttccggaagaatgtagcagaaatcgaaacaattagggtttggcgagaagaagaatgtaaaattgggagcgatgatttttttttgtttgattgaaaaaaaaattgagaggaaatgttttttttttttttaaaccgtcgttggggttggaagagacggcgaagatgctgacgtggactcagcgactatgtttcgtcagtgcgttgacacgtgttctcatcattgcggatattgtttttgtatgtgttttagattttatggattttcattttaatcgttgggttcaaaactttaaaagcccaaattcataaaatccatagttatatcattttaaactacataaatacaaaacaaatatttacatcttcgtgatatcattttgatcctctacacatctaagatattattatcatcttggttttctacaatttttaccttccttactttgagtctttgattgtatatcatcttcaaaaatatacgccaaattcgttttttggatctttttacaaagatttttttcgtcgactatcacaaactttgactctatgaaacaaattgaagaaaaatgaattccctaaaaatcttggaagaaacaaggaggctaatggtgctttaacaagtaggctagtggtgcactggtgcttttacctttgttgacatcccaccaaatttaagctcgatcaatgtgactctaattggccactaggtaacatgttaaaaataaaaagaaagttccctaaaaacttcaaactttttacttcaacaaagagaaaccaaaaaaaatctagtgttcatgagtttatcattcattttaattttaaacaccggttcttcgattcatctccaaaaaatcccttcaaaatctagaaaccctaagggggtcgtgtgcctccatttcttttctctttcattttgtgaaatccaaaacattatcgtctatcatatgtataaacaaaaatttgttgcattttttactaacaagataggttactttgcatacaatttaaagtgacgacattttgccaatcgataagtctctttctcaagagagaattaaaaatgcaaggcctgcagcctctggcagcaaaaataatacaagggtagtggaccgacaaaataataaatggggcactctataatcagaagacggccacgactcgagctggtaataagatactaattgacattgtaatgcatggcaaatgataattgcctatttaggacaagagcattaaaataattttcaattatttagagtaattacttctaaaatttaaaattttagcctcgactccaggtgtatgaaaacatggtaagtatggtcaaataataaaaaacaatactgaaaaaagaagttgttggcaatgatttaataataaaataatgtttttttaaaaaatcccaaaaaatcatatctacccgatcacatactaagtcaaatgtagttttaaatagattaggtagtctatttttagggtgtattttactgaatacttcttccgtttcacaaaaatgtcattttaatttattttattatacatattctccttcattataagagtttttaaagaaaatcacggatttaggatgctgatgtataagcattatactaataatacactaatttatatagaatattggaatcaatacactaatagtactattgaagtctatatataatgttttgtaaaaaattcttacacaaatcagtctagtaataacattttctttattatcttttggattggaacgaaaacaagtacaaaatacgatacataatctacaaataactcgcaaataaacaagtcaagaaacggtacaaagaatctgcaaacacatttttttttgagagtgtaaacaaataaaatacaaatacaaagttttattgtcccatacaaagtaaatttcctttgccccacctttacttaaggctcattaactcatatgactcattggcccatctctgccaattgtcacacgacttgatggttttctttgttttcgacgaagtgctaaaacatgtggctcaactttgggttccaaaacaaaagattttgaaaataatatatcataacacaaagaaaagaaagaaagatataaagtcagcttaaagctctcgc

SEQ ID NO: 10375 - DNA, 3000 bp, Unknown; identical to SEQ ID NO: 10372
  misc_feature (1)..( 3000): cDNA_ID_2715566_gDNA_ID_2213645_Annot_ID_181410 3000 nt of promoter + ATG

SEQ ID NO: 10376 - DNA, 3000 bp, Unknown
  misc_feature (1)..( 3000): cDNA_ID_1387126_gDNA_ID_2213645_Annot_ID_181409 3000 nt of promoter + ATG
tcaatagactaaaccaacacttgggctgaacatccttagttttcttgtactggtagagtttagagtttgtaactgaagttgatctctttctattgcgatgcaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtatttggtctatggcaatatggcatgttgagctagtcttaacaattattcaaacttgtgtacaaaccaaaatttttatggaaaagagaatattttcggatagtaaacctttataatctgggtgaaagctttgggaaagagatgatagttccgtgaaaatagagacaacaaatttcacatatagtaaatgtgaataataccaccatttccttaagttttgctgtttgttgtattagagattgcaaagtgatattcttagttatatacaattgtaataaattatacaaaatccataagtaaaataaattattttagactatgtttagatatacaaaagtttcagttcaaaatataaacgcctgagaatcaaacaaatgttgtttgtagttttttatatttataaaatagtctaaaaatatttttcttacttatggattttttatactatattaaagttttatatatgtaaaagattactctggaacctctaatacaacaaatggtataccttcagaaaaaaataaaaaataattgtgtgtcatacaataaataaaaataataaggtgaaaagatttgctttctgttttttttggtggctgaaaaaaacaatggcgatgatgcttctgcaaattcctccttcgtcttccttgttgaacaccagaaaccttcaaatccgattcttccactcttcagtttcagcttcctcgaagaaattcagatgcagagccgtccgtgagaaggcggaggacattgataagaacatttcgccgccgtcttcttctcctcctcctccttccgccgaagaagttaccaagaaatatggccttgaagttggtctatggaaggtaaaatcaattcgattgcgcaatttctcgttttaattcgtaatctaaaattgatgattctatcgctatggaagctttaagtgtaagtaaaatagtgtttttggatgaacatgtgaggacatatgattgtttctgagctgaatgataggctaattcagagcaattttggtattagtagaagctattgaagctttaagtgtaactaaaatggtgttttgtatgattatgtgagcaattttgtagttgttgaagctatggaagcttctaagggtactaaaatggtgtttagatgattatgtgagtagatatgatcgttttcgtggtagttgtagaagttatgtaagcttttaactatgctaaaatggtgtttttttttatcaacaagtgagcatatgtgattggttagtttggagcatttttggaagttgtagaatctatggaagtttttgtgtagtaaaatggtgttttggatggacttgtgattagatattaagctctaaggatgatgaaggaagtgatggagacaataagaagaagaaatcaaaaacagatgaggctaaagagttacttgcaaagtatggtggtgcttatctcgctacatctattactctttctctcatttccttctcactctgctatgtccttgtgacttccggtgttgatgttcaagctcttcttctaaaggttactactttcacttcttgatcatactaagtttatgttttcttgatcttgggttgagtaaagctgattttgatgttttgtgtttaaggttgggatttcgacgaatgagacaggagagaaagtaggagcctttgctttggcttacgcagcgcataaagctgcatctccgataaggtttccgcctacagtggctttgactcctattgtagccaattggattgggaagaaagtggacaaggagaaggatgatgacaagtagcttactttggaggtattataatgtagatgttctatatattacttgataatcaacatacataatcctgtacaatcctcacttctctaccttgtatgtacaaaaaagattgaagcatatctgaatatgatgatgagttagaaagatacagaaccaaagagtggcagaatccaagttgtgatatagttttagacttgtctatttaatatgtggttggttggaaattacgacttcacgattcactaacctctagacatttggtaagtgggagaagtagttgtcaaatggttgggaatgatctctgtgatccagagcatatgacctcgatcgttttggtgatgcattttaacttgtactctagaacctcattatctcggcccatcaaaatatgaaaacattgggccgtaacaattgggccgtaatcatctataccatctatagttaattggatctttttatctcctcccttcctctttcactttcttccatggattactaaattccttaatcctgggaaaatcacaccaatcaacttttgtgaattgtaaccctaatcgattctacagcgaaatctacctatttcatgcttgggtttgattagtgtttttccagaatctgggacttcgcaggaattgcgctaattttcaatcgattttgcagaagtttgttgctcctggaatagaaatcgaagatg

SEQ ID NO: 10377 - DNA, 3000 bp, Unknown; identical to SEQ ID NO: 10371
  misc_feature (1)..( 3000): cDNA_ID_2704816_gDNA_ID_2213645_Annot_ID_181403 3000 nt of promoter + ATG

SEQ ID NO: 10378 - DNA, 3000 bp, Unknown; identical to SEQ ID NO: 10374
  misc_feature (1)..( 3000): cDNA_ID_2710477_gDNA_ID_2213645_Annot_ID_132375 3000 nt of promoter + ATG

SEQ ID NO: 10379 - DNA, 1853 bp, Unknown
  misc_feature (1)..( 1853): cDNA_ID_2709039_gDNA_ID_2213646_Annot_ID_132380 3000 nt of promoter + ATG
gtgactactctgccctgaaaccctctttctcgttcagaagcagagcgctccccattcctctatcagaaattttaacaacaatacaaactgaaacctttgattttcgtggttgaatggtcaaaacacacccaataaaaaaaaggttgtgatttttagtataatgcatttttcctaagatgatggttgcaccaaaaagagagaggcaattctgttatcctcctgcatgttagatcatttatccgaacaaaccataaaaatgaaaatattttgaaaaaattaaagtttgtttgttttcaaaaaacatattaatcccatgctcatgagtgtgacaaaaatggaccactagccgcatagaatcacaatgaagatttaacaaagcaaaaacaagatattgatattctaagatctacttgattaagacatgcaaatgcattaaaattaaaaagaagaatcgaccttttaatgcagtcatctaatgcgtgtggtaggaaatgctctgtaaacaaagtttttaaatgaagtcgaacaaaatttttagaaattgtaaaacatatcaaccaatagtttttggcagtaaaatttaaaagacttttaatttgtaatatctcagtagatgactggaaacaaaaaaaagtgggtctaagcccatgtagcaaaccacgttgcaaaaggaaatgtctttatcagacagaggttggcccaaatcaaattgagaggtgagacaagttgcctctgtaccaatgagattgttatgggtcccataagatctttaagtgaacccttcttaaaacgcttttacactttgtgtatcaattcgatatgacccggtttaactccggttatcttgcaaatacaaagctggttaagtaatggtaacgaactacatcaattttggtaaataaaggtttgtcatccatgctttggcagtgttgtcaatttaggcaacaaggcaaagaacaaagaataaaagcaaaagttttgtttcccccaacttgttcacatataacattatgtctctatgtggaagaatgcttttaaaaaaattcaaacataattgttacaaatagttattgtttgtcaatataatgactcatataaattcaaacatacccagcatgaaaaatgggaaattttatcaatatatattagctattcttgttgttgtcatcaatgatgaatggctggtctttagtatgccaaatcccattatgtgttttccctaataacattaacaataatagtgttaggtggtagtaccctggttggtgaaatgctaatggtgaaactgggtcaatataaagataacacttattactactgatctcgccagcttggtggttctcattcttgtcttcacaaacatataagaccctcctcacacgttgatgaactgattcttttccaattataaaaatcgtaatctttggtcacaaaatattaaatttggtcttcaagccttaaaaacggcagagattacatcagtcaagtaaaaacagcgacgcttttattgatcaaactcattctagcaaaaggtgttacaggcccatatgaggcccataatgtgaaaacaaggcttagtcaaaaacggcagggagtgtggtcaaaagttttgaaacggcaaagagtgttagtatgtgttttgtctttggttgatgatttatgaacggcaacgaatcaccttccgaagatttttcttcctttcttttttggattctcctccatgcaaaattggaaagccctaagacgaacaccaaccatacgccatcgtgcgacgtgaaaattggagaatctgattggctgaaggattattgaaattgaaagttattgtgatcgagttttgttttttcctgatg

SEQ ID NO: 10380 - DNA, 3000 bp, Unknown
  misc_feature (1)..( 3000): cDNA_ID_2991409_gDNA_ID_2213646_Annot_ID_132381 3000 nt of promoter + ATG
gaagaaattcataacaattgcacatacgatgttattagtgtgaccaccaacttcaagtctctaggaaaacaagtagaatatgtcgttgatgaagggcacatgggttaaatgtggttatttttttcctattatctattactataaatctcgaaatcatgaattagacatgttctttgtatctatgtccaacatgtaatgggtacattgtatgtttaagagtaaaactaggataggaagatgtaattgattgcttggtggcgtgggtttaggcctttgagccaacatttctctttagatttgaaccctctgctttcgcgagagactctctttgtcttgcgttttaaaaatcaaaacattatccttccttcgaagcaaaatctttaagattttggtgctatgccatctcttgcaagtcatctttcacatctgccaggtaagtgtcttttgagtattccaattctaacaagtccggacaaacaaaaaacaaaaaattggttcttcaatggaaaatgaatctaaatattaaatcatcagtgactatcaaattttggcccattctgttcatgccacaaaataatactagcagttctatcatctttgttatgccatgcaataagaacattttctgatatctctatactaatattgtaaaatgctaaagatgatttgattattctgatgaaatattggtaactttgaccagtagttgacgaaacattggtaatcgaattggaaccaaaagaggcaagttgggttcacagggcacatggttgcttcaaacaatcccattactccatccttttcattgtccctctattttaggctctttgtgctcatctctattttctttctttgatcaaaattattataccacaagacttttttttgtgcttaaattttagtcgtcatatacgacaattttttatatacgaagtttattattattaacatcaattgattattcatatatttttaatcaagtggcctttttaataactctctattcttttgacgtaagaacaaatagtaacttttatttgtagaatattcattctaagaaattaatacgtaaatacatatatttctcacccgtgaaacaccaccagtcgagtaacgtgattgaagatatgtttaaaaaaaaaaaaaacatgattgaagatatgagagagcaagagtcagtgaactattttggccgcacacatgtgacacatatatatatgtgtattattccttttggatttactacattcattctgatttctgaaccattagtaacccttgaaaagtaaaagctgataacgttttaggatttgcaaatttgaaaaaagatgaccctacattatttccaactgcaacatgcacgttcctgttatgttaaaagatattattatagtatatatattttgaaacataaaatgattgatgtaactgatccaacggctaattcctcttactagttagtgaattagccacctaataaagattacatgaatcattaaataacaaatataataactatacaacaaataattcatattgtcgtacattcaacaaccgaggtactccaaattaaaaaagaagtcaagcacactcatatatattttaatttttaactgataaccttgaaagaaaaagaaaaaggatatggaatagaatggtaaaatcaatcaatctgccatggttatgaatcaaaaaccatagaaaaatcgttatttactgtttagtattataaatagtgtcaagttaaaaagtttttaatattgtaaaatacactctacctaaacaaaacagcatatgtaagataacatcatcacgataaattgttttattctgacaccacatgtgagatagataggaaaatctttagtatttaaaaaatcaaaatgttggcagattaaccgataatcacgcagattaacacctactgagatagccgttaaataaattaatcgacatagcagaaacaaataattgagtatcaataaaaaaaaggaataatagagagagagagagactgactaatgagtcacatatgacgaatgagtccagtttggctgccagtctgtcagcccctaccattacaccacctctaaagatttgtattttatcataatccaaccaaacaatgcttacaaaaaaaagataatcacatcacatcacatggccttcttcgtcgctgtaacgtttaattaaactagccgccaatttcttttaaagatttttttgttttgtttttgggcttatgtttaaaccatataatccataacttcatttctattgctatttttgaatttaccctataaagctaccaatattgaatttttgtaattcatttaagtttattacataaataatttatttacttatatgattataattttttttatcggctatatgattgtaatttagatcagtacctaatcaagtttctatctttttctatccgttgacagaaaaaagaaaacaattttctatcaacaattcacaaatcaaattggattagagatacaacaactttagtcaaaattctaacacaacaattcatacttttgatcattcaaacatgattttattttttatttatctagaaacatagtaatgtcaattttgacaattattcattcaaaaaaaaatgtcaattttgacaagaaaactaggaaaaaaaagaacaatagaggaatggtcaaaaaagaataaaagaaaattcgaggaaaatcatgcttcttagaagttttttgtttaattagcttgactagtaaatagatttgaccggataaataaccggttgaaaccggtaacctttaaccggtcttcatactataagaacaccttaaacaagtcgtctccttccacttcttgctttattcctctcataccgttttctctctctcctccgtcgtctctgcagaatcactctctcgccggagtttttcacctgcagagctctcgattttttctctcgagcatcatcattttcgtcggatcaatcaccaagagatg

SEQ ID NO: 10381 - DNA, 3000 bp, Unknown
  misc_feature (1)..( 3000): cDNA_ID_2709024_gDNA_ID_2213646_Annot_ID_132382 3000 nt of promoter + ATG
cctctttatttaccatcctacccctatactcacacatatcgtttaaccagagaggaaaaacctgagtggcataatccgtaaataagaccaaaaaacaggaccatctctaaagctgatgtcactaatcaaaagattatgaacgtaatctcgtgtcataatccttttgacctcttacttaaacaaaacaagtataataattgggcagccaaaataaaaaatctttctctctttttgctataaagtaatgaaaaaattaaataaaataatgttcaaaaaattgtccgccagaataaagaaaatttgatatgtggcttcaaagcctaaattaatcattaaaataaaaaatcagaaaataaggaatgaagaacgaattgtgcaaaagtctatagagaaagagagattcatttgtgtttcttcgactatacacagaatacaaaagagatattatatgtaattatcaatagtatatgacaaatttatagcctcacctttcttcttcttcttcttcttcttctgtgtgtttttgaatttgctttcttcaagaggtttcttctccacaccgcttcggtgtatgatctgattgtgatctctctcgatatctgggatcttcggggtaagcgatttgatttttgtgtatttctcgtttctcgtaatcttcatgattggttttaatagtttgctgcgattttacataatcttcttctgttttgattagctactttagattacagctaatgatacgtttcgggattagtgattattgtatgtttaactagttttagaatctctacatgcatgaatttactaggtagggcttctttcttcttcttcttcttcttcttcttcattttgttggtttgattctgatttgtttttgtattgtatatgatttaaggtatggaggctgtagattattattattattacgtgtggtgctgatgcaatgagtgttgatgcctgttatggaaagagtagctgaagaaactgtggcgactaacaacatacaattgaaagcacgagtggatgatgttccttgtaataagcttgatgctcgtcataacgatatggtgattcaatcagaaactgcaaacagtgattgtcctggaagctcagctcacaggaatgttgatttgactaagccgccgcctcctgaggaagccgcaggagctaagctttctgttgaagagttgacattggggaactacaggattgttcaagggagtaataatactaatgtggatagtcctagggctggcaagtttgagcatctttatcgtttggctagagggtctgcttttagggcaggagatggggatcttgattctcaacctcgtgatatggatcaaatgttgtccagaatcagacaacagcttgctggagctccttctgagaggcaaaacttgaaaccttttatgtctaggaggagcgatcagaatcttgaagctttttctgaacgtctaagagcagctggtgagaatagtattatgaatgctcctgcattgatcagtgaaggtgtccaaatgaaaacgccggtgagttcttcgaatttttctcagttgttacttaaaagagctatgaaagggaaaggggtagtaggaaagaaccaggaaactcctcctgaatttgtctctgatcaagatttaggaagcaaggaaaaaaagttggatattagcaagtcgcctactcctcacgatgtgttacctctaaaatcaagtcccaaaggaaatggtatggtatcacatggtgatgggaatcatagtaaatcttctattggaatcagtttgagggagtttcttagatcaagttatgctaaaagagaaaaaagacatggcctttgtctatttaggcagctggtggaactggttgactcagcccattcaaaaagattattcttgctagacttgagaccatcccttttcactttagttccatcaaagaaacttagatatattggtaattttggaaagaacgatctagaatcagatgttgacgaagatttgaataggaggaggcctgttgttgaggaatcatctagtggaggtagggattcgaagaaaagaaaaatggacttgcatttgaattctccagggaatcaacttcaggccacttcaaccgggcgacctttcaaaaggaaaagccctgtgattgatttaaacatggttgatgcacgtaatccagacagttgcgagcttcaacagcaagactacataaaaaatttaagcgtgtcttcagtgtcgagaaaacagtctatgtccacatggctagaagagcaatggtatacttgtccagaggagataaatggagaagatattggagaaaaatcaaatatttatgcccttggtgttcttctgtttgaggtatggacgaatacccagttttattgttgtggatagatttttagtttgctttaataccaagaaggatgtaacatttccttgcatttgaacactatgtactgtcatatcctgcttatgtgggctttgggtagtttatattctttcattttcatgaaatttcttactctagtctgaactttgaatcccagagctagtattttccagtctgcagtatataacttgtcagtatttttgtttacttgtttgatactttcatgtgaagacgcctactgacatctagcttgaccaattgttgtttcagttgctatgccattgcgagtcaggcgagatgcatgctgcaatgatggcagatttacgccatcggattctcccaccaacatttctctcgaaatacccgaaggaagctggattttgtctttggcttctacatcctgaaccctcctcccgaccatcagctaggtatttagctgagtgctactcttttatgattcatgtgggcgagtatttactaggagtctaggagtggtacaaaggagaatctgtagaccttccattagcttaaatagtcgtatttaagatttctttgccggatatcttcaattttatttaatgttttcccgcttaattgtgaagaaaaaaaatg

SEQ ID NO: 10382 - DNA, 3000 bp, Unknown
  misc_feature (1)..( 3000): cDNA_ID_2704868_gDNA_ID_2213646_Annot_ID_132383 3000 nt of promoter + ATG
tccgtttccggccactttttatatcattcctttttatcactcttttgtttgttttcaagtcacatcttctcaacgaagaccggagccctcgtgtgaacatcttttcccttcgacggctagccgaaatttttaaagatataacactctgatctcaacaaattaaatttttcataataacacttcgtccaaaaactctaccattacatttaaacgtgttgtatataaatatgatatatcattgtagtattatgaatttacaattcagggtatattatggaatataggaccgaccaaatcaaatttttattcgaaatttaattttatagattatgctgattatcagtttgggttttatttccaagttcacatgttgagagaatacaaaaacaaaacaaagctaaagggattatatatggattaggttgtggatgtcaactagttattaaaataatgttagattaagggatagattaggtaaaggtaagtagctgttaatcatgttaaatattattattttaggttgtggttcgtctaaaaggaatctccctatgatttacgaatccgaaatagagagaggaggattttcatgttattgtggtggaggagctagggtcgtgtcaatgctgcttttggttcattgtttaagaacaatgatcataacacgataagattgatgaatgaaacgtttctatctgatataccacacaaatttaactaagcatcacaaatccgaattagagcagagaaaataatacaacatgttgctggttaggttgaaacattgaatttgcatctcttctatagttgatacaagattggatacatcttcgttacaaagcgaatacttgcttacatttaattacgccaaaaaatctcttcattttcatcttttacagttaattaataatgaaaagatctgttcatctttatatatagtgatcaataacaaaaaaatttgaatccaataaatataattgaactcaggttctgggggcaatcacaagtcagtcatgcgccttcacattttcctgtaatgcctgaattctttagccatgggctgaagcacgtgagtccttttctccatcaactttgtatccttcataaacctcttgtttgcacgtgctctagattcacgagcctcgtgtgcaacatggtctcttctctctttctccaaaccattctcatcttccttcttcgtagaaagctgagagagaagcaccaccatgagatttacctccatcagagaagttttctcgtcttctcttttctcctccgcatcatgtttacgattggcttcgcgagacgaatccataaacccaaaaagaagacccaaaaatgatacaattattgggagctattagtccctaaattagcccgtcttttggacaaaatttttatcttcttcttttttttttcttgtggtcattcatagtaactaattaaatcaatttgcaattttttgagtggtattggtatattttccatcttaaagactcgatggtagagaaataagattcctaaattcattagtcacaagatcgaccaatttttatttttatttttcttatctcaaatgtttcgttttgagaacaaccaaacatttaaccattgataaaattggccaatggctaaaatgaatgccttttcattgtttttttgacatcctaaaataaatgcttaactaatgggtttatggaaaacaaaagttgtgtccaagttataagcgaagcagcccataaaagtattaaaatgggctgagcccaataactgataggtggagtatattagtttaaattgtgtttgttgtacaaagtttcccaaatgggtttccaaaatgggctgagcccaaaaagtgttgttataggtgagggtatattagtttattcgcaaaaaaagcgtggcttaataatctccacatctttcacgtgacccccctcgaatggcgaatagattaagcgacgtcgacgtgttttaatctcctcctcttaacaaatatccctaaagattacttcccccatgcaacactcttaatacccacgcttttcctctttatttaccatcctacccctatactcacacatatcgtttaaccagagaggaaaaacctgagtggcataatccgtaaataagaccaaaaaacaggaccatctctaaagctgatgtcactaatcaaaagattatgaacgtaatctcgtgtcataatccttttgacctcttacttaaacaaaacaagtataataattgggcagccaaaataaaaaatctttctctctttttgctataaagtaatgaaaaaattaaataaaataatgttcaaaaaattgtccgccagaataaagaaaatttgatatgtggcttcaaagcctaaattaatcattaaaataaaaaatcagaaaataaggaatgaagaacgaattgtgcaaaagtctatagagaaagagagattcatttgtgtttcttcgactatacacagaatacaaaagagatattatatgtaattatcaatagtatatgacaaatttatagcctcacctttcttcttcttcttcttcttcttctgtgtgtttttgaatttgctttcttcaagaggtttcttctccacaccgcttcggtgtatgatctgattgtgatctctctcgatatctgggatcttcggggtaagcgatttgatttttgtgtatttctcgtttctcgtaatcttcatgattggttttaatagtttgctgcgattttacataatcttcttctgttttgattagctactttagattacagctaatgatacgtttcgggattagtgattattgtatgtttaactagttttagaatctctacatgcatgaatttactaggtagggcttctttcttcttcttcttcttcttcttcttcattttgttggtttgattctgatttgtttttgtattgtatatgatttaaggtatggaggctgtagattattattattattacgtgtggtgctgatgcaatgagtgttgatg

SEQ ID NO: 10383 - DNA, 3000 bp, Unknown
  misc_feature (1)..( 3000): cDNA_ID_1838273_gDNA_ID_2213646_Annot_ID_132385 3000 nt of promoter + ATG
tatgcttattgcagaaattgtgtgtcgtttactttttcgtcttatcataatcacttgtatcaagttgtacgttagcccctatggaacgtgaggacgcttacgtattcataatactaaaaagataaacagtgtctagttcttttgtagccatttttttgggtacttaaacactataaattctttaaataatatatcactgttttcttttgataaacgaaataagaaaccaatgttgtacataagttctgtgttatggttgacgtgataggtaaatgttgtcaagctaatcgtaagtaattaaactatatgattaagttattaatgcgtcactgatatggaatatttttgtgatctgttgatggacctgactttaattctcgattcttaggaattaggaaatggccaagttgaccaacaaaaaatgtggcgggtgtagtggaacccactcaaaaaaatcaggcaactttcgtaatttaatgaaacatttgggggcgaaaataaggaaaacgtaaaggatgtgaccgacaaattatttagagccgagacgtaattgaattggacggcactgccacgtgtaagcacgaaactcacttgggtcacagtacatgcggatccagaggatcttttatactaatccaattagactcatccacgtgtcaaattagttaaatttaagttttttttagtccgaaattaaagttagaatattaaattaatttccacacacaatcgtttttcttagttattttacaactagctagtataaacgataaccaaaatggatgacatcaaaataattaattaggccaaaaataataatatcagcagtcaataataaaattgtgtatgcatgtgtcatggtaccattgtttcttaagctcaaaacatttatgatgagcatggaggaatatgtgatttatgttgacttgtcatgcatgtatacaatttatagcttcttcagtcaacaaaaaaaattgaaaatgttaacttctctaaaaggagcttttccacagatttcaatcagttcatgattttctcgatataaagtaggcatgaaattgacgaatgaaaatgtatgaattgaagaaactatataatgaaaaacaagaatcatcaataaaaatcaaatgtttcttacatagtttttttttcttcttcaaggaaatcaactatgttttgtttttttatacaatcagatcattagattaatcgtatgtttttgtaacttaacttatgttgatcagcttcattaaaatgagagtttattcttgtaaacaaaaaagttagttgtgatgactaatatgcgtttccgaaacgaaaccctaaaccctgcaatagaaaagggattgttgaacttaatttgttttgtgcacgagaagatggatgaaacagaattgttaaccaaaaatcttatgaacctaattccaaaaatcttatgaacctcacagactttgagaatcgtttaaatgactaatgtaaagatgtgcaagcaactgatatgaagaattgttaaccatatattgtgatatctcatatttgtatatatatttgatatatacaaatatgtttgttccaaattttgttacaaactacacagccaaatataagaagctatcaaatattatttctttagcaagtttgaattaatcaaacgcaggtcattataaattaaatcataacaggtggtataaaaacaacgtattttgttaaatttaagtgattgtagtcttagaattatatataggtcttttgttagagatgaatagttgatttctgatgtatttcctagtattacatcattaacgcaatgaccatatataatgatatagacaacgatgacagagaggtgactaagttaacatgttatgatcctcgtctgaataaactagaagactagccgcatgaaaattcttagttaacaaaaaatgatgttgtctatatgtatatctactactaatatcatgaacccaaattactcaagaattaaagaaataatattcctaacacaagttggcttttcgtaaactaaacttacggtattgttttatgcatcgatcataatgaatattttaaaacactaaaacatggttaaaaaaaaaagtaatccacatgcgattgttttggattggtccttttaaataaactaaagttttggcagagaggaaccaagtaaaaatgggcattatctaagaatggtcctaattccaagaagatattacactcttttacagattggacccaaacactcatgtgaagatgaaaaaataaactaagaatacaaaaagaagaaaataaaagaaaaaatcagagatcccgtcggagaaagaaaaagagaagatagagagatacaagtaacggcttccactaatctttcgccttctacatttttgctgctccgtccaatttttgtgtctataaaataagacagcttctttctcttgactttccaaattcactcaactttctctcactccttttttctctctctctctctatcctctacagagctcgcagcaactagcgcaggtactctctctttctcactccttaatctagatactaaagctgatcattttcatatctctcagtaatccgtttcgtctgatcgggtaaaacacacttccaattactccggttccgacctcgttgactttttcttcagatagattccaaaaaagttctcatctttacttgttcaatctcatagattccgatttgggtctgattgttacctctccacaactattgggttcctctcaaaacccttcgatttcttgatccatccttccttaattttcgattctcgaaaaccgttttcacaacttttttttataaaaaaaaaaatctgcaaaaagatctctctgataagaatttttaaaaactttccctttatggatgctctgaaacataaaagagcttttaagtttataccttcccttatattctctgttttcaaatctgtcagaatctgatcactcttttctttttatctacttcagg

SEQ ID NO: 10384 - DNA, 3000 bp, Unknown
  misc_feature (1)..( 3000): cDNA_ID_2715592_gDNA_ID_2213646_Annot_ID_132386 3000 nt of promoter + ATG
aaattgtgtgaaatcaaagaaagtggtttttagttgtttatttccgtcgttgttgtctttatttgtcaatatagttttctttacgttatttaattgagcataaactttttttatctttatagaatttgtatcacagtggttttactttgctttttgtgcaattagtgtttgggaaataaatagatttctgatgtgacgttacctttattatacttggaacaaaaaaatcaagattcgaataattgattgtctgtatggagaataaaattcggataatctaatctatctcgatctgacctgaaccatattgtgaaaatattgttttatattacgatattcgaaacaataatgtacgtgttcgacaattgaattttggtgcttctctcaaaaacaagaagagatcataaacaattaaaaatttagagatcataaactctctaaatactttgccaaaacaaaaaaaaaactctctaaatatagatagtggtgtgattttgtgtgagaagctatacgtgactacgacattattagtgcgaccgatgtttatttagagagttctaattacgaaaaagtaatcatagatctacatatagtccactaattgaagtcattatcttatagtagaatttgataggatccatttgaatttccgagtaagtccactaattgtgtatacttcacgttataaaaaaaaaaaaaaaggaaatcactcaaacaaggttaaaaggaaagttaattccgtttacgtatgtgggctgcaaaaaaaatggaacctaatcataacggtaagagaatactaccgtttgtatatatattactgttacaacttacaacaataatatattctcttactgcgtaacaacaacatatgaagctaaattatttgagtgacttgacgttgtttagtctcattatactatagtttgttctcgagcagatccactaagtagtctgtagcgtaatctagtggttgttgtatggcttgtctcatgaaacatgaaatcaaggattatactacagtctcagggcaaattagaaagcaaataggaagtggaagttttttttttttcttctgcctattcaattttctgctttgtggatgacgacataattatggattaagtgccaaaggactgatgaagatgacgaaataattatggattaagggccaaagatatgtcttttgacttttgtgagacttgaaaagtaaaaatacaatcaatagacaaaatcgaaattgaaatatggcatgatgaaatattgctactttgaacaaattatagcaagaaaaaacagctggaaattattggtaacagtactgataagttgtcgtgaatttggtacaatatatctcgtgattttttactataatggtcacaatttatcgtttatactcactaacacacgcacacacacccacacccacacacacaattctatctatttggccctccctatataacaacaacaaacttcgatacataaacaaagcaaaacaaaaaacaccttaaaccacttgtagaaacaaaacttgaaattgtaagaaatcgactttgagagaaactctccagtccttgaataatgccaaacacaagactctgtggaagtagctcagaagagaagattagtgatggtcgtgatcctaaaatctgggactgtgatagtactctctatgattcctacgaactcgtctcctttgttcacatcatcgaacgtaaactaatgcctttctctcctctcgctcggcagcctggtttgactctacgagctttgatggataaagatagcgaccattgttcctgtgcgtcgactaagaggggaccttgtattcaccggaggaaatattggtggaatggaaagaagaaagacgaaatgaaggaacgaatcaataagaagaagatgtttgattttagtttttggtggaatttttgttgtaagaacttgttcttctaatatgtaagcaaatttctatgccgagttgtttatgtgatgaaagttgtgtgtaggagcttgtcttacttcaaaattaatcgaagaaagtgagttcactgtgctcccatatttgctataatttacaaagtgaattttgtgcctagtgggcttatggttaggcccatataggcccatctcttagggtccgacttgagtacgaaaaccttattgatctcttaacaacaataacataaaggaagctactactgtattctctagggtttctattctctatttgctttaccttttgtattttgtactttgtataaagtagatataggcaggtaaccttgggtcgaacgaccgtcttgtaatttttgtttgtagctttgtttctttctcaaatgaattggaataagtctgattccatatatttccctcgttcaatcttttgaaaattactaatgaacaaatatagcataaaaattcaaaatcagaacagttcaagttataaagaataaatgagaaatagacaactaaccactttcttccacaccctcatcaatttaatgtttcttttcttttattgttgtcccaaaaccagtttggcttttgaccttaaccttgacttttctccctctttgattgatgttttttttcagcgttaatttattccagtaatttcccttagttttaaacattacaacactaactactaaatgtaagtaaaaaagtaaaggtaaatctttaaattttattccttggctgaaaaagaaagaaagttacgagttacaaaaatgggcccactttgtagattggcccgcccaaaataaatcgatttgaaactcaattttgtatagtcagtctctctcttcttcatgtttggtttcagagaatgaaaggcttaacaagagcttcttcattgactccatcttctgcatctctttagagtttatagatctaataacagcaataaatctagcttcttaagtcttcttggtttttcttctttaattgaatgctgagtatctttcttgtcagctcagtgactattttcgtttgtttgta

SEQ ID NO: 10385 - DNA, 3000 bp, Unknown
  misc_feature (1)..( 3000): cDNA_ID_3036175_gDNA_ID_2213646_Annot_ID_132388 3000 nt of promoter + ATG
ttggccaacatactaaaacagtaaaaacaaaaaatagaaattttatcaaatacatgcattgaaacataaatgacagttaaacagcttaaaatgacactttttataaacatatttcaaattctgaaatgacgcttaaattgaaacagagaatatcaatcaagaccagtaatttcaacaaattcacatgtagatgtaacttactaaatacccttaattaaattctattaaggcgtaagagtttttattagtctcaaaagtaattttattgtacaaattaaatttaatcagcatatgaagtgacatgtgggtctctgtataaggagagttatatctttttcaacacgcacccaaagtccaaagacctttcgtggaaattaccagacagtttccaaaactaaatgtagatttttatttttgttcaaagaatatttcatcggtgtaggtttattttggtaaatattccaaaagtttcaataacgtttatccatcccatcgataagaagatattgtgtttgaaagttttctttccttacgataccataacatgtacggagttataattttgatgttttttttttgtattttgctctaaagcatttacaccacaatcctgttaatacaagataatcttattaaattatggttggacatgaaggtaataacaactgctctcatttgacagcattctgttaagtgttaatcgtctttcttgagtttttcgtcaagctatgatcttatcatttcgatgttgatatctagccgatgtaaataagttaaagaccattctggtaacggtggactaatgcatgcattaacaagggaatgttctttacataaacaaaagcagatgataagacatcatttgatttgagaagaagttgaaaacatattgttcaatttataatcgttagttgttatcaattcaaagcaagctaagagcagcccaaattaagataataaacccttatggcactaattaatcatagatagtccatacatgcttgaataattatttactaagtgtgattaaagctattatttttatcacaaaaggcatgtgcatgtatatacgccactcgggcattttactgaatttagttttagtcataaattattcccttgaccagacgcgttaaacaagcgacgcgtcgtagaataaatatttatcttcaaaagaatttatattatttttctactagtattaaggaattaattaagttcgactcagcacagcagcctctaaaatatattaatttggagtcagaaagctacaaagttgataactgagaaacataggatatagtactacagtaacgtggatatatcaatatattatctacgatattcacaatttttaaactgaagaattcagtacgatgaatatggcaaatgcataaggttagatttcatctaaattcacacaaaatttgtttgttcgacgaacaaaatttgaatacataatggccacgatgctctgccattaatcatggatgtaagcgccatgattaaaaatttcattttacgatttttaaggtaaatcgttatgatacggagtatatcattattaataaataataaaacagtttgtattcctttaaattcttttttttgtttactaattatgacttaatatagtattactttataaaatcactgttttaaattttattaaatgcatttattccgtattatatattaactgtgtttttgtttttttttttaatttttggtaaagtactaactgtgtttttttctgtatccttctgtagttctgttcgattctattaaaaacctatatacattggtgaatagaatactacaacatatatggatgatggatcatagtgattacgaatttaaatcatattaataattaatgataatacgtcactgtcaattgtgtgaatgaaaaagacacattggtatattttctcaaaactacacctgcatggtttgatacttttttgatttgatccatagattcttgatttgcttgttagggccactaaaatttgattaatttcgatctttgaccccctaaaaatataactaactacataatcaacatcctatataaaaaaatggttgataaaatatatgtaaatcgagtatagagtatatatatgcaaatacatgcaataaatgactatatattggtaatttaaaataaataactcttttgttgtaaataaaacccataatttagctaccttaaaactacaatttaaaattcgaaataacgcaataattgggcaatttatgacatcacgagtcttcacgtcagcgaaacaaaagaaagacattcaatttcaaccgaatctaacgcggcaggacgtctttgaagaatattgtttattggttcactcgtctgaataactataactttaattattatttgttagtttttgtagataaaataggattagcttaaccgacttagtgagactcaccatatatgggttctattaagattggggagttagttgacgatttatagataacttgatatgatcattagtctgtctaatatataaaaattatagaccgaaaataataagataagaattatagttgcttaataggtatggaattagcaactacattttttttttatcagaaacgagtaacccctagactaaaacattccaattttatttgtaatattttaagacaaatttagcagttttatactattttatatattctagcaatataaaaaaagagtgaaacactaatagtctcctttatgtcaatttctctccaagatccttctcttttccacacaacttctggtcgaagattgaaaccaataataaatacaaaaataaaaattaatacttattgtctaagcacaaggacgagtaccatcatagaatctccatcattcatgtctataaatacatctagatactcacagacgaaactcacatctcccaccaatctcactcaaaagaaaatctaagaaaagattcttaattttctgaagtgaatgcaaagatg

SEQ ID NO: 10386 - DNA, 3000 bp, Unknown
  misc_feature (1)..( 3000): cDNA_ID_3036189_gDNA_ID_2213646_Annot_ID_181448 3000 nt of promoter + ATG
tcggtttaagaagtgtttacgtggttatcaacattaacttttgaattgaattatacgaaacggcaaaaagattatcaaaagtgttgacttgtgagctaccgtttttgccccttaaaagtctcaaattccaaggcgataaatggtcaagcaccctccacgctcctcctgtcttttattgccacgtgtctaccaccgttcccgtctgaatttgtcagcatctgtatgccacgcggcggccagtttccccgacgttaatttctccggtaattatcacacgtgtcgtgtagtcaatggatattaacttcgagcttattttatggagtttttaattgttttcaattagcgtttttttctcattggtgggtccacagattaatggaactaacgaaatataattggtgaatgaaaatgtctgtttcattgaattcatgcgtttctattaaagaagtcacagtttttaaaatgggttcacgtggtcgagtacttagctcgtgagccggcttcagtgtccatagtgtattactcagctttgtaacaacattattagagagaataattcactttcattgtataaatgacaaaaacaattaataccaacttgttttgataattacaaagtaacaaaatagaagcattcagagttttgaagttatatattcatttgaaatgtcttgaaaaaagttatatgtctttctttgacaaaacaaaattcagtaaatttcaatcaattatatatttttaaaagtactatacgcacacaattctttatacaacgacaaaaagaaattttacatctaaaaatttcgtatatagataaattaacacgtttgtaaaatattgaataaatattattttgtcactatatacacagtaatcacatgtaataaattaaaatcaatcgatatgtttcgttagatctctcaatagataattattgatataaactagtacgaaaataacataacatacacagttacacatacataaacatataatatttgtaccaaaattattaagaaaaagaaatttaaagctctcaatcaagagattttgtatgatatgaaatattcttctgatttttgaaccattttgcattagagaaaagtaaataaaactaaagtggtcctggaaacataaaaaaataaaataaaaatagagaaagaaagagatgctattcctggagactgagagtacagtggaggtccatgacatctcgtaacacccaacaacactcaacaacttgccaaattagctttcactagctgttgttatacattcatttcttaatttaaattggaatatcataaataacaccttataacattataaccaaagcataaactacatgcatatattcttagaagacattaactttttaattaatttccgattatagtgtgattacgctccttgcaaatactctacaagctatgaaagtaaaaaggtattggctactttcaccgccgctactatatctcgtgagtcgtgagtgaagccaagccaggctattattaagttgtgtactactcattccgtaaaaaccaaactgaaacagaactattccttttatagttaaacaccgaatttaattctaaactcaatcgtattaaatgagaaacgtaccattactttaaaactcaaactgaaactaaactaaaaatccggtaaaagttcttttactcatatcattggaaatagtttttgaagcaaagtaaaaaacactagaatagtgtaactagaaggaactactaatataaattttggttgctggtgagattctttttcctccttccccagcggacgtctccgtctcttcttctgcttctaacttgctccaaattttcatttcaatttttttgataggacttaaaaattccaagctcgcttatgagagtaatggcgtagcaaaatctttatctaactcttggctcttgtctttttttgtttgtttctcaacctacgccggatcttgcttcttcgaacttctccgacgcatcttcttcagattccgcagaagtttgcgtcgttttcttgaatccactcaaaattttattggaagtttgtgttgtttttactagctctgaatctttagagggctcaaaaattcgtcgagaaaaccagtctttggaagtgtagcattttggattcgcttgtgacttgaatcttgaatattaggtgaaaccgccttggatcttctcgttgatctttgtcgtggacatttttttttgtaaagcttagtagattctctaatatttaattagagagtatctgttcgtgttattctttattgttagataatgattaatcactgcacacaatcttattgaattttcctgttgcttttctcggcttgaattctgaagaagtagttagagagatggctttgctatatactcttgctagatctgtttgatttcttagattcctgatttaacgatttccttctaatttgattatccaaaatctagaaatggtaaaagtttcttgagttaaggttcatttattttacatttgactgtagtttttttgtgtgatttagatgcagacaggaccatgttgtgttttggattacttgagagatttactatctcaatagttcatttcatcgtacataatttttttttgtgaacttgtttaataggaatgatgatgaactattcttgttttgtgtgtatagtttgaagatggtaactttatgaattaattatttattacttattagattctgcagttgcgtcttcttgattcctaataaacaatgttaaagaacacacttttcatgcttcctatcattagaagtgtcaaagatgctgctcttttttaatcatttttcttcttacctgctgtattaacaatttacgtatatccaggtttctatttggtcaacaacatcagaaacatgtgtgctcagatgttgagctctttagattcaattgttgtgaacattgtcaaggagaatagtgattattgaaggatgcaagatttttatattcagctcta

SEQ ID NO: 10387 - DNA, 3000 bp, Unknown
  misc_feature (1)..( 3000): cDNA_ID_1442431_gDNA_ID_2213646_Annot_ID_181447 3000 nt of promoter + ATG
ttaaattaagaaatgaatgtataacaacagctagtgaaagctaatttggcaagttgttgagtgttgttgggtgttacgagatgtcatggacctccactgtactctcagtctccaggaatagcatctctttctttctctatttttattttatttttttatgtttccaggaccactttagttttatttacttttctctaatgcaaaatggttcaaaaatcagaagaatatttcatatcatacaaaatctcttgattgagagctttaaatttctttttcttaataattttggtacaaatattatatgtttatgtatgtgtaactgtgtatgttatgttattttcgtactagtttatatcaataattatctattgagagatctaacgaaacatatcgattgattttaatttattacatgtgattactgtgtatatagtgacaaaataatatttattcaatattttacaaacgtgttaatttatctatatacgaaatttttagatgtaaaatttctttttgtcgttgtataaagaattgtgtgcgtatagtacttttaaaaatatataattgattgaaatttactgaattttgttttgtcaaagaaagacatataacttttttcaagacatttcaaatgaatatataacttcaaaactctgaatgcttctattttgttactttgtaattatcaaaacaagttggtattaattgtttttgtcatttatacaatgaaagtgaattattctctctaataatgttgttacaaagctgagtaatacactatggacactgaagccggctcacgagctaagtactcgaccacgtgaacccattttaaaaactgtgacttctttaatagaaacgcatgaattcaatgaaacagacattttcattcaccaattatatttcgttagttccattaatctgtggacccaccaatgagaaaaaaacgctaattgaaaacaattaaaaactccataaaataagctcgaagttaatatccattgactacacgacacgtgtgataattaccggagaaattaacgtcggggaaactggccgccgcgtggcatacagatgctgacaaattcagacgggaacggtggtagacacgtggcaataaaagacaggaggagcgtggagggtgcttgaccatttatcgccttggaatttgagacttttaaggggcaaaaacggtagctcacaagtcaacacttttgataatctttttgccgtttcgtataattcaattcaaaagttaatgttgataaccacgtaaacacttcttaaaccgaccaaataatataattaaagatttgattgattgataagcttttgtgttttctttttctgttgttgtgcgtgtcaacgtgttgtactctccgtaaacattcatgggccttttcaagtaactgctcaagctggccgatagcaatttaaaataatcaataagcccatattgtttttgaataggcccatggcttattagggcaacatataacgctttaaccacttcgtcatgaaaaaacccatacaacaacatgcagcaactaacattcaacataactgttttcattagcatataatgtacgaaaacatgcaacttatctctataaactgttagatcatgtacttaaaaatgcatagattaaacgttttcaatttatcataacatgtaccacacaaaaaaagtagctagagcagctattcatcttatagaatatatagacgtatctcaccttcgcactgcagatcttatacaaatctttttaagaaaatgaaaaaaggggggctaatctcatatattcttcgaagtctttttgggttattaaatagctttaaccaccacatgtcataaataattgttgttagatacttgtctgattcatgcctttttttttgcgagtcaaagctttgtatacaacaaatgtgcttctttgctctttcgtctcactccatttagtcaaaaattccatttgtgatataaaaatgaatagatgaaaccttgaaatatgtaatgaaaccggtctcgagatgtggttaaagcatatttgtaatcaaaaatatataattaatgaagaaaaacaagtacgttttcggaccacatcggaccagtagaggcacacaaccatacgggtgttgtgcccacttttgacgacattaccatcagaccaaaggaatatatgaaagatacatagagagagatatgttctcgaactaactatttctttttttaccctcttctgattataatattattttcccgttttgctgttctcttctaccaaactttcctcttatatcaaactttcaaatcgaattcctgaactttatatcacagtccttatttgttttctcttgcaacaaatgaatttttttgttattgttgaatagttatatttttaaataagtagctttgacagaatgtatatttaatgtagaatagcaaataaactagaaacaagaacacatataagggacatactggtcatttcgaaagtcaaagccagaggagaagctactatttctccaactgtctgtaaacgaggaatttttacaaccgcaagtcaaaggatttaaaataagtagttatggttgtatctgtcgttcttctttctctatgaactaaaggccgttggaagcaacacacacacacacacagtgaaacactacagtttacagattcgttttctttagctcaatcgaattatattatttcttaatcagtcaatatttaaataatggaggatgatgataagtattaaataaataattattctaggattaatcagacatgcgcagttatataataatcagtttgattttcttttccttttcgagcccctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatg

SEQ ID NO: 10388 - DNA, 3000 bp, Unknown; identical to SEQ ID NO: 10383
  misc_feature (1)..( 3000): cDNA_ID_1838273_gDNA_ID_2213646_Annot_ID_181442 3000 nt of promoter + ATG

SEQ ID NO: 10389 - DNA, 3000 bp, Unknown; identical to SEQ ID NO: 10382
  misc_feature (1)..( 3000): cDNA_ID_3036204_gDNA_ID_2213646_Annot_ID_181440 3000 nt of promoter + ATG

SEQ ID NO: 10390 - DNA, 3000 bp, Unknown; identical to SEQ ID NO: 10380
  misc_feature (1)..( 3000): cDNA_ID_2991409_gDNA_ID_2213646_Annot_ID_181439 3000 nt of promoter + ATG

SEQ ID NO: 10391 - DNA, 1853 bp, Unknown; identical to SEQ ID NO: 10379
  misc_feature (1)..( 1853): cDNA_ID_2709039_gDNA_ID_2213646_Annot_ID_181438 3000 nt of promoter + ATG

SEQ ID NO: 10392 - DNA, 3000 bp, Unknown; identical to SEQ ID NO: 10387
  misc_feature (1)..( 3000): cDNA_ID_1442431_gDNA_ID_2213646_Annot_ID_132389 3000 nt of promoter + ATG

SEQ ID NO: 10393 - DNA, 3000 bp, Unknown
  misc_feature (1)..( 3000): cDNA_ID_2715584_gDNA_ID_2213646_Annot_ID_132390 3000 nt of promoter + ATG
agtgtattactcagctttgtaacaacattattagagagaataattcactttcattgtataaatgacaaaaacaattaataccaacttgttttgataattacaaagtaacaaaatagaagcattcagagttttgaagttatatattcatttgaaatgtcttgaaaaaagttatatgtctttctttgacaaaacaaaattcagtaaatttcaatcaattatatatttttaaaagtactatacgcacacaattctttatacaacgacaaaaagaaattttacatctaaaaatttcgtatatagataaattaacacgtttgtaaaatattgaataaatattattttgtcactatatacacagtaatcacatgtaataaattaaaatcaatcgatatgtttcgttagatctctcaatagataattattgatataaactagtacgaaaataacataacatacacagttacacatacataaacatataatatttgtaccaaaattattaagaaaaagaaatttaaagctctcaatcaagagattttgtatgatatgaaatattcttctgatttttgaaccattttgcattagagaaaagtaaataaaactaaagtggtcctggaaacataaaaaaataaaataaaaatagagaaagaaagagatgctattcctggagactgagagtacagtggaggtccatgacatctcgtaacacccaacaacactcaacaacttgccaaattagctttcactagctgttgttatacattcatttcttaatttaaattggaatatcataaataacaccttataacattataaccaaagcataaactacatgcatatattcttagaagacattaactttttaattaatttccgattatagtgtgattacgctccttgcaaatactctacaagctatgaaagtaaaaaggtattggctactttcaccgccgctactatatctcgtgagtcgtgagtgaagccaagccaggctattattaagttgtgtactactcattccgtaaaaaccaaactgaaacagaactattccttttatagttaaacaccgaatttaattctaaactcaatcgtattaaatgagaaacgtaccattactttaaaactcaaactgaaactaaactaaaaatccggtaaaagttcttttactcatatcattggaaatagtttttgaagcaaagtaaaaaacactagaatagtgtaactagaaggaactactaatataaattttggttgctggtgagattctttttcctccttccccagcggacgtctccgtctcttcttctgcttctaacttgctccaaattttcatttcaatttttttgataggacttaaaaattccaagctcgcttatgagagtaatggcgtagcaaaatctttatctaactcttggctcttgtctttttttgtttgtttctcaacctacgccggatcttgcttcttcgaacttctccgacgcatcttcttcagattccgcagaagtttgcgtcgttttcttgaatccactcaaaattttattggaagtttgtgttgtttttactagctctgaatctttagagggctcaaaaattcgtcgagaaaaccagtctttggaagtgtagcattttggattcgcttgtgacttgaatcttgaatattaggtgaaaccgccttggatcttctcgttgatctttgtcgtggacatttttttttgtaaagcttagtagattctctaatatttaattagagagtatctgttcgtgttattctttattgttagataatgattaatcactgcacacaatcttattgaattttcctgttgcttttctcggcttgaattctgaagaagtagttagagagatggctttgctatatactcttgctagatctgtttgatttcttagattcctgatttaacgatttccttctaatttgattatccaaaatctagaaatggtaaaagtttcttgagttaaggttcatttattttacatttgactgtagtttttttgtgtgatttagatgcagacaggaccatgttgtgttttggattacttgagagatttactatctcaatagttcatttcatcgtacataatttttttttgtgaacttgtttaataggaatgatgatgaactattcttgttttgtgtgtatagtttgaagatggtaactttatgaattaattatttattacttattagattctgcagttgcgtcttcttgattcctaataaacaatgttaaagaacacacttttcatgcttcctatcattagaagtgtcaaagatgctgctcttttttaatcatttttcttcttacctgctgtattaacaatttacgtatatccaggtttctatttggtcaacaacatcagaaacatgtgtgctcagatgttgagctctttagattcaattgttgtgaacattgtcaaggagaatagtgattattgaaggatgcaagatttttatattcagctctaatgaagaacggacaggtttgtccctaacacatcctcaccaactttttccttattgttataatcttgctttcgtatacttagataagaagttgagccatgatagaaacttcattattaagaatacgtgatcctttagttattggtatgcttgattggaaagaaagttgtagctactttagcattgatatacttagatttaccaagaagtgaagaagtaaaagagagtttgtataacaggagttgcagtcttctacccaagtttcacatgagtcccaaggtgaacagaaagttaatttatcagtagaagctccaatacaagattctggttctgtatctgcctcaagtaatgacggtaggaaagtgtcaagacaagatattgaacttgtaagaacactttgccaccttcctatctttatagactttcttgtaagtttccaatcatctgataaaaaaacatattctaaatgactgatgcaggtccaaaatttgatagaaagatgtctccagttgtac

SEQ ID NO: 10394 - DNA, 3000 bp, Unknown
  misc_feature (1)..( 3000): cDNA_ID_2704860_gDNA_ID_2213646_Annot_ID_132391 3000 nt of promoter + ATG
tacaatcacttttgtttatttccatatcaaagtaacattgtgttagtaacttaccctttatgataacgttcttttgaattttagtatggcaaaaactggaagaagaaaacgcagagtttttcagggcatattacatcagactgaaactgaagaagcaaatagttgtattcaatcatttgcttgagcatcagtatcacctcacgaagtataatgtacattcaaaagttcctctggtcccaatgcagaacggtattcatcctatggcatctggtaagtctgactccttatatcacttgttggtgtagatggttcaatgatttgtttgtggtttcactattattataacactaaatgtttgcagcgcagtgaacaacatgcccatgggatacccagtactacaacatcctcagatgcatgctcaaggtcatccccatcttgatcctatgagctgtggaatgtcaagctgccatgtggttaatggagtccctgcacctgctaatttccaaccaatgaggatcaactcagggaatgagtaagaactaacttggattgagttttgtttttgcatttttggtgctttagacttaagaactaattcctactgttgtttccggtgcttggtgtagtatggtaatagatacaaccatggctgaaccaactccaatgattccaccaaatagtggtatgtcggatatgccagtaagtccagcttctgtggcgtcaagcggacactttccatttgctgcttcagacatgtcagggatgggaatggacacgtcagctcttgactctgctttcacatctgatgtcggaacttcagtagggttacaacttggatcagatggaggagctggaaattctagagaccctctcaggccatttgatcagataccttggaactttagtctctctgacctcactgcagatttgtcaaatcttggaggtaagctctttttatcaaatgccattgcgagtttagctcgaaaaactttataacatacgttggtagatgctccatgtacaggtgtactccatagaatgttgcatatcaatgatcttttactttgcagatttaggggctttaggaaactatcccggttctccttttctgccatctgattcagagattttacttgactctcccgaacaagaggacataggtaaacattagctctcactctccatctaaaaggtgcaatcttataagaatggtttgaacatggatgttatagatttaaaagtttcatgtcctatgatcactaaccaatatcttcgtttctgtatcccgtagatgaattctttgtggattcgattccaggacctccatgttctcagtcagaagaagacaagtcttaatcaagcttatgatatttgatcaatagaaacagtcttattatctagcaagcaagcattgtttgtgccgtttctctatattagagaaaacctcccaaaaggatttaaaatcttcttcttttttcctcttctaagggtaatgatcgatcatagattcatagacttagattaattgctcagttgtttgtttattgtacacctttattttgggactttgctaagcattgtataatatctcccaataatctattttcttgttggatagttcatcaatatgcatgggaatatctcatttttttccttctaataaatactccctattatagaaatctataaaagtgttcataattataactcgtggaaattaatttgagctttaaggaatgattgatatctttttgtgaaacaaaaaatcacaaaaagaaaatcattgatttttttttttttggttggaaaatgattgattcttttgtttttttgggtaggaaaatgattgattatttttgtagaggagaaaatgacgtactctaaaattcagaaaaaagaaatgacgtacgccaaaaaaagtatgaaagtctcttcaagactaaccactaaacaccaaacaagatataattttcttttttttttttgtatgtggagtagaaaaatcattgatttcgtatataggtagactaatcaacgtttgtggattcagaatttcaaatacaagtgtccgtgaattaaatccaagaccgtgaatgcataaaaaaaactaggtctataaagtgaaaaaaaatacaaatattaagggagtaactgagtcatcataactatgaaaaatatgattgtttgttatacataaaaaaattatgaccatacatatatattttctttttaaaaataatgaacatattgaggtaaataaataaacaacagattaaaatattatatatcatggtaagaaccacaacatatatatataagttgaattagtaaattaaaaatgttggatggaatttgctcattcactagaaaaattattttcatatttcgtctcaagaaaaaccaaattggaattgtaatttttttgggttgactgactcagtcttcgtcaaaagtcaactcaactttattccctttccaaaatttattattattgaaaacttgtctttttcatgtgtgttccaggctcgtttcttcttcacttagtttcaattcaaagttgtactaaatcactacttcgccaaaattagaacatcattatcttcgagggtctcttctctcttcatactacttcaagaaataattaaacctttttttcccttttaatctttcctgtcgggaagacttttaagtaccatttcttttccgggaaacaaattctcgaataatcacagaaaaataccttggttcactttttttactgtatagatcgtccattgaaatcaaggttttattctttaaaactttggtctttatttcacaacttctttgaacttcaaatagtttaaaatttactctgtttcatcaaattactctgtttcgtcaaattactctgttttgtcagcttgctcttttctaaaacgtggaagtaaataaaattttgacataagtatattttctcccacaggttcaagaatctgtggaagaaaacaatcagcgatg

SEQ ID NO: 10395 - DNA, 3000 bp, Unknown
  misc_feature (1)..( 3000): cDNA_ID_2715580_gDNA_ID_2213646_Annot_ID_132392 3000 nt of promoter + ATG
tgccaatatgttccgaggatagcgagaatctatccgcttttcaaggaagtaacaagaacttctggtttggtaactgaaactgcttgggctggtgctgctttaaacctattcctctacatgttagctagccatgtaagaaaagattattttatttgattctttgctccacttgattaggttatgtttgggcaaagataacggttttaaccattgcgaaaaatggacaggtttttgggtctttttggtacttgatttcgatagaaaggaaagatagatgttggcgtgaggcgtgtgctaagatacagaattgcactcatgcatacttatactgttcaccaacaggggaagacaataggttatttttaaacggttcttgtccgttgatcgatcccgaagaaatcacaaactcgacggttttcaactttggtatattcgctgatgcattgcagtctggagttgtggagtctagagatttccctaagaagtttttctactgtttctggtggggtctccgcaatcttaggtttgtaacatctaaaactcttacttattacggttcggttactttttgttatctaatcgatgaaatcttatctttctgtgtgtagtgctttgggccaaaacttgaagacgagtgcctttgaaggagagatcatttttgcaatagtcatttgtatttctggactagtcttgtttgctctcctcattggaaatatgcaggtaatcatttctcttctcctttgagctcttaaaacaaggaatatccatatatatagtcttaaagagttctgtgatttgtagaaatatttgcaatcaactactgtaagagttgaggaaatgagagtgaaaaggagagatgcagagcaatggatgtctcatcggatgttgccagacgatctgagaaaacgtatccgtaaatacgaacagtataaatggcaagaaaccaaaggagttgaggaagaagctcttctctctagtcttccaaaagatctcagaaaggacattaaacgccatctttgtctcaagttgctcaaaaaggtaaccttttattttgtcccatcataacttcttgaattcactgttttgttttgtttcaggtgccttggttccaagctatggatgatcggttactagatgctctatgtgctcgtctcaaaacggttctttatacagagaagagttacattgtgcgtgaaggtgaaccagtggaggatatgttgtttataatgagaggaaatttaatcagcaccactacttatggtggcagaactggtttcttcaattctgttgacttagttgctggtgatttctgtggagatcttctcacttgggcattagatcctctcagttcccaattccctatctctagtagaaccgttcaagctttgacagaagtcgaaggctttcttctctcagctgatgatctcaagtttgtcgctactcagtatcgtcgcctccatagcaagcaactccgacacatgttcaggtaatactttcaattgaaaaaatgcatgttgagttaattataaaagttaacatattggataatgaggacatatcgtatacctatctcgtttctcaagtttccttcaacataataaccctaaatctttttattacctaccttgtatcttgtttctcaagttacctttaatattataacctaaacaactttttgtctccaggttttattcagtgcaatggcagacatgggcagcatgttttatacaagcagcatggaagagacattgtagaaggaagctctcaaaggctttacgtgaagaagaaggcaaactacataacactcttcagaacgatgattcaggaggcaataaacttaacttaggtgctgcgatttatgcgtcgaggtttgcttctcatgctctgaggaatctaagagcaaatgcagcagcccgaaattctagattcccgcacatgttaactttgttgcctcagaaaccagccgatcctgagtttcctatggatgaaacctagttgtgtatatagttgttgactctatctctatgtaatgtgatcgctagtattttttgcaaatgattatgtaaccagtaaagagctttatgtgaaataatcaataggaaaaattcttatagagtttagttaaaaaataataattaatggagacattaattttagcgagaatctcaccaccacaaccactgtaaatgttttgctatccaaaaacactttctaagtcctaagctttaaaagcatctctcattaaacaatttttccacatagttaggagagtttactagctagagacggtagacttatctctctattggtggtccagcttggcttcactctctcgaattgacgagtttagtcttattacgacgactttcaattgggtctgtattgactaaaagatggccaactaaaataatgatttaagtatatatttgaagatggtacgaaatgggcatgttgtgaaaagaagacaggtagagaaattggattttgtgaatattattgtaagttgtagggcaaagagagtgagactgcagagcccccaccgtagacgactttactgtctcttcaagtccatttagcttaccactctgcatccacatacatgagtctgtgttaaagctggagaacatcgatttgcccaccatttctcactgccaaagccatacccatatttattctctctcggtctctcttctcggtctctcttctcagtctctcactcccacagcctttagttcgagaagaccgaaggggacttcattttcttgtacgggaattaaaatattgaagattgacagataaaaacatgaatcttcagaggagaaaatttgttaggtagcttcttggaatttttatgaacaagtttaacatagcttcaatctagtatttttatatttacttttggcagtagtgatcatatcttgttgatacaggcttgatagtacgggagttgatggaaaattgaaaagtgttagaggacgcttgaagaaggtttacgggaag

SEQ ID NO: 10396 - DNA, 3000 bp, Unknown
  misc_feature (1)..( 3000): cDNA_ID_2704856_gDNA_ID_2213646_Annot_ID_132393 3000 nt of promoter + ATG
caactgtgcatgatggatggctactatatgtatataggtgtgtggggctttttggtatttgagttcaatagaaaggaaaagcacatgttggcgtgccgcgtgtgctaggacatccgactgcaatctcacggtcacggatctgctttgtaaacgagctggtagtgacaacattcgttttctcaacacctcatgcccattaatcgaccctgcccaaatcacaaactccacagacttcgactttggtatgtatattgatgcgttgaagtcaggggtcctagaggtgaaaccaaaggattttcccaggaaattcgtctattgcttttggtggggtctccgtaatattaggtactaaattgtattatgctaaactctctgccgtgagacatatatcaatccacttgatagattaatccgctctacagtgctttgggccaaaacctggagacaagcaactctgcaggggagattttctttgctatcatcatatgtgtctctggtttactcttgtttgctgtgctcattggaaacgttcaggtaatgttcataccttagaactagagtttgatctcataaagctgattcttaatagatgtttgtttttggtgatcgcagaagtacttgcaatcatctacgactagagtagatgaaatggaagagaaaaagagagacacagaaaaatggatgtcctatcgggagataccagagtatttgaaggaacgcattaggagatttgaagattacaaatggagaagaaccaaaggcaccgaagaggaagctcttcttcgtagtcttccaaaagacctcagactcgaaaccaaacgctatctttttctcaagttgctcaaaaaggtaaccttttattttgtcccatcataacttaaccaactcctcttgaattcactgttttgttttgtttcaggtgcctttgctccaagctatggatgatcagttactagatgctctatgtgctcgtctcaaaacggttcattatacagagaagagttacattgtgcgtgaaggtgaaccagtggaggatatgttgtttataatgagaggaaatttaatcagcaccactacttatggtggcagaactggtttcttcaattctgttgacttaattgctggtgattcctgtggagatcttctcacttgggcattatattctcttagttcccagttccctatctctagtagaaccgttcaagcgttgacagaagtcgaaggctttgttatctcagctgatgatctcaagtttgtcgctactcagtatcgtcgcctccatagcaagcaactccaacacatgttcaggtaatattttcaattgaaaaaatgcatgttgagttaatcatattggataatgatgacatatcgtatacctatctcgtttctcaagttaccttcaacataataacccaaaatctttttatcacctaccttgtatcttgtttctcaagttacctttaatattataatctaaacaactttttgtctccaggttttattcattgcaatggcagacatgggcagcatgttttatacaagcagcatggaagagacattgtagaaggaagctctcaaaggctttacgtgaagaagaaggcaaactacataacactcttcagaacgatgattcaggaggcaataaacttaacttaggtgctgcgatttatgcgtagaggtttgcttctcatgctctgaggaatctaagagcaaatgcagcagcccgaaattctagattcccacacatgttaattttgttgcctcagaaaccagccgatccttagtttcctatggatgaaacctagttttgtatagttgttgactctatctctctgtaatgtgatcgctagtgatttcttgcaaataacttttgtgtaaaccagtaaagatatttttatgtgaaataataatcaataggaaaatttcttatagagtttagtaaaaaaacaattttaatggagacgttttagcgaatactcaccacctcaaccactgtaaatgttttgttatccaaaaacttctaattcctaagcttttaacttttaaagcatctctcgttaaacaatttgtatttttttgcaaaacaaaaataaaacgctgtatttttaaattagaatccttaaggttgggtatttttaagtgaatcaaaaattccaaccaaagtaatggaactaaataactgttttttattagaaaactgaatacgtacatataccaaagtacataataaaactagttctattattgatatatataaattaaacacagatttagattatatttaaacacatagctaagattgtttactagagagacttaattaggtctctctattggtggtctagcttggcttcactctcgaattgaagaggaacaacgtgtttgtttagtctttttaggacttacaattacgtctctgttgtttagtaacgatggcaaataaaaataatgatttagtatatttgaacatggtcccaaatgggcaagttgtaaaaagaagacaagtagagaaaattcaaaattggatttcgtggatattattgtaagttgcagggaaaaaagagtgagactgccccaccgtagactaaaatgatttagcttaccactctcactctgcatccacagtttaataattacccctttaatattttaatcattattttagtagaccaaaactgtttagtgttgaaacttgtgcatccacatgagtgttggttaaaggttgagaacatcgatttgccaaccatatctcacagccacagccatttttattctctctcggtctctcttctcagtctctcactaccacagccttaagttcgagaagaccgaagtggacttcattttcttgtacgggaattaaaatattgcagattgacgacatatactaacatgaatcatcggaggagtaaatttgccaggtacttcttcgaagttttgattaactactatttcatatttggttgtgatagtgatcattgttgatacaggatagatagt

SEQ ID NO: 10397 - DNA, 3000 bp, Unknown
  misc_feature (1)..( 3000): cDNA_ID_1808176_gDNA_ID_2213647_Annot_ID_132396 3000 nt of promoter + ATG
ctgttccaataccactcaccggaattccacagaataaaagattccgatcataaattctacaatcatcgaattataatagtgatatcgatacaaacataccaaagcttagaactttacaaaattgaaaactcgccggaaaaaaagatgcaaaggggacctctgattaaacgacgtttcttcttgtttgtcctctcgcatcaactgtactgggcctaataaataaacggttctggattattgggcctaaagtagtgaggaatcatggcccctttatataacgtgtgcgttactaaaaacacacactgagaaactctcaatctgagcagatatttacccaatcagggattcaggaagagaagcagagaaagaaatggagataacactgaacagtggcttcaagatgccgatcgtcggcttaggagtatggagaatggagaaggaagggattcgagaccttatcctcaatgccatcaagatcggctatcgccatctcgactgtgctggtattcacttgttctctcaaaaccttctctttctgatctttgttgcttctggtttgtctaaatatgtgatttgaatactgggtttgttttaactttttgatagttggaatctttcttggaaaatatgtctttaagatttgttttttttttcatagtctctataaacttgttatctaaagtaaatgctctctgtacatctttatttgcatctgattctgaagttctaagtatttggaatcatagaatgatctagattctattgctgtattgatgacagattgttctataatagcttttaacttgttacttattatagacagagttcagctttgttttaattctattgtgtgatttgcgttgttttaagtcttgattttggtgtgttcgttttccttggtgcagctgattataggaatgagaccgaagttggtgatgctcttacagaagcattcaagactggtctggttaagagggaggatctcttcattacaaccaaggtccaatcgaaaactatacagctatgatctcaatttaatgtgagcaagctctgatctgtgatctgaattggttttttgcagctatggaattcagaccatggccatgtcattgaggcctgcaaagacagtctcaagaaacttcaacttgattacctcgatctcttcctcgttcattttcccgtagcaacgaaacacaccggtgaggcctctgcctcattagcgttttattagtctagagtcagagaccattgcatttcgttttattacaagtcctcctttttcactgactgagatcaagttttcttaagtgtcttctatatatgctttgcaggagtagggacaaccgatagtgctttgggcgatgacggggtattggacatagacacgaccatctctctggaaactacatggcacgacatggaaaagcttgtttctatgggtttagtccgcagcattggaatcaggttcaacttctctcactatcattacaagttctcttgtttagtcgccaatatatgaattttttgaccattaggttttttgcagtaactatgatgtctttctaacgagagattgcttggcttactccaagatcaaacctgctgtgaatcagatcgagacacatccttacttccaacgtgattctcttgtcaaattctgccagaaacatggtatctgtgtcactgctcatactcctctcggaggtgccacagccaatgccgagtggtttggcaccgtgtcatgcctggatgatccagttctcaaagtaagccccatcctctaaaccttaaaagtttggattgaacctttgacaattaaaaaaggactgcgtttatctgaattcttaggatgtggccgagaagtacaaaaagacagtggcacaagttgtcctgaggtggggaatccagagaaaaacggtggtgataccaaagacatcaaagcctgcgagattggaagagaactttcaggttttcgacttcgaactatcgaaagaggacatggaagtgatcaaaagcatggagaggaaataccgcacgaaccaaccagccaagttttggaacattgatctctacgcttgatcacactctctctatctacatgaataaatgaagcttaagaagataaacaacgagaagaagccatagctttacctgaaacattctcaaatgtttgtgagcctatctttcatacataaactcatgttgttaaacagattatgatttcttaagtactacaatatcacacattgatggaaagtgatatagatttctctcttctctatttatatgcttaaatccacaatgaatcattattgtaactgaaagaggatatttaaaaagacgagtatacccttgatttctcttgtttagtagtagagaagagggtaatttggtaaatgacgaagtaagtacattgagcttcttcgcggacagagacactatctctctctctctctaccctttggatctttcttctcgatcaattatccattttgcccagattttttccagaagctcatcgaattcgtaagctttcgcgccttttcctctctttaatttatttgttaatcaattttgaatgtgttgtatctctagggtttataatttcagtttcacccttgttttctattgtttcgcggaataatctcttgtcatggaaggtttagattgattcgacctttttgatcttgacctaatttattccaattttcgtaaaattgttccttaagacctgtttctctgactagctcagattgattttggtatctgaatcaattgcggaaccctaactggcagatcaattcgagaagttttgattttgtttgaagatagtgaattgcgagttcagtgtgctaatatctgcttgtaattcttactcttcaattgttttcatagatcgaatcacaatgtttgaaatttggtttcactgttgctgagtgtgtttggaggagaagcttgattggttcggtgtttcactgtttgaagattataagagttatg

SEQ ID NO: 10398 - DNA, 3000 bp, Unknown
  misc_feature (1)..( 3000): cDNA_ID_3036229_gDNA_ID_2213647_Annot_ID_132399 3000 nt of promoter + ATG
tcactactttaggcccaataatccagaaccgtttatttattaggcccagtacagttgatgcgagaggacaaacaagaagaaacgtcgtttaatcagaggtcccctttgcatctttttttccggcgagttttcaattttgtaaagttctaagctttggtatgtttgtatcgatatcactattataattcgatgattgtagaatttatgatcggaatcttttattctgtggaattccggtgagtggtattggaacaggtttcctaggatcttaatgggcttgtttcaaaaggtgtgatattgaaacttggagatggttcttcgtatttctaggtttcttttcttctgctcagattcgaaattggagtcttaggttttcttaaaaaagttgaagttatctgatattatattcttaagcttcatttattcatatagatagatagagagagagagtgtgtgtgtgatcaagcgtagagctcaatgccccaaaacttggctgtttggtgcgtgcggtaattcctctccatgcttttgatcacttccatgtcctctttcgatagttggaagtcgaaaacctgaaaattctcttccaatctttcaggcttcgatgtctttggtatcaccaccgtgttcctctgaattccccacctcaggacaatctgtgccactgtctgtttgtacttctcggccacatcctatgaattcagacagacaaaaggtttaattatttaactgtttcagtccaaacttttaaggtttagaggatggggcttactttgagaactgggtcatccagacatgacacggtgccaaaccattcggcattggctgtggcacctcccagaggagtatgagcagtgacacagataccatgtttctggcagaatttgactagagaatcgcgttggaagtaaggatgtgtctcgatctgattcacagcaggtttgatcttggagtaagccaagcaatctctcgttagaaagacatcatagttactgcaaaaaacctaatggtcaaataattcatatattggcgactaaacaagagaacttgtaatgatagtgagagaagttgaacctgattccaatgctgcggactaaacccatagaaacaagcttttccatgtcgtgccatgtagtttccagagagattgttgtatctatgtccaataccccatcatcccccaaagcactatcggttgttcctattcctgcacaaggcttacatgttacagcttattactctgtgtgccaattgctagagacttgagaaaacttaattttccagccagtaacaaggctgaaatgcaatggtctctactcgaaactgataatattcatgaacaaggctgaagcctaacccgtgtgttttgtagctatgggtatatgaacgaggaaaaggtcgaggtaatcaagttgaagtttcttgagactgtctttgcatgcctcaataacatggccatggtctgaactccatagctgcaaaaccaagacagagagcattcgatctgaaatgaactgatatcaaaggtatgtagtagtttaacttaaagccgtttggaccttagtcgtaatgaagagatcctccctcttgacaagacctgtcgtgaatgcttctgtaagagcctcaccaacttcagcttcgttcttataattagctgaaccaagtaaccccaaaagatactcataaatcaggatacagaacaaagcaactcactcacatgcaaagaaacaaaaacaattgtctgtgatacagcaaagacttaagatcattctacgattccaaatttccaaatacttaaaaacccaaatcttaagacataatttccaagtaagattccaactttcaacaaattaaaacaaaacctaatattttattcacatatcctgacaaacccgaagcaacaaagatcagaaagaaaaggttttaagcagtgttaagttataccagcacagtcgagatgacgataaccgatcttgatggcatcgatgataaggtctcgaagctcttctttctccattctccaaactcctaagccgatgatcggcattttgaagccactgttcagtgtaatctccatttcttcttcttgcttctctcctcaatccgtgattgggtagatatctgctcagaattgagagtttcccagtatggtaagttggtaacgcacacgtcaatataaagtggtcatgattcctcactattcgaggcccaatgggctagtaccgttttttgtgaagcccaaactgttttacaaagacatgaatcaatacgcaccgtatgggtatatatatatacaagcaacgttatcacaggtcctcaaagtttgcatctttacttgggttgtgtctggaatcaattacttcctaaaggtaattttattggtcgggcagctcaatcggtggtttctgagttcttattcttctctgataatctcaagacgagcttttaattttgtaaagtttttagctttggtattgtttgtatcgatcccactctcaacttttgatcggaatcttctgttctggggatttccggtgaattgtttaggaataggtttccaaggatcttacttgggtttgtttcaaaaggtgggattttgcaagttgtagatggttcttcgattttgtaggtttctattcttctgctgagattcgaaattgaggtcttaggtttttgataatagcttgtttagttatctgttaaagtcactaactttgatgttccttccggtcggaattgttggccacaattgattattgaaacccttaaattaaagagtgccctctttttctcttttatgatttggatctcttgtaattgacttgtgtgaggtttctttttctgtaggttgccatttgttaacttactctgttagtctactaccaccaataactatggtaagtgtattcaaagctttcctttttaaccgttagtcttcactctagcttttatatctcgcacccttggtttgtttgtctaaacctttggaatttaaactcg

SEQ ID NO: 10399 - DNA, 3000 bp, Unknown
  misc_feature (1)..( 3000): cDNA_ID_3036249_gDNA_ID_2213647_Annot_ID_181501 3000 nt of promoter + ATG
ggaagaagaaaaagtgatggtcgagtgagttctgtatccattgaggatgtgagggatgtcgaggagctacaagctgttgatgcgtttcgacagtcgttgttaatggacgagttgcttcctgatagacacgatgattatcatatgatgttgaggttcttgaaagcgaggaaatttgatgttgagaaagctaaacaaatgtgggctgatatgattcaatggaggaaagagtttggtactgacactattattcaggtatgctattaaatagaagatagtagtttaaaccattgttgtctgtttttgtaacgttttatttctctcgttaggattttgatttcgaagagattaatgaagttttgaaacattacccacaatgttatcacggtgttgacaaagaaggtagacctatttacattgaaaggctagggaaagttgatcctaacagactcatgcaagttacaagcatggatcgatatgtaagatatcatgtaaaggagtttgagaggagctttatgatcaagtttccttcctgcactatttctgcaaagaggcatattgattcaagtacaactattcttgatgttcaaggagtggtaagtattttctacagttcatgatattagttgtgaaatgagtttttttctcatgtgtttatataacttcatattcagggattgaaaaactttaacaagtctgctcgagatcttatcacacgattacaaaagattgatggagacaattatcctgaggtattagttaattggagcttctaatacttgatctcaggtatcaaatgctaatcttggctttgtggtatttcatgcagactctccaccaaatgtttattatcaatgcagggcctggatttaggctactctggaacactgtcaagagctttcttgaccctaagacatctgctaaaattcatgtatgagagatctaagttatatctctatttaaaagtcttgtctttgattatatagaattcaatatggactattctattgtttatgtaggtactcggatacaagtatctaagcaaattgcttgaagtcattgatgtcaagtatgtgaaccttgacccacccttatttgatctgttctatcgaaagctgcacgtttttttgtttttgcttatgttcaaaatggtctgcacttttttatagcgagttgcctgagttcttgggaggtgcatgtacttgcgcagatcaaggcggttgcatgctttctgacaagggaccttggaaaaacccggaaattgtgaaggtcatttacttagactaatctctttttggattctatttgtatcatccaagttggaatctgagacatttggttttcttctcattatttcagatggtgcttcatggaggagcacatcgagcgaggcaggtggtgaaagtgttgaacagcgaagggaaagtcattgcttatgcaaaaccttcatatacatgggtacgtagttattaaatcctataactagtcaatctttaacttgtggctgaccatattgtgcctaaactctgctctgtcataaacatagataaagggaagtgacacatccactgcagagtcaggatctgacgctgaagatatcggttctccgaaggctataaagagtttctctcatctccgcttgacacctgttcgtgaggaggtaacttttttctctttctttctatcttctagttggggaagtagtagatgtttatcctgaggctttgcaggcaaagatagctggtgaaacaagcttggctggtagttttccgggttatgacgagtatgtacctatggtggacaaagccgttgacgccacctggaaggtgaaacccgccatccagagagttgcctcaagaggttagttagttagctgctatatgctttacgtaccagtaggctccggtttagaaccaaatactgaaggaaaagaatttaacctaatccttgtttacataggatttattttcttattaggattgttttggagttggttataaaaacagagtttttttggtctttctttgtttggtgatcttaactcttatctgtttccttcaggagctttaatgtctcccaccgttccaaaagatcatgaaggcatcaaggctcgagtcctagtaatgttcatggcattcttgatggcggttttcacattcttccgcactgtaacaaagaaacttccagcgactactacttcttccccagcagaaacccaaggaaacgcaatagaacttggttctaacggtgaaggagttaaagaggagtgtcgtcctccttctcctgtaccagacctcacggaaactgatctactaaactgtgtgacgaagaaactgacagagctggaaggtaaaatcggaacgctccaatcaaagccaaatgagatgccatacgagaaagaagaactgttaaacgcagccgtctgcagagtagacgcacttgaagcagagctcatagctactaaaaaggccctttacgaagctttgatgagacaggaagagttacttgcttacattgatcgtcaagaagaagctcagttccagaagatgaagaagaagaagaagaaacatctcttttgcttctgaagcaaagccaagaaaaaccagcaccaggcatcaaaatctccctctttcgtaattcgctgttcttaagtataaacaacaaaacaaaacaaaaactcttatatctgatttgatgttaaagctaatacagagagctctgtttccttctgtgattatgagccactttatattatatgttttatttttataatcataaaaaaatctgtaactgtaaacttgttaatgcaaaacgaaaaaagagtatcgaaattattaatcaggattctgtttttttttaggattttgtttttatccagatacaagatattgtagccacatatcccatatagtgattatctcttaacgtatctcaaaagtttttgcatttttctttacttcatattttgtttttgtaagatcaatcagtttttatgaagagaaa

SEQ ID NO: 10400 - DNA, 3000 bp, Unknown
  misc_feature (1)..( 3000): cDNA_ID_3036252_gDNA_ID_2213647_Annot_ID_181500 3000 nt of promoter + ATG
aaacgtactgatgatcgtgcagaaatgtaaatgggggcaacaatatctctcgattctacttcaggtttgttgttttatacgacgcgcaagagtttacggttttggtttttgataccagcatcacaacgaagtagatttgatagagatagtcgaaacgtgtgaccgtgtccgtgacgtacacatctctctatataattaatacacacgtgtccgagaatgttacgactcaaccgtgttcgagggaagaaaaaaaatatatatatctttttagggagcgagtccatggagtatcgaaccctgctcttcagagccaaaagaatagtgtctgaaccactaggctgtgagtaactttttgcaatttaaaaatcaactctttgcttagatctgatctcttcgaccatcggaagttgaaaccctagtttctttgcgagggtaaacccagaatacatctaagagccaaggaaggtaatgtattcatttttcaacttatcttgtttgtatttggaagaaaagtgagagttctagtcttctagatgttttatattgttcttcatttactcaattttttcacgcagtgcaaacattattctcaagatgacacagagaacttcgagtcagatgagtacagagaaaaccaagaaagtagcagagttaaaccagactcaccggttaactatcaaacctacttgcagtattgtttgtttgaaaagctgcatgcgatcattcatcttaattgttcggtttcttactcctctgcaaatcatacttattaccataacgtgatctagaagtttcaacaagaggctgatgcatagaaagctgatgaagaagctgaaactgcgggtaatgtaagaagtcactgctttgctcattttatcatatgctttagtgatgaacctcctttttgtaaaatcatatttgtttgtccggttctgtttgtgcatgtatattcagcaactacgatttgtcgatttaacctgaaaatttgattttttggcctggttttgtttcaaccaactggattagtttactcaaaattcatttcagaaaatgatcatttaaatgttgtggttcttgcaggcgaaatgcgaggaaacgcaggtgcgaggtgtgttgctcaagtagaaaccgagaacggtccaagatcagaccgtacagagttccaacggtggattatttagcaagacaaattctgggcttctttttgattatttagcaagacaaattctgattttcaagacttgatctagaatgtaattactattttttgtccaactggatgcattttgtgggttacattattgtattgaaataaaatatagtgtggttatgttgaaaaatgattagagcaatgattgattaaaaattctactaccagaacgaacgtactaaccaatcataacacaactgatcattacgaagtctaaaccgaaagtcaatatttcgtgctgttcagattcaattaatgaaacttgtctaattttcttttgtcaaaattcactatctgttgatttctgtaatataaaaatggatatatattgtgaaagtaaaacaaattaagtaataaatatattcgaactagaaatgggaaggcctaacgaccgttgaccctccctttaattgctccgtatttaattgatttttcttctaatcttgttatcatcctccgctatccgccacgtgttgtatgggtcccacggtacgggcaatgagagaaactacactttgctccctattttaattaataattcacattttgctacacaacatcttctaattgtcaaaactcaaaactaacaatcatggtcatttaaaacaagctatatacatttttcaaatctgtatttcaaaaaatcaaataaaaatcatcttaagtcactaacctatgtgattaatcaaagtggagtaaaattttccgaaataacatttgcaaaaaattgttgaaatctaaattgacaatagttataataaaatatccaaaattaagtggggtcatattgtaaagaatatttcattttccacctcctgttttgacgtttctcttcttttttttccaacaaaaaaaacaaaagcaattaaatagtgtttgtcgtttagttggcggaattctctcagttgaattttgttataaaaatcttacaggtatacaggtctactgtccatagatccgttaaaagttttacctacggccattaatgaccgtccgatcttcctttgttgatgatgacgaggaccaactatctctgcactttctcggtttctccttatttaactacttttaatattactccaaattcacaccccataattatgcttctttttgcatatttgatcaaaaactagttctagtgacagaattaacctcaatttccgtaaaccaagttttaatatatatcaaatgcaatactcgatatcacacattattcactaaatgtgggagactttcatattttttgttttgtcacacactataatatgaagaatgaaagtaacatgatatttttgttctaggtgtaatttaatttccaaaacattaaaaattcctgacacaaaatactgtaccaccgtcaatttggggggtagattgaaagaaaataaagtgtggggctcacagataaaaacgaatgtaacagttggggtctcattaaatagcggtgcaaatacaaacttctctataacaaaaatctactactattaaaaaataattaaattcgagaggcagtttaggtgagaagaaactgagaaagttcggtccgaattctaatcccacttttgtctctcaatttgtttcccctttctctctctctctctccttcaaatttttttagcgatttttctgggtttcatgtaaatgtgagaagtagatagattctcaacaagaaaaaaaggttttttttttttttttttttggattcgtggatcagccatcttctcgaaagatttgggaaagatccaaagaatcacaatattttttcgatatttagtcgaaaggaatttaac

SEQ ID NO: 10401 - DNA, 3000 bp, Unknown
  misc_feature (1)..( 3000): cDNA_ID_3036259_gDNA_ID_2213647_Annot_ID_181497 3000 nt of promoter + ATG
gctttaagttataatgtaaattttatattgtgaatatcctttctttgcttgctcttcaggcaaggaaagttcatccagacaagaaccctggagaccctcaagctgctaaaaactttcaggtgttttgtcatattgttactgtttctttccagggtctttatatgttgttttactggaatcacatcaaattgctgatgacgtctctcatttgttgattttcatgaatgaaaaaggttttaggtgaggcttatcaggttctaagcaatccggataagcgagcagcttatgacaaatatggcaaagaaggggtccaacagtatgttttgtcctctctgtttacaactttgcatctccaacttcggtttgtgattgatttttcatttgcagggatgcaatggttgatcctgcagctgtatttggtatgcttttcggaagcgaagtctttgaagaatacgttggccagcttgcacttgcttatttggcatctatcgaagctgacttagaatcacatgaccctgaaatcagaaagcaaatgcttcaagacaagatcaaagtacattgtttatttatcgttctattttaacacatgtcgatgttttttagctacttttctccatatattaacgtgggatttgtgtgcaggctcttcaaaaggagagggaagacaagctcgccgctacattgaaaaacaaacttgaaccctttgtggaaagacaaacagatgaatttatcgaatgggcaaacgaagaggcaaagcggctttcttctgccggtaagttttgcatttaagctatagaggaaagtctttcaatgtatatatataaactagaaagatttacatcttcttgctctggatgtttaaggttttggcgaggcaatgatgcatactattggttacatttacacaagaaaagctgctaaagaaatcgggaaagacaagcgatatatgaaagtaccattcttagctgaatgggtgcgtgacaaaggccaccatatgaaatctcaagtgatggctgcttctggtatgaaacaaagctaaatataaaccaaaatgttttggttttctaacttaaacaaaatccttactaattgctttggatgattttgttttggatctgtaggtgcggtttcgttacttcagttgcaggatgaagtaaacaagttgaatgaacaccaaggagagaacaaagaggaacatattcagaaagctattgaagctaaaatggatgctttgcttcaatctctttggcaaatcaatgttctcgacatcgaatccacgctatctcgtgtttgccaatctgtaagatactatgcttcatcatacattatatgaccatttcttttgtagcaacaatcgacgaattaatcttgttgttaattatatatgtatctttctctcacaggtgcttaaagatccaagtgtttcgaaggatgttcttcgagctcgtgccataggactgaagaaacttggaacgatcttccaggtgagcaagaagaacaaaagggttcgtatcataacataaaagaaacactcattgtgtttagatttaagatgtcgagagccaaaaaaaaaactttttgaaaaaaacatgtaactcaaaaccttagtgaatttctctgttctttttctttgaagggtgctaagaagccgtacacgagaggaagcagcttgcgtcgggaagccaccaccgtgaaaatggacaccggaggttcttcaaaggcgacgtcttgaaactccggaacttaaaatgctgtttcttttattggttgaagttggatttgtccttcgttttttactttccccagttttgtagagattgctttctatgttaacttttttttcgtgtagatgttacatttaaggtggtgcattactgcattctcattaaaatcttttcgtcacattattcaaatttcttatacattcagagctagtgatgaaatgatctaaggaacaaaatttacaatttactttcggtaaagaaaaaataatagtgaatagtaatattgtatgtatttgggcgtgtttgaatcgcgtttttattccctttccatctttccgcgttgtgatcgttttaacatgacgtgccatcgttagcctaattccgctaaaactaacgacaacagaccaaaacaagttaaaatgcagtgtttggttctattaaaccgaatactaatcaaaccggtctgctgacactcgacatttcatttggtacggtttatgggtcctcaacctaaaccacacgccaatcggaacggtttatgggtctttaaccggtacaagccaatgggagtctaacggcgttaaacaaaaccggtcagagaagacttttattcgtctctttccttcacaaggaaaaaaaaagagagagagaacgaagcaaaaaacctcgctcgctagctatgtgaagaaactatcttcgttataaaactttccggcgacgttttccgacttccgagagcaggttcggtgttcatcacttgtcctctcacatgcttaattcttttcgattttgttatttagttttttttttagtttctattttgggtaatctcgacttggtttgcaagtcccttggccataatatcggatctgtttaatgttagttatgtagatattgcccgattcaatttctatttttagtgcctttgagaagatttttcattttggattttcttagtgaagaatagtcatcacagttcactcacctacatgttagtcagcaatggattactggatttgattctctctttattttcattctactttgaacttcatttatcttggccatggccagtttaagttattgtgtagattaatggtaagctcttttttttagtgttattgttgaggttatagtcataattgattctgattgagttcttaaaattgtgtttttttttgttggaaggttttgaggtggttttatgcgccaaaacatctaaccggagtgtcgttgtacggtgcttagtagttttcaataacacgcttcagttatg

SEQ ID NO: 10402 - DNA, 3000 bp, Unknown
  misc_feature (1)..( 3000): cDNA_ID_3036266_gDNA_ID_2213647_Annot_ID_181494 3000 nt of promoter + ATG
ggcttgaattccagatatattcaccaacagcgtgcctataaaatgcaaacatataccacattttatttagtctcttagattgatttaatcaatatatatatagagagagagagagaagctaacatgaaagacaaagaacgaaaacgatgaagattgtagtttttgatgcggccatgtctttagcttgaaatatttggatatgaggattatttatggtttagagtttataaaacacgttatgatatctgtatgtggtggtttggatgcttatatattgtgccttggagcatgaaattggtaatttaattaatacataatagaactttgacaaataagattttggcaattaatttattagtgaagactgaagactacgaaggagaaagttaggaataatttactttcctatgatcttatactatttaaaataatattttatgtaattccttctcattcataatttgttataccatttggaagtaatatttgatatatatgagatttacataatttatccacctcatttggaatcatatcacaaaaatatttttcaccaaatttgacaaggaacaaaaagaaacaatattctttccttttataaaaaatgtaatattaatttatttaacaaaatggattatttacaagaaaatatacaaatttcacgaaataaaagaaatatttcttataaattccatgaaatttgtttttttttgtaaataaaccattttgtaaaattaattaatattacattttttaaaaagtaacaaaggttttattccctgtagtttgttctatttcatttctcttcattctttcttctttttgttcctattattttaggagttattattaaaaataggcatttgttgggttggaaattagagattaggaaattttgtaatgctttacagaattaaacatttctggttttgtgtcttgacaattttacccttcattccactagagcgaataatgaaaatttaacttagctttctaatgactgaagtgaatgccaataattgtagatcgattatgtgctaggatttgttgctgttgggattagtggacaagattaattttcatttacaatggatatgtttaagctacgaagttgttgtgtacaattgtagatttttgaaactgtaaaacaagattagaaaagaagaacatcacaggagaaacctgattgaggtcacaatattacaaaatttacaacttttgcagaaacgaatattggtttgggtgtatacaccaccgagacattagtagtatttggttcatgaaatgaaatcatttttttttttttttgaataccagagattctgggtcaaagtccgtaatcctcccaaatctgaaaccacagcatataatattagtttagtctcaagcgtcactcgaaccggcaacctctaagcttcacctagggtttttaccaattaagctaacgatatttggtataaatgaattcttttttagttacactcagatggatactaggctttacagacaaagaagtcgagagtgcacaagcaccaatcctactaaatccattttgatcacttcacaacatgatatcaagtgaaatggatattatttatgaggaagtgtaatttaataatctaggttacacctatgtgtatataatgcaacaaacaatcaattagtaaaactacaccccaaagcgaattacaagatcaacacaaagagtcacataaatgtgcattcaagaaatgacaataaacactaaggtcttgaatatgggagaacccaattagacgagataaaatgcaagccaataacaggtaattaggactacaaaacaaagagataaaatgcataacatgattcaaaattggaaactaaattgaacaatcaatgagctaactagggctattagagtaatcaacacaagagaatgcatcaaggtaaagaaggagaatcaagcacatacattagtcgtatgtgactaacgaccaatgaattagtgaaactaaaccctaaagtcaattacaagtatcatcccgagggaattacataaacacctattgaagaaaggaaatactaaagaccagagaacccaatgggcatgataaaacacaaggcaaagagctctaagtatcatgacagagaagaagaggtaacacaccgaattcaacacacaatgaagaaagaacattacaccatgagagacgtacgatgcttccattcagtatccattgtaggaattcatcaaaccagagaaagcattacttgaatatacattccatcaaccaagcaaaaagtcgtgactgaaataaactacaaattcaacaaaacaaacgtgttttgtttttatcaaaacgtcattgtctagatttattgaattaagctttaactcttagcaaatgattgagatagtttaaacaaatatcaagaacttaacctaacgtaagctataaactctatataaaaaaatccatcagtagagatagtttataaaatttgaaaagaaaaaaattaaaaggcttgagtccgatcaaactactaattaaaagccatcactaaattgagcaagaaggtgtaaagacatttatatgaaaaaaaatatatatctttttaattaatgtttttcaaacataagtttacataaaaaataaaaattcactcgaatcaaaattttgttttgactcgaatcgaattgaattaaaaaagtcaactacactaaatattcgaaagaggaaactaacaagtttacacacaaaaaagcccacgtgactcttttttctccaagagacgtctcttttcctcttctctcctttgttctttcttccaaatttcccaaatccctccacaataaaccctagaaaatcaaaattcgctactatttctctgttccctaatttctttcgatttcaattcattagtcctaaaaagctttaatttttctaatcccccagttctccttcttctgcttctgaatcgtcgtttaacgtattgctccgtcttttcactttctccgcc

SEQ ID NO: 10403 - DNA, 3000 bp, Unknown
  misc_feature (1)..( 3000): cDNA_ID_3036280_gDNA_ID_2213647_Annot_ID_181490 3000 nt of promoter + ATG
ggtaaagtaattgcatttttagttccttttttatgatataaataaatgagtcaagaacatcattttctatatcaaaaagtttttgttttctctgattcttgataacaaacacattccaaacaaaactaagaaaaatttctgaatcttctgcttgattcaatggatgctaatcaacaaaatccacaaaagaaaggtatggatcattgttatccaatgttatatgaattcatacacaacacacacacacacacacattgtttgctgcaaatgcagatctgattttgtttcttctttatagatatatttatgatcttgtgtctacatacaatattctccattctttttaaagaatgtcctttttcttattattgtttttcaaaaagtattagaaataaagagatgttcttatttgtataatccccttcttttttgtttttcatcaccaatgtgaatcttaattagactcttattcataaatcatctatacaatatggatcttaaatttttatattggaagagtagaagggataacatgaaaaaaaaaatagtacttgtagatgtgtaagagcccatctcaattgatttgaagaagaagcatgtttcatgttctttctttttgtacatcatgtttatggtctttcgaaattgaccatagttcatgttatacaaattatcgaataatatgttagatgatacaaacataacggtattttaaatattcccgcgaaaaccaatctacttaaggtcttctatattttctttttttggatttgtttgaataaatgaaaaaaatatttttggtgtaaatgtttgattccttttgtttatgcttctaatttttactcgtgattgatgatgaacagcttggcctccaaatccacttagcaagagcattactcaaggagatcttgccaagcgccttgacccattctatctacctaatctctttgatgggtttgaagatagtaaatacggattgcttgttgatgatgttgtgagactttgtaagctgaaacgtgactactcgagtggttatatctcgctggcagatattgaagctagagaagagaaaaaaccagccaagtctgctaatattattattagcgaaccaaccaagtctactaatattattatcagcgaaccagccaagtctgctgatattattatcatcgattcagatgatgtgttgcctcaagaatcagttattgtaagcttttaacgtttgttgattaatttgatttcatcttttgtttagtaaatacttataatcacgttttgcattatttttcagcctccagatgataaacgatcgaagaagctcaaggaagtgattgttgtggatgatgatgagccttggttttatgctaatgataagttgactataggctcggcttctactagtaatgctgttcgaaacagttcttatgatgttgtgatgtatggaaatagctcaggatgtcttcaagaaggttgtgttggggagggttcatcgaggaattctattgataatgacaatcaaactcctctatatgtagaggcaaaaaaataagaagaacattagaggcagatggattttgctcaagaatcaattatggttacttcttttacattttaattcagtcaatcacatagctctctttgcatatatagattagagttcttgaatatctggttagagtttccggctgactttttttgcatatgttcttggttaggtaacagtggaggatttaccaagtaatgatcacaaacaagttgaagaatgaagaagtttttttttttttggttgttgtcgtctgatgcactttcttaatattatttcctataattaaatataatttgaatatatttgtattcaacgagcaattcttgctttattaaataaaagtataattttaattttatactagctgttgaaaaaataaaatagtattaccatattgacgagtctatattaggtaaataagtatgaaaattggaaaatgactagtgatgtttgaataatttgccaaaacaatttcaaaacttaataggattgagtgtttgactaagggtgttttttttgggttaaaatttgactaaggttaaatttgatatgtataattaaaaaatatataatctatgtgaaggtgaagaacatatctaaccagatattaaggacatatatgtgaaggtgaaactatttgtcactttatgtgaaaatattccaaaattgaccataaacatgattcaaatatatcaaataaaaataattaatatgctaggttatatatatacataacggtattttaaatcttcccacaaaaactaattatttaaaggcgttcattttttttttttattagctttttatagagatcgaaacggttagttagtttcttctttaccgtcaaaatttaaaactttttgatttagggaatccctaatacaccaattgaagtattagcacataatcattttttttattggatgtccccgaaagaacgacactgaatcatgtaacaccaatttgtaaaaagattagcacatgtatgtatatagatcattttttttgtccaaggtatatagctcatttctattcaaacatagaaaaatatgtaagagagatagacataaccatgtgtccaccaaaatatgagtacactaagcataagtttgaagaacacattcatatatatcttacacacaaagatacagtagagtagagagcaagttgaagtgtatagatattatagatgtagatatatagttttgtcttattgactttccgaaaccgtcattgttcttgtctctctcctttgccactttgccaccatgactaattactattatgggaaacaaaaagacgcttcagtttttccagaaaaaaagtagatctatttgtcttctttgcttgaaatctctctgattcatgcataaagcttgcatctttctagtctttaacatgtttggagtcgtagttttgatttaaggagctctgtttagcgaagatcaaacatg

SEQ ID NO: 10404 - DNA, 3000 bp, Unknown
  misc_feature (1)..( 3000): cDNA_ID_1808761_gDNA_ID_2213647_Annot_ID_181488 3000 nt of promoter + ATG
gcattttcaggcaattaaaaagttcaatgggcacatgtttggtaaaaggcctatagctgtagactgggcggtacctaaaaatatttacaatggtgctgctgatgccactactgcttcagcagatggtatgttaccgtattgtttttccttttatcactggagtttttaaaaacttgttaattataaacaatttttttactcaacttgtaaatgagggaaacagatacagtcagtggccgaagttttgttttatctcctcctaacagatcgtcatactttttgacgcgatccttggcaggtgacaaagaaggaagtgatggggacagtgaaaacagtagtgttgatttggaggaggttgatgaagctgtagaaagccaccctcctccaggagatgatactgatgatgatgaggacggcagtaacaaactgactgaatcagatgcactggacaaagatgttgggaccgatatgaactttgaagatgaagcagatgttgccagaaaggttcttaagaacttgcttgcttcttcaaaaggttctactgctacacctgagggagagacagaggaatcggataaaagtaaactgaaaagttcatcaactaagccagttgctgactcttctggtgtatctgaacctttgaaatccggtaaaactaaagtggtggctcctaaagagacgcaggataatgatgattttgagagaactttatttataagaaacctcccatttgatgttactaaggaagaagtcaaacagaggtttacagtatttggggaagttgaatctttatccctggttctccacaaggtcacaaagtatgtatccttatatactttgaaattcattcaatcatcaaaaaatttccaagctcccaaagctttacattttttctccctgtgttttctttctcagacggccagaagggactgcttttgtcaagttcaaaacagcagatgcatcagttgcagccatttcagctgccgatactgcctcaggtgtcggtgtccttcttaaaggcaggcaactaaacgttatgagagctgtgggtaagaaagctgcaaaggacatagaactcaaaaagacagaggagaagaatgttgaccatcggaatctttatcttgctaaagtacacacttctccctctccctcacaaatactgggaaattgtattatctgcctgcttttcaaatacgaactaatatatcatcctgttttgacttccacaggaaggtcagatccttgatgatacacctgctgctgagggtgtgtctgcggaagatatggacaagcgacgaaggtaaacttttcttactttctcagatatgcatgttactgtctagtgctttgggatgagagaagagtgagcatgtgattgtcctcgcagattgcatgaaaacaagatgaaaatgcttcagtctcctaacttccatgtatctcggacaaggcttgtgatttataatttgcccaagtccatgaatccaaagcaactaaacaggctcttagttgatgctgttacctcacgagctacaaagcagaagccgtgtattcgacaggtcagctattcgcctttgtgctacaattcaaacatagttctattatctgaacctagtttctttgttttctacgcagatcaagttcttacaaaatgagaagaaaggtaaagttgatactaagaactactcccgtggagttgcctttgttgagttcacggagcatgaacatgctcttgtagccctgagagtacttaacaacaatcctggtaattgatcttgctgaaagctaaatttccttcgaaattcaagtacttttttccaaatgatatgctatttgatgattttatggttatctcaccaatcggatgagacatgtatcactttagcttacgatttaggatgcaatgtccaagaataataattttcatgttatggtaatcgttttggttatctctgcagagacatttggtcctcaacaccgccctgtcatagaatttgctgttgataatgtccagaagctgaagatacgagaagctaagcagcagcagtttcagcaacgcgagaaacacaatgaatctgatcagcagcaggcgaacggcgaagcacaggcacctgacaataaatacaaacgaaaaacgagggaaggggataacactggtccaaggaaagagaatgcagccaggtttaagaagggaccacgtgaagagagtaaagaagaagcaaaatccaatatagcagtaaaagataatgcagcagagaagaagagacctatacgcacacaggaaaaaccgtcttcaaacaagaaaggccaattgatgagacagaaagagacaactgagaaaccagatccgaaaatttccaaagatttgagcgaaccaaggaagaggaagttcggggaggatagaggtgaagagaatagaaatgggcagaggaagaggaagaagcaaggtcaaggtcaaggtggtgcagaagttgtggacaaacttgatctgttgattgagaaatacaggtctaagttctcgcagagctcagccaaaaccggcccacaaaaacagagttccggtcaagtcaggaggtggttcgaatcttgagacttgaatcaaacaaatgtaagttttgatatttttaagtttccttgtatctgttttttgattctgtctgaaaaatctccgaagtagtgaatgctgcgaacacaaccttgttttgtatttgtatcgtcaaaactagaccgaacttgaaccttaacaaaacagaatttattgttttgaaccgaaccggttttgtcgacatagttagataaagcctataacggttatttacctaactaccgaagactccgtaggcgtgtgccaactaaacatcacaactacaggtcatacatttccacgtgtcaaattatcattggttccaaaccgtccgattttttcgatttcgtcttcgaatatttttttatttaatccctcagctctgttttcttctctccataattttttaaaaagtcatg

SEQ ID NO: 10405 - DNA, 3000 bp, Unknown
  misc_feature (1)..( 3000): cDNA_ID_3036307_gDNA_ID_2213647_Annot_ID_181481 3000 nt of promoter + ATG
ttttgttgttttcagaaagttatgagattgatgacacaatgcaatgagaagagctttgagctggaggtaaaatgtctctctagaatgaaatgtcttcttctatagcgaatatggaagatttctcaagtcaatatatatatttaaatgtgttctacctatggatcagattatatcagcagataatcgtattctccaagaacaactacagacaaaggtcacttctaagtcacggactccttttattcttttattcttttttatttttcatatacagcattttcttgtggctattatctcagtcatccttacttatatacacatgctctaacaactgcagtgtaccgagaacaatgaattgcacgaaaaggtgcatcttctagagcaacgattatcgagtcagaaggccacactgtcttgttgtgatgttgtgactgaagagtatgtagatgagctgaaaaagaaagtacagtctcaggtaatttctcaaaatctcaaccaattttgtcaaatttgcgaccatgcattctcacaagtatgcctgaatcctgataaatatcttcactggttgcgaggagattgtgaaaacacatataatgatatatatgtttaatggacctctcattgtatttacatgagcgtttgatgttttcatacttcaggagattgagaacgaaaagttgaagctagagcatgtgcagagtgtggaggagaagagtggattacgagtgcaaaatcaaaaattagctgaagaagcttcatatgcaaaagaattggcctctgcagctgctattgagctgaagaatctagctgatgaagttacaaagctctcgcttcaaaacgcaaagctagaaaaagaattagtagctgcaagagacttggcagcggcagctcagaagcgtaacaacaactccatgaacagcgcagcgaaccgtaatggaacaaggccagggagaaaggcaaggatctcagactcatggaacctcaaccaagaaaatctcacaatggaattgcaggcaaggaaacagcgagaagcagtacttgaggctgcactagctgagaaagaatacatagaagaagagtttaggaaaaaagctgaagaagcaaagagaagagaagaggcccttgaaaacgatttagccaacatgtgggtgcttgttgccaagttgaagaaagccaatagtggcgccttgtcaatacaaaagagtgacgaagcagagcctgcaaaggaagatgaagtgacagagttagataataagaatgaacaaaatgcaatcttgaaagagaggcaactcgtgaatggacatgaagaagtaatagttgccaaggctgaagagacaccaaaggaggaacctcttgttgctcgtcttaaggtaaaccttttacaaatttgctttctattttctttcagcattcttagttttctataagcctactccacagtctagcggtaggcaaatctagatatccattacctgttcgctccatatcctttatgccatgaccttcggatcaggcaacatatattaaaaccttcaaaacacccagaatatatggttcaaaatatgtaaatagctttacctgatccaatatattctaatatcatgtcctcctatctataatacaagtgactgttacggataattaagtcaagctacttgtgggtattgaatatttatctggtttttcggggacatggaacttgtgtacccatgtgtgagcttctatcttgtacgggtaatgaaaatcatgaatcatcatctcacacgttcaaacaatatgagctttaataaataaaaaaactacttgttttcttgttctgcatttgatgctttatatacataacaggcaagaatgcaagagatgaaagagaaagagatgaaatctcaggcggctgcagcagctaatgctgatgcaaactcacatatatgtaaagtctgttttgagtcgccgaccgccacaattctcctcccttgccgtcatttctgccgtaagtctcactctcacattacctgaggatccttcattaagtactaagtaatcctaaaacgatcacaatctctccttttatgcagtctgtaaatcttgttcacttgcctgctctgagtgcccaatctgccgaaccaagatctctgatcgcctgttcgccttcccgtcttgacctgcggcaagtatagtcactctcctacacacagtataaggtaattccaatatttcccaccttcacaaaatctttaaaatccaaattctttagttcaaaaacattaggcaatctttttattgaaagacaattgtatgtgattttgcaggtataaagaactatatggaagtctgtttgtttgctaacattttccagaacggcaggctcgaattcttttattacaagttgttttttgttttcttgtatgtaatgtctttgttatatctttctgttcaaaatgtggtaaagaaagaggaaacataacatgctaacagaaaaataggaaacatatcatagccgtttcatagtaagttcaaaatttgaagtaagtaattaaaaattattttgctaattcatgaaatttgtgtacagttttttagaaaaaacatacagttgtacaatggagaatagtgtacgaatgcaacagtgatacacaagaacaccaaactacaccaattatcatcgatgaattactgcaaaccacacaaacctttgatctcttctaacttatattgtaatttttaattttaataataatttttacttagttatatctatgctaaattcttatttttttttaagaaatttaatacataccgaatttaatacaccaataacacatgtaaatatttttggatcagagtggttgttacggcccaatggatctagtgagcctaaatgatacgaccatatattgtttttttttcggttttcgccaacgaggatttggttaccgagagtttgtttgaacggtcctcagaaattcggagcttgtagcttctcggtgcggtgccttcacttta

SEQ ID NO: 10406 - DNA, 3000 bp, Unknown
  misc_feature (1)..( 3000): cDNA_ID_3036311_gDNA_ID_2213647_Annot_ID_181480 3000 nt of promoter + ATG
gccttgtaaagctttctttcagattgcctattgatgttccaggagcttgcaccttaggtaataactgagaataaggctgacctagcaaccatgatggatatgattcactctcaggatcatagcccacctgcactcaaatccaaaataggaaagcactttgatgagtcacatttccttgtttagcagcctattaatctacactttctgcctaaatgcagtaaatacttcatggtgtgttaccttcaaggcattgttgtaatctgacactccgagtctaccgtgaagtaaccacaacaaccagtctgcctgatgcagcaataccgctgattctctgtttggcacctcagtgttccaccatgagacaagtttgcacaaggtagaagtaccagagcagactgtatggtttgctggcgctatagacttgacctctggcagagcatcagggcagctctggttgtagagataaggttgacacagaacttctccactctcactgcaacacataattgaataagcaaaggagatttaaacaacacattactgaaacatcaaatcctctaatgtaaatggaatacagaaacagaaaagagaagtgatccggtgaattacatgcctgtttaagatgagagtagttgcagaagttccatcaagcgaaatggatgagacgagggagcgaactgtgacgggaatgtcctctagcaacgaaaaaagagttgctttccatgagcttgcccaacccatgctttcttctttctatctagatttcaaaacaaatgtctcagtccatagctttctcttgattttgttcataaagcagctcagaaattgtatatgatatatatacaaggatacttaatgcaaaagttttaccatgaaaggaggatattctcttttgccttgtgctttaatctctccttgctcatcaataactgtaaatcgacctccagaagtaccaaaatccatacccagataaagtttttcatagttcgttcctttattgccactcataactctgaaatcggagtaaaatctagttctgggtagaggaacactccttgaactagagtaaaaccctgagattaacattatcataaatgattcagctcctaaaacccctaataaacgccattatatcgaaaaatcttcatgtttacctgtttgttttggagattggaagagctcaaatgaagatatctgaaattgacgaagaatcagcatctctcttttccttctgaggctgctttcttctaaactccatagataagggagctagcaagttcgtgaccgttggatttctcgattttttcctcttgatttgaatttaccattttagccttccatattatttttatttattttactccactcaacaccaagcagttgggctgcacgttctctggtcatctaacggctcagattatgggtgcggatcttcatatttggacccttgtaggcccacgaccaataatgatgacaacaatccctctctcctggcaccatattttgttccacacaagttttctttaaaaaatttacatgtaaatgctatatataccaagcaatttttgtctaattaaaaatttacagaatattgaaatcatagcactaagacgcaaaactaaaaataacaacattccatttgcatatgaaccaaatgggtcgtggtctagtggtaattcatgaagatgaaggttggttttggtgtgtcccaagtactgttgatatccttattcattaaatcggaacgtctaaaaatctgtctttggatacttgggaaaactacaaatgattttttgctgaaaacatgacttggatttcattgtgaaaagcatgcacgtgtgagccagatgtgcggtggagctcaagaagtgggagatatgacaacttctttgccactgctactttaccttcgagaagcaatcacactctatatacgtaaactacttggtattagggaataaggacccacatattcaatgtgtgtgtaacataagtgtttaatattatagaagcaagatatacgtgctcgtaataactccattttattggattactttctattttatttttatttaggttataattttgtcttttgcaatttgcaggatttattagtacaccatctatttaaggataatgtttcctttcatttagccattattaaattcagtactgaatctattcgacatgttgcagttaagtagaatctaacataatgtcgcaaatcatgttccattggaattgacgttttttaacattttgagtgacccttaagagaaattactttaaatctgttcattatttttagatttggtgttggatacaattcctaatttattttttaactgattcggttaaaaacttaaaattgaacatatttcactaggatttcattttctttggtttaggttgaaccggaacaaaaacattgaacgaattaaagggcagaaaggacaaaaacattgaaatcctccatttttactaacccatcgttcttcccgctcgttcggttcattcaatttgtttcgaaaaccttttaacccggttcgcggttattttattttaatcctcaaccacgttcgaatctattagcgacacagtaaaaacaaatatattttattaatcaaaaattcaaaatctgaaaaaaagacgctttcaccaaaaaaaaatatctccaatcgatttctctctatctctctcttcaccaccgtcgcgtgaagaagacgaaacaatcgctctctccttgtgtggtctcactatctttttctcaccttcgcgtagcttaaccatggaaaagtagagaagaagaagaaagagagaagtgagagaaagacgaagaagatgaagagcatattgctttttctgtccccagccatgtgagtttccactgacacattctctccatcttcacatttggtgtttttttcttttgcttgattctttctatcttcattttcagatttttaccgagtccgtaaccgagtttgaacgagttagtgg

SEQ ID NO: 10407 - DNA, 3000 bp, Unknown
  misc_feature (1)..( 3000): cDNA_ID_3036315_gDNA_ID_2213647_Annot_ID_181479 3000 nt of promoter + ATG
atagctgaatctctgattgtttgatggaaatccaagatgcatatgatcacgtgatgatttaagaagagatcattttggtcaatcttaatcaagatcttctctactttttatcaacacaagcatgtcaatcaaacatttatcagcaactataatcacccagtgtgtgtatgatatcgtatatctttcacatcacagtaaacgttgtataacgaaatggtgtatagcgtgtatttttccaaaacacttacatgcattgtatgtgtctttccactgcttgtaacaccataagcaaaaacggttcctgtcaaattgcaaacacagagtcagaatacttccctgcaagtaatgctactagcaaatgagttggctaaaagtatttcaatgacaaacacaactcttgtttaatcgataacacagctataagccttaccgttaacaccttccatagcagccttgactacaggtttagcagctacgtcatatacttctggagttgttgactgtggtccaaaaactttatctggcatcaacaaatatggaagaacattcattgaacaaacggaggcgaccaaatctataatcaatgaacagtaaattgaaattatctccggcaataaattgatctcaataccaaatgcgtaagctgtgaggggattgtattcattcctgaccatcttatctgcgtcaggataccaaacaatctcatctcctcgttgatactccctctcactgcaatcaaacaaataacacgggagattttcaaaattgactaagtatcaattcacatttcataaatattaaacttctaaagaagaataatcgtgaaattgtatcaaatggatctgatattccgcttccagatctaccgtacctcatcggacgaaatcgaacggtgacggagatgctatctcgctcagaggtaatcgtctgcccagactcgccaatgagcccctccgatgggtacgattgggctccataagtcccggagccgccgatgggaccggaatcggaaatggtgcgagtaatcgacatagatcgggacccggttacaccgccggaattgtaaacggtagaagtaggtgtggaagaagaacgaggtaatagacgattatttataagagacgaagaagtagacgaagccgaagagtaaggactcggaggtctacggtgcgagaaaggagaacgactcctagttctagacgacgatgaagccatccactaactcgttcaaactcggttacggactcggtaaaaatctgaaaatgaagatagaaagaatcaagcaaaagaaaaaaacaccaaatgtgaagatggagagaatgtgtcagtggaaactcacatggctggggacagaaaaagcaatatgctcttcatcttcttcgtctttctctcacttctctctttcttcttcttctctacttttccatggttaagctacgcgaaggtgagaaaaagatagtgagaccacacaaggagagagcgattgtttcgtcttcttcacgcgacggtggtgaagagagagatagagagaaatcgattggagatatttttttttggtgaaagcgtctttttttcagattttgaatttttgattaataaaatatatttgtttttactgtgtcgctaatagattcgaacgtggttgaggattaaaataaaataaccgcgaaccgggttaaaaggttttcgaaacaaattgaatgaaccgaacgagcgggaagaacgatgggttagtaaaaatggaggatttcaatgtttttgtcctttctgccctttaattcgttcaatgtttttgttccggttcaacctaaaccaaagaaaatgaaatcctagtgaaatatgttcaattttaagtttttaaccgaatcagttaaaaaataaattaggaattgtatccaacaccaaatctaaaaataatgaacagatttaaagtaatttctcttaagggtcactcaaaatgttaaaaaacgtcaattccaatggaacatgatttgcgacattatgttagattctacttaactgcaacatgtcgaatagattcagtactgaatttaataatggctaaatgaaaggaaacattatccttaaatagatggtgtactaataaatcctgcaaattgcaaaagacaaaattataacctaaataaaaataaaatagaaagtaatccaataaaatggagttattacgagcacgtatatcttgcttctataatattaaacacttatgttacacacacattgaatatgtgggtccttattccctaataccaagtagtttacgtatatagagtgtgattgcttctcgaaggtaaagtagcagtggcaaagaagttgtcatatctcccacttcttgagctccaccgcacatctggctcacacgtgcatgcttttcacaatgaaatccaagtcatgttttcagcaaaaaatcatttgtagttttcccaagtatccaaagacagatttttagacgttccgatttaatgaataaggatatcaacagtacttgggacacaccaaaaccaaccttcatcttcatgaattaccactagaccacgacccatttggttcatatgcaaatggaatgttgttatttttagttttgcgtcttagtgctatgatttcaatattctgtaaatttttaattagacaaaaattgcttggtatatatagcatttacatgtaaattttttaaagaaaacttgtgtggaacaaaatatggtgccaggagagagggattgttgtcatcattattggtcgtgggcctacaagggtccaaatatgaagatccgcacccataatctgagccgttagatgaccagagaacgtgcagcccaactgcttggtgttgagtggagtaaaataaataaaaataatatggaaggctaaaatggtaaattcaaatcaagaggaaaaaatcgagaaatccaacggtcacgaacttgctagctcccttatctatggagtttagaagaaagcagcctcagaaggaaaagagagatg

SEQ ID NO: 10408 - DNA, 3000 bp, Unknown
  misc_feature (1)..( 3000): cDNA_ID_3036327_gDNA_ID_2213647_Annot_ID_181476 3000 nt of promoter + ATG
agaaccaacaatttatgaaatcaagtcaagcaaaactcagattctatggtatatacctaaagcagcgagttcgagtgagcttccttgaccaatcaccgccgtatcaatgagactcatcaacggcccacatagccacaatcccgcggcaggtccggtaaacatgacgatctctttcatctgtccccaaatgctctgagtcgccaaatcatctaccttcacttcttctacttctgcttccacttccaccggcgaaatcgaaccatttgctgcatctccttggagctccgaaatcgacccatttccggtttctccatcaacaacaagctcctgattcgtacttgcacagtttcttaaaaacctgttcagcttcagtgatgactttggtccggaaacagcggagctcctgaaactcgggaatgaaggattccatgaccgtaaagtgagggaagatgggaatggtagctttgggttaaaggaatcgaagaaactgtaaaagttagggttttgcattgaatttgcattgtttcttgatccacaaattcaacgcaccaaacccctgaaaaagcttctcggcgttgcgttgattaactgatagaaaacaacacaactcaagtttcctgtgaactcatttactcatgtaagcattcggtctaatgattggtacacctaaccggttagtcaaattgagattttaaaagcaaagagaaccaaaataattaagaaacagaaagtgggaaaattggtaaggcaatgtgtgactgtaaaagcgttgttttcatgttggagacaaaggacaagaagatcttaatatgcatcgagtcacatatgaccctactttgtatgtttctgactaaaagtcttaaaactgtacgcaaattgcaagcaacggtttgtattcgctttcgacacttcataatttataaaccatactgaacgactctaatatgccttctcaagattagcttccaaagatatgtataagacgcattctccatttaagatgttcaaattgatgaaggaacaatgcatggtaagaatatttgccacttgatcatttagtccgcagtccgcacatgaattgcatctttagaagcagcactttgtccaacctttcaatggtgtagtaataaatatctcataataatgcaaagaatctctaaataaattaataatatctttcagtttctttcatactatgtattaaattttttatcatctcgatataatatttgtatattcaaattaaaattgattttctttttataatttagatttaaaactaatataaattattcttaaaactaaaataaatataataggttcggttattgaatttgagagacaattttgctacaatctttgtcccatctctatggatatgagaaaagttcccccctctaggaaaactgttcagtcacattccatctattcgctttgagttcatactttttcgctatattacaacacaattagtccaaattaaattcatataaaaagtgatgtcatcaaaactatattaataagttgcttcatcaaaatctagtagtatctaagagaatccccatcagtggaatgactcaaaaagttttttatcagaattatattaataatttattatataataaaatttatttattttaaaagaactaaatcattaatcatgtgacccttgtttggagaggttctagaggtatctcatttaagagagtctctctcactctctctacaactttttttcttttcaaatttttattagcttagatatccatctaaaacctatcgatagaagtgctctaataaagacttccgaattgaaataccaagctctaaactataaagctaaaatatatttgatgtatcatcatcaacttgtcttcacttatgacttgtcttgacttgtaaacttgagtttaggagtgcgcattccgagttactatttggtttttatagttttctagttttaaaatagtatgtagtagttaagtttggcagttgcacccaaaaaaaaaatagtttccttagcttatggtttatgggtttttacaaaaaaaaatgaaatcattttaaaacaatgtaattcggtttgattttggttttttcggtttattcctttcattttacaaagaaaaaaaaacaattttgatgcattacaaaaacacacattcactttaaagatgtaagacaattcgcaagtattgaaagaaaaataagaaacaacatatattcttgttacggacaaaatatttaacgagatcaaaagaagtaatagataactatgccaaggcgtaaaacaactaaaaattgagagaaatctatcacaaattcaaattcaaagagtaaatgaatatatttttttctcacgagtgtgtagaaaatctctccctaaaactcgagagtctccgttagtcaaatagctagtttgaacgccattataaatgtgatatctccaagttactttgaatgaataacgtacacctaagaaatgatagtaccacatcttcgccataaggcacaagaattaacgtgggagttgacatggcatgccttgaaccgttgatgtagacttcacaatatctgatgataatctccaaacataacctcagccttaaaaacctgtgagaactcctcaccacctcacaaactaatctctcattgtaatttttgttatctatagttttttagatgaattttgttgggaattgtcgatttctcttatgctcggattgctaaataattttttttattttttttaatggtttgattctataattctgagaggtttttatcatatggtttagtcttttttggcattttatctgaaaatattatcatcatccacgtggcaaatcctcgtcagccggctcacgagaacctcaattatccaatctttgtatgtcacttgagtctctatatatcaaaccaccgaaaagcacgattgtttatcgtagtgcgttacaagcgttttaagctctcactagcaagcaagtactagcaacaatg

SEQ ID NO: 10409 - DNA, 3000 bp, Unknown
  misc_feature (1)..( 3000): cDNA_ID_3036331_gDNA_ID_2213647_Annot_ID_181475 3000 nt of promoter + ATG
tcaaaagatgaatcaaagatatggcacagcagattatgccatatgagtcagagaaatattgatgtgttgatcaagaaaggatgccttcaagctgaaaagataaatggtctcgagttttgtgaagactgtgtgtacgggaaaacacatagagttggttttgggtctgcaaaacatgtcacaagagagaaacttgagtacattcactcggatctttggggagcgccatcagtaccaaactcactaggtaattgtcagtactttatcacgtttattgatgaccttacaagaaaagtatggatttattttctgaagaagaaagaacatttcttctcttgtatgttgatgatatgttgatcatatcaaagaacaaggaaacagtcaaggaattaaaggaaagactgagttcagagtttgaaatgaaggatttggggcctgcaaggaaaattctgggaatggagataacaagaaaccgagaagaaaatattttggagttatctcagagaagttatctgcaaaaggtgttaaagacattcagaatggatgaatgcaagcctgttaaaacaccattggcaccacatatgaagtttgtagcagcaacagagactgaagcagaggagcaagctgatcaaatgaagtctataccttatgcaaatgcagtgggaagcataatgtattctatgatcgggtcaaggcctgaccttgctcatcctgttggagtcataagtaggtttatgagtaaaccattgatgaatcattggctaggtgtgaaatgggttctccgttacattaaggggtctattgattcaaggctgcagtacaagagagaaggtgattttgtggtgacagggtactgtgattcagatcactctggagatcgtgatcgaagtagatcgaccacagggtacacattcactgtaggagggaacatagtaagctggaggtcatgcttgcagccagttgttgcactgtcatcaacagaggctgagtatatagccttaacagaggctgcaaaagaagcatattggctaaaagacttgatgaatgagctgggatttaaacaaggagcggtagatatccattgtgattctcagagtgctatagctttagcaaagaatgcagttcatcatgaaaggacaaagcatatccagagaaggtttcattacatcagagatgcaatcactgatggagaagtgaaagtgctgaaaatatccacagttcataatccatcggatattttcacaaaggtggtaccggttaacaagttcctgagcgcgttgaagaagctcagggttacaagtgcctgataagggatcatggtccgagatggaaatcaagttacactagaagggaagcaaaggaaaggttgacactaaggcaaggtgaagttttgtggaagtattgcctaaagtgtcataaagactctaatccaaagagaaggtctcagcttgtgaaagaaacgaagtcacgagaggcgcacgtgctttgtcatacagctcatcaaggctagagacgtaattaacctcttgccaatggttcaaccattttgtctctttgtctctgcatttgaaacagagtacggaagaagagagaggagcgtggcggtgagtagagttgtataaaggagaagataagtgagacattagggttaagagagtaagtgcaagagaggcagctgaaagtttattcagtcttgtttctaagggtttgtgtaaccaaggctttctagtggatttccgggtaatctcggtccagacgtagcgttcatcactgaacgtgaactgggttaacatttgcttgtgtctgttttactttctttgtctaaacacacgagtgatcgaacaaagagagatttagtgagagcttccgcataaaacagttaaagattcaagctttttttttttacatcaacatttactaataaaaatgtatagttgaattttcaatattatatgctccaattgatacttcagaatgtgttaagattttcagcttagcaaaagtacacaaaaactatagtagaatagttcaaaaaaaattacaataacaattaatgataaattttgagaccatttttgacactgcaatttccttttaaaataattaataacaaattaacaatcaaaatggtgtatacactcacctaccattcaaacccataatttcatatagaacatattcctaaaaatgtgaaaaaattttaaaagattaaaaaatatttgacaaagagtcaaatacaaaaaaaaaaaaaaaaaatcctatctatgtttaattttggccatcagaagggaaatcaaataaaggggagatagagcgagtatacatatacaagctactcgcagcgtctgcaaattcatctatccatcatatttctctgctgctctctgctttcttcttcttcttcttcttcttcttcttcttcttcttcttcttcttagtttgattcaaaaaatctccttcctcttcttactttatctcgtattatccattaatcctaaaccctttagtctctccatcttccgcttcaacaatcagaatttgggtttggcgaaagatgctaactttgaaagtgagactaatcgtttgagtaaaaaacatgcgaattttgtgtgatgcttgtgagagcgccgccgctatcgtcttttgcgccgccgacgaagctgccctctgttgctcctgcgacgaaaaagtaaccacctttacctgaaaaaaatctcatttttcttaaagtaacacttttatctcaacaaatgcaaaaatttggaatttttgagacaatatctagttgaagtgctaaatttatagattttgaggttattataactcgaacatggccaaagtagtaccaaaagttgtgttttgattgttaaagaaacattctagtgattttagcttgtcataatttgaactttgcatatagcagttctctggtgatacactttatttacagttacagtcactctattgaagctggaagagctatgagactttttgttatctgca

SEQ ID NO: 10410 - DNA, 3000 bp, Unknown
  misc_feature (1)..( 3000): cDNA_ID_3036346_gDNA_ID_2213647_Annot_ID_181469 3000 nt of promoter + ATG
tagagggttcaatagatttttttagaccttgattgaccatttgcatttattagttttggctctcttcttatcagttttttttctttgtttctatgtaaaaagtataagcaaccacatatctatatcgttttcctcctaattttgcaatattgttttcatcaataaataccactaaatgctagcaatttggtcagccaaacaatattttttagagttaggttttctaaaacattgttactttgttagtacttagtagaaactatattcttaaaattgaaactatataagtatataacagaagttggtctgattcatactcgtgtacaaaatttcaagaatacaaaattttaagcccataaaacaaatcaatgagtactgagcaagtattagtataatgggctttatgtgtgaggccattgaagatttaagcgtaattttttcttttcttcgatagtattcgtgtcaggcttttgtgatatccaaaaactatgggcatgactgcacgaggatgacagtttttttttttttttaccagcaaattagtcacttttttgttctcacttaccaacttagaccatgagatttcaggtcaaagtttacgtaaatgttaccaattatacattggatctaaatttaacggtttaggtaaaaaaaacattgaatctaaggactaaatttttatgtagacatgttaccaatttactttttgtacattgttttcaagaggctaattgtaaaaatgtgttattaatatgtaaattgggcttgctgataaaataggaatgttagttatgttactatttagcacatggagcattaattacagttgattagggtttatgacttgtgggaaaaaaatgagaggttatagaatcatggttaatgacttttgacttcattttttcttccttgtttattttattatatactttctagtttctataataagtggaccgacaaaactaaaaaagtgatccgtgaatttcgctatttaactaatttcacgtttgtttggtaaaatgctatgtcagtgcatgagcaaaaaaggttgtaaaataaagctgaagttgtaaaataaaatgttatttttattttaatttattcgagagcctctggatggatgagagagtttagaaacacttgggctccgtacctttcaacggctataaaggagcggtcctcttgccacgtgtcaaaggcgtaactgagaagaattatcgcaataaatttaaaaaaccgaaaagccaacgtggcagggctttctcagatacccgacaacgttcccaggggtaatttaggtatttcaaaaggtatcttccttccaccgcattctctcggttcaacaaatacaaaggagagagagagagaagaggcgcttcgctacgagatttgcgggaccaaatcaatgcccattggtccctcctccttcacactgagagagccattggccaatttccagatatagacgacgacgacgacgaagcagcagcatgatgatggagtaactagacgaagacgaagaaggtaatgtactgtgattctctctctttctctccggatttttcgcactatgtgtaatgtgtgatagagatcctgggttcttctttgagcttccgattccactgtttcatagattagatagagagaccttgatttctcaaatttctcctctgatttctgattttcttaatttgggtgaagtgttgtttctttatctgatttttttgaccagcttgattctaggaattattttgggtcaagtgttccctattttttagatcgagattgctatttttggaaattttagtggagaacacttggcgtttttatttggatgcgctttatagattcagaaatttctatctagggtttattatatttcctattccactttcaaaatcagtcttgtgtgtgttttaatgctgatatctgtggtggatgtttcagattagaggagcttctgaagaatcactttgaggaagaagacaacatatctcacaaggtataaagcctctctcactcatattcaacatctaacacacaaaatattgtacacattgtacatgaacaagagaagatttagagtttcttagttatcaagatgtggggtattttgcattcaagtcaaaatctattattatattgaattagtcatgatttctttttatgttaacttagacttttgtttttcctttgtttcattattatgattaactcaagtgcgctgttgagaaagacttatgagtatacaacaacttctatatattaaattcctttctcttttttttttgttctgtctgcttttgcgtgtgtaagattacaatcaaagtactttgaatatgatgataactttttctttttcagttctttctttgccattataatatagagatacgtttaaacagagaaggtatggttttgtgggtccttttgttacttatattttctttaaagaaactttagattgatgatacatgacttcgttttcaagcatagttagtgggtgaccactaaagataaaaaaaagtcggtagtctttttgttgtttgttcttcagtttaaaggttgatcaccttctaagtaagctctcttttgttattctaattacaacatccctccctattaataagtaataagtcatctctctttcggtttctttttctttctgtttaagcagtgtgttgaagaaattcttaattctagtgtttaaatacagtgtaatcgacatacgtactatgagcttgctttgttgaactgttcaagtttcctctgtttttaaggaacactactaagagattttttaggcatgtttcttgtttttggtttggtaagttgagatttctgagctttatcatttctttatggttgtgttagttggaaagtaagtactcttttggtctctcctcagatctattctgttcttgatagctttcaacattccttaaaatatgaatgaaatgagctcattgtgcatcattgtgatttgaccagtgagcaatg

SEQ ID NO: 10411 - DNA, 3000 bp, Unknown
  misc_feature (1)..( 3000): cDNA_ID_3036350_gDNA_ID_2213647_Annot_ID_181467 3000 nt of promoter + ATG
gaggaggaaatgtcgcccaggcattcaggagatcaatcagaagaatactgcaaagaggtacaatgcattgagatggaagaatcgaccagagacattaataacgacagtgaagaaaggacagacgcagaaacacttttgggacacaatgcagaggcaaacggtgaaacaggtagtgctcaacacaggatcccgtcaagtgttagaagtgtcaggaggaggaagagttggagccgtggagataccatgacaggcacaagcactcctcctgatgccctggagacagactaccgtggaagaccggagggtcatggatttgcgtttcctgatttggagtttggttctggtgggaaattgttgaggaacgattcaatgacttctcgtggaagtgattcaactgaggctcacagcattggaacaccgttggtgggagaagagggaggtatcaccagcatacggtcatttgttgaagggctgaaggagatggtaaaaaccgttaaaaacactctcgatatatatatcttttgctacaaaaggtgcaacttcttatgtggagctttgtattcaggtttcggatccggagaattcagggaaaatgaggaaggacattggtgtggatgctatggaggaagaggtgtctgggacaatgacaaactggtcggaggaattcgagagacagagagaacaaattctggggctgtggcagacatgtcatgtctcgttggtgcatagaacgtacttcttcttgctcttcacgggagatcaagcggattcgatatacatcggagtagagctaagaagactctcctttatgaaagaaagtttctctcaaggaaaccatgcctttgaaagaggacagacactcacaatagcttcaaggtaagtacttttagcgtttgcatttgtatccgcagcaaacaactaatgttttgttaactgcttttccggttttgctgtagcctgaaggcgcttcatagggagagacggatgctaagcaagcttgtcgggaagaggtttactggagaggaaaggaagagactttaccagaagtttgggattgctgtgaactcgaaacgtcggcggttgcagctagcgaaccagctctggagtaaacccaatgacataactcatgcggttgaaagcgcagccgttgtagcgaaactggttaggtttgtggagcaaggtagagctatgaaggagatgtttggtctgagcttcacgcctccgctaccgacaacgcggagatcactaaactggaggaaaagcatggccacactgttctaattttaatagtcaaccacgttcatataatggtttcaaggtttgtacgtgtaaatcttctaggcttctagctaatgggtgtttgatgaaaaagattcttagatgttaccgcagccgaagagaaccttttctgtttcttttgcgttgatgggtttttaatattggaaacagacattatctgattctgatgttcgtttttcttaactggcaagtcgtctgggtaatatgatattgatccttgtcctatttaagcgcaacgaaacatctcttgaaatgagtgacactggtccaacaatgttgcttacgggttggaactactgttctcaagcacaaggagcccaaaagaatgatcgtttctaaacactcgtttatctatacacaatttataactatggtatcaattacatacttccaaagcatggcctcagtttcggaattgggtaaaaacaacagaagatggaatccaaagcccgactcaagaaaacagaacaaacctatgaatgatgatcatcattatcagcggctaaaaaggaaaaagtaaaatatctgtcgaatttgttagaatccaatttcagagagcaatctatgatcatcgtcactgattttacttaattcaaacatcttggaactagatattcaaccaagataatagcaaactagataataaaactttctattaatctaagttgcatgtaaaacatccaatgaaatcaaactagttgtaaccattatccaatgtgatatgccaggtgcgttttcaaacatgtcatataaatacacaaaatctgagagtcaaaactagtctctcaagccatatcttgcttatcctacattcaaccatcgattcatccaagcgattcagcaaaaacattcataccaaagcatcagattagttcagttctataatcttcctacaaccaactaattagacaaccacctgaaaggtctaaggtcactgaatctctaatcgcagaaagaaggaaaagccaatcaaacaattcacagtgttgctatctatatagcttatgacctcacactctctacatttctgatcccaagtgaagctacttcaccagtaaaagaggaaatattgatgaccaatttcaatttcaaacaagttcaatgattcataacaaaaagtatacagagagaaccgccactaaaggcgacatttttgttgttggcaaaagaggagaaaacccctaacaagagattcagatgagcttgaaaggaagaggccaaggagtagacctgggaagctcaagcttgtctttgattctctcaatcatcttctgtttcttccctctcgaattcccgtacgatcctttgaatcttttccctttcttcgtcttcttatctcctctcccacacaaatccatttccgataccgccggagctgcacacgccggagataacgatgaatacctcgccgaacaattcagagctgcagatgttcgctgcgtcatcataatccgtcgtgtcatcgcgccgcaccactgcatcgccgccatctcctctttctcacacactctcgtcctcctcctctccgtctctcagacttcaatcaaagattaaacacatggaccagaaataagactaaatgggccttaataatgaatatcaacaaagcccaataagggcctttaagttgtctccgtgcaaaatacgacgtatatgtgtctccaccactcactgttaacgatcagtttcagcgaaacgatg

SEQ ID NO: 10412 - DNA, 3000 bp, Unknown
  misc_feature (1)..( 3000): cDNA_ID_2704895_gDNA_ID_2213647_Annot_ID_132400 3000 nt of promoter + ATG
gttctggtgggaaattgttgaggaacgattcaatgacttctcgtggaagtgattcaactgaggctcacagcattggaacaccgttggtgggagaagagggaggtatcaccagcatacggtcatttgttgaagggctgaaggagatggtaaaaaccgttaaaaacactctcgatatatatatcttttgctacaaaaggtgcaacttcttatgtggagctttgtattcaggtttcggatccggagaattcagggaaaatgaggaaggacattggtgtggatgctatggaggaagaggtgtctgggacaatgacaaactggtcggaggaattcgagagacagagagaacaaattctggggctgtggcagacatgtcatgtctcgttggtgcatagaacgtacttcttcttgctcttcacgggagatcaagcggattcgatatacatcggagtagagctaagaagactctcctttatgaaagaaagtttctctcaaggaaaccatgcctttgaaagaggacagacactcacaatagcttcaaggtaagtacttttagcgtttgcatttgtatccgcagcaaacaactaatgttttgttaactgcttttccggttttgctgtagcctgaaggcgcttcatagggagagacggatgctaagcaagcttgtcgggaagaggtttactggagaggaaaggaagagactttaccagaagtttgggattgctgtgaactcgaaacgtcggcggttgcagctagcgaaccagctctggagtaaacccaatgacataactcatgcggttgaaagcgcagccgttgtagcgaaactggttaggtttgtggagcaaggtagagctatgaaggagatgtttggtctgagcttcacgcctccgctaccgacaacgcggagatcactaaactggaggaaaagcatggccacactgttctaattttaatagtcaaccacgttcatataatggtttcaaggtttgtacgtgtaaatcttctaggcttctagctaatgggtgtttgatgaaaaagattcttagatgttaccgcagccgaagagaaccttttctgtttcttttgcgttgatgggtttttaatattggaaacagacattatctgattctgatgttcgtttttcttaactggcaagtcgtctgggtaatatgatattgatccttgtcctatttaagcgcaacgaaacatctcttgaaatgagtgacactggtccaacaatgttgcttacgggttggaactactgttctcaagcacaaggagcccaaaagaatgatcgtttctaaacactcgtttatctatacacaatttataactatggtatcaattacatacttccaaagcatggcctcagtttcggaattgggtaaaaacaacagaagatggaatccaaagcccgactcaagaaaacagaacaaacctatgaatgatgatcatcattatcagcggctaaaaaggaaaaagtaaaatatctgtcgaatttgttagaatccaatttcagagagcaatctatgatcatcgtcactgattttacttaattcaaacatcttggaactagatattcaaccaagataatagcaaactagataataaaactttctattaatctaagttgcatgtaaaacatccaatgaaatcaaactagttgtaaccattatccaatgtgatatgccaggtgcgttttcaaacatgtcatataaatacacaaaatctgagagtcaaaactagtctctcaagccatatcttgcttatcctacattcaaccatcgattcatccaagcgattcagcaaaaacattcataccaaagcatcagattagttcagttctataatcttcctacaaccaactaattagacaaccacctgaaaggtctaaggtcactgaatctctaatcgcagaaagaaggaaaagccaatcaaacaattcacagtgttgctatctatatagcttatgacctcacactctctacatttctgatcccaagtgaagctacttcaccagtaaaagaggaaatattgatgaccaatttcaatttcaaacaagttcaatgattcataacaaaaagtatacagagagaaccgccactaaaggcgacatttttgttgttggcaaaagaggagaaaacccctaacaagagattcagatgagcttgaaaggaagaggccaaggagtagacctgggaagctcaagcttgtctttgattctctcaatcatcttctgtttcttccctctcgaattcccgtacgatcctttgaatcttttccctttcttcgtcttcttatctcctctcccacacaaatccatttccgataccgccggagctgcacacgccggagataacgatgaatacctcgccgaacaattcagagctgcagatgttcgctgcgtcatcataatccgtcgtgtcatcgcgccgcaccactgcatcgccgccatctcctctttctcacacactctcgtcctcctcctctccgtctctcagacttcaatcaaagattaaacacatggaccagaaataagactaaatgggccttaataatgaatatcaacaaagcccaataagggcctttaagttgtctccgtgcaaaatacgacgtatatgtgtctccaccactcactgttaacgatcagtttcagcgaaacgatggagcttctctgctcaccaacgtctctttcctcctccttcgctctctcttctgctcttttagtccctcgttcgttctccgtatgcaaattttgttttttttatgttaacattcatttaatttgttgcgtgattgattactcatgaatgatcaaattttggatttttacttggtttttagatgccagggacaaggagattcatggttctgtgtagttcccagaaggtatttcatttcaatctcttcacccggaagacttgtattgtagtatctttttaagctacaagtatgaaaatagttaagagtttgagaattaaaatgtttagttgatagagaatg

SEQ ID NO: 10413 - DNA, 3000 bp, Unknown; identical to SEQ ID NO: 10410
  misc_feature (1)..( 3000): cDNA_ID_2704891_gDNA_ID_2213647_Annot_ID_132402 3000 nt of promoter + ATG

SEQ ID NO: 10414 - DNA, 3000 bp, Unknown
  misc_feature (1)..( 3000): cDNA_ID_2715659_gDNA_ID_2213647_Annot_ID_132404 3000 nt of promoter + ATG
cgaatgcagacaatcaagaagttgacaacgagtggataatggacacagggtgctcatttcatatgacaccaagaagggactggtttgttgagtttgatgagtcacaaaccggaagagtgaagatggcaaatcaaacatattctgagatcaaaggcattggaagcataaggattcagaatgatgataatacaaccgttcttctcaagaatgtgagatatgtcccaagtatgtccaagaacttgatctcgatgggaacattagaagatcaaggttgctggttccagtctaaggctgggacattaaaggttgtcaaaggctgcatgacactacttaaaggaaagaaagttggtactttgtacctcttgcaaggagttgttgtaacaggaaatgcaaacgcagttacaagctcaaaagatgaatcaaagatatggcacagcagattatgccatatgagtcagagaaatattgatgtgttgatcaagaaaggatgccttcaagctgaaaagataaatggtctcgagttttgtgaagactgtgtgtacgggaaaacacatagagttggttttgggtctgcaaaacatgtcacaagagagaaacttgagtacattcactcggatctttggggagcgccatcagtaccaaactcactaggtaattgtcagtactttatcacgtttattgatgaccttacaagaaaagtatggatttattttctgaagaagaaagaacatttcttctcttgtatgttgatgatatgttgatcatatcaaagaacaaggaaacagtcaaggaattaaaggaaagactgagttcagagtttgaaatgaaggatttggggcctgcaaggaaaattctgggaatggagataacaagaaaccgagaagaaaatattttggagttatctcagagaagttatctgcaaaaggtgttaaagacattcagaatggatgaatgcaagcctgttaaaacaccattggcaccacatatgaagtttgtagcagcaacagagactgaagcagaggagcaagctgatcaaatgaagtctataccttatgcaaatgcagtgggaagcataatgtattctatgatcgggtcaaggcctgaccttgctcatcctgttggagtcataagtaggtttatgagtaaaccattgatgaatcattggctaggtgtgaaatgggttctccgttacattaaggggtctattgattcaaggctgcagtacaagagagaaggtgattttgtggtgacagggtactgtgattcagatcactctggagatcgtgatcgaagtagatcgaccacagggtacacattcactgtaggagggaacatagtaagctggaggtcatgcttgcagccagttgttgcactgtcatcaacagaggctgagtatatagccttaacagaggctgcaaaagaagcatattggctaaaagacttgatgaatgagctgggatttaaacaaggagcggtagatatccattgtgattctcagagtgctatagctttagcaaagaatgcagttcatcatgaaaggacaaagcatatccagagaaggtttcattacatcagagatgcaatcactgatggagaagtgaaagtgctgaaaatatccacagttcataatccatcggatattttcacaaaggtggtaccggttaacaagttcctgagcgcgttgaagaagctcagggttacaagtgcctgataagggatcatggtccgagatggaaatcaagttacactagaagggaagcaaaggaaaggttgacactaaggcaaggtgaagttttgtggaagtattgcctaaagtgtcataaagactctaatccaaagagaaggtctcagcttgtgaaagaaacgaagtcacgagaggcgcacgtgctttgtcatacagctcatcaaggctagagacgtaattaacctcttgccaatggttcaaccattttgtctctttgtctctgcatttgaaacagagtacggaagaagagagaggagcgtggcggtgagtagagttgtataaaggagaagataagtgagacattagggttaagagagtaagtgcaagagaggcagctgaaagtttattcagtcttgtttctaagggtttgtgtaaccaaggctttctagtggatttccgggtaatctcggtccagacgtagcgttcatcactgaacgtgaactgggttaacatttgcttgtgtctgttttactttctttgtctaaacacacgagtgatcgaacaaagagagatttagtgagagcttccgcataaaacagttaaagattcaagctttttttttttacatcaacatttactaataaaaatgtatagttgaattttcaatattatatgctccaattgatacttcagaatgtgttaagattttcagcttagcaaaagtacacaaaaactatagtagaatagttcaaaaaaaattacaataacaattaatgataaattttgagaccatttttgacactgcaatttccttttaaaataattaataacaaattaacaatcaaaatggtgtatacactcacctaccattcaaacccataatttcatatagaacatattcctaaaaatgtgaaaaaattttaaaagattaaaaaatatttgacaaagagtcaaatacaaaaaaaaaaaaaaaaaatcctatctatgtttaattttggccatcagaagggaaatcaaataaaggggagatagagcgagtatacatatacaagctactcgcagcgtctgcaaattcatctatccatcatatttctctgctgctctctgctttcttcttcttcttcttcttcttcttcttcttcttcttcttcttcttagtttgattcaaaaaatctccttcctcttcttactttatctcgtattatccattaatcctaaaccctttagtctctccatcttccgcttcaacaatcagaatttgggtttggcgaaagatgctaactttgaaagtgagactaatcgtttgagtaaaaaac

SEQ ID NO: 10415 - DNA, 3000 bp, Unknown; identical to SEQ ID NO: 10408
  misc_feature (1)..( 3000): cDNA_ID_2704876_gDNA_ID_2213647_Annot_ID_132405 3000 nt of promoter + ATG

SEQ ID NO: 10416 - DNA, 3000 bp, Unknown
  misc_feature (1)..( 3000): cDNA_ID_2715655_gDNA_ID_2213647_Annot_ID_132406 3000 nt of promoter + ATG
ggacgatgttctgctcgacgagaacatcaaccattttcttgccatcagtggtggattggtacagagtctcctcgaacaggatagctccggagatgtactgtccaagtcctggagccgacacaagcaacgtcctgtaagcttgacggttagcctccgtgttctctagcccaattgacgccaaacgctttccacaagtcgcgttggactcatccatcgccataattccgtgtcccggagacgcgattgttttctgcaacccatatcttaatcattaaccattgaaatgaaaatgaaaatgataatgaaatatacttggattatagagttaattacagcggttttgacgagctcatcggcgtaagcagaagcggctcggacggtgagagcggaaggtgccacgtggctgcgaatagctgagacagaggaaggttgacggaggagaagactctgtcccttaacccaatcagatttcaccggtgaggctttgagcatagtcgcagtgcttgacgccattgttgctagtacttgcttgctagtgagagcttaaaacgcttgtaacgcactacgataaacaatcgtgcttttcggtggtttgatatatagagactcaagtgacatacaaagattggataattgaggttctcgtgagccggctgacgaggatttgccacgtggatgatgataatattttcagataaaatgccaaaaaagactaaaccatatgataaaaacctctcagaattatagaatcaaaccattaaaaaaaataaaaaaaattatttagcaatccgagcataagagaaatcgacaattcccaacaaaattcatctaaaaaactatagataacaaaaattacaatgagagattagtttgtgaggtggtgaggagttctcacaggtttttaaggctgaggttatgtttggagattatcatcagatattgtgaagtctacatcaacggttcaaggcatgccatgtcaactcccacgttaattcttgtgccttatggcgaagatgtggtactatcatttcttaggtgtacgttattcattcaaagtaacttggagatatcacatttataatggcgttcaaactagctatttgactaacggagactctcgagttttagggagagattttctacacactcgtgagaaaaaaatatattcatttactctttgaatttgaatttgtgatagatttctctcaatttttagttgttttacgccttggcatagttatctattacttcttttgatctcgttaaatattttgtccgtaacaagaatatatgttgtttcttatttttctttcaatacttgcgaattgtcttacatctttaaagtgaatgtgtgtttttgtaatgcatcaaaattgtttttttttctttgtaaaatgaaaggaataaaccgaaaaaaccaaaatcaaaccgaattacattgttttaaaatgatttcatttttttttgtaaaaacccataaaccataagctaaggaaactattttttttttgggtgcaactgccaaacttaactactacatactattttaaaactagaaaactataaaaaccaaatagtaactcggaatgcgcactcctaaactcaagtttacaagtcaagacaagtcataagtgaagacaagttgatgatgatacatcaaatatattttagctttatagtttagagcttggtatttcaattcggaagtctttattagagcacttctatcgataggttttagatggatatctaagctaataaaaatttgaaaagaaaaaaagttgtagagagagtgagagagactctcttaaatgagatacctctagaacctctccaaacaagggtcacatgattaatgatttagttcttttaaaataaataaattttattatataataaattattaatataattctgataaaaaactttttgagtcattccactgatggggattctcttagatactactagattttgatgaagcaacttattaatatagttttgatgacatcactttttatatgaatttaatttggactaattgtgttgtaatatagcgaaaaagtatgaactcaaagcgaatagatggaatgtgactgaacagttttcctagaggggggaacttttctcatatccatagagatgggacaaagattgtagcaaaattgtctctcaaattcaataaccgaacctattatatttattttagttttaagaataatttatattagttttaaatctaaattataaaaagaaaatcaattttaatttgaatatacaaatattatatcgagatgataaaaaatttaatacatagtatgaaagaaactgaaagatattattaatttatttagagattctttgcattattatgagatatttattactacaccattgaaaggttggacaaagtgctgcttctaaagatgcaattcatgtgcggactgcggactaaatgatcaagtggcaaatattcttaccatgcattgttccttcatcaatttgaacatcttaaatggagaatgcgtcttatacatatctttggaagctaatcttgagaaggcatattagagtcgttcagtatggtttataaattatgaagtgtcgaaagcgaatacaaaccgttgcttgcaatttgcgtacagttttaagacttttagtcagaaacatacaaagtagggtcatatgtgactcgatgcatattaagatcttcttgtcctttgtctccaacatgaaaacaacgcttttacagtcacacattgccttaccaattttcccactttctgtttcttaattattttggttctctttgcttttaaaatctcaatttgactaaccggttaggtgtaccaatcattagaccgaatgcttacatgagtaaatgagttcacaggaaacttgagttgtgttgttttctatcagttaatcaacgcaacgccgagaagctttttcaggggtttggtgcgttgaatttgtggatcaagaaacaatgcaaattca

SEQ ID NO: 10417 - DNA, 3000 bp, Unknown
  misc_feature (1)..( 3000): cDNA_ID_3036315_gDNA_ID_2213647_Annot_ID_132408 3000 nt of promoter + ATG
gtatgtgtctttccactgcttgtaacaccataagcaaaaacggttcctgtcaaattgcaaacacagagtcagaatacttccctgcaagtaatgctactagcaaatgagttggctaaaagtatttcaatgacaaacacaactcttgtttaatcgataacacagctataagccttaccgttaacaccttccatagcagccttgactacaggtttagcagctacgtcatatacttctggagttgttgactgtggtccaaaaactttatctggcatcaacaaatatggaagaacattcattgaacaaacggaggcgaccaaatctataatcaatgaacagtaaattgaaattatctccggcaataaattgatctcaataccaaatgcgtaagctgtgaggggattgtattcattcctgaccatcttatctgcgtcaggataccaaacaatctcatctcctcgttgatactccctctcactgcaatcaaacaaataacacgggagattttcaaaattgactaagtatcaattcacatttcataaatattaaacttctaaagaagaataatcgtgaaattgtatcaaatggatctgatattccgcttccagatctaccgtacctcatcggacgaaatcgaacggtgacggagatgctatctcgctcagaggtaatcgtctgcccagactcgccaatgagcccctccgatgggtacgattgggctccataagtcccggagccgccgatgggaccggaatcggaaatggtgcgagtaatcgacatagatcgggacccggttacaccgccggaattgtaaacggtagaagtaggtgtggaagaagaacgaggtaatagacgattatttataagagacgaagaagtagacgaagccgaagagtaaggactcggaggtctacggtgcgagaaaggagaacgactcctagttctagacgacgatgaagccatccactaactcgttcaaactcggttacggactcggtaaaaatctgaaaatgaagatagaaagaatcaagcaaaagaaaaaaacaccaaatgtgaagatggagagaatgtgtcagtggaaactcacatggctggggacagaaaaagcaatatgctcttcatcttcttcgtctttctctcacttctctctttcttcttcttctctacttttccatggttaagctacgcgaaggtgagaaaaagatagtgagaccacacaaggagagagcgattgtttcgtcttcttcacgcgacggtggtgaagagagagatagagagaaatcgattggagatatttttttttggtgaaagcgtctttttttcagattttgaatttttgattaataaaatatatttgtttttactgtgtcgctaatagattcgaacgtggttgaggattaaaataaaataaccgcgaaccgggttaaaaggttttcgaaacaaattgaatgaaccgaacgagcgggaagaacgatgggttagtaaaaatggaggatttcaatgtttttgtcctttctgccctttaattcgttcaatgtttttgttccggttcaacctaaaccaaagaaaatgaaatcctagtgaaatatgttcaattttaagtttttaaccgaatcagttaaaaaataaattaggaattgtatccaacaccaaatctaaaaataatgaacagatttaaagtaatttctcttaagggtcactcaaaatgttaaaaaacgtcaattccaatggaacatgatttgcgacattatgttagattctacttaactgcaacatgtcgaatagattcagtactgaatttaataatggctaaatgaaaggaaacattatccttaaatagatggtgtactaataaatcctgcaaattgcaaaagacaaaattataacctaaataaaaataaaatagaaagtaatccaataaaatggagttattacgagcacgtatatcttgcttctataatattaaacacttatgttacacacacattgaatatgtgggtccttattccctaataccaagtagtttacgtatatagagtgtgattgcttctcgaaggtaaagtagcagtggcaaagaagttgtcatatctcccacttcttgagctccaccgcacatctggctcacacgtgcatgcttttcacaatgaaatccaagtcatgttttcagcaaaaaatcatttgtagttttcccaagtatccaaagacagatttttagacgttccgatttaatgaataaggatatcaacagtacttgggacacaccaaaaccaaccttcatcttcatgaattaccactagaccacgacccatttggttcatatgcaaatggaatgttgttatttttagttttgcgtcttagtgctatgatttcaatattctgtaaatttttaattagacaaaaattgcttggtatatatagcatttacatgtaaattttttaaagaaaacttgtgtggaacaaaatatggtgccaggagagagggattgttgtcatcattattggtcgtgggcctacaagggtccaaatatgaagatccgcacccataatctgagccgttagatgaccagagaacgtgcagcccaactgcttggtgttgagtggagtaaaataaataaaaataatatggaaggctaaaatggtaaattcaaatcaagaggaaaaaatcgagaaatccaacggtcacgaacttgctagctcccttatctatggagtttagaagaaagcagcctcagaaggaaaagagagatgctgattcttcgtcaatttcagatatcttcatttgagctcttccaatctccaaaacaaacaggtaaacatgaagatttttcgatataatggcgtttattaggggttttaggagctgaatcatttatgataatgttaatctcagggttttactctagttcaaggagtgttcctctacccagaactagattttactccgatttcagagttatgagtggcaataaaggaacgaactatgaaaaactttatctgggtatg

SEQ ID NO: 10418 - DNA, 3000 bp, Unknown
  misc_feature (1)..( 3000): cDNA_ID_2715643_gDNA_ID_2213647_Annot_ID_132409 3000 nt of promoter + ATG
accttcaaggcattgttgtaatctgacactccgagtctaccgtgaagtaaccacaacaaccagtctgcctgatgcagcaataccgctgattctctgtttggcacctcagtgttccaccatgagacaagtttgcacaaggtagaagtaccagagcagactgtatggtttgctggcgctatagacttgacctctggcagagcatcagggcagctctggttgtagagataaggttgacacagaacttctccactctcactgcaacacataattgaataagcaaaggagatttaaacaacacattactgaaacatcaaatcctctaatgtaaatggaatacagaaacagaaaagagaagtgatccggtgaattacatgcctgtttaagatgagagtagttgcagaagttccatcaagcgaaatggatgagacgagggagcgaactgtgacgggaatgtcctctagcaacgaaaaaagagttgctttccatgagcttgcccaacccatgctttcttctttctatctagatttcaaaacaaatgtctcagtccatagctttctcttgattttgttcataaagcagctcagaaattgtatatgatatatatacaaggatacttaatgcaaaagttttaccatgaaaggaggatattctcttttgccttgtgctttaatctctccttgctcatcaataactgtaaatcgacctccagaagtaccaaaatccatacccagataaagtttttcatagttcgttcctttattgccactcataactctgaaatcggagtaaaatctagttctgggtagaggaacactccttgaactagagtaaaaccctgagattaacattatcataaatgattcagctcctaaaacccctaataaacgccattatatcgaaaaatcttcatgtttacctgtttgttttggagattggaagagctcaaatgaagatatctgaaattgacgaagaatcagcatctctcttttccttctgaggctgctttcttctaaactccatagataagggagctagcaagttcgtgaccgttggatttctcgattttttcctcttgatttgaatttaccattttagccttccatattatttttatttattttactccactcaacaccaagcagttgggctgcacgttctctggtcatctaacggctcagattatgggtgcggatcttcatatttggacccttgtaggcccacgaccaataatgatgacaacaatccctctctcctggcaccatattttgttccacacaagttttctttaaaaaatttacatgtaaatgctatatataccaagcaatttttgtctaattaaaaatttacagaatattgaaatcatagcactaagacgcaaaactaaaaataacaacattccatttgcatatgaaccaaatgggtcgtggtctagtggtaattcatgaagatgaaggttggttttggtgtgtcccaagtactgttgatatccttattcattaaatcggaacgtctaaaaatctgtctttggatacttgggaaaactacaaatgattttttgctgaaaacatgacttggatttcattgtgaaaagcatgcacgtgtgagccagatgtgcggtggagctcaagaagtgggagatatgacaacttctttgccactgctactttaccttcgagaagcaatcacactctatatacgtaaactacttggtattagggaataaggacccacatattcaatgtgtgtgtaacataagtgtttaatattatagaagcaagatatacgtgctcgtaataactccattttattggattactttctattttatttttatttaggttataattttgtcttttgcaatttgcaggatttattagtacaccatctatttaaggataatgtttcctttcatttagccattattaaattcagtactgaatctattcgacatgttgcagttaagtagaatctaacataatgtcgcaaatcatgttccattggaattgacgttttttaacattttgagtgacccttaagagaaattactttaaatctgttcattatttttagatttggtgttggatacaattcctaatttattttttaactgattcggttaaaaacttaaaattgaacatatttcactaggatttcattttctttggtttaggttgaaccggaacaaaaacattgaacgaattaaagggcagaaaggacaaaaacattgaaatcctccatttttactaacccatcgttcttcccgctcgttcggttcattcaatttgtttcgaaaaccttttaacccggttcgcggttattttattttaatcctcaaccacgttcgaatctattagcgacacagtaaaaacaaatatattttattaatcaaaaattcaaaatctgaaaaaaagacgctttcaccaaaaaaaaatatctccaatcgatttctctctatctctctcttcaccaccgtcgcgtgaagaagacgaaacaatcgctctctccttgtgtggtctcactatctttttctcaccttcgcgtagcttaaccatggaaaagtagagaagaagaagaaagagagaagtgagagaaagacgaagaagatgaagagcatattgctttttctgtccccagccatgtgagtttccactgacacattctctccatcttcacatttggtgtttttttcttttgcttgattctttctatcttcattttcagatttttaccgagtccgtaaccgagtttgaacgagttagtggatggcttcatcgtcgtctagaactaggagtcgttctcctttctcgcaccgtagacctccgagtccttactcttcggcttcgtctacttcttcgtctcttataaataatcgtctattacctcgttcttcttccacacctacttctaccgtttacaattccggcggtgtaaccgggtcccgatctatgtcgattactcgcaccatttccgattccggtcccatcggcggctccgggactt

SEQ ID NO: 10419 - DNA, 3000 bp, Unknown
  misc_feature (1)..( 3000): cDNA_ID_2715639_gDNA_ID_2213647_Annot_ID_132410 3000 nt of promoter + ATG
acttatattgtaatttttaattttaataataatttttacttagttatatctatgctaaattcttatttttttttaagaaatttaatacataccgaatttaatacaccaataacacatgtaaatatttttggatcagagtggttgttacggcccaatggatctagtgagcctaaatgatacgaccatatattgtttttttttcggttttcgccaacgaggatttggttaccgagagtttgtttgaacggtcctcagaaattcggagcttgtagcttctcggtgcggtgccttcactttaatggcggcaatatcccctgttcaatgcttattctcttgcaattctcatcatcatcatcaacaacgcgagcaggtgaatctctctgttcttatttcttcataattagcgagaactaccttcttcttgttatgacttcattcctccgtttttttcaagtagagtgggtcgctttggagattgggttctagggttttagtatcttcgagtctatggaagctttctctgttctctggactccatttgaaccgaaggtgattatgttctagttaacgatttcagtaggatttggcccttgaagcgatgattctgtgtaatgcagttggatatgagataattgattgcaatcttttgggtctaataaaacaggagaactttgatctgtgcagtcaagggagatccagaagatgcctttaagaagactgtcgaaatcgatcggatgattgatgctcttagagatgcaaaccctagacaagtaaggaaacatgtcatatgcatcgtataaatgttgtgtttttgctctattatcttgagtaaattgagttttgttttgttgttgttgccattttcattgaacaggttgagaagattgttgttgaaaatatccttgcttttgatgaggttttttggataagactagcagctaggtcggatacttgtaaatcagaagatgacaaggcatgagtttatattgtttatgtcaatgatagagcagacttttgatctcttttgtttccgctaatgctttgaatacggtttgtttcttacagaaggactatgaggagttagctacaactgtgatgactatagttgactgtgttgtgaataagactcgggtttctctttcttctgtggttttattgtctcttcttcttcagcgtttacttaaacagggataactgagagttcattatatccctttaggaaaagatagagacgtctactgatattctgaaagggattttaagacctgctatagatggagtggaagagatttcatggccgccaagagatcctgaagccatcaatctaatgaaaaaggtttatactagttgttcttcactttctactacatctacacattttttatatatacaacctatattcagaagggttatctggtcttagattctgtgatttgatatcgtcatggttactgagatcagtgtattaacaggaaattatacaacgggaaaaagaagggcaattagatgaaggatttctttcagaagttaatgctcagctccggcaggtaagtgctacaatttgttttgtttcacttctgaggtctttcctttacagtgaatagatgtattcttttgaatgtttgaggctgacgattgttttcaggcaaaagaagataaagacaaaccagggttattggctatgctgcaaaaagttcttcaactctattctgctactatcctctccaagcgtagctacgcaaagaaaggtgatttgcccaattttgaaaactatgccaagtcactctaaaccattttctacgaacataatctcatccactatagctattgtcacagggaacgaagttgtaaaagccgagcattttcttgaaactctgatcaaaggtctgttctgcaaccacttttccatgtactatagaccccagccagacttcacatcggtttattatgtgtgtttcagctcctgaggaacaatggaacaagcttttcgtagacgggttaacaatcggaaaaggagatatcacacctgatgagctatctgctgttatcaagaaacgaatcgagcgcacactgattcgaactgtaagtaacataccatgacacatttgcttgcattgttattattctcttcaggagtgaatgcgaggctaaccgggttttgggttggggttttaaccagatattgttttctaaaattcatcattctaaccacaactattctgatcataccaggaagggggttcataccagcagcgaattttgaccgagtatctcaaaggaatcgagtccagggctaatgaaattatgaaattactccagggttaatgtcgtaaatcatgtatttatctatacatttttgtgtaatatcagttcaataaccccaattaatatattgttttctctcatgtaataattttttgattgagcatttgaagtgttatctgatttaaaaatatgaagctctgtagtcaaaattttacagattttaattatcttggaataaaaaatgtaaagttgatgcttccatataaaataaaagtaaaaatgagtaattcatgccaattaaattagcgagacgcaaattggagacagagataactgagcggagggattcagatctatacgacgaaactgaatctcaccgtcttcttcttcttcttcttcttctagacgatccttgtgtttctcttgctctcgcatccacgcttctctggtaatgctactgatcgtcaccgtgaagctgagcttgatcgcttccccttgtgaactgatctgatctgaggtgaatctctatttcttctccttcttcattgtacgaatctcgatttctcggatcttgctgcttcttatcgttagatctgttttcaatttcacgtggattacgttttttttcttccttttgcgggtttttcgatttctttgaactgatctttctccatgattttcattctctgttgatctggtttttgtagagttgtttctgtttcgtaatctgtgaat

SEQ ID NO: 10420 - DNA, 3000 bp, Unknown; identical to SEQ ID NO: 10397
  misc_feature (1)..( 3000): cDNA_ID_1808176_gDNA_ID_2213647_Annot_ID_181463 3000 nt of promoter + ATG

SEQ ID NO: 10421 - DNA, 3000 bp, Unknown
  misc_feature (1)..( 3000): cDNA_ID_2715631_gDNA_ID_2213647_Annot_ID_132412 3000 nt of promoter + ATG
cttctctttggaaacactactcatcccaagaaagatcaagataggggtacaatggaagtaacttcaagtgctaaccactaacctaccacacttttgtaaggatcgagctacaaaaatagagaagtagtacatataaagagtttagtattagtttatggatggtgatgataaatttagagcatctttcaaagtctgaactatatgatttaatttgtgtccataatattatagacaaatgagtatgtttaacaggtggcccatgagggtatcggattaactttcgtctttacctactagcctactttatttactcaatttcattattgtcctaactatagatatatagttaagtatttttgtttttaatggttacataatcaaattaaactgatctacatgttaataatctaactagctatcaccaataactaacatatccaaaataacaaaacaattcataatcgtaccacgtaccgtgaagaatcataagttttcagctaaaattaagtatgagtaaatagattaacaaaatgtatacacatctttggtaaagtatcttatgttttttttaactcgtcttatgtcaatttcataagtgagatttctaacacgtttagtcgataataattttccttactgttagtcagtcacaattttcattttgactttaaacatttattgtaatattcttttcttatgattaagtacatctctatttattatactttgctataaaatttaaaataagaaagaagattatcattaatcatgtaatgttaaaataaaaagtacatatgttcgtcttgttaaatgtgatatttaaaaaacagtcgtgttaattatgtgatatttatcatcaagagtttccaaaggcaaaagtggagaaaaaacattcaatcttgttttgcataaaaaggctacgtacgtatatgtttgtttgcaagtaaagttaggtgtgtctttagtctttacttatattagtgtcttagtgaatcattctttagcaaatcttaattaagtttccttaaacaggtgtcgagatcgtacattatgtggtgcgatttccatttagcattagctttttggaattattccctcccataaaaaaaagtgttgtattattgtagcaacaaaacttttaaggtttttaaatttggcttagttaaaggcgttaatgggaatcacaccctatatgatgtagcctatgcatgtaaagctaagctatagattaatatatataacccacaagtttaatagattactacttcttggttatttttaaaaagacagattaagaataggaattaaaaccaaaaatatccaccccggatgtgtatgcttgagatatagatgacatccaataacaaaaagagaggggttctctataatgttgaaagtcaaaaatgaaatttgtgactgactaattgtggttaattcgatatttagtgaggttagaatggatcggagttttgtaggagactagtgcggttgggagattgtttcccaccatagtttttttgtaagaaacgaacgtaatctccgacttcatttttgatacatattttctatgtaacgagagaacgttctattaacggggttaatcggcgagttaacattttgggattttggccaggtcaacgtttaaaggaaattctttacttcttctttacttgcagttttgtagtgaccacctcttctttacttgcagtttcacttctgcaatttgggtagatttagcgagaggaattttcaaaacacagtacacttcacactgacaatcgataattgaagccattacaaactctcagcatcaccgtgtggaatggtttctccgccgctatgttttccaagccacaatctacattgtgtggagggagcggaatggtaggcgtcacggcgagcctccgaacacagcatctcaactcgttggttggatagataaacaaattagaaatcagctgtcctctatctgtctcaagggggacaagcgttatgatggaagtctccaagtttggtttcagtcaagaagttaatctcttagctctgtttctttcttttgttcaaaactattctcagctctaattctcaaaaccaagctgcacttgttgtaaaaacgtttttctttggaatataatttaacattatttttaaaaaaaaaaacaaaatggctgatcaacgtttttatcatgtttaatttggccgacctcagaattcacgtatggaatgagcactttttgaaagttcacgtataaaacaacatttttcccgatctttatgatatcatttttattgatatgtttctttttttctttttgttaaaggatttgttcttattttgtgacaataatatataataagagttcttgattatgatcaaagtaaactttttttgtagaacccatgacataacatacatgatacaaccaattattcccactttgaggttcctttcactaatattcaactaatattagattattattttattagcttctatacttttaaaaagtttacaataaaaaagtgaacataatctttaaaacagttatttatcgtgaattattttgaaaatagcatttattaacacacattttctcttaaatatctttaatttcgtatttatttcatcaaaataacaatatttaatcgtaattacgaaaattcaaaattggaataaattgttttgctaatcgttatttattgggccataaccagtagagaaagcccgaactaaatatgggccgatacagagagaccctaactcaaatctggaaacaaggacaaaatggtaattcagacaactagtaatgatttatcataattgattcatgatgaatcatcatcatatgtgtaatggtatggtcaaaactgtgttaaaaagatacattaaacaaatacgtggcagtaacaacaacaaagttacctctggctcaaaattgtcccttcttagctcatcattgatccactgagagagaggattacgaatacgagatcggagac

SEQ ID NO: 10422 - DNA, 3000 bp, Unknown; identical to SEQ ID NO: 10404
  misc_feature (1)..( 3000): cDNA_ID_1808761_gDNA_ID_2213647_Annot_ID_132414 3000 nt of promoter + ATG

SEQ ID NO: 10423 - DNA, 3000 bp, Unknown
  misc_feature (1)..( 3000): cDNA_ID_2715623_gDNA_ID_2213647_Annot_ID_132415 3000 nt of promoter + ATG
aatgtttgtttattatatggtttcatcttttgttgccaagtttaaatctttatgatctcgttttgcatttttcagcctctagaaaaaaggctgaagaagctcaaggaagtgattgttgtgaagaatggagatagctcaggatctgactcgagtccacaaggttatgacgaggaggattcatcgaggaattctactgatattgacaatcaaagtctatatgtggatgcagaagaagaagaagaactttggaggaagatggcttttgctcaagaatcaattaaggtaagcattttcagtgaatagaagaccacctctaatttgcatatagattcgagttctggagcaggtacggtgtctgcttctctgtccagcgttttccgctgatctttgcctatgttcatggctaggtaacggtggaggattcacaaagtaatgatcacaaacaaatcgaagactgtgaccattccttcatttgcaaggacgatattggagaagtgtgtcgtgtttgtggacttatcaagaaaccaattgagagcatgattgaggttgtgttcaacaaggttagtgatcactgataactgtgtctgaaatatattgattttgttacaaatattcagaagttcaatctactttctttcctggtgtagcaaaagagatcgaggagaacttatatgcgtgaaaaagaaaatggggaaacgagcagggatttctcaggaatccagtcttctcatacaaacattttgggagaaaaaatgttcattcacccatggcatgatcaggagatgaggcctcaccagactgaaggatttagatttttatgtaacaaccttgcagcagatgagccaggtggatgcatattagctcatgctccgggatcaggcaagacatttctgctcatcagctttctgcagagtttcatggctatggatccgcaggctagaccattggttgtgctaccaaaggggatcatagagtcatggaagagagagtttactttgtgggaagttgagaagattcccctgcttgatttctacagcgtgaaagcagaatcacggaagcagcaactgaaggttttggggcaatggatcaaggagagaagcattctgtttcttggttaccaacagtttacgaggatcatctgcgatgataactttgaggcagcttcagaagattgtaagctgatattgcttgagaagccaacgttgcttatacttgatgagggtcatacctcaaggaataaggagacctacatgcttagttcgcttgctcgtgtcaagactcgtcgaaaggtggttctcacaggtaccttgttccaaaacaacgttgaagaagtgtttaacattttggatcttgttcgtcccaagttcttgaagcgccctggaactcgggagattgtttctcgtatcatgagcaaggcagagataccaagaggaaaacaggtgaaccagagtagtagtagtatcgaggggactttctttgctgcagtagagcttacattacagaggagtacaaacttttctgccaaagccagcttgataaaggatctacgcgaaatgacccgtaatatcttgcattatcacaaagcagattttagcggcttgcttccggggcttagtgagttcactgtcatgctcaacctgagctcaattcagagagatgaagtaaaaggtctgaggaaaatggaactgttcaagcagatctctcttggtgctgctttgtatatacacccaaagctcaaatctttcttggaggaaaacccttccaacggggaaaagggtttttctgataacaatacaacagttatgaagctggacaagatgctgaaaaagatcaatgtgagagatggggtgaagatgaaattcttcctcaacctcttagctctgtgtgaatcaacaggagagaagctcttggtgtttagccaatacattgttccaataaagactctcgagagactcatgagctcaatgaaaggttggcgtttagggaaagagatgttcacaatcacaggtgattcaagcaatgaacagagagaatggtcaatggagagattcaacaattcactagaggctaaagtgtttttcggatcgatcaaagcttgtggggaaggaatatcactagtgggtgcatcacgggttctgattcttgatgttcatctgaacccatcagtgactcagcaagccgtggctcgagcttatagaccaggacagaagaggaaagtatatgcgtacaagctcgtagctgcggattcaccagaggaagagaactacgaaacatgtacgcgtaaagagatgatgtcgaagatgtggttcgagtggaatgttggatcaggaagagaggattttgggtttagagccattgatgctgatcactccggtgatgcgtttcttgaaacgaccaagatgaaggaagatatcaagtgtttatacacaaaggtaaactgatttgataaccgattataaccggtttaaaccggatatttcgtttggtcaattagatgataacataatattttcatacttttttaagtttttatattttgtagacatttgggtttaagagatgaaccgaattgaaattgaatctcgtttgatggttcaacgagattccggtttctattggttgttttcttttgaatctgaaacacttttctagtaaaaattttgagtttatattcatttgaattttcaattatatacacttttgttgagtttataaaaatacagtaaaataaaaccgatcactaatgccaaaaaagaatagtaaaataaataaactaaaccgaaaaattgaaccgacccaaatcgtaccattcgattcggagtaattttatctggattagtcggttaacatgggtttagtgatttaatagataaaccctagatttcttcttcacatcatcttgagctcagctcttcctctatctctctgcaactcaaaaaataagattgtgaaaaaccctaatcgtaatctctcggttgagtcagtcttaaggtatcaatg

SEQ ID NO: 10424 - DNA, 3000 bp, Unknown
  misc_feature (1)..( 3000): cDNA_ID_2715619_gDNA_ID_2213647_Annot_ID_132416 3000 nt of promoter + ATG
ttgtttttcatcaccaatgtgaatcttaattagactcttattcataaatcatctatacaatatggatcttaaatttttatattggaagagtagaagggataacatgaaaaaaaaaatagtacttgtagatgtgtaagagcccatctcaattgatttgaagaagaagcatgtttcatgttctttctttttgtacatcatgtttatggtctttcgaaattgaccatagttcatgttatacaaattatcgaataatatgttagatgatacaaacataacggtattttaaatattcccgcgaaaaccaatctacttaaggtcttctatattttctttttttggatttgtttgaataaatgaaaaaaatatttttggtgtaaatgtttgattccttttgtttatgcttctaatttttactcgtgattgatgatgaacagcttggcctccaaatccacttagcaagagcattactcaaggagatcttgccaagcgccttgacccattctatctacctaatctctttgatgggtttgaagatagtaaatacggattgcttgttgatgatgttgtgagactttgtaagctgaaacgtgactactcgagtggttatatctcgctggcagatattgaagctagagaagagaaaaaaccagccaagtctgctaatattattattagcgaaccaaccaagtctactaatattattatcagcgaaccagccaagtctgctgatattattatcatcgattcagatgatgtgttgcctcaagaatcagttattgtaagcttttaacgtttgttgattaatttgatttcatcttttgtttagtaaatacttataatcacgttttgcattatttttcagcctccagatgataaacgatcgaagaagctcaaggaagtgattgttgtggatgatgatgagccttggttttatgctaatgataagttgactataggctcggcttctactagtaatgctgttcgaaacagttcttatgatgttgtgatgtatggaaatagctcaggatgtcttcaagaaggttgtgttggggagggttcatcgaggaattctattgataatgacaatcaaactcctctatatgtagaggcaaaaaaataagaagaacattagaggcagatggattttgctcaagaatcaattatggttacttcttttacattttaattcagtcaatcacatagctctctttgcatatatagattagagttcttgaatatctggttagagtttccggctgactttttttgcatatgttcttggttaggtaacagtggaggatttaccaagtaatgatcacaaacaagttgaagaatgaagaagtttttttttttttggttgttgtcgtctgatgcactttcttaatattatttcctataattaaatataatttgaatatatttgtattcaacgagcaattcttgctttattaaataaaagtataattttaattttatactagctgttgaaaaaataaaatagtattaccatattgacgagtctatattaggtaaataagtatgaaaattggaaaatgactagtgatgtttgaataatttgccaaaacaatttcaaaacttaataggattgagtgtttgactaagggtgttttttttgggttaaaatttgactaaggttaaatttgatatgtataattaaaaaatatataatctatgtgaaggtgaagaacatatctaaccagatattaaggacatatatgtgaaggtgaaactatttgtcactttatgtgaaaatattccaaaattgaccataaacatgattcaaatatatcaaataaaaataattaatatgctaggttatatatatacataacggtattttaaatcttcccacaaaaactaattatttaaaggcgttcattttttttttttattagctttttatagagatcgaaacggttagttagtttcttctttaccgtcaaaatttaaaactttttgatttagggaatccctaatacaccaattgaagtattagcacataatcattttttttattggatgtccccgaaagaacgacactgaatcatgtaacaccaatttgtaaaaagattagcacatgtatgtatatagatcattttttttgtccaaggtatatagctcatttctattcaaacatagaaaaatatgtaagagagatagacataaccatgtgtccaccaaaatatgagtacactaagcataagtttgaagaacacattcatatatatcttacacacaaagatacagtagagtagagagcaagttgaagtgtatagatattatagatgtagatatatagttttgtcttattgactttccgaaaccgtcattgttcttgtctctctcctttgccactttgccaccatgactaattactattatgggaaacaaaaagacgcttcagtttttccagaaaaaaagtagatctatttgtcttctttgcttgaaatctctctgattcatgcataaagcttgcatctttctagtctttaacatgtttggagtcgtagttttgatttaaggagctctgtttagcgaagatcaaacatggtgggtactaatcagttttcattttcgaagccgagagagacgcgtacgtttatatactacttacactcgtttctttttcttctgtaacctctcttgttgttcaatggtgtgacaaagaagaagattagtctctctgtttatggaaagttcaaagattcagacttttgagtgtgcaaatctaaaaagccaaatgggttttgcatgatttctaaagctaaaccgaatctgttgattcaattatgtttttgattgtatcatacatggggttttgttttccactaagttcatttctggctgtagctttcctagtggttgagattttcaactaaaaaaatcgtttcttttttgggtttgtttgaagaaattaaacccattttggtgctgatgccttttgtttctgcttctaatttttactcgttattgatgatg

SEQ ID NO: 10425 - DNA, 3000 bp, Unknown; identical to SEQ ID NO: 10402
  misc_feature (1)..( 3000): cDNA_ID_2715611_gDNA_ID_2213647_Annot_ID_132418 3000 nt of promoter + ATG

SEQ ID NO: 10426 - DNA, 3000 bp, Unknown
  misc_feature (1)..( 3000): cDNA_ID_3036259_gDNA_ID_2213647_Annot_ID_132421 3000 nt of promoter + ATG
tcctttctttgcttgctcttcaggcaaggaaagttcatccagacaagaaccctggagaccctcaagctgctaaaaactttcaggtgttttgtcatattgttactgtttctttccagggtctttatatgttgttttactggaatcacatcaaattgctgatgacgtctctcatttgttgattttcatgaatgaaaaaggttttaggtgaggcttatcaggttctaagcaatccggataagcgagcagcttatgacaaatatggcaaagaaggggtccaacagtatgttttgtcctctctgtttacaactttgcatctccaacttcggtttgtgattgatttttcatttgcagggatgcaatggttgatcctgcagctgtatttggtatgcttttcggaagcgaagtctttgaagaatacgttggccagcttgcacttgcttatttggcatctatcgaagctgacttagaatcacatgaccctgaaatcagaaagcaaatgcttcaagacaagatcaaagtacattgtttatttatcgttctattttaacacatgtcgatgttttttagctacttttctccatatattaacgtgggatttgtgtgcaggctcttcaaaaggagagggaagacaagctcgccgctacattgaaaaacaaacttgaaccctttgtggaaagacaaacagatgaatttatcgaatgggcaaacgaagaggcaaagcggctttcttctgccggtaagttttgcatttaagctatagaggaaagtctttcaatgtatatatataaactagaaagatttacatcttcttgctctggatgtttaaggttttggcgaggcaatgatgcatactattggttacatttacacaagaaaagctgctaaagaaatcgggaaagacaagcgatatatgaaagtaccattcttagctgaatgggtgcgtgacaaaggccaccatatgaaatctcaagtgatggctgcttctggtatgaaacaaagctaaatataaaccaaaatgttttggttttctaacttaaacaaaatccttactaattgctttggatgattttgttttggatctgtaggtgcggtttcgttacttcagttgcaggatgaagtaaacaagttgaatgaacaccaaggagagaacaaagaggaacatattcagaaagctattgaagctaaaatggatgctttgcttcaatctctttggcaaatcaatgttctcgacatcgaatccacgctatctcgtgtttgccaatctgtaagatactatgcttcatcatacattatatgaccatttcttttgtagcaacaatcgacgaattaatcttgttgttaattatatatgtatctttctctcacaggtgcttaaagatccaagtgtttcgaaggatgttcttcgagctcgtgccataggactgaagaaacttggaacgatcttccaggtgagcaagaagaacaaaagggttcgtatcataacataaaagaaacactcattgtgtttagatttaagatgtcgagagccaaaaaaaaaactttttgaaaaaaacatgtaactcaaaaccttagtgaatttctctgttctttttctttgaagggtgctaagaagccgtacacgagaggaagcagcttgcgtcgggaagccaccaccgtgaaaatggacaccggaggttcttcaaaggcgacgtcttgaaactccggaacttaaaatgctgtttcttttattggttgaagttggatttgtccttcgttttttactttccccagttttgtagagattgctttctatgttaacttttttttcgtgtagatgttacatttaaggtggtgcattactgcattctcattaaaatcttttcgtcacattattcaaatttcttatacattcagagctagtgatgaaatgatctaaggaacaaaatttacaatttactttcggtaaagaaaaaataatagtgaatagtaatattgtatgtatttgggcgtgtttgaatcgcgtttttattccctttccatctttccgcgttgtgatcgttttaacatgacgtgccatcgttagcctaattccgctaaaactaacgacaacagaccaaaacaagttaaaatgcagtgtttggttctattaaaccgaatactaatcaaaccggtctgctgacactcgacatttcatttggtacggtttatgggtcctcaacctaaaccacacgccaatcggaacggtttatgggtctttaaccggtacaagccaatgggagtctaacggcgttaaacaaaaccggtcagagaagacttttattcgtctctttccttcacaaggaaaaaaaaagagagagagaacgaagcaaaaaacctcgctcgctagctatgtgaagaaactatcttcgttataaaactttccggcgacgttttccgacttccgagagcaggttcggtgttcatcacttgtcctctcacatgcttaattcttttcgattttgttatttagttttttttttagtttctattttgggtaatctcgacttggtttgcaagtcccttggccataatatcggatctgtttaatgttagttatgtagatattgcccgattcaatttctatttttagtgcctttgagaagatttttcattttggattttcttagtgaagaatagtcatcacagttcactcacctacatgttagtcagcaatggattactggatttgattctctctttattttcattctactttgaacttcatttatcttggccatggccagtttaagttattgtgtagattaatggtaagctcttttttttagtgttattgttgaggttatagtcataattgattctgattgagttcttaaaattgtgtttttttttgttggaaggttttgaggtggttttatgcgccaaaacatctaaccggagtgtcgttgtacggtgcttagtagttttcaataacacgcttcagttatggggaatgcttgttgtgttgctactcgagacaaaatg

SEQ ID NO: 10427 - DNA, 3000 bp, Unknown
  misc_feature (1)..( 3000): cDNA_ID_2715603_gDNA_ID_2213647_Annot_ID_132423 3000 nt of promoter + ATG
gttctagtcttctagatgttttatattgttcttcatttactcaattttttcacgcagtgcaaacattattctcaagatgacacagagaacttcgagtcagatgagtacagagaaaaccaagaaagtagcagagttaaaccagactcaccggttaactatcaaacctacttgcagtattgtttgtttgaaaagctgcatgcgatcattcatcttaattgttcggtttcttactcctctgcaaatcatacttattaccataacgtgatctagaagtttcaacaagaggctgatgcatagaaagctgatgaagaagctgaaactgcgggtaatgtaagaagtcactgctttgctcattttatcatatgctttagtgatgaacctcctttttgtaaaatcatatttgtttgtccggttctgtttgtgcatgtatattcagcaactacgatttgtcgatttaacctgaaaatttgattttttggcctggttttgtttcaaccaactggattagtttactcaaaattcatttcagaaaatgatcatttaaatgttgtggttcttgcaggcgaaatgcgaggaaacgcaggtgcgaggtgtgttgctcaagtagaaaccgagaacggtccaagatcagaccgtacagagttccaacggtggattatttagcaagacaaattctgggcttctttttgattatttagcaagacaaattctgattttcaagacttgatctagaatgtaattactattttttgtccaactggatgcattttgtgggttacattattgtattgaaataaaatatagtgtggttatgttgaaaaatgattagagcaatgattgattaaaaattctactaccagaacgaacgtactaaccaatcataacacaactgatcattacgaagtctaaaccgaaagtcaatatttcgtgctgttcagattcaattaatgaaacttgtctaattttcttttgtcaaaattcactatctgttgatttctgtaatataaaaatggatatatattgtgaaagtaaaacaaattaagtaataaatatattcgaactagaaatgggaaggcctaacgaccgttgaccctccctttaattgctccgtatttaattgatttttcttctaatcttgttatcatcctccgctatccgccacgtgttgtatgggtcccacggtacgggcaatgagagaaactacactttgctccctattttaattaataattcacattttgctacacaacatcttctaattgtcaaaactcaaaactaacaatcatggtcatttaaaacaagctatatacatttttcaaatctgtatttcaaaaaatcaaataaaaatcatcttaagtcactaacctatgtgattaatcaaagtggagtaaaattttccgaaataacatttgcaaaaaattgttgaaatctaaattgacaatagttataataaaatatccaaaattaagtggggtcatattgtaaagaatatttcattttccacctcctgttttgacgtttctcttcttttttttccaacaaaaaaaacaaaagcaattaaatagtgtttgtcgtttagttggcggaattctctcagttgaattttgttataaaaatcttacaggtatacaggtctactgtccatagatccgttaaaagttttacctacggccattaatgaccgtccgatcttcctttgttgatgatgacgaggaccaactatctctgcactttctcggtttctccttatttaactacttttaatattactccaaattcacaccccataattatgcttctttttgcatatttgatcaaaaactagttctagtgacagaattaacctcaatttccgtaaaccaagttttaatatatatcaaatgcaatactcgatatcacacattattcactaaatgtgggagactttcatattttttgttttgtcacacactataatatgaagaatgaaagtaacatgatatttttgttctaggtgtaatttaatttccaaaacattaaaaattcctgacacaaaatactgtaccaccgtcaatttggggggtagattgaaagaaaataaagtgtggggctcacagataaaaacgaatgtaacagttggggtctcattaaatagcggtgcaaatacaaacttctctataacaaaaatctactactattaaaaaataattaaattcgagaggcagtttaggtgagaagaaactgagaaagttcggtccgaattctaatcccacttttgtctctcaatttgtttcccctttctctctctctctctccttcaaatttttttagcgatttttctgggtttcatgtaaatgtgagaagtagatagattctcaacaagaaaaaaaggttttttttttttttttttttggattcgtggatcagccatcttctcgaaagatttgggaaagatccaaagaatcacaatattttttcgatatttagtcgaaaggaatttaacatgtcaggtccacttgatcgatttgcaagaccatgtaagagatctcaatcttctttgtaatgttcttgcttctgggttagcttttttctaggtttactgtagcttaaacttggaattgtgtctaatataataatgagaatctaaaaattgtgtctctttgctttctcgtgtcttcaatatatgttgttgagctggttaaataatgtgtattgctttagataatttttaatgtgtctcatcaaatcaaaacagctttcactacaggttttgagggattcttgagcagtgatgagaaaaaggaaagaaagtcagattttgagaattcagaggatgagaggagaacaagaatcggttccttgaaaaagaaagccattaatgcctctactaagttcaagcattctcttaagaaaaagagcggaagaagaaaaagtgatggtcgagtgagttctgtatccattgaggatgtgagggatgtcgaggagctacaagctgttgatgcgtttcgacagtcgttgtta

SEQ ID NO: 10428 - DNA, 3000 bp, Unknown; identical to SEQ ID NO: 10399
  misc_feature (1)..( 3000): cDNA_ID_2715600_gDNA_ID_2213647_Annot_ID_132424 3000 nt of promoter + ATG

SEQ ID NO: 10429 - DNA, 3000 bp, Unknown
  misc_feature (1)..( 3000): cDNA_ID_2715686_gDNA_ID_2213648_Annot_ID_132425 3000 nt of promoter + ATG
taaaacacttcctcctctgtttgcttcccatgttgactttcctcctctgtttgctttccatgtttcttttccttcagatctgccacaaataactcaatagacttcactctcccatcaatggcatcaatcttatctcttgtttcctcaaagcctttggtcatcatctgcgttagtgagtttatagatgccacaactgcatctaattcagggactcgaggagggacagcagtcggaggaacatctttctcggggacatcagtcggaaggacatctttctcggggacctcattctcaatctcatggacaacatcatcatcaagatcattaacaatacatcaagaagaaatgtccagctcacacattcctttccaccatatcttcttcttctctacaaatagtcgccctttccaattgtcaataacaatatctataagatcgaggtcatcatcaacatcatcttctaagagactgtccaacagatatttctcatgatactcaggtaccaaatggctagcaatatcctgtgaaaagaaactcatttagcaatcaagcaatctcatgatatacagacaatcaagtaaatacagaaactctaacctcactattcccaagctctttatatataacttccaacgggacacctttcatgctacattctttaaacttatgcttgcacatccttggacagtccttctctgcacgtacagggactctaaatttcagttgaagctgtagaatagcctcataagccagaatctacaaataacaaaacaatgtttaatatcataaaacctgtacattacaccttatactcatataatgatcataaattacttatctcgagaggcacaatgaatccactgtagcaaggttgagcttttggtttcacgaaaccatccacgttcttcatcattttccttatcccatccaaacattccaagaagtattaacggccccacagaaacgtctcgtactcatccaaaccgccaacaatccttaaaagaatctcttctatgtttccatcattctttgagtttgcttttactaccttgaccaggaagtacaacagcactaacttcaacctatctgtaccgctgcgtatcttctcgtacttagtaagaacttttgaaacctttatcccagtttcttttttgaagatcctcttcacaaactaagtattccccattgtcttgagttattttgggtaactacggcaatcaaactcacttaacaacgcatgctctttaatggaatacctaataggtactctatttacaacaaaccaagcctcctagagcaaatctgtcttcactgtgcgaagcataagcacccacatgccttgcatttggtggttaggctcctgagacatgtggaatatacgcttgaactgtgggtgttttcgaaatcattttgcttcttctttaaaccttctatctatcattgccactatctgcgtgacttggcacctactgcttatcttgcacactttgtcgtattctgtaaaagaaaaatacatggtctctggcgccagtggctgagaatcatcttcatcatcctcctcctttaaactatcattgccagcctcatcttcctcattttctttacaagtaacctcatcatcctctggcccagaatcatcatcctcggcctcacatgtatcctgcaactgcgaattcaatgaacattgaccaactgaacaatttagaggtatcaaactaacaattcatatgtactcattgaactagttccatcaaattacttatatcaaacaattgtcacatatgaactagttgtatctaaaacatttctaactaatactcaaacaaaacaaatgtgagtcatagagattccaatgtatatacttgacaattaatgttctctactccttcttttgttgtattcaccatttcctcctcctccagctcatccccatcaccttcattcgcttctaggatttctataaagacagcctcaagtagaggttcttttgcagtatgggttggtggttatgtcttacccttttcaatatcggcggttcctttagaagaagcctcatcaccatctagcgattcctctatggcctcttcaatttcagcagttttttttggagtcttattcgctgaaacatctgtttcagctggttcggtcggaacctctacggcggcatctccgtcgatctcaatttctgaagaaactgtttgtgatgtcgaaacttcttcggacggcctctccgtcgactcatatacatggccaccggtaccatctctaacacgagccatcaaactattacacgaatcaagaattcgtcgaaaaatcgtgaaagccgaaaaattaggaatctgattttggaagaatctgaattttgtgagagccgtttttttaaaaatcaggaatttcacttaagtgtttgggatgagttttgtatcgatggacatatatcttaattggatcgaatacttttttgggtcgtctaggttttagttttttaccaattgttttgattttttcttatttttagtttaacaaagaattaaaaattagaaaaatgacattcttgattttttttttttgagataatggcattccaaccatatattctatcatttgacttaagaccgtttccgtttactaaagatcgatataaaaattggctaaagattagtaatttaaattttttgttgtttcaagttcaaaatcgcattgcatatttggtaaaggtttaccatatttgacacgatatgtgggaaaaaaagaaagtaacaccgatccaaaaaagaaaaggactcttaccttaactttttattattaacatatttgaccctaaaacttcttatctgagcttatcagaccaaaccaaggtcacaaataaaaaagaaacagatttgtaatcgattgttcgattcacttcatcgttggcacacacacatactctctattcgaaaaattcgccactgcaatttcttctagggtttctggtaatcctcacttagccgggcaatg

SEQ ID NO: 10430 - DNA, 3000 bp, Unknown
  misc_feature (1)..( 3000): cDNA_ID_3036389_gDNA_ID_2213648_Annot_ID_181537 3000 nt of promoter + ATG
tgtggctttgcaagaacaattacttgaagctcaacgcaagatagaagagcaggtttcttacaatcagaagcgtgaatctgagattgctttgcgtgatgttgagaattcccgagctgcagatgagcagaagaagaagcttgagcacttgtccttagtggagaagtttttcgcgaaaataatcctcggttcctcaatttcctcgaatgtcattcagctaaggagacaaccacagatcctatctcaccctctccagctgcctctccctcttcatctgcttcataggtctgaatcttaactccttcctcaagactcaatatcacggctcaaagtttttatctatgtgtacttgtgttgcttgtatttatgctgaacaaagttctaagttgtagtgaatcgaacatgtttttgtaatttgggttttgtacttttctgaaatgataataaatttgttttcatgcttcttgtattgtgtttatgcttcttgtaatgttttgtttttgcaggaaggtttccatctttagaacaatcatataggtgttctaataaaaccaatagtcgcaaatttagtcataaaaaatgtaaccaagcagtcggtttttgataacaattcagtcactaaaatttctgactaaatgatatttcagtcgcaaatcagtcttaaatatagtgacaacatagtcgtaaattttaacgactaattacctacaacgactacataaccctcaagttaatcgttaatttgtcgtccaatagtcgctaaatttaacgactaaaatgtcactaaaaaagcgattactttaacttagtcgtaacttagtcgctctttggcgactaaaatacgactaccgtatttaccgactctcgattagcgactaaatttaatagtcgtttatttgtcgtaaagtggtgttaaccgactacagagtgactactactgaagtcggtaaatggtaattttcttgtagtgttgtttaacactgctttgtaatgttatggtttgtacgaattcattatccttctcatcaacggtactgaattttatctaattttaatgcttatattctcataattttctaagccaatatgatatgtctataatttgcataatttagacactcattcttcaccactttgtcattgtttcatccacatttcagctcattaggagtcgttttagtgtgttttgcatacttaggaaggttttgcattaggattgcatgtgcattgcatatttggttgttttcaggtactttggatgcttttggagttcaaacagaggaaaaacagaatgggaagtcaggatgcccaatgacgccttcagtaaaagtactctatcgcagcctcggagccctgccagggcaaatcactctatcgcaaccctggagaagctagcagctcagtttcactcaattgcgaagccggaggaatcaccccatcagaaccactcgaccatcacctaatgacatccactcgatcgcacttgatcacagggttgctggaccattcaatctcgacttcactacatctcactcgctcgcaaggcggagccttgaagcccagtttgatcaatgacatactcgatcacatggaagctcatttcagcccatcagatgccaatgacacattcggtcgcagggtcatgacgtgaagattcgctatatatctattttccttatttgtttcatttctcgcttatataaactgcctcttagggttttccctagggcatccgttgttatttcgtttctcatcaacttttacattttcgcaactttcatagccgcagtgtttctcctgcgactttgtattttcactttcaagtatttgatattcagttttcgtttaagtatttcgttatttctgttatcatgttttcaatcgttgctttgatattgtctttgattatgtctgagtagtgaaccgtatttctgaggatgggatagattagttgtggtttacttggtcgttttaggtggttgagtttagaatactagaatcccttctggattagttgtgattattgcttgtttcacgggctaatgtggaatatgagtccagacgtccagcgctcagaaggcgtttaatggccgttggatcctattaattctagagatatctgactctaccccaagggattggctgtagagagggtattggctttaacatgttgattcgatagtaccttcttagttagagattgctaatgggaattaggtcagtgtctagctttccttgaggatttctatcacgggagtgaattaatctgttgttgaacttgttgtctatggatagcttctgtgaagttttgtcaaccacctgaatagattaaggagaccacactattcgattaccccatccttaggaatcgtttatccatttgattgcctgttatcatttctgctttgttattcaccagcctgttattgccaaatctgcttttagtttcatttcatttctgttattgcatactaggactattagaaccaatcaactctctgcgtggcttgacttagagctttctaatcatatctcatctgtttgcatcacaccggattggattgacaacctaaaataatacaacgacaggataatgttttaggattaattgagaaaaatcctactatcaatttggcaccgtggcgcgtttggtgtttgtttgctatatttgatatcattagaaacgttaagatcaagttcgtttttgttacacagttggcgagcaatacggtcgatgtttttgtttcggtaccttgcaacccgctttacagacgcatctctgattcgtctgttatagctcggctgctatttgttgcatgcatacatggtcacaaggaaatcagaacatcctattcaacaataacatcgaccgtattgctcgccaactgagagaacagacagaaaccgacacaatggtcacaaggaaatcagaacctcctattcaacgataaccttgaccgtattgctcgctaactgagagaacagacagataccgacacaatg

SEQ ID NO: 10431 - DNA, 3000 bp, Unknown
  misc_feature (1)..( 3000): cDNA_ID_2704909_gDNA_ID_2213648_Annot_ID_132426 3000 nt of promoter + ATG
agaattaaggggaattcagcagaagagtggagaaaagttaccaaagtaaggaaatacaaattcgtgtgggttattattagtttctttgatggctgccatatagtacatcccagccttttcaaagtccccctaaaacaagaccatcatcagacatcagaaaggaaggttacacaaaggaaacaaaaaaagatgcattcttctataacagcccatagaatgaaaaaaacgcctcaaatatatcacaacccaaataaattatttattactcgtattttttcctccactggcaagctcagagggtagataagaatggaatatacaagggaggacaaaaatgtcaaaccttgctatgatatgaccgtgctaaattgtaaaaagaatgtgactttgttggcccatgagttgtgacggctaatgctgtttcagtcagctgctcaacaagaaagtgctggccggtgaaaaaaaagtgattggccaaataatttaaggctgatgcgcaatagggataaatctcgaatgcctgctgcattctgtccattcctttcctcattcctatagctatacatatgtaatatcatcagtgaaggccaaagagaagtaaagttaatagaatctttccagcccacacgcattatcataagatttagaactgaggtatacttacaatcatttgcttgcaaatccataatcccaagtgccacaagagcctcaacattatcaggatctagctgcagaaatagaattatggtaattagcactatttgttgacgcatacagtcagctatgtcataagaagatgagataaacatcccagtcccacttgcctgcaaaacgcgatcaaacgcttgccgtgctttatctagttgccccaacttataacgacaaaaccaattcccagtctcacagctgcaggacaaccgggaaatacttgcaaggccctctaaaagaattcaaaacatagacaaatcaaaatactaccaatttgttccataaatagactagatggttcacttgaacaatcaaagccatgagatttacagccaaaatgaagaagtggtatacagaaatatagtaggttataaggaaaagcttaccttgtatagttgtaatgactcagaaaatcgtccacgattaaattctacagaagcctgtatacgtgatagagcaagttattaatttgcagaaaagtaaacaatagactaatactgtgtcaggcctaggttggtaagaaagagagcgtcagaatcaaattcttactaccaccaataaattctagtatacagaatctacctacctacaaattattagctaagtgacagaaaatgaaatcacaagtcattatacctgacccagaagagcaggaacattatcaggggcagtgtctaacacaatcttaaatgcctgaagagcattatctatttcacccttagccagtaagagctgacctgtaagcagacaattacatttcaggattctgtatcttagtaaacatagagcatcatcacaaccttcaaattcttaaagcgtacattgtacagggagaaccggaaaagaaagattgttataggaattgcttgcaacagaaacttatcagtcgaaacgaatctggtagtacctttcccaacccaagtggaaggttcatgcatatcgattctcgatgctttgttataatatcgtgtggcagagataaattgctcctctttctctctgtttttggtctcagttttaccaaggtagctataatacgcacctagagcattcaaaatcgctattctctcgtacttaacatcggcatagtactcgtcaatgtcttgccaaaaagaaacaaaaaggacttatattttcgaaataaccaattctagaacaaattgaagcagcatcatcgtataactgcttaccagaacttgacccttcctccaatatttgtcgaaactgttcaatttttccttgtttgaagtactccctcttcaccatagatgaaaccaaaatcagaattggaaaaaaaaacaatctttaagcaaatcagccacaaaagcaactaacttttgaagtgttaatcaaaacccatcagccattaactaagaaaaactcaacaaaactcgattccagatagaacctaattagagtggaaaagaacgaaccgcgatgatgagccagagatcgagaggagcttgttcggctttaagaatatcaagtatatcagaagcgtcacgagggagctgatcaagaacaaccctaacttcttcttctgaattctgaaccggtatgtacacactcgccattgcccggctaagtgaggattaccagaaaccctagaagaaattgcagtggcgaatttttcgaatagagagtatgtgtgtgtgccaacgatgaagtgaatcgaacaatcgattacaaatctgtttcttttttatttgtgaccttggtttggtctgataagctcagataagaagttttagggtcaaatatgttaataataaaaagttaaggtaagagtccttttcttttttggatcggtgttactttctttttttcccacatatcgtgtcaaatatggtaaacctttaccaaatatgcaatgcgattttgaacttgaaacaacaaaaaatttaaattactaatctttagccaatttttatatcgatctttagtaaacggaaacggtcttaagtcaaatgatagaatatatggttggaatgccattatctcaaaaaaaaaaaatcaagaatgtcatttttctaatttttaattctttgttaaactaaaaataagaaaaaatcaaaacaattggtaaaaaactaaaacctagacgacccaaaaaagtattcgatccaattaagatatatgtccatcgatacaaaactcatcccaaacacttaagtgaaattcctgatttttaaaaaaacggctctcacaaaattcagattcttccaaaatcagattcctaatttttcggctttcacgatttttcgacgaattcttgattcgtgtaatagtttg

SEQ ID NO: 10432 - DNA, 3000 bp, Unknown
  misc_feature (1)..( 3000): cDNA_ID_2704957_gDNA_ID_2213649_Annot_ID_132435 3000 nt of promoter + ATG
caaatttttacctattaaaattttaaaataattaaacattttgggaactctctaaatcttaaaaaaagatcgtatttgattattaaggtattattaattaatgattgtggttatgatgatgccacacaccattcattatcgtattaatggaatgcatagggaatagctaaattgatgactgttgtcatgtgatgaaaatcccttacttcgtgggttgcgatatctcttccgtttatttctgaccgtccgatattctcattcaaacatgtgtagctctactcacgttcattgattatctcacaatcatctatatggtactatatatagatcgccctatgaatgatttttactcaaaatagtctttagaatttatttctgttaaaaatagccttcaaattttcaactaccagcttctattaaagcaccatatacttataagtgaattatattatgcatatgtatttctactgttagagtgtgcccatgttaacataaatctcattttgtatgttatatgaaattcaaacttcaatagcaaaagagtaagagacgttccaaattgtacgcaaagataaaaaaaaaacaaaagtaagttcaacattatcgaataataatatggatacccttcaaagtttggaatcttcaaagatatgctttgtctcagtttagtgctttgtatttgaaagcagattatagcatctgtatatattatttctgatcgcatagtttcctaggggtgtccagtgtccaatgtactggaaaaaggtatcgttgccaaaatttgatacagaattaggaatattttaaatcgaaaccgtaactaatttttggaacctagtttagaattagaagaggatttatattttcgtattgcaaagggtaaaaagaattaaactcatataagaattgaactttcctaatcgaagtcagtgcagcctttaaactcagaagttcaacgtgcgatatttgcaagcctgacacctcaaacttattcacactgagaatgcatggtcgaccatctgaggtcatgttttgtcattgttcggctaacgaaagcactatcaaacaaacaacaatttgtaaagagaaccagaactaaccaaaaatatcaaacgtaatgctgttaaaagacaaaacaaaaaaattcgattgcatttggtgtccaattaagatgaaacttgagagtaccttcccgatgaatttagctctatctatgcatcgtagtttatactgttaaaatgaaattgtggtagtttcatgtatttgttaaagtggaaataaccctattaaaaatgcccaacaatattacatgtcgtcatgcgcaaagactttaatctttttttttcaactgaattttctaaatttcccttaaaaaatattttagttttcccccccattttattatgatatttatgacacaagcaattacatcactacgaatagacacgagagacacgttcaatccgtaatattagtatattactttgtttaaattagacacactacctacaatatcaacaaaattaaactaatcaaatcatcacagaatttgtaaaattgtaactcaacgagataatgctataagaatccaccgtttgcggcaaaatcactaatttttttttttttttttaattgaaattgaaagcataacttcgttggaagaaattatgcgatggaatttaattattttttacaattcacacacattccaaatcctcaatttgaattttaaaacgacagaaaacaaaaattaataggcaacaattttgatttagtacaaaataattccgttggaggaatttcagttgatacttaagtaaaagatcatgcatgtgttagattttaatgcaattttattaaaaaagcaccttgaaaacttttaatagtatggacgacttaccatttacttacgattatgaacatagcaaacagttagacggattatgttgaatgttgatcgtctgatcaccatacaatgtagatttcttacacctaataacacgactgtactatgtagcaataaacgtctgaacagtaggtgacaatccatcaactcatttggacatccattatcaaaactaaatatatgtaaagcagactaaatattggactaactaattttactaaaatattcacctaaactaattacactgaaagctaggaaatacatcttaattatatatatatatacgtctatatttattttgtttataaaataactatgatatgttacaaacaatataatataaataagatatactaattcatcagaaattcaatgttattcttcatagtaatttattaaaataaattcataagaagttatctgatacaaatatgtaacacgcacatatatcacatcaattcaacattttatctttcctatatatagtattgaattttatttgatattttctatctaattgagatcgatttaaatatagaactaaattttttcagtatattttatcgaaatgatgtaaaataaatcatatttaccatttacgtctgaacagtaggtggcaatccatcaactcatttagacatcaatagtcaaaaacaaatatctgtaaaacagactaaatgttggactaactaattttactaaaaaaaattatatgatacaaataactaacaaacacatatatcaattcaacatttcatttttgctatagatagtaattaattttatttgggattttataactaattgaaatcgatatatatatagctagtaattctttttaagtattttctatcggaaaataatataaaatactatttaaatcatatttaacagttgttagtcttactagacaaaagaaaacagacaaaaaaaaaaattgtattataaataaaaaaaatattgtcactcgaagcctttaaactcgcctcttctctcttctctctcactccagagtttctctctcccctttaaatggtcgccggaaactaaatcgtctcgaacattcattagtaaaaccggacgactcagcggcg

SEQ ID NO: 10433 - DNA, 3000 bp, Unknown
  misc_feature (1)..( 3000): cDNA_ID_2704949_gDNA_ID_2213649_Annot_ID_132438 3000 nt of promoter + ATG
aatgatataactatcaatatttttcgtaagaaaacacaagtttccttattcttttcttacgtcggcgataaaagttaatgtcgtactttgatttatgaaattgtgatggaaaattgttttaattaattaagaagagaaacgagttatttgtacaaacaaatctgaaaatatagaaatagagcaaaggacagagaataagaagaagaggcaaaggagggcgagagttcacatgttcaagagaagacaaatacgtttctctgacacaaatctgtcagaccaatatttttaaatattttattgtatagtttttattttgttttgttgtatgagaaagaaacgtatattatgtctttattaccaccacaaggggtcaggctccgtccacttggggtcccaattttttctttgttacgagtttttttttgtagtaaaaggcaagtcacgccggcacgcgagccctcacgtgatcccacgtgctttatttattctctccataccaaaatttcttttcctttgttgtttggtaaggttttttcttttttggccaaaatatgatattggcgagattgaaaacatgtatatttttaaaaaaaatgtaggcgtaaaaattatgttactaacacttcattaagcatatgccaagatttttaaattaaaatttatatatcactattggtcgtttttttttttgtgtgtgacagcagctcactattggttgtttatattaaccacatactaaataaggctagctactaccaaacttggaccagaacctaacacatgatgttatttttagtaatatgaaaaaaaagaaacgaaaaggaaaaaggaaagaatagatctttctggtgagagagcatacacaacacattggtgacacaaggtatctaagggcatgaccgcacgtgtcaacatgcatcaaacatgcgatctttcaatattagtattatatatttagcaaagacgcaaaagaatccaaggcaaagactacttcgcctgcatgtcatgccaatctctctctatatgttttctaatcaatatactagattactagacaagttgttttctaataagatctctcacatatgagccaatttgagccaaaacatgatatgatggataaagcttatttgggtattgaaagtatagagactgtcaatgagaaagtagtcatttgggcccaagtacagagatttaaaccttatcaggaaaagcccaatccagtacaaacttgaagaaaaagattgatctccttgtaagttgcaactggtaaagaataggacctttgttcaaggtctactgtattgagatactgaattagtataaacggccacttaaaactactttgtatttgtttaggcccaaaacattggactatcatgttgagaaaataaacacgaacgcaacagaagtttcctacttattatatagcccaacaaatattgatctctttgcttccaatgaatctttgttaaggcccaaaaaatacaaagccgaaactacttccatcttgtactatttttaagtttattttttggaaattttaccatgtatgattcagatcgttggtttaaatttttacaactagaaaatagtatatactctattagcctattatgatattaattaatgggcaatatttcgattagtttacgtgtagagtgtagtgataatgtatttaggttttgaccggcaataatgcatttgtaagaaaagtctttggacaataatagctttggtcaagtcaatgtagaacagaagactaatttctcttgacaaaatattaaaccttaaaaacaaatcctgtcagaccaaaaggtgatacgattgtaacttacaaatgatactatatatttttatagttaacagtctagtatttaaaattttgaaatattgatgatcattgattggttcatataagtaatccattaggttttcatgttggtcaatacagatgtacatgttttcaggattaatataggttccgtcctatgaatttatccgaccatgcataagagtaactctttaatctactattacaagttttcaggatttgaaagctctatacaagtttaactttatgtgtatattagttaacgtttgtaaccacagattcataatatttaccgtcgaactcttagccataaaattcggactaaaagactcgattcaaaaaggtatcgatgagatggaaagttgttgaacttattgtataaaagcttagagaggatattgataagtcgtcttttgcttttgtatctacagctatgacgtatattgtttaatccaaatcaaagtgttttaaagatattttggtttctggtggaggtggtatactaaagattcacatatagatagagatatttatgaatacattgatatgaaaatcatatacaatatgctaaagaacaataaatggtacacatatggattggttggatatggttggcacttggcagttaggtcattttcgttgctttactaaactttaataaacagtctgtaacatttacatttatatacgccaatgccaaaaaattctttattttatgcaatggcacattttctgcttttcctttacaggcaaaaactctttctttcctaaagatgcattatttttccatttgataaaataaaaaaaacttgacggtacaaaaatacacagaagacaatcgaattaagtaatgactaagtattaagattaggtgaaatggtgtaattaaaccgatgggaataatataattattatttaaatacagaaacagagcttgctttaccaaataccaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaag

SEQ ID NO: 10434 - DNA, 3000 bp, Unknown
  misc_feature (1)..( 3000): cDNA_ID_1808560_gDNA_ID_2213649_Annot_ID_132439 3000 nt of promoter + ATG
acgttccacgcgttcagcaaaatctttttgtctgctgcatgctcagatggaaaaaaagatcagctaattaacaaaatatctaatcagaataatcagaatagtctaaactaatgcagctttacttcatcttaaatcttattcattttcatatatgtaaagttggttacgttaatattaaatctttaagagagcggggaatccgagaacaaacagtgtctctccttcgctaaattatttatttatacagtatagtattaccaaattgcaattaattctttttttatatataagtggtgacaattagtggacttcgctttttatgagaaaaaaatatcattcatattgagacaacaacaactagaaaaaatattctacttactgtattatttaaaacacagatatgtcaataattgaaaaatatgtatgagtggatcaacagtaaaacaaattatatgtaacatatcattctacaacctctccttaaatcaattttttaaattcaagccaaaagctaaacattaaataaacagtagtgccacatgaaattataggtcggaccatagtgaaaatatccactatatatactttttttttttcaactatccactatatatactataaaaacaaaacataaagtccacagatgctgagaatttaattaaaaggagtacacagctgtaaagcctacaacttttctttctcatttatggtgcgaaccttttattgtcctgcccaatgcaatttttttaatatgagtaattaaatatatttttcgtttttataaattcaattttcaaggagaaaataattcgatgtatatgcatattttgtgtgtatatattagcaaattttcacgtgtggacaatctacgtcaatggagtatataaacgtgtgttacgtaggacaaatcagtcgttggattagtagttgccaacagttgccttgattaataaattggtatcatactctcttctttgtgtttgttagggtcaagataatatataaatttgtgatactaatcatagacattttacgacaaaaatacggacctgttcattactcgaaaactatatgaagccgaaatagataatgtcctatttttcctcatcattatcatgaaatctatttaaaaaaatcaatagtggtgtaaaacaattgattcgtcatgatttataggtatgattgctattcttgatttcaacatcgtcagatactaaaaatttcccaatgagtaagttaagattcggaccactgttatttgggatttcttaaaataaataatcaacaacagatttcgtgctatgcccggtaatgttaaatgtagaacatggggtgttttgttttacttaattgtcaatcataaatcaaatattcggattaggaattacgtcaagtgccaattagattgttatcactaaaatcatatcatattgctttctaaaccaattaacgtcagtccatttatttaaagaaaaaataaagtatttcactaaactgtccagtccatttcaccaagtacttagatattcataaacacaaaattaatcactcaacttttaaaaatatttcttctagaccaaatcctgtaccaactcgtattgaatgtttcagtgtaaagtgtaaagtgttttcttaaaaaaattagttaaaaaataactgaattatcacaaaatattttcagaacctagtcacaaatctaataaattacatataaaagcttcttcatagttaaaaaaaaccagtgatttcagtaccaaacaataagaaaagctagcatatgatatatttcttttgctaagaagcatatgatatattcaatattcgtccacgatccactgaatattttttctttattccactgagatttcttttcgtcgctactttgaatctgaacattatttttggtctctgaatctatatgtttgcttgtctttcaacatcatgactcgcatatcgatactacaacttcaactcttcaagcaagacacatggaaatataggagttaacacatgcaaactagcacccccaaattttgtcctcctggctcctacaatagctggaccgaacctacatgaagccggctttatctggttctcttctccagttatgatgtcaaatttaaatcattcatccctcaacaagaattgtcattttaggaaccatcatcataccgagagagagcaacattttatctataaatatagtaatagttctactcttatttcttccgtggtttcttgtaaaaaaaacttatgcatgttcgttcactaaatagtagttaaatttgcgataaacgagcgagatatgtcatgcataaaggagttaaaaattacgtgaagttatttcaatgatcatgcaagaaggattgaatgacttgtaattacgatcaagtaatataaaaatggtctatttgttgttccttcgttaccacagtatggttcttacatgtgaaaatgattgtgctttacataaatgtagtagtacatgagcccataaaaagttactgctcagtcgagttttcactaaccggtgaaaagaaatggataaataaaaatatacacgactacaaatagactctttaaatttgacacgtaaactctatttttcaggagtctttgaggcccactctgataataatatgtcaactaaactttctttttacaaacaaaattaccgttgcataagacacatgtcgtcaattataatccaatatgaagaaagaaagaatataaaacgaaaactttacttttcttatttttttcctatttttcaagatgctaggaagtagccaaatccaaagcattgactcttctttatccaatgtctcaccctttgtcttcaactgttcctcatccttcaccaaaatctctctctctctctcttcttataagaaaagagctaaaaagcttcccttcgttttactatatccatgattctgaattccacacacactgagagagatagagggacacattaaaagctaattcaacttttctgca

SEQ ID NO: 10435 - DNA, 3000 bp, Unknown
  misc_feature (1)..( 3000): cDNA_ID_1383349_gDNA_ID_2213649_Annot_ID_132443 3000 nt of promoter + ATG
cgaaagagccatctttttttctttttttggacaattgaaagagctatctaatgtccgttccttgggttttttataaagacagttctttaacgaccttatgagaattttccacttgcagttgatgtttgagactttgagttcgaaactcataaaccttgacatgttatcgaaaactaaattgttgatacataagtaaagtggtctaactgtctaagtaatatttttggccgatcgataaatatgattcaattataaaatgaattttaaaaacacatcatttctagatagtttcacattaaacaaaattgactatcaagcattgtatcagcaaaagaaagatatcaaggggaagagaagagtttaaaattcataaatgttgataatgcaaggaacatggtacaaaatatctaaatttcatttctgcaaatctcttgtcgttagctcatcttttccacatctaacttacatttaatgatggattcgtatttaaattttacattttcaacaagagtaacaataaaaaaaaacaccaatccatataatagaccagacgaaactcaaaaagtcagaagagaagagagacatcttcacatggccgaatgaaacacatatccaaacgccaaggacaaagaagaattcatcactttcttccatttcttctctgcaacttccgtaccaaaaaatacataaagccctaactaatattatttctccaccaagtttctttatcttttagtttcccggtaaaaaatctctctgtcatgtcttatgttcttccacgtcgttcctaatctcccaagacagaatctctaaacttcattttgctccttttccacacaaaactttctctccctccaaagaccacaaaaaatgttcttccttccttcaacttcaagtatctctctttattcacacgtatagcatccaaaaccaaaaatctataaccttttcctctgtaaagtttcttcctttctaaccttcccgagaaaaaaacaaaccctttctgttagaaaaccatgagaggtctcgcggcttgttacagtgaacacgccattaaagtatcagatacatattgttcaggtccatcgaatcattcctatatatctccgacattacctccttcaatccccgacacagtaaccaccacttatagatccaatctcccatcttccgacaaacccgtctctgtttcactcacctggtcggataatctcaccgtcgtcatctcaacgccgccgaaatcatactctgtttcactcagaaaacctaaaggatcaagaaagttgacttcttcctccggttcactcaacgccgagatcctctgggatctatcggaagcagagtacgaaaacaacggacctgaaccaataagaagattcttcgtcgtcgtcgttgtaaattccgagattaccctcggagtcggcgacgttgaccacgagcgagacacgtcatcatcgtcgtcgtggcgagtctcaaaaacggagagattctctggaacttgttggctcacgacgaaagctcaattctccgacgtcggaaggaaacacgagatacagattcaatgcggcggaggaggaggaggaggaggagaggaagggtatttatggaaagtgaaaagtcctgaaacgatgtcggtttatgttgataagaggaaagtgttttcggtgaagaagcttaagtggaactttagagggaatcaaaccatgtttttcgatggaatgcttatagacatgatgtgggatttacacgactggttctacaaagaaacgttgtcgtctgtttcgactagttcatcgtctaaaacggcgtcgtcgtcatcgtcttcttcaacttcatcgtctactcctccgtgtgctgtgtttatgtttaggaggaggagtggtttggatagtagattatggattgatgaagatgaacaagagagtgagatgaagaagaatattggttctagagatgagaaacattcgttttcacttatcatttgtgcctctaaaaagtgaccaaataaacaaataaacattttaacataactcttcgttgtctgaaattttaattttaagaatattttgtgttgcatttaggtatatctgataggttgattagatcaaatgtttttgtgttttttctctgccaaatgttcgtgagaatgcaagagatattcaaattgtgttcatcaaaactaaaatttatattcaaaaccgtggatggcaaactatgcataagataaaatgtacataatttttgttatcttctaaaataaatgtacctaatttaatagcctaataatatcttctaaagttattaacttttgtttatgacaatgatgatgataggagcattttcgatatttccaaaaaaagaaatggaaaggacattgcaacaaaattgaaaattcaaacaaacaaacaaaataaaaagtgcagctaggggataaaattcaaaaggcaggatagaaaataaacaagaaagaattcatgaataaataaaaacactagaagttgaaattctgaaaaatacttgaaaagaattgatacaatgaatttgatgattcattgtccgaattagactactcacagtctcacataaatatcaattctaaatttttggttccaagatctcaaagtcttcacttctcattttgtaaacacaatttttttcaagggaaacaaaaattgaatcattttacctgaggaatattattgggctacaatgggccgtagtgaggccgaagtcacaccttaaatagaacgtggtagaagttactataatattagagttacaaaccagtaatcacggaagtagtaaaaacggcccatagaaagtataaacaatccaacggctgaaaaagcttaccttggagaagagtccaaaatatcttctggaagctaccatcactctctcctatataactcaaaattcaccatcatcttcatcatcatcatcatcatcatcctttctttatccaactttcttcaccaaatcgattcttcttcaaccatg

SEQ ID NO: 10436 - DNA, 3000 bp, Unknown
  misc_feature (1)..( 3000): cDNA_ID_2715704_gDNA_ID_2213649_Annot_ID_132445 3000 nt of promoter + ATG
ctggaaatgtaagcacttttcaaaatggtcctacttggaaattgtaatttgttacttaatacatctgaggtttggtttgtctaggtatcctatgcttgaatctattcaaaagtatctttggccccgtctctgcaaactcgaccaaaaaacattgtaagaatgatgtttatcactaactttttttttttcatgcctcagtctaatacacttattcattagtttaataccctattatctcacaggtatgagttgcactaccagatgattacttttggaaaggtatgtattaaagaaatacatatatacgtatgtcaaaatcagctcacatgatgaggtttgtaatctgcttgattattgtatcaggtcttttgcacaaagagcaaacctaattgcaatgcatgtccgatgaaaggagaatgcagacattttgccagtgcgtttgcaaggtgctacaacatgttctcttaaacctttagtaccactatgactctatgaggaaagtccttgttaaaatataacccagttaaatgagaattggtctgtatctaaacgaagctctgaatcatcattacagaaaatttagtaacattcatttgttttacagtgcaaggcttgctttaccaagtacagagaaaggtatggggacacctgataaaaaccctttgcctctacacctgccagagccattccagagagagcaagggtctgaagtagtacagcactcagaaccagcaaaaaaggtcacatgttgtgaaccaatcatcgaagagcctgcttcaccggagccagaaaccgcagaagtatcaatagctgacatagaggaggcgttttttgaggatccagaagaaattcctaccatcaggctaaacatggatgcatttaccagtaacttgaagaagataatggaacacaacaaggaacttcaagacggaaacatgtccagcgctttagttgcacttactgctgaaactgcttctcttccaatgcctaagctcaagaatatcagccagttaaggacagaacaccgagtgtaagaatccatttttctctgtttttcttcgttcttaggttaaaaatgaaatcagaaacacatttttcaaaattattaaagcttgaacagagtagaatatttaagtgattgaccaagcatgaactcgtaagttggaaagcagacaaacttcccaataattacaggctatgccataacttgtttcttttcccgtatcttgcagttacgaacttccagacgagcatcctcttctagctcaggtatgtgagctaactggataaggacacatgccgtatagagtgctgtctatattgtaaaatctgactagctgtttgtgatttcttgtggcagttggaaaagagagaacctgatgatccatgttcttatttgcttgctatatggacgccaggtaatttaatgatttgcatatcttttaatcatgaaatcaaatcggtatctttaatcgatgtgttattcaacaggtgagacggctgattctattcaaccgtctgttagtacgtgcatattccaagcaaatggtatgctttgtgacgaggagacttgtttctcctgcaacagcatcaaggagactagatctcaaattgtgagagggacaattttggtaagtagttgcatcaatctccttatgcggcttactacacttatgttttctacagattaatatgttgtaaattgtacagattccttgtagaacagcgatgaggggtagttttcctctaaatggaacgtactttcaagtaaatgaggtaagacttgaactccaataactccaactctttcattttaattatttgcattgaaacttgtgatgtattctattgatacaggtgtttgcggatcatgcatccagcctaaacccaatcaatgtcccaagggaattgatatgggaattacctcgaagaacggtctattttggtacctctgttcctacgatattcaaaggtataagattttctttattggattgtgatgcgattgtttatataaaagaaagttgttctaaccacttgagctctatttttctcaggtttatcaactgagaagatacaggcttgcttttggaaaggtacattttgtattaagcagtttcttcttgttctgaaacataacttatcttttgatattatgtagggtacgtatgtgtacgtggatttgatcgaaagacgaggggaccgaagcctttgattgcaagattgcacttcccggcgagcaaactgaagggacaacaagctaacctcgcctaatccgttggcaagcaaacaaatacaagcttatggttaagagtgagagagcacactgttccaatctagttaatgtaagaaagtgaaaacgtaaagttaacagtcctagagttgtacaaggtttctaaatcccattttagtttcgtcttaaatttgtatcaaacacttgtcacaaaaaacagacccgtagctgtgtaaactctctgttcccttcgtttggtttatatctgaatttacggttagcttttggttacctgaatcaagatctggttcgatatgtggaggatctcacttaacttggtttaaatcagatagttcaaccggaccaaagaattctattgttgtcaaatattagatgatgggcctattatacatggaatgtgggtcattaaatgggcctaaatatttttggaaccagctccgatcttcaacttttttttgtctcgtctccataaaatccccaattcacaaccctaattgatcggagattgtccaaactctctgacatttttgccgaattcgaagcattccttctatcttctccgtcttcttcgcagaatcgcgttatgcatctcaatttttagattgtaacttagggttactgattgttgtaatgctctgaattcccctctaacgaggatttgttgtcactgcaatcgatttttgccgattaggtttaatttagggcattatttgcgtacctcttgtattgtatagttctttggaatg

SEQ ID NO: 10437 - DNA, 3000 bp, Unknown
  misc_feature (1)..( 3000): cDNA_ID_3036486_gDNA_ID_2213649_Annot_ID_181571 3000 nt of promoter + ATG
cggtttgtactatcacaaacgacccggaatcttctaacactgatcagattgttccgtcgaatcctacttcgattccgcattctccggttagcgttagagaaccggaaattcacagtcatagagggattaaaccgggaataatcgctgcggttatcggtggttgcgtggcggttattgttttagtatcttttggttttgctttctgttgtggaagattagaccgtaacggcgaaagatcaaaatccggaagtgtagagactggtttcgtcggaggaggagaagggaagagacgaagcagttacggagaaggaggagagagtgatgcgacgtcggcgacagataggagcagacttgtgtttttcgagaggaggaaacagtttgagcttgatgatttgttgaaagcatctgcggagatgcttgggaaagggagtttagggacggtgtacaaggcggtgttagacgacggctcaacgactgtggcggtgaagcggcttaaagacgcgaatccatgtccgaggaaagagtttgagcagtatatggagattattggtaggcttaaacaccaaaacgttgttaagctaagagcttattactatgctaaagaagagaagctcttggtttatgagtatcttcctaatggaagcttgcactctcttcttcatggtaaaactctcttctctaagctttgattatcaaactgaaaatgctctgttttgcttagtgacaaaagtgttgatttttactacattatcggccaaagttatgatttttttattggtggttttagggaatcgaggaccaggacggattccattggattggacgacgaggattagtctaatgttaggagcagcgagaggattagcgaagattcacgacgagtatagcatctcaaagataccacacggcaatatcaaatcctctaatgttctattggacagaaacggcgtcgcgctaatagctgatttcggtttatcacttttgctaaacccggttcacgctatcgctcggttaggaggataccgtgcgccggaacagtcggagatcaaacgtctctctcagaaagctgacgtgtacagttttggtgtgttgcttctcgaggttttaacaggaaaagcaccctcgatattcccgtctccgtctagacctagatcagcggcgtcggtggctgtggaggaagaggaagaagcggtggttgatttaccgaagtgggttagatcggtggtgaaggaggaatggacggcagaggtttttgatccggagcttttgaggtataagaacatagaggaggagatggtggcaatgcttcatatcggtttagcttgcgttgtgcctcagccggagaagaggccgacgatggcggaagttgttaagatggttgaggagattagagttgagcaatctccggtcggtgaggattttgatgagtcacgaaactcaatgtctccgtcgttggctaccaccgacggctaagtttggtttctgtctgtcgatgttgtagaatacgtatcgtttggaccttgtcgatttttaaggttcttgcttagaatccctgatttgcgaacttgtcggagtttttttagccatgttttgtgttttcactgtttgtgatcgtaacggggttgtgtggttttgtggatttatgaagccgtttcaataataaaaccccatttgttactctttaaagcccattaggcccatatgttttagatgaattattttgcaattgctgctatttaattatagaacctaaaactcgaacgcccattgattagtgcttctagaacggtggatgcttctgtgtccactggtaattgtctttttggttgaagagtcagcccttcggatttgacctttcgtgtaccttttaagcccattgattatgattggcagattaagtaaattaacgaatggtcaagcacatgattagccaaatcatgacaaataaatggattcctttttcatttctggaagcggaatcttgtctaacaatttttttaattgatagtaatattttatgttatgggtttctgatagttgaagacttgaaatgttgaacttaaaagtgaaattacgctttcataatttcattaagccatgatggcaagttttttttttgggttgaggtcaacaagagcaagtttaatggtatcgaatagtgcgtaactgaaataaaacttgttgaaaaatcattcattcactattcctcggcgcgtgaggccaatttgaccccttcccccacgaaattaaacttggggagtactaaaagtctaaaccagcaacgtcgcttttcatgtgccttaatcacacccttttctgccacgtgtacgatctgggaccgtcgttgtgctcattgacatttgtagatccctttctagatgttcattaaaattacttaatttatatccagtccttctacttttagttttttgatactttaatccctgttgttttaatgatacttcattcagtatccatccaaaatcaaattaaatccatagattaagatgtacatttttgaaaataataaatggtttattataatatgttactaaatttatggtatttttcgctcttgtattgacttttacatggatacattaattttaatcttctttgatttctgttaattttctttgaattcattttatacatttattagtgaactattctaaaaattaacaaaatcatttaaaccgacaaaaaaaactttaaaagatcagcgtattataaaccaacgggggatagtttgcattaggtattggacatctggggggtaaatagagcgaaacaaaagttgaggcttgtttttcaacattttcattttattgtgtgctatttaaactgcgtcgtatttggaggcatattcgccggtcaagcgtatcaaatacccaatcacgcgaacttttctccgcctcttctccactccaaaattcttctccgtctttctcccgtcaccgtcgaataaagcctgagatctccgaattctgatcagcaact

SEQ ID NO: 10438 - DNA, 3000 bp, Unknown
  misc_feature (1)..( 3000): cDNA_ID_2704913_gDNA_ID_2213649_Annot_ID_181570 3000 nt of promoter + ATG
ttgtttggaaaacttttcttttctttttaccgtttcctaattaatatgtggctgtcccaattaatagaaaatatataaattaaattttgaagtttcactgtgtatgtatatgttgtctgtacatacagagataatataagaaggtaaacaaaatcgatattttgtctatctatgtaaaatttagtttttcttttctgtagatgttatctatagatatggataataagaaagaaaactttttttatatataattaatttcatattaaaaagaacttagtttagattttcgcttaaaactttatgattctagttattaaccattgttaacggtttaaataccgttattttgtaatgctagctagtgaccgttgtaaatggtttttataacgtttaaaacttataattctattttagatgtgttggaaagactagtaatttcaacattttcatatttttttagtgatttgtaacagacttctaaaatgaacaaacttacttatatacaaatgaatattatattatataataatataaacaattagaccttatattaatataatttatattcaatggatattaagtttcaaatatcaaataatttagattaaaatgcaaaaaagaacaaaaaagtcatgatttgaatttggccgaattaaatcatttcaatgtagctgtcttttaaaaatgttatttttttgtttttaatggaaacagtaattaagtgttacatagaaagtattttattttgactaacatacaatgctaagacagatttgttttagtatacgataattatatattttaaaagtaaaagttgggaatttgaattggcttggccagttataccactaaaaaacaaatttcttaaatggaaaacgccagcgggaagcaaagaacacgagtcaaacctttatagttttttccacttctagatattatataattaaagtacaaatggaaagaaatatagattttgaccaatttaaaataagttcacggaatttgtttttgatgttcagaaagaaagaaaattatgtatatttggaaaacatcaacggaaaaaaaagtagtatttgctaaaacaaaatctacaacaattgcaaatcatcaagtccggtaatttttttttatttttgtatttttcttcagtcaaaccgatgatgtgttgtaacgtaaatggcatctttttccaaactcagattctttttttttgtgttgataacattataatttcgaccactttaagcccaaggcctaaggcccaactgtatagcataacgtttaccgtcaatgcttgggccaacataataaaaccaagcgcgcacacacacatcaagccgacacattcggaaagactaaaagagcgacccaaagggaactgtgttttttttttttttttttctttctttcaaagagaagcaacgaacattatcaattcaatatgttgttatctccctgtttaaagtttcaggttgattcaagttcttcgtagcagagaattagatcaaacgtaatctacgtgaaatgcaaatgcatggccacatcgtagcagaatacaacatcactacatgagtcgttccttctccaatgtttaacaaaatattcaacaagtatacaaagctgacactctagtcaaaaatttgtaatggttatagtcgtagttgttacttgtatgtatattacttagtaaatcaaacattcttaagatagttgttttaagtagaatacaaaaacaacctaaaactgtaaattttttgtttaaactttggtagtatgaaggtgtaaaaactttagtaaattttattcaaaagataaaaaaactttggtaaattttctgattagcatttgaatggaaaaaggggatgggaatcacaacgccaattgcgcatttctttcctccttttataatttacattttaaattggttaaaggggtctcgaaaatgtcgggttggtaaaaaataagagtgagattagctacaagaaagctgactttgtttttcaagcaaatcatcaactgtcgcgtcgtaccaatcatggatccaccatgttatttgttatttttttgtcggcacactagtgttaatttgaattatttgatatattaatagcagaaataaaatacttcttacttgaagagcttaaacatattttcattacccgagaatgttggtttatcaaatgtgtatattagtggaaatgacaaatacgagtccaatagttaacgtaataactacccttcttttggggttcaaaagaactaattatgttgtttggagatttcgggaatacgagatcgaaaaatctatcttatttggatttgctttgattcattcttagtgtaaaaaccaaaaggaaagctaacctgttataaattttgatttactcaatatctaaacagaaaagcaatttgcacaagtaactttaactaatcttgtaacaaaaagacacaagttaaagcaatgatatactgtggatacctttttcaaacattgggtaaactttttgggcgtagggttatgttcacccacactatggagtggaaaacagcaatcattcacacaaccaccaccattcctactttttgtgcgtagggttatgttcagaaatatgatttaccattatctccttttttacatctatcaaagtatattattaactgattaatggaaatttcagttgatattactcgataaccttatgtcattactcagttcaatccttatgttatatatgcaattttaacatagaacgtacattattcttcatgagttctgttcctaatcagtgctatgtacgtaacttttgtttttactttgttcagtttttgttttgtctctttttttcttgactatgacactgcattcaaaaacataagaaaacagattaaagaaaagagaaaaaagataaaattgaaagattcgtttttctcaaatttcaataaaaagaaagatacatttctctcttcacacttcactcttctctttcccgcctctccgcc

SEQ ID NO: 10439 - DNA, 3000 bp, Unknown
  misc_feature (1)..( 3000): cDNA_ID_2704917_gDNA_ID_2213649_Annot_ID_181566 3000 nt of promoter + ATG
gtggcatcctggccgtacttcttcttaatcacagactggaaaaacatatgagaacaagatggttaagccataaacatgtaatacatgttagttcacaggaaccatctgcgaaaaagtaatacatgtatatggaatattcattgaagagcatctcaaagaccaaaaaatattggagatttaccttcaagtggtggtaaacttccacacccatcttcatggcttccttgaaagaagcagctccaacagggaggatcataaactcctgcatagcaagcttgtttccggcatgggatccaccattgatgacgttgaaggcaggaactggtagcacaatcttggggttaccagcaaggttggcaatgtgctgcacccaaataccacacaaagggaaaagcttagaacatttatcaccgaaaaaaccaagtagccaaagcagtaacaatcttatcttccatggacagagggaaccaacttaatagtgccagatcgttctaccttgtatagaggaatgccgctgacaacagccccagctttgcagacagcaagagacacagcaagaatcgcattggctccaagctaaacacagatagaaggcgcaagatggtcagacttgccttctattcttaagtgaatacacaaaaaatgaattttcccttttaagtaccttttgcttgcaccacccccactcgttttgggttccgtcaagttcatggaccatgaagttgtcaatagcagtctgctgagttgggtcctgcaagaaataataaaagcaacaaaaataaaatgagtgagcctagcgcatagaattagacacaaatttgatgttctgagagtagcttaaagtgagtcactcacctttccaataagtgctggcccgatgatgttgttcacattgccaacagcctagtgatataaacaaataacgaatcagtcaacatgatcaattgaaataactctactaacactaaaaaaacacacagaacagatcgcagtctctcaccttagatacaccctttccaaggtagtcagatcctccatccctcagctcaagagcctcatagataccagtggaagctccacttggaacagctgctgtaaccttaataccatttgacgtgtggatatcaacctaaaccaacatcatcagagaaatcattagctttcttttcaaattcgtcattagcaaacaatcgaaatcgtaaaaaccagatggaaataaatagatccgtcgcaaaaatcatataaacaaaatcaactccatcatcgacaactcacgatccaaatcgccgagatcaaatcaccgatcatcgttcacaaaaaccaaatctcattcacgtacgactactagatcaattcaggtttacaaaaaaacgattgaatagtggttttagcatcggatagtcatcaaacaaacagatccgtcacgaatactgtacaaagccggaaagtgactgggaaatacaaaagtgatcggagaaactaacctcaacggtgggattaccacgactgtcgaagatctgtctagccttaacaacggtgatagtagccatagcgagtagatctagagaaagagataaaggcgatgtgttcgagggttttagtgagaatcgcttcaacagtagtagctgaggaaatgggttggtggtctggttcgatatataaagacgtcacggatttagccaaaaccgttggattgttttaataacagccgttggatgagaacagtcagctctgatgcaagaagccaaaacgatgcgctgcacgccttttgcagaatagaagagttttttccatattgttttgctccttgtccaagtaataccgactatttttattaaagactttagaacaagtaagaataatatatggcatctagattttattccattttccgactatacgtttcactgtttccatttttattttgtcaataacatcttttataccatgtttgaaatttggatggttgtacagaactctctagaaacaattcactagttgaaaattttcttttttgttaaaggggtttcgctaaactataacttaatggatatgtttgtgggtcaaaaactttgggccttacttatgtgacaaattctccactagggtttcaatgtccatcaaccatttttatacgatattaatggaccatatttttcagtaatcattgtttgattatgcttattctatatgtatcaacatttaaaatgcaaatcactagttctataattcttatcaaaatgtggtgtttgcgtcggatttttggatgctctttggactttggagtttcaaactcaagattatgaggtgatctaatatttattttaatctaagttactaatttttgaaaataatttaaatgttgctaaactattatgatttttatgttcttataaacttttttttttgttaaaaggttcatataaacttagatatttctgttaataattttaatttcgattaattcaaatataagtttttcatgttttatatgaaaaaaatagtaaacaaatgcgttttacttatgtaaaaattgtcagaagaaaatagagcacaatcttccatgtttcatcaggcttcctccgagcctttagtgctatttcttttgatagaattcgtgagagattccccaaatcataacaagaaaacaaaatggtaaacgggaaatataactcgacaaatcagcgtcgattaattgatgtatcgacttttgtccatgtataacaactgctgacaggtggaattttctgattggtcgctgtaagtcgattcacactaccaagttggatacaggaaaaaaaaaaaaaaaaaaaaaaaagagagaaattaaggataagtacaaaaaagatttgtgagtatccaaagagccgcttgaagaaaaacgccaaataaatggttttgatctcgtgaagccaaatcgccattagtcaccaccttaaatgactcacctagtatatatatatatgcaccatatgagtttgatcaatctcattcaataca

SEQ ID NO: 10440 - DNA, 3000 bp, Unknown
  misc_feature (1)..( 3000): cDNA_ID_2704924_gDNA_ID_2213649_Annot_ID_181565 3000 nt of promoter + ATG
gaacatcctaaactcccacacaaacaccacattttgatacaaaaattagaactagtgatctgaattttcaaattttgacacatagaataagcataatcaaataattgttaatgaaaaatgggtccaaaagagaatatataatcaaccatgacacagtataaaaatggttgatcgacattgaacacgtacagaagaattaacaaatgctgaagcacaagtgattcatctttcttattagaattgaaataggtagactttttaatgtgttcattactaagcaaaagaagataatgattgagatacgaagcttaaacaaactaataatcataaaagattaagagacaatctttgaaacgttgctgtagaaagaccaatcaggatgagaagaatcgatcatgggccgtccaaaagaatgcacttttatgtaagcctgaacatccgatgattttgccaaaccttccaagtaagaacacaactctccttccggatctaacaaaataaaagaccaatcacaaataaaccaaaacgcatgtctaaagataagaagtgaacagcagaagtttaaattttgcataccaagtaaattatcctttatgttagaagcatcatagctcattgggaacagaccagtattgtcctgaatgcaaatcaagatagattagaattaggattaagaactacaaagttatcgataaacaacactataatagagattcgagtgttttacaggattacgaagagctttatatggttcatcatcaatgaagatggtgtttgaagcagagaagcctttaaagcacttgaacactttagagagatccttaaagaacaaaggcttgtaacggttctctagtgttttatatccactgtccgtacactctcttggtcctacaataaaagagtattcgaaattatatatacataaatagacacacatctctatacaatgagagtcttacccaaacaaagagaagcttgtcttggagattttcaagcacaatgcttaaaacaatgtcaacatttttcctatcaatcaaacacatgaagagtcagataaaaagtactatttaagcttaagaaatcaacaatattaacctgtaactataagaatgtttagtgaagagactaactcgcaagcagaggaccaaataccaacttcaaatctctcaagacaaaacttcataaactcttcagcaaacggtctcttatacactaaacaacaaaacaaacacaaataaactataaatacaaaaaaggtagcaaagttaataaaagaataatgaaacgttaccaagatttggcccacaagaagcatcaggagagcggttcttgggtttcttacgcaactcttttttgtggactctgtgaagaagaagaccacttagactcaagaccaagagtttctttttctccgtcttaggttctagactaagtttatcaagaatcgaactcagttctgtctgatctgaaactgtatcacctcttgagtactcatcgtcgctgtcgtccgcagcaagcaagctcttcttgatcttttcttcagccattgtattgaatgagattgatcaaactcatatggtgcatatatatatatactaggtgagtcatttaaggtggtgactaatggcgatttggcttcacgagatcaaaaccatttatttggcgtttttcttcaagcggctctttggatactcacaaatcttttttgtacttatccttaatttctctcttttttttttttttttttttttttcctgtatccaacttggtagtgtgaatcgacttacagcgaccaatcagaaaattccacctgtcagcagttgttatacatggacaaaagtcgatacatcaattaatcgacgctgatttgtcgagttatatttcccgtttaccattttgttttcttgttatgatttggggaatctctcacgaattctatcaaaagaaatagcactaaaggctcggaggaagcctgatgaaacatggaagattgtgctctattttcttctgacaatttttacataagtaaaacgcatttgtttactatttttttcatataaaacatgaaaaacttatatttgaattaatcgaaattaaaattattaacagaaatatctaagtttatatgaaccttttaacaaaaaaaaaagtttataagaacataaaaatcataatagtttagcaacatttaaattattttcaaaaattagtaacttagattaaaataaatattagatcacctcataatcttgagtttgaaactccaaagtccaaagagcatccaaaaatccgacgcaaacaccacattttgataagaattatagaactagtgatttgcattttaaatgttgatacatatagaataagcataatcaaacaatgattactgaaaaatatggtccattaatatcgtataaaaatggttgatggacattgaaaccctagtggagaatttgtcacataagtaaggcccaaagtttttgacccacaaacatatccattaagttatagtttagcgaaacccctttaacaaaaaagaaaattttcaactagtgaattgtttctagagagttctgtacaaccatccaaatttcaaacatggtataaaagatgttattgacaaaataaaaatggaaacagtgaaacgtatagtcggaaaatggaataaaatctagatgccatatattattcttacttgttctaaagtctttaataaaaatagtcggtattacttggacaaggagcaaaacaatatggaaaaaactcttctattctgcaaaaggcgtgcagcgcatcgttttggcttcttgcatcagagctgactgttctcatccaacggctgttattaaaacaatccaacggttttggctaaatccgtgacgtctttatatatcgaaccagaccaccaacccatttcctcagctactactgttgaagcgattctcactaaaaccctcgaacacatcgcctttatctctttctctagatctactcgctatg

SEQ ID NO: 10441 - DNA, 3000 bp, Unknown
  misc_feature (1)..( 3000): cDNA_ID_3036499_gDNA_ID_2213649_Annot_ID_181563 3000 nt of promoter + ATG
atatggataatatcatgtcgatacaaaatgtattataatatcataacattataacgtgtgcatgtaaaataggattataataagataagaattaagtgctttgctaaaattcaatgtaatttatacttttcatgcatggtgaatgagtaaaagagttgaatgaatctgatacatgagacgtggatggtaagcgagagctatgtcattcacacgtctcacacagtgcgtgaaacgggaatctcctgccaccgcttgagaggattgaccttatgggataaaaaaatctttcgacgcttaaatcagaaaataatcacaaacatgttatgagaaaacaaatcagcgaagtcgtgggtcttgtatccgctggtactattgctctgattctctgtttccggtcttcagcaagatccgatcattatctccagtcatacaaagatttttttgattatttatttttgtatatgttggatctttgtaatgtccaagaccttacccaaatttttgggaaggccaatattataaaattatgaataaaacaaagaactaagaactatgggaatgatatttttttttttttaatatataaactacgtgaatgataccatatcataagacaaaaaatagaagtatggattgagatacaagcgtggcgtctttgttttcaagtgacctatctccttgattatattaaataaaaactagtaaacaggttacatgatagattcgtagattagtagtatttcaagttataattaagatcaggatatttatagttacagagtatgatcgagtaacaagcgacgatttatatgaggtttttaggcatgccggctttagactatagtcgatgaagcaaggactttaaggtcgacgccaaaatattttttatattttgaacttttgagaaccctagttaggcctaagcttcactttgcttggcacacagccggttatattggtggatcaatgtatggatattttgtatgtttggagtgatggctttatcgaactctctgaacacaactctgctaaccatacatccacacgtcgtgtgataattagatcttatataatagtccaaaaatgacttccaactcatatatttatataaatagtcttcttttgtggttatatgtttggttatttctatttatagtttaattcaataccaatattacaactaaatcagtttaatttttctttgatttggtctttgaattcactttcatggtcagtttcattgtttaagataaacttgaatggattaaaccgaattaggcattcacttttgatcagtctcttctgccataatcttcataagacaaacccaaatttgtaaaaacttttttgaaaaagaaaccgtaagtaaaagtaaaagcgtttaggatccaagtatggattagcttcgtaatttgaattaggtttagctatacgaattcgtttacttttgtaccatatttagttgtattgttttcaataatagttttaaacattcgaataatccgttcccaactttttatccactattattcgtctcagtttctaggatagatatgtccacacaaaaaagctcttgatttttttttttttttttacaaattccaaatttctttgctcataacccaatcattaggttatgaccaccattgactcactcataagtcataagtcataggctcataaccaatccaacaagttgttaagattgacaacaacgattcactaagattccaaccaagtccatgaaataaatgatttacaatactcatttctcatgtacgtctctttgaaggtttcttgcatgacaggaaatcaaaggttagcacactaattactctttttttcacacacattcacagtttcacacatatggtgcagtattttgactcctatcgtactagactaaaacatttggaatgatcaaaaacgaaagactcgttgggcaactagcctaataatcactctactacactagctcccatatcagtggaaaataataattctaaaacgaatcatttaacttctgcatatgtaaacgaaaacgtgtaaatttatgagattacgtaaaaattagcaaaataatatattattgatcaaaattataaacgtggattacataacatgttatttgtttaaatcataatttgatgataaatttataaataaagttctaattattttatatctaaagcaaaattaagattattttataatttctattaattataaaattagttagttcatataattttaaatagttacgtaaacgagaaaaaatacgaaattttaaagagaaaaagataacagaaaagacgatgatgacgatgacgataacaacgacaatattattaactttttaaatcatctttcccatagtctaggagattttgtagaaaagaatcattatttttaaaataaaattccgtaaaacttttcccgccaaccaaacgaactttcgccctacataaacaaacggttatgaaaaatagtgaaacacacaacaacacatgttatatcctcttctttatacgttaggccaaaaaagctttttctatattactctttaacttcatcgattccaagagaagaaacgaagcatcagtgatcttatcctctcatagctaccaccgaactaactctctccatcaccaccataaccattgattctactggtaatgaattttgtttttttcttacttttttttacattttgttgtgaatctaaaaagtctctctttcacctaacgaacggattaatcgttcatgtcgccactcacccaaaatcaatgacttccggagatctctctttctctaaaaccccagaaaaaagtggatctgatcattttataaaatcgtgatttttaaaaaaaattggtgatctcttttattgaagaaattattgaactttttgcagtggaaaaaatagaaagttccaagctttttctcaaatggttctgatttaagtaagagtgaagaaaagtaaaaatagagtcagaaatg

SEQ ID NO: 10442 - DNA, 3000 bp, Unknown; identical to SEQ ID NO: 10435
  misc_feature (1)..( 3000): cDNA_ID_1383349_gDNA_ID_2213649_Annot_ID_181560 3000 nt of promoter + ATG

SEQ ID NO: 10443 - DNA, 3000 bp, Unknown; identical to SEQ ID NO: 10434
  misc_feature (1)..( 3000): cDNA_ID_1808560_gDNA_ID_2213649_Annot_ID_181555 3000 nt of promoter + ATG

SEQ ID NO: 10444 - DNA, 3000 bp, Unknown
  misc_feature (1)..( 3000): cDNA_ID_3036513_gDNA_ID_2213649_Annot_ID_181554 3000 nt of promoter + ATG
tataattttaataagtttcatattatctgatgaaaattaaacatcaaactttgttatttataattttagtaaatagattttttttcttttttatttcataagagattaagttatttaatgtaaagcttctcttgactgtataatatcttaactatattattcttataaaatttctcaaatttcaataaccgtattatgttagtctacaaaaaaaattatattacatcaatattcttacataccaaactaagatatatattgtccagttcttttcatggcatatgtattttacatgctctattttaaaaaattactacgtgtttcaatatcagtattgttgaaattatacaccctccaacgagtaaggagataacccattacaatgcattggcactgatctacatgaacatgactgaccagatttaaccattcgagcaaacaaaataataagtcaactatattttgaatagtcacaaaactatacatcgtaattacaaaactatttctgacatataagattaataggttaaaagaaccaccgtcgaatcgttgatgtacgtagtagtagtatcgtattaacgaggcaatgatataactatcaatatttttcgtaagaaaacacaagtttccttattcttttcttacgtcggcgataaaagttaatgtcgtactttgatttatgaaattgtgatggaaaattgttttaattaattaagaagagaaacgagttatttgtacaaacaaatctgaaaatatagaaatagagcaaaggacagagaataagaagaagaggcaaaggagggcgagagttcacatgttcaagagaagacaaatacgtttctctgacacaaatctgtcagaccaatatttttaaatattttattgtatagtttttattttgttttgttgtatgagaaagaaacgtatattatgtctttattaccaccacaaggggtcaggctccgtccacttggggtcccaattttttctttgttacgagtttttttttgtagtaaaaggcaagtcacgccggcacgcgagccctcacgtgatcccacgtgctttatttattctctccataccaaaatttcttttcctttgttgtttggtaaggttttttcttttttggccaaaatatgatattggcgagattgaaaacatgtatatttttaaaaaaaatgtaggcgtaaaaattatgttactaacacttcattaagcatatgccaagatttttaaattaaaatttatatatcactattggtcgtttttttttttgtgtgtgacagcagctcactattggttgtttatattaaccacatactaaataaggctagctactaccaaacttggaccagaacctaacacatgatgttatttttagtaatatgaaaaaaaagaaacgaaaaggaaaaaggaaagaatagatctttctggtgagagagcatacacaacacattggtgacacaaggtatctaagggcatgaccgcacgtgtcaacatgcatcaaacatgcgatctttcaatattagtattatatatttagcaaagacgcaaaagaatccaaggcaaagactacttcgcctgcatgtcatgccaatctctctctatatgttttctaatcaatatactagattactagacaagttgttttctaataagatctctcacatatgagccaatttgagccaaaacatgatatgatggataaagcttatttgggtattgaaagtatagagactgtcaatgagaaagtagtcatttgggcccaagtacagagatttaaaccttatcaggaaaagcccaatccagtacaaacttgaagaaaaagattgatctccttgtaagttgcaactggtaaagaataggacctttgttcaaggtctactgtattgagatactgaattagtataaacggccacttaaaactactttgtatttgtttaggcccaaaacattggactatcatgttgagaaaataaacacgaacgcaacagaagtttcctacttattatatagcccaacaaatattgatctctttgcttccaatgaatctttgttaaggcccaaaaaatacaaagccgaaactacttccatcttgtactatttttaagtttattttttggaaattttaccatgtatgattcagatcgttggtttaaatttttacaactagaaaatagtatatactctattagcctattatgatattaattaatgggcaatatttcgattagtttacgtgtagagtgtagtgataatgtatttaggttttgaccggcaataatgcatttgtaagaaaagtctttggacaataatagctttggtcaagtcaatgtagaacagaagactaatttctcttgacaaaatattaaaccttaaaaacaaatcctgtcagaccaaaaggtgatacgattgtaacttacaaatgatactatatatttttatagttaacagtctagtatttaaaattttgaaatattgatgatcattgattggttcatataagtaatccattaggttttcatgttggtcaatacagatgtacatgttttcaggattaatataggttccgtcctatgaatttatccgaccatgcataagagtaactctttaatctactattacaagttttcaggatttgaaagctctatacaagtttaactttatgtgtatattagttaacgtttgtaaccacagattcataatatttaccgtcgaactcttagccataaaattcggactaaaagactcgattcaaaaaggtatcgatgagatggaaagttgttgaacttattgtataaaagcttagagaggatattgataagtcgtcttttgcttttgtatctacagctatgacgtatattgtttaatccaaatcaaagtgttttaaagatattttggtttctggtggaggtggtatactaaagattcacatatagatagagatatttatgaatacattgatatgaaaatcatatacaatatgctaaagaacaataa

SEQ ID NO: 10445 - DNA, 3000 bp, Unknown; identical to SEQ ID NO: 10432
  misc_feature (1)..( 3000): cDNA_ID_3036523_gDNA_ID_2213649_Annot_ID_181550 3000 nt of promoter + ATG

SEQ ID NO: 10446 - DNA, 3000 bp, Unknown; identical to SEQ ID NO: 10441
  misc_feature (1)..( 3000): cDNA_ID_2715700_gDNA_ID_2213649_Annot_ID_132446 3000 nt of promoter + ATG

SEQ ID NO: 10447 - DNA, 3000 bp, Unknown; identical to SEQ ID NO: 10440
  misc_feature (1)..( 3000): cDNA_ID_2704924_gDNA_ID_2213649_Annot_ID_132448 3000 nt of promoter + ATG

SEQ ID NO: 10448 - DNA, 3000 bp, Unknown; identical to SEQ ID NO: 10439
  misc_feature (1)..( 3000): cDNA_ID_2704917_gDNA_ID_2213649_Annot_ID_132449 3000 nt of promoter + ATG

SEQ ID NO: 10449 - DNA, 3000 bp, Unknown
  misc_feature (1)..( 3000): cDNA_ID_2715694_gDNA_ID_2213649_Annot_ID_132450 3000 nt of promoter + ATG
atctaatatttattttaatctaagttactaatttttgaaaataatttaaatgttgctaaactattatgatttttatgttcttataaacttttttttttgttaaaaggttcatataaacttagatatttctgttaataattttaatttcgattaattcaaatataagtttttcatgttttatatgaaaaaaatagtaaacaaatgcgttttacttatgtaaaaattgtcagaagaaaatagagcacaatcttccatgtttcatcaggcttcctccgagcctttagtgctatttcttttgatagaattcgtgagagattccccaaatcataacaagaaaacaaaatggtaaacgggaaatataactcgacaaatcagcgtcgattaattgatgtatcgacttttgtccatgtataacaactgctgacaggtggaattttctgattggtcgctgtaagtcgattcacactaccaagttggatacaggaaaaaaaaaaaaaaaaaaaaaaaagagagaaattaaggataagtacaaaaaagatttgtgagtatccaaagagccgcttgaagaaaaacgccaaataaatggttttgatctcgtgaagccaaatcgccattagtcaccaccttaaatgactcacctagtatatatatatatgcaccatatgagtttgatcaatctcattcaatacaatggctgaagaaaagatcaagaagagcttgcttgctgcggacgacagcgacgatgagtactcaagaggtgatacagtttcagatcagacagaactgagttcgattcttgataaacttagtctagaacctaagacggagaaaaagaaactcttggtcttgagtctaagtggtcttcttcttcacagagtccacaaaaaagagttgcgtaagaaacccaagaaccgctctcctgatgcttcttgtgggccaaatcttggtaacgtttcattattcttttattaactttgctaccttttttgtatttatagtttatttgtgtttgttttgttgtttagtgtataagagaccgtttgctgaagagtttatgaagttttgtcttgagagatttgaagttggtatttggtcctctgcttgcgagttagtctcttcactaaacattcttatagttacaggttaatattgttgatttcttaagcttaaatagtactttttatctgactcttcatgtgtttgattgataggaaaaatgttgacattgttttaagcattgtgcttgaaaatctccaagacaagcttctctttgtttgggtaagactctcattgtatagagatgtgtgtctatttatgtatatataatttcgaatactcttttattgtaggaccaagagagtgtacggacagtggatataaaacactagagaaccgttacaagcctttgttctttaaggatctctctaaagtgttcaagtgctttaaaggcttctctgcttcaaacaccatcttcattgatgatgaaccatataaagctcttcgtaatcctgtaaaacactcgaatctctattatagtgttgtttatcgataactttgtagttcttaatcctaattctaatctatcttgatttgcattcaggacaatactggtctgttcccaatgagctatgatgcttctaacataaaggataatttacttggtatgcaaaatttaaacttctgctgttcacttcttatctttagacatgcgttttggtttatttgtgattggtcttttattttgttagatccggaaggagagttgtgttcttacttggaaggtttggcaaaatcatcggatgttcaggcttacataaaagtgcattcttttggacggcccatgatcgattcttctcatcctgattggtctttctacagcaacgtttcaaagattgtctcttaatcttttatgattattagtttgtttaagcttcgtatctcaatcattatcttcttttgcttagtaatgaacacattaaaaagtctacctatttcaattctaataagaaagatgaatcacttgtgcttcagcatttgttaattcttctgtacgtgttcaatgtcgatcaaccatttttatactgtgtcatggttgattatatattctcttttggacccatttttcattaacaattatttgattatgcttattctatgtgtcaaaatttgaaaattcagatcactagttctaatttttgtatcaaaatgtggtgtttgtgtgggagtttaggatgttctttggaatttcaaactcaagatgatgaagctaggtgatccaatatatatttaatctaactggtaatttgttaaaatttgtaaaataatttgaataacgctaaactgtatatgggtttccatgtttttatatgaaaaaatagcaaacaaattcttctactatttttttcgtcaacaaattcgtttacttatttgacatttttttcagaaaaatatataatacaattttccattcagcttcttctgagccaagtgagatttcatttaataggatttcttttgattttaaaacaataaaaacaactggtaaacgagaaatagaagttgattcagtttaaatttataggattttagtctttcaacatttctattgttggattcatcaaaaactttaaatgagattcattattcatatgaggaaaaaatcaactttcaaagcgatggaaaagatgtacagtatctacattttcccatgtatgacaggtggaattatctgattggtcccttttaagtcaattactaatggtctttgtctctgactctcttcgaatcaacagaaaaagtgaaaaaagatagtcattagaaaaacaattaaagataagtacaaaaaaagattttgtgagtatccaaagagccgcatgaagaaaaacgtaaattaaatggcttttgatctcgtgaagctaaatcgccattcgtcaccaccttaatgactaaatcctctactatatatgcaccatatgagtccttactgtcttaagcataaca

SEQ ID NO: 10450 - DNA, 3000 bp, Unknown; identical to SEQ ID NO: 10438
  misc_feature (1)..( 3000): cDNA_ID_2704913_gDNA_ID_2213649_Annot_ID_132452 3000 nt of promoter + ATG

SEQ ID NO: 10451 - DNA, 3000 bp, Unknown
  misc_feature (1)..( 3000): cDNA_ID_2715690_gDNA_ID_2213649_Annot_ID_132453 3000 nt of promoter + ATG
ataggagcagacttgtgtttttcgagaggaggaaacagtttgagcttgatgatttgttgaaagcatctgcggagatgcttgggaaagggagtttagggacggtgtacaaggcggtgttagacgacggctcaacgactgtggcggtgaagcggcttaaagacgcgaatccatgtccgaggaaagagtttgagcagtatatggagattattggtaggcttaaacaccaaaacgttgttaagctaagagcttattactatgctaaagaagagaagctcttggtttatgagtatcttcctaatggaagcttgcactctcttcttcatggtaaaactctcttctctaagctttgattatcaaactgaaaatgctctgttttgcttagtgacaaaagtgttgatttttactacattatcggccaaagttatgatttttttattggtggttttagggaatcgaggaccaggacggattccattggattggacgacgaggattagtctaatgttaggagcagcgagaggattagcgaagattcacgacgagtatagcatctcaaagataccacacggcaatatcaaatcctctaatgttctattggacagaaacggcgtcgcgctaatagctgatttcggtttatcacttttgctaaacccggttcacgctatcgctcggttaggaggataccgtgcgccggaacagtcggagatcaaacgtctctctcagaaagctgacgtgtacagttttggtgtgttgcttctcgaggttttaacaggaaaagcaccctcgatattcccgtctccgtctagacctagatcagcggcgtcggtggctgtggaggaagaggaagaagcggtggttgatttaccgaagtgggttagatcggtggtgaaggaggaatggacggcagaggtttttgatccggagcttttgaggtataagaacatagaggaggagatggtggcaatgcttcatatcggtttagcttgcgttgtgcctcagccggagaagaggccgacgatggcggaagttgttaagatggttgaggagattagagttgagcaatctccggtcggtgaggattttgatgagtcacgaaactcaatgtctccgtcgttggctaccaccgacggctaagtttggtttctgtctgtcgatgttgtagaatacgtatcgtttggaccttgtcgatttttaaggttcttgcttagaatccctgatttgcgaacttgtcggagtttttttagccatgttttgtgttttcactgtttgtgatcgtaacggggttgtgtggttttgtggatttatgaagccgtttcaataataaaaccccatttgttactctttaaagcccattaggcccatatgttttagatgaattattttgcaattgctgctatttaattatagaacctaaaactcgaacgcccattgattagtgcttctagaacggtggatgcttctgtgtccactggtaattgtctttttggttgaagagtcagcccttcggatttgacctttcgtgtaccttttaagcccattgattatgattggcagattaagtaaattaacgaatggtcaagcacatgattagccaaatcatgacaaataaatggattcctttttcatttctggaagcggaatcttgtctaacaatttttttaattgatagtaatattttatgttatgggtttctgatagttgaagacttgaaatgttgaacttaaaagtgaaattacgctttcataatttcattaagccatgatggcaagttttttttttgggttgaggtcaacaagagcaagtttaatggtatcgaatagtgcgtaactgaaataaaacttgttgaaaaatcattcattcactattcctcggcgcgtgaggccaatttgaccccttcccccacgaaattaaacttggggagtactaaaagtctaaaccagcaacgtcgcttttcatgtgccttaatcacacccttttctgccacgtgtacgatctgggaccgtcgttgtgctcattgacatttgtagatccctttctagatgttcattaaaattacttaatttatatccagtccttctacttttagttttttgatactttaatccctgttgttttaatgatacttcattcagtatccatccaaaatcaaattaaatccatagattaagatgtacatttttgaaaataataaatggtttattataatatgttactaaatttatggtatttttcgctcttgtattgacttttacatggatacattaattttaatcttctttgatttctgttaattttctttgaattcattttatacatttattagtgaactattctaaaaattaacaaaatcatttaaaccgacaaaaaaaactttaaaagatcagcgtattataaaccaacgggggatagtttgcattaggtattggacatctggggggtaaatagagcgaaacaaaagttgaggcttgtttttcaacattttcattttattgtgtgctatttaaactgcgtcgtatttggaggcatattcgccggtcaagcgtatcaaatacccaatcacgcgaacttttctccgcctcttctccactccaaaattcttctccgtctttctcccgtcaccgtcgaataaagcctgagatctccgaattctgatcagcaactatgcattcaagtcatctccttctcgaggaaccgatcaggatgacttcaatcctcgaaccttctaaatcagtgagctatttatttctccttctctcgctctgtgtgttttctgtggttgttttgatttccttagctcgttgttgattatcgattacgtttggatctgttgcgatatttcatccattttgaagcagtgagagatttgtttcgtttgtcgtggtttttgatccgcttgatgttatttcgcagagtttcttcccggctttgactaagattgttgggactctaggtccgaaatctcgatccgtcgaggtgattgctggttgtctcaaagctgga

SEQ ID NO: 10452 - DNA, 3000 bp, Unknown
  misc_feature (1)..( 3000): cDNA_ID_2703736_gDNA_ID_2213650_Annot_ID_132455 3000 nt of promoter + ATG
cataatgacagattgtgataaatttgtcagaaaaatgaaacaaagaggacaaagaagtcggaaagacataaaaaacaaaaagggagtaacaaattagaaaagtttgttctgggtttacgtaatacattttttcgaattatttattcttgttttattatatgtttgttagtgagggaaaaaatgtgaggagaggattgaaacacgactgtagaaagaagacagacaattgaagacagatcttatctctatccctcccacgactactttctttggaaacacaaagctatatatgtgttctcttttataaaaaataaattatcatttcacataaaatagtcagagacaaacaattttcgaaattttatgaacaatacgtagccatttatgagatgtgtcatgcacgtgatgaaaaaactaaataaggaaaggctgtacatagaaatcttcttggttaagagacaaaagatcttttctaggctttggtccatgtatctgcctttcttttcttcttctttttcatatatatgttttttatataatccaataatatctgcaattttatcaaagataaaataggctaccttactatttctggaattatacaatattttctcatgtagaaatatggttttgtgttaatttcacactaaggctgataaatataatgttctaccgtacctgatgaaattgtagggtcacaaagtcaagctgtaacagaaataagtaaatgttattgtaagaaactaaaaactatatatgtatgtcagttaatttgtaatacaaatgtcaatatgtcaaaactaacataattaagattgagataattggatgatttgttgggtggtgaatggagagcacgtgcttgagaagttagtagtaagctatagaaaatgaaggataatgcgataacatgtgccttatcccgacaaaacacatctcacatgtaaatatagatatgtccatacatattatcatagaaagagtaccaaaagtgtgaaatctatacaccctaaaataccactagataacactctttattatttatatagtgatatcaaccacctttcatatgtttctctgttttgcaagtaaactttttacatttatatcaaggatattaaattagttttcatattgttagctttgctgaaacccaaattaatgagtccaatttttaattattctctttacatcaaaattcatatctacaattatattcagaaattactagaaaggcatatcttatacatacttgatgtattatagataaattttctctttcttttgaaacatatatatacagatataaatagaggcagatacatgtaacctagccaaaggagcattggtatctcaaacaatatttgccctttctctatctctctctcatcactatttgccatctctttctctctccctctctttcaaatgtcaataaaccaatactcaagcgatttccactaccattctctcatgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggtaccctttttatttaattaaacttttttttgtgtcataaccaaaaaaatttgaacctaaattcagattaatcttgaacaaaaaatgtcgaatatctttgacatttaaaggtgtagtgaaacacaatagtttttccaaccatttagctcgattattaactaagccattgactaattaacacactattaagagttatggaatagcattaaaaccaaaacaaaaaaagagttatagaaattggaagagatgttcattttgtcgtttctatttttgtcaacgtatagttttcattttacatgcatagactggataaataacggaaataaaatttaacgagtcatgcgatgttctttctcaaaaaaaaaaaaaaaacgagtgattcgatatttacttaaagttaaaaaagtgtaaaagtccaaaaaaaaagtggaaaatctatttcatgaaatgtatgaggttacgtgacccaattgaaaactctttatcttgtttgagtttgtaaatgtgcgcgtgaggttagacgcgctttaaagtaagtagagaagtaaaaataaagaaatgatggaagcccatagaaacagaatcggattcgtattatctgctctgcgtgacatttgttgcgtatccttacacctactctttctccatttttcattatacttatagcatcagtgtgaatatatatacacccttatctttaatcgggatcttggaccgtaaccaaaacggcatgcagtagttcctcacatgttccgaatatattcatcagctcaaattcgattcaagacattaacccaagtccaacatagttttaagagtatatacttaattattttcatatatactggtttatgtgatgtggacattttgtagtaccaatgtaattcacatataatataacgtggcgtcccattgtggtaaagcttgtcatctgagtaccacaattggaaattctcttccgattaaagtcttgttcattttggaaaattatgacaaaagtctcggtagttatccattatagattcctcgatttcactatctatgttactggatatataatttttatg

SEQ ID NO: 10453 - DNA, 3000 bp, Unknown
  misc_feature (1)..( 3000): cDNA_ID_2991235_gDNA_ID_2213650_Annot_ID_181593 3000 nt of promoter + ATG
tcgctgcctatggcgtgaatagtggtttaagtgctggtcttggtgttggtattggtggtggtcctggaggaggatctggttacggaggtggaagcggtgaaggcggtggagctggtgggcatggcgagggacatattggtgggggcggaggtggtggacatggtggtggtgctggcggaggaggaggtggtggccctggaggaggctacggaggtggaagcggtgaaggtggtggagctggatacggaggcggagaagctggtgggcatggcggaggtggaggaggcggagcaggcggcggtggaggtggtggtggtggtgcacatggtggaggatacggtggtggacaaggtgctggtgctggaggaggatatggaggtggaggtgccgggggacatggaggtggtggaggcggtggaaatggtgggggtggaggaggaggttctggcgaaggaggagctcatggtggtggttacggagcaggaggtggagctggagagggatacggtggtggtgctggagctggtggacatggtggtggaggaggaggcggtggtggttccggaggtggaggaggaggaggtggaggttatgctgctgcttctggatacggtcacggtgggggtgctggtggtggagaaggaagcggtggctatgtaccatgaaaaattatctatatggagtgtaacggcaattgagtgaagtgtcatatctcgtaagggactatatagtttcacgatttatatgtggcaataaatagagtaatccttcgtataataagccgtagaaaggcggctattgttgaagtttttaaattgtaccacgaccaatattgttgtaagctactactacgtgtgtatcaagtttttataaatggaaatcatagttgttcctacgcgtgacgtagaatctatattaaataaattttacggagtatgcaaagtaaggtacatgagtgaattaggacacatacaactttgatttggtacatgacaacaagtgacaatatgaagaacattaaaaacatcaataatgcccaaaggtttaattgacattaatttaattgggccgaacttaattttccaatagtttcaacctctataataaacactcttaatattatttacactaaaaggcccaaaggttatagaaaattagagccgacccataaaaccgataataaaggatcagatccgacccgataaaggtaagcagtgtagcgtcgcatcatacactccttcggttcccgacgaatcgctgcttttttctctctctctctccgtcgctgaaaaatgtcggcaagacctgaaggaagtccgccggaggttacgctcgagacctccatgggtcctttcaccgtcgaggtttctctctctcactttttcgcttatcggatcaacgataacacattccggccatgacattcatatatagagcttacacgaacttgagatctagatttcattctctataattctacattccaattgtatttttctcgaatcgagcttaaactttaggattttagaacggggttttagggtttacaatgttttgatctgtgtgtcaatttttactcagatgtattacaaacactccccgagaacttgccggaacttccttgagctatcccggagaggttactatgacaacgttctgtttcacagaatcgtcaaggtatgttttctgtgtgtttcagtctacttttcgttgtacttaagatcatcattgtgatgaagttttaaggaaattgttttgctttgctattgatctgtttcaggatttcattgtgcaaggtggggatcctacaggaactggaagaggtggtgaatccatttatgggtacgttatcatcgtttttctttaatcaatgctagctttgcttgttgattctttgtcagtaatcaaatttgaatatggggacacaagcaagctctgatgtagttagttttggtgggggatagaagcaagctctgatgtagttagttttgaagtgataatattcaaagctctgatgaagtaagcttcattatggactaggctctgtgactagaagtctcaagttaattgacactactcaagttgctttattcattgtccattccattcttgttttgtttaggtccagtcatgtgttccagaggcttgatcttaatcttagcatttgtcttattttattttattttttgccttgctccttttcctagttcgaagtttgaggatgagataaacaaagagttgaagcacacaggagccggaattttatcaatggcgaacgctggtcctaatacaaatgggagtcaatttttcatcaccttagccccacaaccgtccttggatggtaaacacagaatacactcttttaatagcttacaatgttttgagatcattttccatgtttactaagagaacttgcattgactgttgtgttcttcttttcacatctctatgcaacttctaggaaaacacacaatatttggtagagtgtgccgaggcatggaggtgatcaagaggctcggtagtgtccaaaccgataacaccgacaggtaaagttgattattcatttggaatcaacaagaattaaccaccgagtgaaaaaacccaactaatcgaaggaatctcttttctattctcaatttccaggccgatccatgaagtgaagattctaaggaccaaagtgatcgattgattggggcagaggagtttttgtcaaggagaagaagaagcatttagtaaaccgtttatgacatgaagaactataactctgtgtactgatcccttgatactattgtagactggtttttgtctaagtcttgactctactttgatggaaaaaaatgattgaaatacgttaaatcactctctatttctttttgtaatttgcctcgttcatatcaattcaacggcttaaaaaagaacacgtcatcaagattttcatgtttcaactcatatcctctaaaaagctatctctcactatgtgaaggacgcgacagtaggaaa

SEQ ID NO: 10454 - DNA, 3000 bp, Unknown
  misc_feature (1)..( 3000): cDNA_ID_1808507_gDNA_ID_2213650_Annot_ID_181589 3000 nt of promoter + ATG
ccgaaccatagcatggtggtttatgcgttatgccccgaccttagatgattgattgacaggttttagttggccgcaaagtgtagttttttacatatgaaagtggacccaaccatttcactttgtttcacaagtggatcctttaatactttcctaaaatttctacaaatgggtttaggcttatgattgtcatgaaagatatagaagcacttatataaagtttaaaaacttatcatatacaaaaaaaaagaagaggaaaatcaaaaagtataaagttaaggaccgcaaaattataatcggaatgtaccaattaaaactgctaacaataatccatagtatgtatatctttgactgatatactaaaatataatttcacccttcataaacaaaaatgcatatctatttctttttattttatatatacttttcaattttccatacatgtttattttacacaaatcatattttttaatgattttttaatcacaccttaaaagatcaactaaggaatcgcggtctcgcgggcatatctcttcttcggggtcagcagtgttccaagagaaagcacaggcccatcatagtcttgtgggttgcatcaaaacacgatcactcgacacttgcacaaattcttttttcatccttgtccaacatgaccacacacaaccaatttcatcttctttttttttttttttggttttcgatttaatcttctcagcaaggaatttattcttttacccttaatctgagcctttggaaatcacagtgttggtcaaaatatctatgatcatgtgtttgatatcgacatacatgtaacatgtatgtgactcctgtagttcatttaatatgcaatattttaaaacatatatattttcataggaatgttaacatagacaagtctttttatttcatagtctctgacaataacgcatgcattgtatttgtattcaaaaaaaaaatattaacacaacatgagaattggcgattaaagattttgacctagataacgttcattatcaaaattccaaacaactaaaagaaaagacattgattattttcaaggaaaagctctttcctcagaaacataccccaacaaaataaagtttcgagctctctttccagatatgttccttaacattcgagctctctttccagatacgttctttaacattcgagcgctctttccagatacattccttaacaccgagcttgcagcaaacatagacatcatctgacgcctgaacaatctgatcatgggaaaggctacgagcaccccaattactcatacatatctccttatctttcctcactcccttgtaccccaaacactcctctacaatcttctcaaacgaactattgaggagcctcgtaggcagatagtgccttatgtctagaagtctccatatctccaactgatggcggaatctttcgagcttgccctggtcttggctgttccagacgccgacaaaagtgattgtctcatcttccaagaaacttcgaaggacctcaggaatgcgtttacagtgagacaactggatgatgagacagcggttaccaacacatagttggagaatatccggtggaggatcggaaccaccgggtgtccattggacgtcgagtccaacaacgagagggtgtgaggagcgaagacggctgaagaaacggatgctatgaatccaacggcggatggttgaggtagtatgagtgaccgtgacgatcaaacgttctccaaagaaatcgatgtagcggttttcgtggatatggcgcttttggattcttcttctgatcctagccatttaatctgcataaaagtgagtatgagagagaagattaaatagatatcaatcctaactaatattcaagaaaacataatatagatcaataaattgatgagagtaaaaacacaaagatgtttagaaataattattgtcaagactcaagtttcttcaaaatatcaagaggcgcttggaataagacccttattctacaatacatcaatctatatagagataaagactaagcataatttttaaaatagaaaaaatataaacgtaaataacacttttttgaggtaatactaaattttctaaacatgaaatgttacaaatccacaatatttccatataaatttgtaaataatattttgttagataatgttaaattttctaaactgaaatattaacaaatccgcagtatttccattattaaatctcgattttgtttcaatgggagatttgaattttgaaccaaaaaaaaaaaaaaagatttcatcaagatatctagggggatattttgctggaatatagctttgatgagaatatttatattttgtatctctgaaaatcaagtttaaaggggaaatgattatgggttgaaattttgcaatcaaaagccctaatttgcaaaaactacataagttttttgtttgggctggcgctatcggatccttttaggcttacatttaacatctggtccacttagaaagagtcacgtagtatatggtaattgtcaacttgatttttcaagttaaaagaaatatgtatcaaaatgactaaaaagtagtgaaatattatgtatctaatttgtttatttaccaaattaatgctataaaaatgttcaactgtacaattggcatggaataatatgaacataaatcatacattattaagcacttttgcctacgaagggataccaacttcattagtttacattttcttttgtgttcaattgttagctcaaacccaattaagtggggaaagtaagaagcaacaactcctcttcccggacccctaacaaatcaactaaactcaatatcaaaccattttaaaagagctcatcattaactagctactaattattcttaatcaatcactgcttaatacaaagcactatatatacacttgtatcttccattagtttcccaccacaactacaaaacattccaatacacaacacacaaagcacacactttttctttcttttaaaccccaattgcaagagaaaatg

SEQ ID NO: 10455 - DNA, 3000 bp, Unknown; identical to SEQ ID NO: 10452
  misc_feature (1)..( 3000): cDNA_ID_3036546_gDNA_ID_2213650_Annot_ID_181586 3000 nt of promoter + ATG

SEQ ID NO: 10456 - DNA, 3000 bp, Unknown; identical to SEQ ID NO: 10454
  misc_feature (1)..( 3000): cDNA_ID_1808507_gDNA_ID_2213650_Annot_ID_132458 3000 nt of promoter + ATG

SEQ ID NO: 10457 - DNA, 3000 bp, Unknown
  misc_feature (1)..( 3000): cDNA_ID_2704987_gDNA_ID_2213651_Annot_ID_132464 3000 nt of promoter + ATG
cccggaaccagatcaatattttgagttatctgattcatccccgacgcgtaaaagagaaaaaccaattctctcctaactaatacctaagacacaaccacttttaccaacacttaaaaaaaccaattattcacagtttgtcaaaaccctctccagctctccaaatatgtatggtttagcattcatttttcctatttccacaacattcatcatcaagttcttcactaatgctacttttttacatcatagtgaacatgttaccaagtgtggattccttatttccaactcattcctcgtcgatcttgccaaacctcataaatgggtttcaaccctggtatgtagtccactatatttatcctagtacaaattaaccttttatcaagatatactaatgtgtaactgttttattcccaagcagatggaggttttggtgtcattactttctcggaggcttacaactacacttgataatcatcgttctgcttttgttgatccatagttcacaagccatctacaagctaaattcagagccttcaatgctgccaagatgaaatcacgcgttcgttggtaagagaacatgcaacgcttcatcaaaagatccaaaattgaatggttcaaggacatagataccatttacgcacctatgaaatggaatgatgagcactgggttggactttcaatcaatcttggcatatggagcgttgaaattcttgacccaaatacagacctctacgacgacgataagataaaagattcattgagcgggttgtcaatcttttgccccacctcatccaaaggtactgtacgcttgagtgttctcagaatcacggtcttcaaccgtttttatggagacgaattgatggtatatacaagaatttgcggagtggtgactgtggcccggttgctatgaagttcctcgagatccaggcaagtgataaactcccagataaaatggctgaaattactgacaaacacgtcgacgcgtttaggcgttaatatgccatggacatatataaactatgtgtctacccactctattcatctcatgtttctgactagttatggaatgtcaccctacattcatgttgtaatatatacattgcttcctccttctttgaatacttataactctggattctataaatatgatttttgcttttcttaaccatattcataatcttatctttttattactgttgaatgttttagtggtctgtatcatattatttgtttattccatccataaccccaattttttaagggcatctaacagttgatatcggttaacaatgcgaacaaaaaaaatactttagagtattttgaactattgttgatttggtaaatcattcgaactaattatgtttacaaatacgtgaaaaaattaatataaatgtcatccaatgataataatttatccaatcatacaaacgaattaatacagttatattgtggatggattcatatggatacattaacaattatctttctcttttaccttgaaagacaaatctgaatttttttctaccgagaatattgagatactgttgtatagcaagaatattcccaccttcacgtttaaaactaggattattatggttagagcataaaccagaaacattatggttagagcaatattcgtttaataaaagttttaattatcacgtttattatgaggaggtgagcataattatatacggttactaaacacccacgatttatttaagtttcttccattccccattccatctgtttcaacttgaaaacaaataagttatgctcaagttagaaaaagtcgacaagaatgaataaccatctggtgtcaaaaaggttgttcagcataaactaaactacttagttttctacgttttacattcatcgtaaacaaaacataatcgtctgcatatgttttttttttatctcaggttgctgctatcccaaaaatttacatcccggcaccaatacttgtttaaattattagctacgttgccgaagatgtcgtggatgctttgaaacccttggttatggctggtccaacatttaaggatgcaatgtattccaaggaaacactaagttgtgtccgcatagacaaatatcgttatttcatgtggtggttcatgccgcattccatctattatcattttttcacacaatgtcttgaagccaacaatccacatgctttgaaagctgtattgtacaaaccaatagcatatgagaattttgttgccgaatgctatagatctaccttatgggcaaagctatacggagagcattaaggataggaatcaaagaaaggaacaaatagtcccaaattttgaaagacaatgaaaagtctgtttttgatgttcatttctgatgttctgcctttcatttcagaaaatagttgcttattaatttctgatgttctgcctttgtttttataaaatacataatttatactctgtttactcctatgaaaagtcagatcccatcaaaatttgttcgttgccatgaatgaggtttgcatatttatgtttaagctaagtccgcaaaaatgatttccaattgataaccctttaaggccatatacgtgtgctcacgtcgttataataaattccaaacggacatatatctttggacatgttctcttggatagaacatatatttagcatttaattacaaataaataactcgactataaacgacaccagacgaattatctatctaatattacaaccacccccaactcaatacgtaatattctcaaaaataaatatgtcatatagtgtaacgacaacggatcgttcaagtaaccaacccttcgatgttaaaagttacatctttttctcgcagacgaagttacaccgttttggcttcaatcaaaggaaccttttcacttgctataaatacctctcctatacttgactctaccaagacaaccccatcacaaaagaaaaacattgtcctctgttttcgtttccataatcctctgtttttcgttactcttcaattctgccgcttttcacc

SEQ ID NO: 10458 - DNA, 3000 bp, Unknown
  misc_feature (1)..( 3000): cDNA_ID_3036613_gDNA_ID_2213651_Annot_ID_181606 3000 nt of promoter + ATG
tgtatcatattatttgtttattccatccataaccccaattttttaagggcatctaacagttgatatcggttaacaatgcgaacaaaaaaaatactttagagtattttgaactattgttgatttggtaaatcattcgaactaattatgtttacaaatacgtgaaaaaattaatataaatgtcatccaatgataataatttatccaatcatacaaacgaattaatacagttatattgtggatggattcatatggatacattaacaattatctttctcttttaccttgaaagacaaatctgaatttttttctaccgagaatattgagatactgttgtatagcaagaatattcccaccttcacgtttaaaactaggattattatggttagagcataaaccagaaacattatggttagagcaatattcgtttaataaaagttttaattatcacgtttattatgaggaggtgagcataattatatacggttactaaacacccacgatttatttaagtttcttccattccccattccatctgtttcaacttgaaaacaaataagttatgctcaagttagaaaaagtcgacaagaatgaataaccatctggtgtcaaaaaggttgttcagcataaactaaactacttagttttctacgttttacattcatcgtaaacaaaacataatcgtctgcatatgttttttttttatctcaggttgctgctatcccaaaaatttacatcccggcaccaatacttgtttaaattattagctacgttgccgaagatgtcgtggatgctttgaaacccttggttatggctggtccaacatttaaggatgcaatgtattccaaggaaacactaagttgtgtccgcatagacaaatatcgttatttcatgtggtggttcatgccgcattccatctattatcattttttcacacaatgtcttgaagccaacaatccacatgctttgaaagctgtattgtacaaaccaatagcatatgagaattttgttgccgaatgctatagatctaccttatgggcaaagctatacggagagcattaaggataggaatcaaagaaaggaacaaatagtcccaaattttgaaagacaatgaaaagtctgtttttgatgttcatttctgatgttctgcctttcatttcagaaaatagttgcttattaatttctgatgttctgcctttgtttttataaaatacataatttatactctgtttactcctatgaaaagtcagatcccatcaaaatttgttcgttgccatgaatgaggtttgcatatttatgtttaagctaagtccgcaaaaatgatttccaattgataaccctttaaggccatatacgtgtgctcacgtcgttataataaattccaaacggacatatatctttggacatgttctcttggatagaacatatatttagcatttaattacaaataaataactcgactataaacgacaccagacgaattatctatctaatattacaaccacccccaactcaatacgtaatattctcaaaaataaatatgtcatatagtgtaacgacaacggatcgttcaagtaaccaacccttcgatgttaaaagttacatctttttctcgcagacgaagttacaccgttttggcttcaatcaaaggaaccttttcacttgctataaatacctctcctatacttgactctaccaagacaaccccatcacaaaagaaaaacattgtcctctgttttcgtttccataatcctctgtttttcgttactcttcaattctgccgcttttcaccatgattcagttccaccgtctgtatgagttgtctccgttggtaactggttgggcgatatgtgtcatggtagtgagagtttacaaaaaaatactcaaccatgatgcattcgaactaagacttctcttggttgataaattggtatacaattttctcgtattccttttcgcaatttgcagatttttttctaatccctcacccctataatgttgttttcatagggcacccaaatagaggcaacaatcgggcctcgtttttctgccttctattatgacagaatcaaagagaatcaatggaaaacgattactacttttattgttcgaccaaactgcgaagcaataagaacaactcctcatgaatttcggattttgttcatggagcaaactgtcgtgactccctcaaccaccaaagaaaccgttgtgcttaacaacttcactccatttgactacatcatcgaagacactgttcgcaaatatactttggttggtaagtaataacttcacaaatttaattttctttccaaacacatagatttaactactgtcatcttcatcatatttcgaccagatttgcttggtgcactcgttgattatggatttctgaccaataacgcgaggaatggtaccgatttggacggattcaagctacccttcaagatcatggatagatagtacatctctttaccaacactacaagaaaacaggtaaacgacgactacaatcagcgacaacaaacgtagtcgtaacattatacgactatttggccacggatttacgactcgcatgcgacaacacgaaaaattgtagttacatagtcgttgttttacgactatcgtatgcagtcggcaaagagtcggcaagtaacgactatttgatgattaaattattgaagggataatgttgtcgttgcttagtcgctaattaacgactattctaccgtctattttatttagtcgctaatttgacgactacaggacgactagacgtcttagtcggcctgtagtcgtagaaacgtcgcaccatagtcgtataaagtagatggaaaacgtgtttcgcattggtaagtaggtacagctaactatttagttgtagtcgtaaattagtcacaaaaattggcctatataataaacgttcacgcaactcttctttcaccaacaaatcaaaacaacaacaacatcaaagagaaaaaaaaaaaattagttactttattgtata

SEQ ID NO: 10459 - DNA, 3000 bp, Unknown
  misc_feature (1)..( 3000): cDNA_ID_3036580_gDNA_ID_2213651_Annot_ID_181616 3000 nt of promoter + ATG
ttggagagtgaacaacatacagaattaaccagtgaaagagatgactacaaaattgattataaagatgaagaacaaaatggattttatactcacagttttcatagagaatagcgatgtggatgatatgggaatctaataacaagcttgaagggtgactttgcaaatcagaaaatttgaaaatcaaatagaattgagagagagaaagagagagagagagagagagagagagagagagagagagagagagagagagagagagagagagagagagagagagagagagagagagagaggagaagatgaagtgttgaaaattttgtcgacattcgagtttccaatattggagataaggaatacggacagaaacagaacttgccgacgatgggattggagcgaaggagaggggaagaacgagatggcaagacaggatgattgtattacttggatcttaatgaaactgatcgttgagtttaaccttttttgcgctaatctccaaattattcattgttcacttttatttttgctttatcatcttcttctttgtccctatttaaggaattcaaattcacttctactgaagtatttcttgtatcttctgtgttggtcgatttgggtttaaaaggattaatcttttaactttaaactttatccttccatcgatttcattatttgtttctgataaaggcttttgctttatggaagtgataagatagtttgatgatgaaaaaacctaatttccaaaagttccccacgccttcgtcttactctttttatctctttcggcaattggagaatatgacttgaaaaatctcaattttgtttcattttttcttctggatcctcttcttcttctctatctcgtttcagtcgataccctttcatcttcttcttcttcccttttcacttgtttctctagatactctgtgaatctgagatatctaccgtgaatatgagaaatccactttgaaaccgagaaaccgccggtaagaaatcttttgtgtcatatctatgtaagattttatctgtttgatccatagtttttgattgattgtgttgggatttagggtgtcatgggttagattacgttttgttttagagtttggtctcttcttctctttgatttagagatggattttggataagttatcgattgaattatgatgtttaatgattataatttggattttatcattacaatttggatttgaattacaattcggatttgaaattgggattcttttaaattgtcccttagtagcctttgttaaggatagccattgaaacaagtttttatgatttaaattcggatatgaatttgttccttatagatggtttgtgaatatcactacaagaaatattgacattgttagcgcgaaatatttgctatcatacatataatatagcgaattcacaaatgttataacatcggcatgcatcgtaagtatgacccatacattagcatttttttaaatgctacgatagattcacatacaatagcactttcttgaacgcttttatttatttttatatgacgatacatccatgctatgatctatcattttttcagtgctataatattcagttttatgactcttattttatgcagttgtattactctacaaacatttggtggaatctgtttaatttggaaaatattcaatatatatattaaatttccaaaagatcaaacattaatttatacataacacgagtctcaaacatgtacaactaatatctttaattctatatactacttttgcaattggagaacttgaaaacgattgatgagatcatgcaaaatccttatttcgttttctagatattggactcggttcctcaaggaagttagctcagcttcatacgttgttgttgtactctctttctttctcataggttttcgaaaaagactactaaactcttccgtatattttctccaaatgttgcagtcttcatctttgtcactgtcctcaacgacatctgtaatttctggtacatgaaagaaaacaaggaagattcatgcttcctactacaaaacttatcgaatcactttattagcaaacaaacatctttactcacatgcaaacgtaacatgtgactgagacatatctttaccctcagaagagactaattccatattatttatacctttactttctccaaaaaaagaaaagttaagaccatcacttgtatccagcattggtgattcatagacataactcgaaaaccatttacttagatcaggaacttctgataattgtgaaaataaaagtgaagaaccacataagtgaaatcaatgcagctaaaacaataagatatacatatcttcccaaccagccaagcaaattcgggaaacagtttccaagaaaatgacttaccttcactatcattcatcttttaattatctatgttcgctcctctttgacctaagaatcttttgtataagccaacaaacaataaaatccaaaaccatgtaatgtatgttagtactaattagtctacaagaaacaaaaccaagactaaatttttataatgtaggcagaatatattattttagaatttattacacgaaagactaaattttggctaaatttctagcggaataaggtattttagtttcccgtttaataaaattatacattagcgttaataaaatgctatatcagcaaactctatcctagcgtatataaaatgatatatatgaaaataaaaattacaattaatcttcaatagcagttgagtaatctgtgctatgtcgttatgctatcaatgtagactttttttgtagtgtatgtctaaaacaaaagatgacaagtattttaaatgtttgatattgaatttgtattttggatttgttgttgcaagtactaattactatagttgttactcgtagaggaggagaacctacttctagaagtgaagtatatgcctatcttagaagtgataatagacaaaagctatctgatccactccatttagagatagtagttgcaatggacaatg

SEQ ID NO: 10460 - DNA, 3000 bp, Unknown
  misc_feature (1)..( 3000): cDNA_ID_3036558_gDNA_ID_2213651_Annot_ID_181622 3000 nt of promoter + ATG
atcaattacaagcccaatccaaacctctcctacagaagcactaatgtagctaactcccaagatcaagtgtatccaccacaatagaatcagtctaagccatttgttcagtataaccaaggttatgtccataaacagcagtacaatggaggataccaacagcagaatccaccaccagggttcactcaacaaccacaacaagcaccgacagcataagatcctgaaatcaagctacttattcaacagatcattcaaggacaagctactggagctatggcttttcacaagacgatagctgaactacacaacaagatatattgttcttacaacgatctaatgtcaagtttgaagctttgaattccaaattcaagtatgtggagagtcagtttgtatccacctcttctccgaagcatccagaacaacttccaagaaaagtagttcagaatcctaaggactatgctactgctaatgctatcaccatccaacaagaagatgagtctacaccaagtcattagactcccaatactgaggacaatatgattcaagaaggggggtattcaactcaaattgctgcacctgccatccagcaattcagctggactatagagcacacacctttgattggtactcaccattctgagaagaatttcaaagtagaaaaacccaagtaggatcagaatcatgagatgattagtagttttatcactcaagaaacttacaagaagaaagtcatccaagaaaagctatatgatcctagttcattcactctgccatcctccctaggaccattgacattcgataggtgcctttgtaatttaggagcatttgttagccttatgcctctctttacaactaaaaggctagggatcatggaatacaagttctgaaacctagcttcactcttagctgatggttctgttgcacacccccatggtttaatagaagatcttcctgtcagaataggaaatgttgagacacctatagactttgtagtgttggataaggatgaagagggaaaggatcccctgatactaggaagacctttcttagcctcaacaggagaagtcatagatgtcaagaatggaaagataaatctgaaccacaaaaagacatcaagatgaaatttgacatcagcaaagcttcagggatatcaacaacaggatgtcagaattttgggatccaggatatggatgttgatgaagaaacataagctggaatcccatcaagatttaactatacttctcaactgagcaagctatagacaaattttgaccacaagaagagagcaatagaaaggttagctcagactaaagacccttcggaggatgactggcaggagatgagaaaaatatttaaatggaaaagtaaaatcatagaggggttgtcttcaagagtaatgaagctaaaagatcaactatgggcttttgaaaaaagagttaataagtattcaatgaacattgacccagataagatggccactacactagctatcaaagaggaaaatgagttcacaacataagagtttgcacgagatgatcagaaaagagtttatgttgaggaaagaaacttagaggatgagttgttgagagaggagggaatccatattccgacttattctccaggagtgcctaaactgccccgtaaaccctctgctaaggaagaacacttgacacttgactctattactagagaacttctggaactcaggatagagtaccaagcttaagaggataccattgggaagttaacctacaagatgaaagaactgaaccatgcaatcttggaacttcaagaaatggttaaaagttaccccggttttgaaattgagcattggtcaaaagaacctggttcagaagaagaagactactctactgatcataaagaagtttattttgaagaaaaatcaaatgagtactcatcattacatatgtcaagagaggatggagtgtatggttcaagcattgaagattcaaccactaaagatgaggacttctcagttcctcctttcaacctttttttgactaagctttgtaagagtcaagcttagtgacttaaaacaagctcacttgggaggaagtcacatgtttacctatgtatataactttctatttccttgttatttttgatgttttcgtttaagtgtgtcaggtttatttcattgactctgaggaagtcaatggtcgagtaaattcaaaccaagtcacgaacaatctcaaccaatgatcgagtaaaatgaagaggagtgttctcagccattggattgaatgaccaaatgagagaaatcatccccaccgtttgatcgagtgatcaaaagcaaagcattctccatcgtttgatcgagtattgtgcatttcaaaaggatgctcgaccatttactcgagcttaaattatttggagaccaaggcataagtcgcgtgaccccacttgttccccctttatttcactactcgatggacaaaccatttacccatgccccgcattatttacaactcgcttttctatcccttcaaaaagaaacaaaaaaccatcctcctccactcattgaaatcgcaaaaccatccttaaaacagtctctctctttcatcctctcatttcgacattcctttctatctcgcaccaaacttcgttacaaactctccctttcactcctaaagaattcgttctcatcttcaccatacctcaccaaagttactcgatcattcccaaatccatcctcaaatattcaaccggtttttaagctcaaaactccatcaccaaataacaaaatcctttccactttgatacctcttggagagttgttcttgattttcctgtagaagctcaccaccaaaatccatggattcaagaagaaagagttcatctcgggctagaagatcctctatttataacaaagaagttgcggcgattgacatgagtggcatgactaaacgccaaattcgccaagctctccatgctcaaaggtcaagctcgattcaaggggggagctctagtcgctaaaccatg

SEQ ID NO: 10461 - DNA, 3000 bp, Unknown
  misc_feature (1)..( 3000): cDNA_ID_3036566_gDNA_ID_2213651_Annot_ID_181620 3000 nt of promoter + ATG
ttgttcaatccttcatctccattccctctcaatctgaagtttcatcaagtgctaaccaacgactttaaggatcctcttcatgaaaatcgacgatggaagaagagcggcattatgatcccgcctccaaggagcggtgattcccgacacttcttcaaatcgtcatctctgctgcgcctatttatcgaacccttccttttgctattgttttttagcatcttcagagatctccctattgaatttacaagattgcagaagaagggcattatgatcccgcatcaaacgagcggtgattacccaaccttctccaaactctgttcttcgatcctaatggtttttgaactcaagagcatacccgaatttatctatatctatcaggatattcaaccctttgtcccaatgtcctcgctgcgttttgcgtcgacgaacacagaggtacaggactctttctcaacgtcattttatcattgtttgatagtgactatctcataattctccgacttgttcgtggacgtgtctttgacacactttgaagtcgtttgtggtatgtggcttgtttgcctctgtctccgactctcatcggcctatccaatctacttatcgacctatgtagctagattatgtttttctaagatctttgtaacccttttcatccttgcagactttgtaaacttgcccttttggaatatgattgaatgaatacatgtcttgtttgacaaaaaaaaaaaaaaaaaatctataaatttatgaatatatattatgtaaaacttagtaaaatatgattttagtattgtttttcttcaatttatattaattttttgtaaaattcaattctaatacttttactacgtataaatgtttttttttttttttttctaaacctaataatggttatctacttgtaatagatttttagaaaaattattgattgtatagagaaactaccttttagatcaaatttttgtaaacaattacaaactttgtaaaatctctccataaattaataattaataatttatcgataaattaatacctctctaaattaataaattttcttggtcccgacattattaatttatagaggttttactgtatttgtaaaatctctctataaattaataatgttgggaccatgagattttattaatttatagatattaatttatagaaatatttaatcaaaatacaacactatattctttcagaatataataaaagtcaatagcatactcgattatccgggtgaaaatgaagcatactcaaagagttttgagaagaaattgtgatttctgtctataatgttggtgaataaattgaagacgataatgtgaaacttttggaaatagtgacacgtaaggaagcaattatcgcgcctagaactcttcacaactttttgatacatatcgagaagacaacaccagaagtttttgatgcaacaaagaaaattagagatggactttaacaagattcaaattttaagaaaagacaaacaacgctagattcatattatattaaattatcttaaagtatgcttaaaatttgtggttattaatttatgatattattgggaccatattgttacatagagatttcaaaaaaaaatattatcttattatcttatcgatatttttggttaatttttacattgacccgacttgggaccggcataatttattaatttatcgtgtttattaattgatcgagtattaatttatagtgtttctactgtataagccctaatgtctttattgaaccgggataaaccggtccgtttgggtcactcaattcacatgttttggatggttatctgtcgttttctatccggttttatctagatcactatgtttgttgacggtactactctcaagccattatctcatagacacaaaatcaataacttaaacaaatcataagataactcactagattgttttatttactcttgaagaagaaacataaacaaaattgggaatgtacttttcaatatcatctacacatatctcctcaaatacaagtgaacctaaaccactatgctaactgaactatttaagtgattttaccaagggaaaccaattatatacactctaatactccccctcaagatccttttatcttggatttgaaaactccatgaaaattgggaaaggtttaaaccataaaatcaactgaaatcacaatgtcctctggcggtcttgttagtgatctaaagacaaatgtgcttcaatgaccagaatcatctacatgcttttgccttaagactaacaagactaccatcaccatgtagcaacaaaaataatctacaacttttgattccaataaagaataacttcaacagatttggcttcttcattgtataacaaatggacatcttcatacacttgtgcatgaaatagtcaacataatgaggtatatatgtgaatctaagaagcacggggacggctaaaaggtgacgtatcccgtatcggaaacgttttagatcggggacgtttctcaaacttggggacgatagcagcttttggggacggcgccgaaccgtttgagggacgtttcagaaatgtttctaccccaaaaaagaaaatataacttttttttcttctataaattataaaagaaaaggaaaatatattcttaaactttgtgtaattagggtttaagaaacgtttaatctcccttaatatacaagagcccgttgttttttttttcatctaaactaaatcttctcgacttctctcctttcacaccctctggaaagtagatttctataaaaggtatatcatgactcatctctaagtttttaatatgattaaaatctctttttaatacaagttattagtcgagtacggttggttgactaacaaatagcgacgtgatgcttaagagattaagaaatttgtttaatctttgtttgacaaatagctttggttggactgtttcatatcggtcgaatacagattatggaatcgtcttaataatttgcttttcatattgcttgcagccgatatc

SEQ ID NO: 10462 - DNA, 3000 bp, Unknown
  misc_feature (1)..( 3000): cDNA_ID_3036603_gDNA_ID_2213651_Annot_ID_181609 3000 nt of promoter + ATG
aaccctcctactcgatccactactcgattcatttactcgaccaagggtgaccatctttacaagacttgttgagctatcaaagcgtctttggatcctcctcattccccactcaaccagacatctgagcatacggataggagaggatgaagcttctacttgaccaattgatcactcggagcatagacacaaaggcgcagactttgcagcaccctctttactcaatccccaaggtcgagtattcgccaaaaccgcctcaagtctcttgtcttctaatgaatctagattttccaacattttagtataaatagatcactttgggatttgtccaaaggatctatgctttatctttcagtttttctttgtgtttatgaatcttgaaaccttaattactcttaatctatttcgtttttgcatttgattgtttaagtaaagttgtttagcttgtttagatctacattttggtatgattttagtaatttctgggtttgtgttcttgagaatgttgcttgagtagtgattagggttcttgaggatggattagattaggataatctctaggttagttagctggttagtgtttaggtttatacccttctggattcgcttggcccctatgcggttttcgctggctaatgtggagattcgatcatagacgtccagcgtccaaaagacgttcaaatggatgtctgacctacgaattccagagatatgtaaactcgaccaagggattggcttgtctgcctattggctttggtagattatttcttaaaccctgctctgctatgtttcatcaacgagagttgagattaggaagtggtagagttatggggatctctgtcacgagagtggattgacccggtttttgaatctatcgtcatgggtatctacctttcgcctattagccatttgatgaaccctagagttgcccttatcaatgaatccatcattagaacttctataagattgatttgtatcccctattgattacacttttatttacctgttatttgtatcctccatttacatcccctgttgattgcattttagttcttaattttgtcacatgttggttctactcgacccaatgatcgagtagggctgttaagttcttatttttacttgtttgaatcctgacctaggagtgttactagaaacccaccatctttataatctggcttgacttagttgtttttgtacacatcttgattgctagcaatacaatggactggattgacaccctctatgactgcatcgacatgtttgtgttttagaggaattgaactgaactcaaacagcattcagcatataagtaggcgtaaaaatctgcttatcagaagtacacaacaatttgcagcaacaaaatatctctactcgccactctcgttattctaaacctttcagatatctacaagttccataatattaagattatcaaaatctatgattaaacatcgctatggcaggtcgataccaaacaggcagagattcctaatcgacttctatgtcatctttcccatcccagtggcggttaagtcgctgcataaacattgttcccaagccgtggttaaggcagaggctattcaattgaaaaatatcgtttcaagagatttttgggatgggagagagagcgttgaacaggaatatcaaccaattcaaggatcatacctgactcggagattccgaatcgacttttcaaaataattccttggtcagaagaattaactgccatcaacatcgatattgtgagataatttcagtcggcgaaggtagctccctttctcatctgtaaatatcaactgtcgttttattagaaaccaaatcaaaacaaaactatgctaactggttaagcaattgatggtttagattgaaaaggatataattgtctatttattctccacgaaacaagaaaaagtgtctcatccctcagaagtgcctcaaaaggaataaaagtgcatagaaatgcctaaacgtgtcacattccctatattatattttggaacgtgattttgtggaagatgggtttgaatcaatatttataaaaaattaaaataatcttaacatgccactttaatacaagttaaattttcaatttattaacaattattttgtagactcgtgatatatcattatttaatttaataacaatcgtaaactattttttttttgtcgttaacaatcgtaaactataatagatacaattttaaaacttttatatatggtaactttaaaatataaattattccgcggtaaaatctagttttcaataattatttgccgactatcaatcattgtggtttgtggtctggttcaaccgccggtttgcttcgaatttacaaaaactattttcaatttgattttttgatatatatatattttttttttccattcccatcatctaacagagaaaacaacacgaactttcctgagacggaaaacaaaaaaacagaacacgaattttcaaagttttccacacgatgtcttccataagatcgttaccacgtccctaactcttctccttcagacaaaagtactttagttattcttctttcttttgccatacttctctgaaaacagaataaatcttttgtattcggtcaaactgattcaaatactgtacagtcaagtcaaagctacaagatcgtgttccaggttttggtcttctcttccttaactctcctgggttttctctaaattggtctcttctacaaaagttcgaatcaaaaaattttctgttttgatttcgcttaattgatttctcgttttctttcttttcttggaaaccttttaattccgaaattgagagttttttttagggtttaggaaatctcttactggatctttgctatagtattgaaatggaaccctaatgttggaagctttctaaagctgagtttttgtttctacaggtttagagaaaatcttctgaactcaaaagattctcataactgagtttataaatggataattgaagttgtgtattttgttgataaaaccaaaacc

SEQ ID NO: 10463 - DNA, 3000 bp, Unknown
  misc_feature (1)..( 3000): cDNA_ID_3036603_gDNA_ID_2213651_Annot_ID_132465 3000 nt of promoter + ATG
ctgctctgctatgtttcatcaacgagagttgagattaggaagtggtagagttatggggatctctgtcacgagagtggattgacccggtttttgaatctatcgtcatgggtatctacctttcgcctattagccatttgatgaaccctagagttgcccttatcaatgaatccatcattagaacttctataagattgatttgtatcccctattgattacacttttatttacctgttatttgtatcctccatttacatcccctgttgattgcattttagttcttaattttgtcacatgttggttctactcgacccaatgatcgagtagggctgttaagttcttatttttacttgtttgaatcctgacctaggagtgttactagaaacccaccatctttataatctggcttgacttagttgtttttgtacacatcttgattgctagcaatacaatggactggattgacaccctctatgactgcatcgacatgtttgtgttttagaggaattgaactgaactcaaacagcattcagcatataagtaggcgtaaaaatctgcttatcagaagtacacaacaatttgcagcaacaaaatatctctactcgccactctcgttattctaaacctttcagatatctacaagttccataatattaagattatcaaaatctatgattaaacatcgctatggcaggtcgataccaaacaggcagagattcctaatcgacttctatgtcatctttcccatcccagtggcggttaagtcgctgcataaacattgttcccaagccgtggttaaggcagaggctattcaattgaaaaatatcgtttcaagagatttttgggatgggagagagagcgttgaacaggaatatcaaccaattcaaggatcatacctgactcggagattccgaatcgacttttcaaaataattccttggtcagaagaattaactgccatcaacatcgatattgtgagataatttcagtcggcgaaggtagctccctttctcatctgtaaatatcaactgtcgttttattagaaaccaaatcaaaacaaaactatgctaactggttaagcaattgatggtttagattgaaaaggatataattgtctatttattctccacgaaacaagaaaaagtgtctcatccctcagaagtgcctcaaaaggaataaaagtgcatagaaatgcctaaacgtgtcacattccctatattatattttggaacgtgattttgtggaagatgggtttgaatcaatatttataaaaaattaaaataatcttaacatgccactttaatacaagttaaattttcaatttattaacaattattttgtagactcgtgatatatcattatttaatttaataacaatcgtaaactattttttttttgtcgttaacaatcgtaaactataatagatacaattttaaaacttttatatatggtaactttaaaatataaattattccgcggtaaaatctagttttcaataattatttgccgactatcaatcattgtggtttgtggtctggttcaaccgccggtttgcttcgaatttacaaaaactattttcaatttgattttttgatatatatatattttttttttccattcccatcatctaacagagaaaacaacacgaactttcctgagacggaaaacaaaaaaacagaacacgaattttcaaagttttccacacgatgtcttccataagatcgttaccacgtccctaactcttctccttcagacaaaagtactttagttattcttctttcttttgccatacttctctgaaaacagaataaatcttttgtattcggtcaaactgattcaaatactgtacagtcaagtcaaagctacaagatcgtgttccaggttttggtcttctcttccttaactctcctgggttttctctaaattggtctcttctacaaaagttcgaatcaaaaaattttctgttttgatttcgcttaattgatttctcgttttctttcttttcttggaaaccttttaattccgaaattgagagttttttttagggtttaggaaatctcttactggatctttgctatagtattgaaatggaaccctaatgttggaagctttctaaagctgagtttttgtttctacaggtttagagaaaatcttctgaactcaaaagattctcataactgagtttataaatggataattgaagttgtgtattttgttgataaaaccaaaaccatgggtggagatgatttgagcttcacaagattggtgattactgctttgtttggtctgttaatgttgttacaaatcaaggaaacttctgcatcaacatcctttgtaagctcgagtgtttgtaagtctgatcacttgacctacacaaagccttatcaacaagggagtttgttcacaattaacggtaatccggtggagaaactccggttttgcgaagctttacggtttcacaaagccaatggttgtatctttgaggattcttttagtgatgacttctgcacaattcactctctactaggtttgctctatttaaagatttttttgtgctcctttgattatatatagtaaccgaatttggttaattgtgacattgtttaatgtagggagaaggtttttggaagaaaaaactgtaaaagattccaaaaatagtaagcctaaaactgaatatagccatgttaaagttagcatagcaggaagtgggtttcttctcttgtgttgcgctctttgttgtccttgctttcataaagagaggaaagcaaatagtcatgaagttctacctaaagaatctaactcaggtcacttagtgtctctcacatttatctttcttttgtagctatgaaataataacatttgacattgaagcttatatatttctatcacagtgcaccaagtttcttcttttgaaatgagcccttcttctgagaagattccacaaagtccattccgagcaccaccaagtccatcccgcgtaccgcagagtccatctagatatgct

SEQ ID NO: 10464 - DNA, 3000 bp, Unknown
  misc_feature (1)..( 3000): cDNA_ID_2703600_gDNA_ID_2213652_Annot_ID_132473 3000 nt of promoter + ATG
gtggttttcttgagtgtgtatgtatgtatatatatacatatatcaataacatatatatatatatatatatatatatatattccatcttttgtatgaaacttatctaatgaattttccataactgaaaagtttacaataatttggtcaacacgttttattatttattatatctttctgtttttaaaacaacaaaagatggaaagtatctcatacatttaaatgattatttttattcaaacctaaaaaaatatattcaaaatatcaataaataatacaagaagttttttaaattatccaattaaagtcaaaattgtattttgcttgctaaattagtataaagtcttttaggaaggaattcaaaaagaaatgcaagtttgaccatttgactcaaagtgcctgcttaaggttcaaaggcccaaattttttttatacatgttaaggctttttttttaatacctattagagatttttgatataatagcattgggtctaggcaatgtttgggtcggacctgactcaaaccaaacaatatcatactgatatgaaagttggtttgggcttggaaaacctaacatttcttttattttcttacaaacaaaattgtacaaaggacccaaaaaaaagacaatgccatatctaggcctaatactccgagcgagtgaccgagcgagagtcatatagttgtatcgaaacgacgaaaaataaaaaccgtacatagatttttttcctttttattcaatgtatcttaaactaccaaataactcaaaataacttcaatcactcaaaataagattgaatgcaacatctttaattttggtatatagactcattgtgtagtctttctcattgagcttacgattgaacgtcaaatgttaatgttttagttgtacaattaatgtctattgtcgtaaaattaatgtttaattgtcttagctttataattttgttgaatggacataattaaaaccaaaatcaaaccacatgttctataatgaatacaacgcatgacatgacaaacttaggatgctatagtcccacatacacacaacatgaccgcatacggctattggccagtcatgagtctctaaagttgtttattaatcactcatgttaagcactattaaaagaaaactttaaacccaattcagtgtcattcttcttaggctttacacttcttgttttaaaggggagagttatagactcatatcttccaaacctgtaatccgacctgcacatatatagatagctcaaattacatatttgatattagttctggtattcataaatgcataaaacatagatataaatataaaaaatgttgacaaatacacaagaataggagtagcagagaagacacaattttgaaacgaaaaattcatatgaataccgaagattatcaacaagcacaacacaaatatcaacatggcagattggacaagttttgagtttctttgttattaacttgtatcaacaagcacaacacaaagatcaacattgcagattggacaagttttgagtttctttgttattaacttgttatgtatgcagttgctgcatattgttttcagaaatatttcaatcaatatatattttcagctataaaatcaatgatagtcctaaaaatcatgaaggtacaagatatgacaacgtttttcttaagccaaattaaatgtccaaagaaacattaagattgatagattccttaacaaaaagttcagaatttttcaaaactcaacaattctaatacaacaaaacgaatgattgtattaggcttgaaaaagcttttaagtgttgaaaagttttgaactcttagggaagaaacatgttaaaactcttaatgtttagacatttagcttaagcaaaacattgccatatattgtgccttcatgaatttaagactatttctaattctataattgaaatttataacaggattgcttgttatattacagtatctattggagagagatattatttatatgtgactgaagaatcacatccatacaaaatgtattatgtcttcttcctgcaaaaacaaaccatgtgactgagaattcctctgcagcttgtctttctgctaacacatcaagcagccacgtgagtcgtgaggttatctgcttctacagcaatctgtttggtatcagtctcaggtttctctccctcagaagcttgtttaaacagagacagaaccgaatccaagcaggtttggcaagaggaatagattgtatcattgaagttatcagctacattggctccattctgttccctaagaagcttcaggacaatagatttcatctcacgtcgacttttctcctctttgcttcttaaaacaagctcaatgatgcgtgatagcgtctcctttggtggatccacagcattagacgcaactcgtttaagaacaggcgtgacaccaactccttaaatcaatttaagttttattaaattttagatgatgtgttataattttttttaactcttacttaaaatcatgcgatttgaatctttttatttttcacttagtaaataatctaaaatctctttatcatgaaaattcaattgttattgtaaagtgttccaactcaaatcactaaattgttcaaacaattcagtactacattcataaaaatgtaatctcatgtcactataatgtgatttataactatttatggatgtctacttaactgttgaaaaacttcataaataaaggtaatatagttatagtgtcactaactaatgctatttttttttttttttttgaaatttgtagaatatatactaaaattgtccacaaacttatttattttttgtcgggtccacaaacttatttaatattaattttctaaattacaacaaaactaatgaataaaaaataccaaagaaacagaaaaaattgcaagctccactaagaattgaccgtctcaaacaaaactcgagggattttttttttatatggcgaattcactcattctgggctcaccgattaatccagaaggagaaatg

SEQ ID NO: 10465 - DNA, 3000 bp, Unknown
  misc_feature (1)..( 3000): cDNA_ID_2715718_gDNA_ID_2213652_Annot_ID_181630 3000 nt of promoter + ATG
tgacatcacaacaactaaatccaaccataaccagcatgagtagcttgcttcatagaggagaaacagtgggttatcagagaacatccttcatccttggaaagcttaacgaaacaggtttcccacaatctagccttgtgccctttgataccgcagaagaatgcgatgagcttctgaaaaaaggaccaaaaaatggtggtgtggctgcagctttcttgggaacaccttacgtgagactctttcttggacaatattgcaacacttataaaatggttgaagaacccttcaatgttgatggattcggctttgtgtttccaatcggatcacctctggtggccgatgtttcaagggccatcttaaaagtagcagagtctccaaaggcagtggagctcgagcacgcttggttcaagaagaaagaacaaagttgtcctgatccagttaccaatccagattcaaatccaactgttaccgctatacagctcggcgtaggcagtttctggtttttgtttcttgttgtgtttgttgtctgcgttctagcactcggaaaattcacattctgtttcctatggaagacaaaagggaaagatttgtggaaagagtttctaaaacgagacaccgactcgtacatcaacgacatagagaaatgcttgtgttctcaagagatgcctgaaaacagcaataaagcaacaaaccagacaaactacggtatggagttaagagttaggaatatcgtgcaagtaaaccaaacagacccagactgtctttaatttaaaaaaacatagaagggcgtctgtttttattaaaccaaactattgtactttattgtgtaaataacgattttcagaaataggtgatccatataatgtataagagactatcaagttactatagtggttgattttcgttacgtgttatgcaagacagtaaacctaaggctatgggttcttacatgtggggaaaatggtattttcatacttgtactatatgctgagtatatttttcaacctgaactataaaaaaatttgaattacatatccaaacttagtatttggtgttaatttcagaatcataattaatgggttgtatttggtgtttgttgaacgaagaagcgcctgttgaagatgttgtaaacccacccgctgatgatattcatcaagacccaagggaacaactataatgtttgaatgtctcaagactctttaatttaactaacaaagaggcgtgtgtttttatcaaacaaaactactgtagtgttttctttttcatttgttcgaaaactaatgttgtttatttagttatttttaaaatcaatttttcgtaaacgatgaaagcaacaattttcatgtaaggactatccacattcttatatatcaggaggttgattatgttacttgttcccccaagacagtaaacctagggctaggatttctcgcattttctaaagatttatagtaagcatattgacttatcttcgatatagagtacaaaaaatattaacctaaacaaaaaatgtggtgcgtttttatacaccaacaaaagttttaaataatttccataaatttccaggctttagccggaatcaacattgatcacaataatgttactcaacaactgttagtttatgttgagtaagatgacatgtgtggaatttcaattgagtcggatgccatatgtctcgtttgtgctgagttggatgtcacctatcacaataaaaagaattgagagaaaattatttgtcttagttcaaatgcttttctgcaaaaacgaattgttatcttttacaactttaacctcaagtttcagaaaatacatacaattaattttgcaaaagtcgaaactaagacacaatataactattatcttcgaactgttttttcaatcacatataaatatacaatagattaataacattcttttttctttcaacaaacactatttatattaacttatcgggaagaaattctccgctagaaagagtcattcaggaactgatgtgcatacatgggagaaaatattatttcgagcccgagtttttttagctaaacaatctgctcgagtattaaaagtacgaggaagatatctataattaataacattctaagagttgatttgaactctgagggcgagggttttgaaatggtcattgatattctccttagtccttgcgtattgaggaagaggcattgaaaatcaaatcagcacgaaaagcgtggtccagactatgatatcagatagtgactacattgagtttgataactgcacaaagtggctcggtgtcgaactgtaaaagctgttgacatgttctttgttttacttttcttttcctctgtttctgagatcaatcaaagtcacaagattttttacttcgtttttgttacttaatcagtcaacgttttattacactcctgattgtgttttaccatgattattttcatgttaaatttattaattgcccagtctttggattacttctaagtcctaacataactctccgactgaataataatttattgctcgactttcatagaaatgaaaatgtcataactttagatacacaatacaagtaaactatagttgcaataagaaaattacaagtaaattgtagaaagataataaagtttatttttctgttactttcaatcaagctgtactgtattttatgtttatttttttgtgtcaagtgtatacaaaacattattttcttgcaatatataatgctaagtcctttcctacaaaacacgaaaccttctttatttttgattaaactacatgcacacgatggcacaaaaccatctaaatacagaaatatctgtattaaacattgccgcgaactttgaaatcgtatttgcttcttatcttcacaatgtttcattgcttattaggatgagatattaaaaaattcagcaactatctaaaattttgctatatatgtgtgcattatttaaaccaataagcatcatctatcacttatcacctaaaagaagaaagaaaaatctccaaatg

SEQ ID NO: 10466 - DNA, 3000 bp, Unknown
  misc_feature (1)..( 3000): cDNA_ID_3036654_gDNA_ID_2213652_Annot_ID_181632 3000 nt of promoter + ATG
tacctcctcatgcaccgccacaaaccctttggctattagataacttcaacattgaggactcttatgaccgagatgccggtcctagtactagtccaatagaccgagaagcatctcatgaagtcaatgaagacgcccacgcaacatcagcacctcctcatgtaatggtctcaccactacaaaacagaagaccatttgatcaattcaacaaccaaccttatgatgcgagtgctggtcctagtactggtccaggaaagcgaggacgtggccgaccaaagggttcgaaaaatgggtcgagaaagccaaaaaagccaaaagcatatgacaacaactctactgatgcgagtgctggtcctagttctggtctaggaaaacgaagatgtggccgaccaaagggtttaaaaaacaggtcgagaaagccaaagaagccaaaagcagatgatcctaatagcaaaatggttatctcttgtccggattttgattcaaggataaccgaagcagagagagaaagcggaaaccaggagatagttgattcgattttgatgcggtttgacgcggttagacggcggttatgccaactaaactaccggaaagacaagatccttacagcgtcaactaattgcatgaatttgggggtccggacaaacatgacgaggagaattggacccattcccggagtacaagtaggtgatatattctattactggtgtgaaatgtgtttagtcgggcttcacagaaacacggctggaggcattgatagtctattggctaaagagagtggagtggatggtcctgctgctacgagtgtggtaacatcaggaaagtacgacaatgaaaccgaggatcttgaaacgttgatctatagcggacatggtggtaaaccatgtgatcaagttttacaaagaggaaaccgtgcactagaagcaagtgtaagaagaaggaatgaagtaagagtcataagaggggagctctataataatgagaaggtatatatctatgatggactttatctggtctctgattgctggcaagtgacaggaaaatccggtttcaaggagtataggttcaaactgctgaggaaaccaggccaacctcctggttatgcaatctggaaattagttgaaaatttgaggaatcatgaattgattgatccaagacaaggttttatacttggagatctttcttttggagaagagggtttacgagttccgctcgttaatgaagtcgatgaagaagacaaaacgattcctgacgattttgactacattagatctcagtgttactcaggtatgacgaatgatgttaatgttgatagtcaatcacttgttcagtcatacattcatcaaaactgcacatgcattctaaaaaactgtggtcagttaccataccatgacaacattttggtttgtcgtaaaccattgatttacgagtgtggtggatcttgtccaacccgaatggttgaaaccggtttgaagctccacttggaagtgtttaagacatcaaactgtggttggggtttacgttcttgggatccaatccgagctggaacttttatctgcgagtttactggtgtgagcaagacgaaagaagaagtagaagaagatgacgactacttgttcgatacatctcggatttatcatagcttcagatggaactatgaaccggagcttttgtgtgaagatgcttgcgaacaagtctctgaagatgctaatcttccaacgcaagtcttgataagcgccaaggagaaaggaaatgttggtcggttcatgaaccacaactgttggcctaatgttttctggcagcctatagagtatgatgataacaacggtcacatatatgttcgcattggactttttgcgatgaagcacattcctccaatgacagagttaacatatgactatggaatttcttgtgtggagaagactggagaagacgaagtaatttataaaggaaagaagatttgtctctgtggttcagtcaaatgtcgtggctcttttggctgatttggacttttttataatttgtgttttcgtttgtttgcttttttagcttctttgtttcttttgtttagttgacaaaaaaaaaaaaaaaaaaaaaatgtttcttttgtttttgttggactttatatcatttgtgtttttattttattttagcttccgtggtgtttgtttttgtttttgttgttgtatttttgtttcttaaaacattaataaagttgtagaactttgaatcatacttttcagttgggcttacattatattataagacctaaatcatagctaaattaaaccgatagattcggtagagaggaacaattcactctatctaccaaataacaacactacatagatcaaagttccagaagctttaagtgatactcatctattatgtaattgagtaaattaaacaatcaccttcaatgaagcaaatgagaatacagtaaatagtataaaaaaaagagagaaatatttaagctttagtaaacagtaaacaaacatgaacagagaaaattaactattaagaacaagatttgccaacagatatttgattgaaagaactgaaatcaattccaaaattcgaaaagcaaatatattatttcaatttcgtaccaaaaagggaaagaagattacaagtttagaaccctaaaagtgacagagacacaaaaggttttctagctcgaagtgagggagagcttctggcttgaaatggagggtttcatgtgcttaaggttttaaaatcaacggtatcgttgtagttaaccaagttggatagaaattgtcaaagaagaaagaatttgtgtcttctttcatttaacaatatgtgccaataaagtattgataatgaagcacaatccccaacaaaaaggttacagtagacttgcactacactagccatatcaaaaatggttctacttgtattatgctgaaaaataatacctgaagctgacttcatctcgtgtgtggctcaactttggctccaaggcattaataagagataaacatg

SEQ ID NO: 10467 - DNA, 3000 bp, Unknown; identical to SEQ ID NO: 10465
  misc_feature (1)..( 3000): cDNA_ID_2715718_gDNA_ID_2213652_Annot_ID_132475 3000 nt of promoter + ATG

SEQ ID NO: 10468 - DNA, 3000 bp, Unknown
  misc_feature (1)..( 3000): cDNA_ID_2715777_gDNA_ID_2213653_Annot_ID_132478 3000 nt of promoter + ATG
ttagagtgatttggatgattcaagacttctcggtactgcaaagttcttccgcctgattaattatccattttacctttgtcgtagatattaggtaatctgtaagtcaactcatatacaactcataatttaaaataaaattatgatcgacacacgtttacacataaaatctgtaaatcaactcatatacccgttattcccacaatcatatgctttctaaaagcaaaagtatatgtcaacaattggttataaattattagaagttttccacttatgacttaagaacttgtgaagcagaaagtggcaacaccccccacctcccccccccccccccaccccccaaattgagaagtcaattttatataatttaatcaaataaataagtttatggttaagagttttttactctctttatttttctttttctttttgagacatactgaaaaaagttgtaattattaatgatagttctgtgattcctccatgaatcacatctgcttgatttttctttcataaatttataagtaatacattcttataaaatggtcagagaaacaccaaagatcccgagatttcttctcacttactttttttctatctatctagattatataaatgagatgttgaattagaggaacctttgattcaatgatcatagaaaaattaggtaaagagtcagtgtcgttatgttatggaagatgtgaatgaagtttgacttctcattgtatatgagtaaaatcttttcttacaagggaagtccccaattggtcaacatgtgaaagcacgtgtcatgttcttacttttgtttgggtaatcttctaattactgtatatggaagatgtgaatgaagttttggtcctgaatgtggccaaggttccgtcatttggagatacgaaatcaaatctcctttaagattttgtttttataatgtgttcttccatccacatctatctccatatgatatggaccatatcatacatcatcatttgtccaaatgcatgaatgaatttggaaataggtacgagaatgccaacaatgacaagaagggatcaaagacagtttttaaaacaatattttacagggttttaatctaattctaagttttggtcactcactttgttaaaagaataattcagtgtctggacactaaaatcttccaaaaaccccatatacatatatgctatttcgatacttatatttatttactcagcataaaaaatattaaccatgtattcatagtaaaatgtttcatgtgatatcaaaccagcgacaacaaaagtattattcccctcattatgtttgactcctattatatttttattttaatttttttcactatcatctttcttgcaatgaaagtcccatatattggtcaacatttcaaaccacttgttctcttttatgttttggtaagagctatcttctaaatttataatacgcataaattcaaaagtaaaagaaaattttggtcatgaatgttgtttaagtcatttggagatacgaaatcaaatctccttgtagattttgtttttagaatgtcgttcctttttcatcatcttagctatatctacagctatatatcctatctttaaacctatattattttttcctctcttcaccaaagccatgttttttagttgtggcgaaaaataagaaatccatacatcaacatatcgctttcgttaccttaaattttggcttgttatgaaggcatgtcataacgtttctagtcacaactcacaagcataccaacgaccatgataaatccaaaaagtagaaacaatctattatctaaacccccaaaagacaaaagaaaaaagtagaaagaaaaggtaggcagagatataatgctggttttatttgtttgttaaaagatattgctatttctgccaatattaaaacttcacttaggaagacttgaacctaccacacgttagtgactaatgagagccactagataattgcatgcatcccacactagtactaattttctagggatattagagttttctaatcacctacttcctactatgtgtatgttatctactggcgtggatgcttttaaagatgttacgttattattttgttcggtttggaaaacggctcaatcgttatgagttcgtaagacacatacattgttccatgataaaatgcaaccccacgaaccatttgcgacaagcaaaacaacatggtcaaaattaaaagctaacaattagccagcgattcaaaaagtcaaccttctagatggatttaacaacatatcgataggattcaagattaaaaataagcacactcttattaatgttaaaaaacgaatgagatgaaaatatttggcgtgttcacacacataatctagaagacagattcgagttgctctcctttgttttgctttgggagggacccattattaccgcccagcagcttcccagccttcctttataaggcttaatttatatttatttaaattttatatgttcttctattataatactaaaaggggaatacaaatttctacagaggatgatattcaatccacggttcacccaaaccgattttataaaatttattattaaatcttttttaattgttaaattggtttaaatctgaactctgtttacttacattgattaaaattctaaaccatcataagtaaaaaataatatgattaagactaataaatcttaatagttaatactactcggtttactacatgaaatttcataccatcaattgttttaataatctttaaaattgttaggaccggtaaaaccataccaattaaaccggagatccatattaatttaattaagaaaataaaaataaaaggaataaattgtcttatttaaacgctgacttcactgtcttcctccctccaaattattagatataccaaaccagagaaaacaaatacataatcggagaaatacagattacagagagcgagagagatcgacggcgaagctctttacccggaaaccattgaaatcggacggtttagtgaaa

SEQ ID NO: 10469 - DNA, 3000 bp, Unknown
  misc_feature (1)..( 3000): cDNA_ID_2715765_gDNA_ID_2213653_Annot_ID_132481 3000 nt of promoter + ATG
tatatatatatattttttaagtatagaaaatagaaatatgacgtgctaaattgagctatggacaaaatcatatatgagaaaatgaatgtagatggatagagtcgtcccacacttaaggttggtccacaatgaataccgttggaggcttcgcaggcttttgttctgtccttgtctctctctcccctaaaaaaaatttgttacgaaaaattcatttgaattaattttggtcggtatgtgtataatattatacaattataatatatttctaggtttagacatttttttattttatttttcatgaagtaaagaacacaaacaaaaacccataaaataatgtaagatagataaaacaagaggatgtcgtcataaataaattggaatttggcatttaatgaaaaagggtgaaaggtgcttgacatacacgcgccgtagtttcttacccggaaagggattggtattgatgttaactagaccgggcccggtttaggctggggcggcggccgaaccgaccacctggctactattcttgtttgtattcgctgattctgcaaatctaaactcggatcttttatggacttggattttcgggtgggtggggttctgctaaagagacggcgctcttgtcattttaagtcggtcactgcaaaacgtgaaccctgtgactgtatttagagtctcgttacgttggatctctctccatgaaccgtccaaagtaggtcaatttttgtgggttcactcacgtatacaacgaagtacggcgctatttaattttccgaaaattttgaaagagacttttataccagaaaagtttgtaatccaaatttttaatatattgcagatttggttcgttttgggcttaaagagcttttattggtgtggtggctcaaatcgtttttgtaggcgtcaggtcaggcccattttcaatgtcgcttgctcatttgatacgctaatatagggctttgcttaagatttgaatgggccgtacccccattttgcttcatgagaatgggatggtaataaagaaaaaaatgacaggaaacaatgaattggtcacgaaaaaatgttgtattactttttccaaaatgcacctttgagaatcttaagattcaatcatacagtgaggtccatgtccacaataagaaatcaaataccaaacaaagtataaacgtgaattgtaagctaggcagtgtatgaagatgcatttgtcttaaagttacgaatctgataaataatattattcgatcgactttagatcgctttccatgcagatttatgcaattatctggaagaagaacaaaacaatatcttagtttcttcggcctcactattcgacttctatcttcaatatattttcgcgtatttttttatttgaattatttggtttttggttagttaactaaacgagcaacagaaccaagatcgaattgcgtttgccgtttggattcaattattgtagaaaattcgacttttcagacatttgttacgttctttctagtagttatattagttattatatgtggagtggaaagagatgaaagtagatgtaaaacataagtgatttcttcatagtgattttaaaactttttgttgattttcaaaattatataatatccataaaaaatagcctatgcgtgttggatgcttacaaagaagaatttgttttcggcgttagccaaaagtcgatggcatttgctaaaggtgttatttgagtggaaatgatctagaacaaaaacgcattgatataccaccactataatgatttggagacgtatctagttctcatcaacttttcaatagtaaacgcattatcaaggtaaacgaagagttttgctttatcagtgtaccatacacacattaatagattgatggacgttagtgactttggtattgactttaacgccaaatggacatcaattctgcaaggcaatgcctagtttcaaagcagcgttacttaacatttaactaaaggtagtgcaaactggttaatactttttaacggctttgcaggaagagtctcgactaaaaggagaggaagagatgagatcgacgaagattttcatatcataaaaagtaatataggtttttgaaaatagttagaataattatttttatttttatttttatgggaaagaagttgcacgagtcggtccacagaatgacagaacaaaagcattttagaagtttagaaccaaccaatcactatagttttccacttgtccgtatctcattggttcatcgaatattaacttacatggaaacagtaaaaagcgtggaataagtcgtaaaactgaaatctaaaaatgaaaagatttcgatttcgatataaatacttaatctttataaaataatatcgaaatcttttcatttttagttttcagttttacacttttacttgataaatttaatacatctgttaattttttttcttctaaaattaacatatgatatctattcgggagataaccctaagaaaactgataaaataaataagttactttttacaaagtcgaataaattatttacccttctgctttaatggcaattatcttaatattgcaaaaaaaaaaagagagaaatattactacaaaacagaagcaagcaagtggaaaacagaccagaagagagaggaagacgaagagagaaacagaacagagtagggatcgatagaccgtggaatctcagaatcacaaacactttgcaaaagggttttcaattcctatttatttacaaagaaatcatcaatagtagtggtctctagggttttgcttgctcttcttcgtgacccctttttacctgcaaacaacaacttcaaaattggcgtgtttcgtacggtctatctaaccctaatctgtcacaaaacactcttcttctctcacccctttttctgggtttattcaattctcgtgcttttggttctgttttcttctctggggatttggttttcttgagtgagtttttctcctctttcttatgttcttgatttgattattatatagaatt

SEQ ID NO: 10470 - DNA, 3000 bp, Unknown
  misc_feature (1)..( 3000): cDNA_ID_2715762_gDNA_ID_2213653_Annot_ID_132482 3000 nt of promoter + ATG
atgttttattttctggttagaaaacatcaactggaaaagaaaatcaagatgagaattgctcgggtgtttctactgtgaacaagtatcccttaccaacgaaagtaagtctaagaaagctacaaaattgtagtcgaagaatctgatgaatgctttcaagtgcatgacaaattatttgttccattctgatttttagcaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaacttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcctgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagaggtaaaacaaaaaccaatgattcatggatattgcagagttcttctgggaactaacactatcaaaatattttcagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtctttattcttctttttaaaaattgtggatattgattgatgagatcataaatagtttataatgataaaagatgaactgtacaaaagttacaacttagaaagttttgtcttttggtgtttcttcataatgattctctctgtttgtttcaaacttgaaggcgctcgttgcccaacgccaaatgcccaaaggtgctaggctgggccttaaagattttactcacactacttgggcctacattacaacattttccctattacaagcttaagtaatagaggcctaaagaaggcttatattgtgtagctagtttatacaatatttcaatctcttaatttggtttactgatgaatgagtagatatacaatttttttgttctcactgaatgagccatatccttgctaccaaaccaaattatttgtgaaaaatgtaatgcaagtatcctacatagattataggagtgaccgcaaaaacacaaactatgtttcgtaataaaaaataaagtatttttaaaaagatgtaaatctttgtaaataattgagtggtagtgtagtgagtgttacgataatataaaagtttgatccgtatatctcggtggtgactcatatatacattttacaatcacttgctagaccaacgggcttcacttgtttctctcccaaagtttcttcatcatccttgcgataaagaaaacaacaatcggctgtttcgtttcgatccaaaggtacgtttttttttcttttgtcatcgttctaagatcatcaaagtttgatgcttttccatgtttaatcttctgggtattttgttgcttcaaatctcaatcatccatcgagtctatagagaaaaagtgaacagatttggtatacatcttttcagtaatcgatacgttaacaatatatgaatccataatttgggtatgatcgatctcaagtctgctttaaggattgttttcccttgtggggtcttgattcgctttttccatttaatactcttgattcgattgattctctctctgccaattagggttatgatgttagattcagtcaatatcaatgagtgatgaaacgttctgattttgacagatg

SEQ ID NO: 10471 - DNA, 3000 bp, Unknown; identical to SEQ ID NO: 10468
  misc_feature (1)..( 3000): cDNA_ID_2715777_gDNA_ID_2213653_Annot_ID_181641 3000 nt of promoter + ATG

SEQ ID NO: 10472 - DNA, 3000 bp, Unknown
  misc_feature (1)..( 3000): cDNA_ID_2994649_gDNA_ID_2213653_Annot_ID_132483 3000 nt of promoter + ATG
caaattaccttaagtatacgtaactgcatccactgagccctctttctaaagcttttcctgaaaaaatgtcttttcttagctatacgtcgcatttttataaactttgatggaatgatgcggaaaattattaaaaagcgactctattttgtaacgccaggaaagaaaaaaaacaaatactttctactatgattcatattctcaataacttgtttcaaaataatcattaaaattttactttttttaggactgaaaatgtgaagattctaaagaccaaagcaggaatgttgaaggtgattggaactttgatctgtataagtggagctttgttcttaacattttacaaaggcccacaaatatcaaactctcactctcactctcacggtggggcttcccacaacaacaacgatcaagacaaggccaataattggcttcttggatgtctttatttaaccataggaacagtgttgctatctctatggatgttgtttcaagggactttaagtattaagtacccttgcaaatactcgagcacttgtcttatgtcaattttcgcggcatttcaatgtgctctcttgagcctttacaagagcagagacgttaatgattggatcatagatgatagattcgttatcaccgtcatcatatacgctgtaagttacaaacatcatatctttataaattaactttttaaaaattataagattagtatgtaagaacttaagatattaatgtgggtttttttatgtggtttttttttatcatatattatagggagtggtaggacaagcaatgacgacggttgcaacaacatgggggattaaaaaattaggagctgtgttcgcatcggcgtttttcccacttactctcatttcggctactctatttgatttcctcattttacacactcctttataccttggaaggtatcttcttcgataatctctatcaaattaattttgtctaggcataacactaattacaacattaaaacttttggtctacagtgtgattggatcactagtgaccataacgggtctctacatgttcttgtgggggaagaacaaagaaacggaatcatcaactgcattgtcttcaggaatggataacgaagctcaatatactactcctaataaggataacgactctaagtcgcccgtttaatttaattatattgttgttaatgtatgtttcaaataactgttatgtcctagttaatgtttaaggagaggtaatgagagataaaattttataattccaaacatcaacgtagagatttgtgaaatatttaaatccggtttgtttggttattttggaataatttcggttatttcaattagattcgggtagttcagttcttcggttagtaacaaaaactggtctattgttttttggttaacctagaaccgaaccgaactaaccaaagttctcggtaaccttttgtagtggcttcctgaccgatgaggccgtcaacttcaaaaaatattgcaactaagctctgctccaacattagagtatctataactatgttaaacgcttctgctttaagcaaaacacagttgtaagctggaatctaaaaaaatgagtgtaatgatgtttgctgaattccataaataaatactacatgcttcggttaagacttaagagtaattaatgttccttaatttctacaaatgttatataagcaagttgaccaaagttctcgatgataatttgttgaaattttgtataggcattgcatgatattatatgaaaagatgaagatttttatacagacgcaagttccccgagcagtccaagcttgtcgggtttaattcaactatgttaatacgcaaatttatatagaataggcgtaaaagtgaggcccatacaatgtcttattacaagcccagatccagcatagccaatacgtagcagtacaccatcacagctggcaccgtacccacttgtttagtcgtccaagtttgtaccaataatcgtttacacgtaagcaattgtggaccaccacactcacttttacctacgtgagcttcacattgaagcttctggctcgtagagaagcaacttgagatataccaaaaagtgcagtagacagccactacaatatcaccacgtgtcgatctgcgatgacttctgttttttccatttatacccttggtgctgttccagcctcaaataaacttttcaattaaaatttttccaaaaattaggggaaaaattgttgtggctgagattgcttctggcttctcttcttcttcttccagtcttcttcagcctaaaacagtcttccttcttcttcttcttcttcttcttcttcttcttcttcagttatcttcttccttcttctctctgttttttaaatttatttttagagatttttttttgttttgcttccgatttgattatttccgggaacgatgacttctccggggagttcccggtgagatgataagtcagattgcatacttgtctcctccatggctactctcaagggtataacagtttacattatgagcagtttctaggattcctataacatactaagatctctgtttggctgctgagaaacttatagaagcgattaactaaatcttattagctctaaaagttagcataaatgatacgaatctggtgattgattactgatatgaagatttgtgaaggttttggctgcggtggattcgtttgggtgaggcttttgtgaataataataaagggaattcttttgagttctgctggagaagcagcgactgtttcacggtggactttgaaaagatttctcttttgaatttcgctcatcactcttatcttagtgtttgtggataaatatttctcataaagtactttctcctttgcagtttctctagaatctaaagaggttatcacaacggctttgcaatttgaaaactttcatgtttggggagatcaaagatggtttcttttttatactttacttgttagagaggatttgaagcagcgaatagctgcaccggtcctgttatg

SEQ ID NO: 10473 - DNA, 3000 bp, Unknown
  misc_feature (1)..( 3000): cDNA_ID_2715754_gDNA_ID_2213653_Annot_ID_132484 3000 nt of promoter + ATG
aatttaccttttctccctaaatcctttttcctctagtaaattagaataaactaaacagtaattatctctttccctacatctatgttgaaaataagaagagaaagtttcgatgttgcgcggagttttgcaggaaacacatgcatgtctcttcttattgatccaaaatttaaattaaaaacagaaagcaaaattagaactataatggagatcaagatttaccaagttactcaacctttattcaggctggaagtatatataacccacaaaattcttaagaaagtttttgaattttgtttaacctaaaattaataacttacttggtggatgaagaatcaatcatatgctaagaatttccgcgagagatgtaaacctttttttaattatgtgaagttttatgctgtgatatagaatccgtgagtaatgttgtactatagtttagtgttttgaacttttgatccatccatttatttaagattaaaatataaaaaagaaaatcaaagaattttagtggtaattattatcataatctgttagtattcaataaattttgtaatttcagtcctcacatcaaatataatagtatacacatttctttgcgatattagtggccacaaaattcccaattatgctcgaagatagaagttataaattagaaaacttagtgaggtacatgtcgacccacactatatattcttaacttttttaaaaacgttattcttgtctcgttactttcaattgcttttctgctccctccaactatttttagtgggtttgttcgatattatgttcaaaaattctcttcttttccttaaaaacatgtcgtgaaaaaaaaacacaaacatttagtttccgactgagttttcatttgccaaagttgtatagctagcgcttgtttagtgcttggtgttaagaaaagcaacatgaggtaaatggaggatgatttctgtgccttaacacctaaaccatttaatcgtttagacaacattaggttgtttaaaaaaaaaaactattaagttgttcatgcatgtataagataaaattattatatattgatgcatttaatgagttaaataatttataaacaatgtaataaattacattttataagttgtaagaaagatcaatagttgtagctagttggtaagaaaaaatattctgttaatttaacaagtacaaatttgctcgatttatagttttgtaatatcaggaaaacaaaatttcaacttcaagttctatattttcagtgttctaaatccaaactatatttgaaggagtaaactaacattagttttaacttcaaaaagatacttgtctagatagaaaaaaacgtttagacttcttagagcatcattatcaataggttgttaacaatatcataagaactattaaaatattatattaaacaaaataagaataaaaaaaaataaaaaagtgtgcttgagatgaaaaatggctcttagctaagagttttcttccttattctcttcttttgtaagagcctttctaatatttaaacattatgttatatatcaaaattgtttagaactacatgtaagagtccattgataaagatggtcttagcccacttaaagtaactcatgaacatagagaaaatcagtctaacttctaaaatcaagacgtgtatgaaaggcttagacacttgtttctgaaaaattatgtcaaaccaactctgaagccatgcataagtaggcatatcccaaattaattccactttcacgaccactcatgcactcgaactcagatagcaataccaactcctttttgtcttttccttctttttttcgtatcacaaaagttttgtcaagttcaatctagatagattgcgatcaatcttatcaatggaaatagtaatgtttcttcttttagttttttttttaccacccacatgttaaaattaagggtcaatttgcaagatgattataaagagacataatctgcaaagaatacgcaatataatattagtaaatgagtggcaatttctcattcgtgtttgatttaaaagacaaatagaccgcaacttagaattttctgttaaccttaacagaaaatgatatttgtaatatatatgacttgtcgtgatagaattcacaacctttttttttttcctttactaacacttttattttgatttctattttaaattcgagtcgtatattacgataatatataataaaagttctaaaaattttccttaatatattatcatttacataacaccaataatcattttttcagtaaaaccactaataaaaaaacttgtcttatggggttaagggagtttaattgatatatatatatatatttacaactttactatagcatttgaaataatttaaaactccgtaattatttttgagctttgatttgtctacggcactgaaggcggtgaaaaaaattatggtaaaggccaaatttgccggacaaaacgaaatttacatactgtgctgtggaatcaaaaaaagaagaaaatatatatatatatatatatatataacaggttgtgggaacattaatctatgccaagttaacgaattcgtaattcaccaaaaaaaaaagttaacgaattcgttagattaaaatcaaatgcttcggcgtggtaatgtacctatgtaatttccttagaatcttgcaaagagtatttggatatatgatgaatatagtaatatgttatgctattttaaacgtttgaaaatcctattgtacacataaaaaattaaagggtgtagtatgaagtgcttgattaacttttcattaaaacaaatgcatatgctgtagtaagattttagataagtagttcaggagaataaaaatataggttaacgttaacgtcaaagctaagtaagtccaaagtggaacaacacatacacacttttcttataaatatgggaagctttgtggttgccaaactcaaagcacattggggcttatctctctctaagtaatacacacaaaaataactcacatatagagagagatatg

SEQ ID NO: 10474 - DNA, 3000 bp, Unknown
  misc_feature (1)..( 3000): cDNA_ID_2715750_gDNA_ID_2213653_Annot_ID_132485 3000 nt of promoter + ATG
aagttgagatttaggtatttagctgtagatttttttttcagaaataaggagtgagagagaaacagaaagtacagataacctttggttgctttgtaagaagttgctctgagtctgaccacctcttttactgcaaccacgacaccaataactgtgtttctttctctttaataaattttatcttttcaccaaatacatagtattattaatttattttgttggcatcgatattaacatgaatatattcgtttttgggtccatattgattatataccgtgcgggacaatatacgtagactagataaggagagagattgcacgttgttttagctccataatctacatttttatttattttttttctgttattctactaaatgccaatatttggcttagcgcatgcgtaatttttactactattatataaagttggttggaatggtagtaggatgaacaagtatttatcgagattctaaacaaattgtataaatcattttttttattaattgacaaatataatcaaacttggtgtctacaactacatgattttgtgaagtttggggttaaagaactaatcaaactcgtgatttttggaccaagacgaatgtacaagaaaaaatgaaaatatattggatcgcatatgatatgtttattgaagactataaatatgtcaaatgaagaattatgttactagtgcgaaaaggacatccatcaagtattgcttgaccaagctcgtgctgtcacatgcatgatggaccacggtggtcgttccctagaaaccaaccaacaatttctggtcaaagtcaaatctcttaatttgggctcttatcttttatttattcacggctattaggtttgaaggcccaatactgaaaacaaatatatgtaaaattaaaaaatgggcctagcgaatatttatgcggcccatcaaataattggataaaagctttataaactctgcatctcccgtctccgcatccaaaccctagaaattttgtctctctcgccgccttgcgaaaagcattttcgatcttactcttaggtagtctatgattctccatttgatccgtttatacttgttattggcatttcatcatcgtctgggttgttcgacttactctaattttggtttaaaacggatttaaagtttgtttttttgtgaataagcaattaatctattgttactgtttttgaatcgtttcaggataaaaaaatgtcgacagttggagagcttgcttgcagctacgctgttatgatcctcgaggacgagggtatcgctatcacggtatctttcctttgactcctgcttgtctatttctaaatcttgattggtctctttgctttagtcagtagggttttggaaccgtttcttttgacttgatagttagaaacttagtgaaaatgattcttatggagtgataaggatttggtatagtattatttggtcaggaattgaacaagtattttatgtatctgtctaaatgtgttttgaattgggtaaagatctttacttgtgtttgtttatgtcgttgataggctgacaaaatcgcgaccttggtgaaagctgctggtgttagtattgagtcatactggccaatgctattcgccaagatggctgagaaacgtaacgtgactgatctcatcatgaacgttggtgctggtggtggaggtggtgctccggttgcagctgctgctccagctgctggcggtggtgcggcagctgctcctgctgctgaggagaagaagaaggtaaatgaaatagcaacgatagacgaaatcattcttctaactaataagtgatataaaattgatctcattttggtattgcaggatgagccagcagaagagagtgacggagatttgggtttcggtttgtttgactaaacgcagtcacttgtctttcttctttgtagttggatattggagactatattttgtcgtatgagttattattacttgtttgatctggctaaaggactattagttggtttatgatgcgtatgttgtataactcaagtttcctagcaaaccaatcggctcgggcttttgttagaattgattttgtttattttctaccaagtcttcgttcatcaaatataggtctttaatttcgaaaacgtcaaaccataaatgttaaatccggtcatacaatatttagaattgtcatcaaatataggtctttaataaaattggcttttgcagtaatgttaggccggcccaatgcctttattatcggaacatgttagtgtttgttcttcttcttacccagcagcgtcttcataacatttgtacgtctattgtcatacattccatttgatgaaattgagataaggataaatacgataaaaaagtaatgggatttttcgtaagagaaataggaaaaccaaaaaatgttgtttagaggattaaatatgtttcataataatttagtagtaacggtaggaattaggttttaaattcaattttctttcttttagagtcaaaagtagttgcatctatagctctacctgataacaaaagatttatgggattatatacaaatcttaaagaaaacggatctattcttaaaactcaattgaaaagccatatttctaaatggttagaattttatggttattcacctgaatttgttcagatcattttgttaatttgatgattccactattgattaaccaattcgagttaaagaagaaaataaattatgttgagcatacttaacaaggattatatttgtagatcggatcttgaaattaagagatgaaatgaaaagaaagaaaaaaacattggtgttaacgaagaagggtgggtccaaaattgattaaatatttttcgaacaaacaaataaaaatatatataagtatttagagccgggatcgtctgcctcctctgcctctcatctcttgttctctccgcccatctctgctctcttttattttcccagaaagttttttttttttttttccgaattccgttaatctcattggggtttccattgatagcaatg

SEQ ID NO: 10475 - DNA, 3000 bp, Unknown
  misc_feature (1)..( 3000): cDNA_ID_3594146_gDNA_ID_2213653_Annot_ID_132486 3000 nt of promoter + ATG
gctagttcttgatggggaactaggtctttggccacgactcgggcttcctgctcctgttcttgagtaaggctgagaagtgtcgatttcaacggttttaactgaaaccctttggtcaaccgaagctctactactagctcgtttatcccacggtctagtagccatccaccggtcaagccattttggcctttcctcttcaagttctacctcgtggtgtccttccgtggattggttaccaaccgtcctccacatctttccattgaaacgaaacgatgttatcaacaagctcaatatatataacagactatatgccggtttaattaattttaccttttgagagaaagcttgtgacaaattagtcttgtcatgtctcaatgctgtgtcccgtctccgttgtagcatcactttcactgcgtctatcgtgtgtggtcggtcatcccaatcttccgcggcgctgcttccttctcttgactacaacaaataaataaccataattccaaaagacgttagccaccatatgaaattacaaacgcaatttacaattaacaaaaacagaattgcttaaagattgaaaaatatacaaaatatgtatacctaagagtaaagaaataatcaaggcacacctatgtgaatgcaccatttgaactagataggcatgctaaaaacagcttaaccttatgaataaactaaaaagcaaaacatgtctataactaaaaaacatatcaattgattatgctatagtttaggcaaggcctaggaggctatactaaccatggattgtcgatctgacaaatcttgaagatagcgagattcaaaaacagcgtgagagtcactgaacgcggatttgcgactaccgtcatgagacaagcgtttgcgttggtcaagcacacgagactggactcgaaccagagcttgcatacaccttaatgtcattttagcttgctttctcacattatgtcccctcaccaatgcttgtagcttcactaacccttttaatgctcttaatgctcttcttgccttaccaaattagaaagaacaaaacttatatcaagacccaaaaaaaaattatctaaatgaaatcccaatcttttaaatggtagatcttgtataagcaatgttaattttatagacatagacacacatcattgtcactaaaaagtggtctagaagtcaagttggttaaaaaaatgaaagtaaaaatataggtcattaataattgctcaccaaatatcctctgaaagaagtctggatgacaacagcagcgtaattttctcttgcgtaataaatccgcctcggtgcgagtgtcttagatgctgacgtggcgatggggactacggcggacgggggtttaccggcgttggatggcggcgtcgtagttgcgtaactcggtgctgtctccggagagggttttgagtttacgttaagtgaatcttcctgaggtgctggtggagagataccggaagacttcaccggagattcttgagtcgccggttttctaaaccaccgtctcttctctctcttctttttttaaaaaaacagagaaaaatgaaaaccaataatcatactttgaatatagtaagcaaataataagatctaagaataagaaaccttttcttcatcttcttcgacgtcattactatgatctttcttcgtcggagatcggaaagctcgctttacagcggtgagccaagaagaagagccgttctttttccccatgtgtaatgtgtttaattacttttggtctcaacaaattattaccactctattgtctttatgtatcggtgttccgtgaagttgagatttaggtatttagctgtagatttttttttcagaaataaggagtgagagagaaacagaaagtacagataacctttggttgctttgtaagaagttgctctgagtctgaccacctcttttactgcaaccacgacaccaataactgtgtttctttctctttaataaattttatcttttcaccaaatacatagtattattaatttattttgttggcatcgatattaacatgaatatattcgtttttgggtccatattgattatataccgtgcgggacaatatacgtagactagataaggagagagattgcacgttgttttagctccataatctacatttttatttattttttttctgttattctactaaatgccaatatttggcttagcgcatgcgtaatttttactactattatataaagttggttggaatggtagtaggatgaacaagtatttatcgagattctaaacaaattgtataaatcattttttttattaattgacaaatataatcaaacttggtgtctacaactacatgattttgtgaagtttggggttaaagaactaatcaaactcgtgatttttggaccaagacgaatgtacaagaaaaaatgaaaatatattggatcgcatatgatatgtttattgaagactataaatatgtcaaatgaagaattatgttactagtgcgaaaaggacatccatcaagtattgcttgaccaagctcgtgctgtcacatgcatgatggaccacggtggtcgttccctagaaaccaaccaacaatttctggtcaaagtcaaatctcttaatttgggctcttatcttttatttattcacggctattaggtttgaaggcccaatactgaaaacaaatatatgtaaaattaaaaaatgggcctagcgaatatttatgcggcccatcaaataattggataaaagctttataaactctgcatctcccgtctccgcatccaaaccctagaaattttgtctctctcgccgccttgcgaaaagcattttcgatcttactcttaggtagtctatgattctccatttgatccgtttatacttgttattggcatttcatcatcgtctgggttgttcgacttactctaattttggtttaaaacggatttaaagtttgtttttttgtgaataagcaattaatctattgttactgtttttgaatcgtttcaggataaaaaaatg

SEQ ID NO: 10476 - DNA, 3000 bp, Unknown
  misc_feature (1)..( 3000): cDNA_ID_2715738_gDNA_ID_2213653_Annot_ID_132490 3000 nt of promoter + ATG
atcatatgggaattatggatataattttgaagaacttaaaaataggttaatcttttaagactatggggagataacttgtcgcacaagtaccaaatgtttcggaaacaaaggtgaaaaaatctacaaacttaacaataaaaccacaagtcttccatttgtacggaggttaataataattaataccaaataaacgacaacacttgaagtagtcaaaacttttatagaattatcttgatttggttgaggtcgagattgacatcatcatcgtcgtcgcagagatcggagatcaaaatggagagggaaagaaacgcaggagtgatgaagaagatgagtccaacaggaaccatccaaagattagaatttgtgggatggtatttgtaaagccaataacttagaaacaatcctccacatatattcacaatcatcgaatacaagaacaccattgacgacgtactcttcttctccttccttgtcctcttcttcatattcgtgttcatgctgctttcgtggttcatttgcaagaggatctaaacaagttatgattcgcctttttattaattaatttactgggagttaggtgaagtgaaagaaaagatggatgacaataatagattctatattgttagagtgtatgagtaagtaagtatatatgcagtcgggttccggttcgtgtaggtcggtttagaaagtatatttcaattaaactcggtttttagtcgtttttctaacgaaatgtgtttggtttttagagattatttatgagcaaaactgagtttgtgtttgggttttagatagggtacctaaaactcgattaaacatttagaccagtttccagctggtccgactccgatttaggttggtcaatgtatgaaaggcaaatctaaacataagacacattttatgttatgtattactaaattactacaaaaaaaactcctacaactccaaaatacacaatggtttagatttagatatacatgtttttagaactaaaattattgaggtattttataatagtactccaagttataatttctgttacgaggcgagaataaacgtgggagaggaaggaaaaaaaggtgccgtgcggtgcaactagattttacatatttgtacacatatttcacgattgaatctttcaagacattatatgctttatcaaattttatatatataacaattagataagaaacacaatctgacccgactctactatttataattatacgtatgaatctctaacttcgttactaaaacggcaaatactaaaccctgaaaggaaactgtgtgagaaacagttaggccccttgaccatctttgttcaacgttgtcaacgaaaaaaaaatggaaccataaaggataattaattgtatcacaaaaagacaaacacaaattattgaatataccatcacttatcagtatataattttatacaaatgctttaaataacaaatattatgtagaaaaagagaaaagaaacttaacttggtcaatttgatcatttgtgtaaacgatgatgcggaacatatgcgataataatgttattggatggcaaaaaaaaaaaaaagtattttagttgggccctaatgttaattcacaatcaagcctaaatttggttaatgggccaatctttcttatatatgtaggactcggatgttcggtctactcgaactatctacaaaccaagctaaaccgaaagtaaatacaaaatcaaaccaaataatagtttggtttatataggttttaaattttaatccatataatccaataagttccaactcataaccaggaaaataaaaaaaatgtggaatgaagaagttcaaattgataaccaaatgaattgctttcatatgatggtgacgtgatgtttttgtaccggactcaattattggaacgagtggttcattgtgcattatttgcattttcttttgttcgtaatatactaacatatctaaaaaattattgtatcattattactagtcatgcaataaatcatcaactcacactgtctgccacacttttttaatttttctgcgtattttggcattatcatatgaaagaaaataagagaaacaaataaaggaaagaagaaaaataaaaacattatcacattctgtgaaatctctgagtttatcaggaaggatatgtggggttcatattcataccgttccctttactcacatcgtcacatggaaagatcaactatttcaattatctatttatttattatcatatactttaaataatcaaatttagaaccgttacaaacaaaaataaacagctacatcaaatttaaacaaaagtaagtatatgcgaatattatcatagatttaaacaaaatttgaccaagatataacaatcatcatttaactaccaacatttgatatatgtatttattgttcttaggtagtttccaacttctaactaaagacaaaaaaaaaagttatatttagagaatatttctacatgaaaagaatacaactatatcaaataatatgataacagtcaactttgaacatcagtagaatggaatgaatcactgaaagatatactcatatacacataaagattaaggacatcaaatcacatcccttacaaataaaaccatatccacataaatttaaaaccccaaaattttcataaaatccatatacttaaacaggagtttctgtatatagttaccacacaagaacaaaattatggaatttttttatatgaatgaagaatgaacgttacgaacgtacacaagtacaaataacacgggactgacgcggaacagagcaaaataatgatttttgacattacgtggcatacgggacccacaatacgcgcgtgactcccagtcgcgcctattaaatctctcgctcgtccactttctctcgtcagccttaaaaccaggcagccactagaagaaggagagatattgagggagaagaatcacattgatagattcgccgccgatctagagccgttgattttcttaatcggaaaaagaaaatg

SEQ ID NO: 10477 - DNA, 3000 bp, Unknown
  misc_feature (1)..( 3000): cDNA_ID_3098512_gDNA_ID_2213653_Annot_ID_132493 3000 nt of promoter + ATG
aatacttctttctttctcaaaaagatgtttcagccaaaaaggaaacccggttgctacatacgattggcggcgatcctccattgtcacgctcttggcaataagatgagctccaagattagagcttcttacttcaccacacaattccaatccaaaaaattacttaattctcccaacaaaaagtgaatctgaaatttatacgaaggccaagacggcagtcgcgtaacagctccaattagatcattgtcttcagaggcaaagatgattttatcaactctgagacttttcatactctccatggcccattgccaacaaagaaaagtagcatcaagcttgctatgaacagatgcaaaagatcttctagcatgaattaggaccttaccgtgttcatctctcaaaaacccgcgcagcacctccaatctcaccaaatctatcccatgacgatctaatattgcattttaaccaatcatggggaggaggagaccacttaaccttaaccgaaatgtgaacagcttgctcattcaccaaatcctgattctcaagaacttgagcaaagaaccattgattggcatcctctttaatcttcgcaacagtttttgagatcgcaaatcttgtccctttattaattacctttttcacagaaaaaaataatattctgaaaatacacttccatggaacacttcatcaatttgaagtaaaaacaaaaaaaatgatgttttttttgtttcacctgatcaatcaaatattttttctcattacacaatcaaaaacctcaaatccattaattttcaaaagatggaaaaaaaatatgaattgactatgcaatattacacattttcttattatttatacatcgaattttttcattccttatgggaaaaagggaatcaggttactttgaccgaatcaataacccaatgttgaccatcggttttgacctttaaccggttaatctctgcgaacagattcacggctctcctcactcctctattatccgccgccgtgaaataatcgtgaccaaatataacaccgccgggtcggagtatccgaaccgcccggtttatatccgcccatgccgaattaaaatcgtgacccgcgtctatctccaccaggtccgccgtcactccccactcacacagcttctccaaagccgaaccggtcgagaaaggaaccggcaatatcgaaccggaaaaatccgagataaccacgttttgcataaactggtacataagcagaacgtcaccgttaaccaaagccatgtccttaaaccggtctcgaaaaccgggccagccacggaagtcgtcgacgcatagaatctgagtctcctcgagcccaagtcggcgcgtgagattcgccatgtgtatcgccgacgcgccgagaaaactcccgacttcgacgatcgtcttaggtttgactcggcggattagattctcgaaaacggccccgtatgatccccaacctttgattctttttggccggagaaacttcttggcgtgcggtggtgggaaatcgatgtacggagaagttccgttaaagatccggtcaataacagtctggcgaatcaattccggcggaacaagattgccgcatggagtcgtaactcggaagttgtcgattgaacaaacttgaggttttgtcgtttccacggctgtcgtagacggtggcagctgctgctgcagcggttgatgatagtggtaggcggagaagtaaccaaaggcgtaggttagaactatgacgataacgtacgcagccttggttttcaagaattggaaggcgtcgcgtttgtgaggaagacgacgatcctccttcatggtcaagatttctgagaatgaagaatcaagtaaaaacaaaataggattaaggaaggataattgtttttgttattaagtttatataattcgaattatggaaatttatttatgattattttggcgggtcagtttgttgagacgtttaaatacagtcggataaggaaattgctcacgtcgtgatctaatttatttgtatttatttgactttacgtgtctagaaagctacatgtgatgtagtcatttacaatcaaaatcatttgctttaatccttgacttaattcattctgtatttcgggttttatgagtttagaaaaaccatataaaacaaaaacttatttaactcccctagacctattaataaatgaaactacgaatctctaatctttagtgtatttacagttttccaacgaaatcatatgttataacacgacacgacctcaatagtcaataataagtagaatcatgttttgaacatgtcaaatgcagcactgattcgaaagaataaagaaaaaaagagttttgaatcgtaattctgcaagaattaaagtgtagtgtttaatatatgtggcattcgccgagatcatcttataatagagtatgtgtcatacgccgaaaacaatgttggacacttggacctttccttactgataaataaataaattcatatcaactagcaaattagcatattacaggttttggttataacaattactcgagctagacgtatgatgaaattcagcaaactagtagatttgctattatatcttcccttgtgatgattgtagttttgtctcttaataaaactagtaattaacgtttcagaaaacaatgcccattttggtaatttcacagagatttatccaaagtttttaaagagataagacgatagagttggacgaccgtcttccaccgttgaattcttctggaactggagtccactgtttaagcttcactgtctctgaatcggcaaaggtaaacgtatcaattattctacaaacccttttatttttcttttgaattaccgtcttcattggttatatgataacttgataagtaaagcttcaataattgaatttgatctgtgtttttttggccttaatactaaatccttacataagctttgttgcttctcctcttgtgagttgagtgttaagttgtaataatggttcactttcagctttagaagaaaatg

SEQ ID NO: 10478 - DNA, 3000 bp, Unknown
  misc_feature (1)..( 3000): cDNA_ID_2715730_gDNA_ID_2213653_Annot_ID_132494 3000 nt of promoter + ATG
ccctgctaacaacatcactaccgaacagatccaaaaggttccttctttctcaccctatatctctccctctctcttaatttgttcaacactacttaggaggctcttagagcttttttgtactgacaaaatcattggcttctgagtgcaagtaatactcttttgactgtaattggtggcaattagggttttcatttgaatctttctcgttaattccacaacacttgagagtctgttgttggtgatgatgagaagagacagtttctaggactaggaaattagtagatgcttggtgggtcaggaaactttgaatccggttttcaagaatggacattgaagttagatgcttgcttgatgttgttgttttgtactttctcttggcttgatgtcttccatggtaagatgataggctgcatcgtcatttccttgtcattctctttcctttgcttaaacgcagtaccttgatgagaacaagaagctgattatggccatcatggaaaaccagaatctcggtaaacttgctgagtgcgcccagtaagtctcaccttttctatccatcttcttatgtctcttagatagtaatggaagcttagaattactattattaatggtgaggtttatatagttattctatcttttgctctgttatattttcaggtaccaagctcttctccagaagaacttgatgtatcttgctgcaattgctgatgctcaacccccaccacctacgccaggaccttcaccatctacagctgtcgctgcccaggttgtttgtgatgataaaactcaattgcgatctatcacagaaatttaatgttgtttgggggtttgcttactgttgggtatgatttctgttagatggcaacaccgcattctgggatgcaaccacctagctacttcatgcaacacccacaagcatcccctgcagggattttcgctccaaggggtcctttacagtttggtagcccactccagtttcaggatccgcaacagcagcagcagatacatcagcaagctatgcaaggacacatggggattagaccaatgggtatgaccaacaacgggatgcagcatgcgatgcaacaaccagaaaccggtcttggaggaaacggtaactctctttacattattaagacaatactcaatctcataaattgtaacttgtatccattacttctttctttgctaacagtggggcttagaggaggaaagcaagatggagcagatggacaaggaaaagatgatggcaagtgaaaaggatccaaagaagctttgttttgttgatatttaggacttgtgagtctcgtaagggctttttgcaatagcttgtttgagttttttaacagaagatagactgtggagtagttccgcaaaccgtgttgtaatgtattgttatttagtacaagctcggatttagaaaacatcgtcatcgttcatcttattctgaaaatcaaagcattgaacttattattttctcattccggacgagtcttgacgatgaaattctgacggctaatgggattcataacaacgggaggaccagcggttcttggccatgcttggaatttctcatccgttgctgcccaccattctttgttagagacagttcctggagtagtccctgaaattttcacaagaagataaccattaagatcgtccctaacttgaaaacacacacaaaactagataaatcttgagcagaacttgcctccaaagatcttattatcagagataactttgtcgaagatgtatgagattccgaaagaaccgatgagagcaccgattatgtacttggctttacctcctgatgccattttcttctaaagctgaaagtgaaccattattacaacttaacactcaactcacaagaggagaagcaacaaagcttatgtaaggatttagtattaaggccaaaaaaacacagatcaaattcaattattgaagctttacttatcaagttatcatataaccaatgaagacggtaattcaaaagaaaaataaaagggtttgtagaataattgatacgtttacctttgccgattcagagacagtgaagcttaaacagtggactccagttccagaagaattcaacggtggaagacggtcgtccaactctatcgtcttatctctttaaaaactttggataaatctctgtgaaattaccaaaatgggcattgttttctgaaacgttaattactagttttattaagagacaaaactacaatcatcacaagggaagatataatagcaaatctactagtttgctgaatttcatcatacgtctagctcgagtaattgttataaccaaaacctgtaatatgctaatttgctagttgatatgaatttatttatttatcagtaaggaaaggtccaagtgtccaacattgttttcggcgtatgacacatactctattataagatgatctcggcgaatgccacatatattaaacactacactttaattcttgcagaattacgattcaaaactctttttttctttattctttcgaatcagtgctgcatttgacatgttcaaaacatgattctacttattattgactattgaggtcgtgtcgtgttataacatatgatttcgttggaaaactgtaaatacactaaagattagagattcgtagtttcatttattaataggtctaggggagttaaataagtttttgttttatatggtttttctaaactcataaaacccgaaatacagaatgaattaagtcaaggattaaagcaaatgattttgattgtaaatgactacatcacatgtagctttctagacacgtaaagtcaaataaatacaaataaattagatcacgacgtgagcaatttccttatccgactgtatttaaacgtctcaacaaactgacccgccaaaataatcataaataaatttccataattcgaattatataaacttaataacaaaaacaattatccttccttaatcctattttgtttttacttgattcttcattctcagaaatcttgacc

SEQ ID NO: 10479 - DNA, 3000 bp, Unknown; identical to SEQ ID NO: 10477
  misc_feature (1)..( 3000): cDNA_ID_3098656_gDNA_ID_2213653_Annot_ID_181661 3000 nt of promoter + ATG

SEQ ID NO: 10480 - DNA, 3000 bp, Unknown
  misc_feature (1)..( 3000): cDNA_ID_3098661_gDNA_ID_2213653_Annot_ID_181658 3000 nt of promoter + ATG
ctatggggagataacttgtcgcacaagtaccaaatgtttcggaaacaaaggtgaaaaaatctacaaacttaacaataaaaccacaagtcttccatttgtacggaggttaataataattaataccaaataaacgacaacacttgaagtagtcaaaacttttatagaattatcttgatttggttgaggtcgagattgacatcatcatcgtcgtcgcagagatcggagatcaaaatggagagggaaagaaacgcaggagtgatgaagaagatgagtccaacaggaaccatccaaagattagaatttgtgggatggtatttgtaaagccaataacttagaaacaatcctccacatatattcacaatcatcgaatacaagaacaccattgacgacgtactcttcttctccttccttgtcctcttcttcatattcgtgttcatgctgctttcgtggttcatttgcaagaggatctaaacaagttatgattcgcctttttattaattaatttactgggagttaggtgaagtgaaagaaaagatggatgacaataatagattctatattgttagagtgtatgagtaagtaagtatatatgcagtcgggttccggttcgtgtaggtcggtttagaaagtatatttcaattaaactcggtttttagtcgtttttctaacgaaatgtgtttggtttttagagattatttatgagcaaaactgagtttgtgtttgggttttagatagggtacctaaaactcgattaaacatttagaccagtttccagctggtccgactccgatttaggttggtcaatgtatgaaaggcaaatctaaacataagacacattttatgttatgtattactaaattactacaaaaaaaactcctacaactccaaaatacacaatggtttagatttagatatacatgtttttagaactaaaattattgaggtattttataatagtactccaagttataatttctgttacgaggcgagaataaacgtgggagaggaaggaaaaaaaggtgccgtgcggtgcaactagattttacatatttgtacacatatttcacgattgaatctttcaagacattatatgctttatcaaattttatatatataacaattagataagaaacacaatctgacccgactctactatttataattatacgtatgaatctctaacttcgttactaaaacggcaaatactaaaccctgaaaggaaactgtgtgagaaacagttaggccccttgaccatctttgttcaacgttgtcaacgaaaaaaaaatggaaccataaaggataattaattgtatcacaaaaagacaaacacaaattattgaatataccatcacttatcagtatataattttatacaaatgctttaaataacaaatattatgtagaaaaagagaaaagaaacttaacttggtcaatttgatcatttgtgtaaacgatgatgcggaacatatgcgataataatgttattggatggcaaaaaaaaaaaaaagtattttagttgggccctaatgttaattcacaatcaagcctaaatttggttaatgggccaatctttcttatatatgtaggactcggatgttcggtctactcgaactatctacaaaccaagctaaaccgaaagtaaatacaaaatcaaaccaaataatagtttggtttatataggttttaaattttaatccatataatccaataagttccaactcataaccaggaaaataaaaaaaatgtggaatgaagaagttcaaattgataaccaaatgaattgctttcatatgatggtgacgtgatgtttttgtaccggactcaattattggaacgagtggttcattgtgcattatttgcattttcttttgttcgtaatatactaacatatctaaaaaattattgtatcattattactagtcatgcaataaatcatcaactcacactgtctgccacacttttttaatttttctgcgtattttggcattatcatatgaaagaaaataagagaaacaaataaaggaaagaagaaaaataaaaacattatcacattctgtgaaatctctgagtttatcaggaaggatatgtggggttcatattcataccgttccctttactcacatcgtcacatggaaagatcaactatttcaattatctatttatttattatcatatactttaaataatcaaatttagaaccgttacaaacaaaaataaacagctacatcaaatttaaacaaaagtaagtatatgcgaatattatcatagatttaaacaaaatttgaccaagatataacaatcatcatttaactaccaacatttgatatatgtatttattgttcttaggtagtttccaacttctaactaaagacaaaaaaaaaagttatatttagagaatatttctacatgaaaagaatacaactatatcaaataatatgataacagtcaactttgaacatcagtagaatggaatgaatcactgaaagatatactcatatacacataaagattaaggacatcaaatcacatcccttacaaataaaaccatatccacataaatttaaaaccccaaaattttcataaaatccatatacttaaacaggagtttctgtatatagttaccacacaagaacaaaattatggaatttttttatatgaatgaagaatgaacgttacgaacgtacacaagtacaaataacacgggactgacgcggaacagagcaaaataatgatttttgacattacgtggcatacgggacccacaatacgcgcgtgactcccagtcgcgcctattaaatctctcgctcgtccactttctctcgtcagccttaaaaccaggcagccactagaagaaggagagatattgagggagaagaatcacattgatagattcgccgccgatctagagccgttgattttcttaatcggaaaaagaaaatgagtggaagcagaaggaaggcgacgccggcgagtaggacgcgagtagggaattacgagatg

SEQ ID NO: 10481 - DNA, 3000 bp, Unknown; identical to SEQ ID NO: 10475
  misc_feature (1)..( 3000): cDNA_ID_3594146_gDNA_ID_2213653_Annot_ID_181652 3000 nt of promoter + ATG

SEQ ID NO: 10482 - DNA, 3000 bp, Unknown; identical to SEQ ID NO: 10474
  misc_feature (1)..( 3000): cDNA_ID_3036734_gDNA_ID_2213653_Annot_ID_181651 3000 nt of promoter + ATG

SEQ ID NO: 10483 - DNA, 3000 bp, Unknown
  misc_feature (1)..( 3000): cDNA_ID_3036738_gDNA_ID_2213653_Annot_ID_181650 3000 nt of promoter + ATG
aaccaaaaaatgttgtttagaggattaaatatgtttcataataatttagtagtaacggtaggaattaggttttaaattcaattttctttcttttagagtcaaaagtagttgcatctatagctctacctgataacaaaagatttatgggattatatacaaatcttaaagaaaacggatctattcttaaaactcaattgaaaagccatatttctaaatggttagaattttatggttattcacctgaatttgttcagatcattttgttaatttgatgattccactattgattaaccaattcgagttaaagaagaaaataaattatgttgagcatacttaacaaggattatatttgtagatcggatcttgaaattaagagatgaaatgaaaagaaagaaaaaaacattggtgttaacgaagaagggtgggtccaaaattgattaaatatttttcgaacaaacaaataaaaatatatataagtatttagagccgggatcgtctgcctcctctgcctctcatctcttgttctctccgcccatctctgctctcttttattttcccagaaagttttttttttttttttccgaattccgttaatctcattggggtttccattgatagcaatggcgacggctttcgctcccactaagctcactgccacggttcctctgcatggatcccatgagaatcgtctcttgctcccgatccgattggctcctccttcttctttcctcggatccacccgttccctctcccttcgcagactcaatcactccaacgccacccgtcgatctcccgtcgtctctgtccaggaagttgtcaaggagaagcaatccaccaataataccagcctggtacgcttcctctcctcgtctccttcttttggaattttacaagttgtgagatttgttgtattgatttaagtaatttgaaatagttgataaccaaagaggaaggattggagttgtatgaagatatgatactaggtagatctttcgaagacatgtgtgctcaaatgtattaccgaggcaagatgtttggttttgttcacttgtacaatggccaagaggctgtttctactggctttatcaagctccttaccaagtctgactctgtcgttagtacctaccgtgaccatgtccatgccctcagcaaaggtgtctctgctcgtgctgttatgagcgagctcttcggcaaggttactggatgctgcagaggccaaggtggatccatgcacatgttctccaaagaacacaacatgcttggtggctttgcttttattggtgaaggcattcctgtcgccactggtgctgcctttagctccaagtacaggagggaagtcttgaaacaggattgtgatgatgtcactgtcgcctttttcggagatggaacttgtaacaacggacagttcttcgagtgtctcaacatggctgctctctataaactgcctattatctttgttgtcgagaataacttgtgggccattgggatgtctcacttgagagccacttctgaccccgagatttggaagaaaggtcctgcatttgggatgcctggtgttcatgttgacggtatggatgtcttgaaggtcagggaagtcgctaaagaagctgtcactagagctagaagaggagaaggtccaaccttggttgaatgtgagacttatagattcagaggacactccttggctgatcccgatgagctccgtgatgctggtaaatatcgacttccttctgcttcttgatgcttgtactgattatctaagggttgaaacaaccttctctttaatttgaatttttttttgcagctgagaaagccaaatacgcggctagagacccaatcgcagcattgaagaagtatttgatagagaacaagcttgcaaaggaagcagagctaaagtcaatagagaaaaagatagacgagttggtggaggaagcggttgagtttgcagacgctagtccacagcccggtcgcagtcagttgctagagaatgtgtttgctgatccaaaaggatttggaattggacctgatggacggtacagatgtgaggaccccaagtttaccgaaggcacagctcaagtctgagaagacaagtttaaccataagctgtctactgtctcttcgatgtttctatatatcttattaagttaaatgctacagagaatcagtttgaatcatttgcactttttgctttttgtttggtgttactaaactatcacaaggttcttcttgtagttcgttgggttttcattggttaccacttaccagagaattgtatttttttttttaaagataattattttgcaacctcgggtgattacactctaaacaagatgggctctgcaacaggagccagtaccaccaattacacacaatctcgtataagaacaatacatgccaatacagcttccacagcacagaaaactcttttcctctttgcttcatctctgcatagcttgcttataatatagctttaaacctcaagatttgcagacttcttcatagtaagatcaaagaagacagtgttgtggtttgcataacgatcatttgggtcaaaatatagcttcaaacctctgagggagttcaaacatagcagattctatcactaccaccttccctcagagccaaggagttgtagatgtagtggtcagaatgaagattgaggatgaatgggccattagacaagattgcactggttctaatttcatggctcctactttctttgtaattaaagtgtttggtaaagggaataagagacttgaagaaatgaaaatgtttgaataattttttattttttgatttataactttgggccttttgtttatttcatgaaaaacaaaacctgctacgcgaaagagagtgtctcatctgacgtagcgaataccgagcaggattgtaacgggttaaatgacccgacccgatttgttctattaatttctatttcatttcttttttttttaatcattcttctcaaataatttactttctggtccttcgataatg

SEQ ID NO: 10484 - DNA, 3000 bp, Unknown; identical to SEQ ID NO: 10473
  misc_feature (1)..( 3000): cDNA_ID_3036742_gDNA_ID_2213653_Annot_ID_181649 3000 nt of promoter + ATG

SEQ ID NO: 10485 - DNA, 3000 bp, Unknown; identical to SEQ ID NO: 10470
  misc_feature (1)..( 3000): cDNA_ID_3036750_gDNA_ID_2213653_Annot_ID_181647 3000 nt of promoter + ATG

SEQ ID NO: 10486 - DNA, 3000 bp, Unknown
  misc_feature (1)..( 3000): cDNA_ID_3036752_gDNA_ID_2213653_Annot_ID_181646 3000 nt of promoter + ATG
tatatattttttaagtatagaaaatagaaatatgacgtgctaaattgagctatggacaaaatcatatatgagaaaatgaatgtagatggatagagtcgtcccacacttaaggttggtccacaatgaataccgttggaggcttcgcaggcttttgttctgtccttgtctctctctcccctaaaaaaaatttgttacgaaaaattcatttgaattaattttggtcggtatgtgtataatattatacaattataatatatttctaggtttagacatttttttattttatttttcatgaagtaaagaacacaaacaaaaacccataaaataatgtaagatagataaaacaagaggatgtcgtcataaataaattggaatttggcatttaatgaaaaagggtgaaaggtgcttgacatacacgcgccgtagtttcttacccggaaagggattggtattgatgttaactagaccgggcccggtttaggctggggcggcggccgaaccgaccacctggctactattcttgtttgtattcgctgattctgcaaatctaaactcggatcttttatggacttggattttcgggtgggtggggttctgctaaagagacggcgctcttgtcattttaagtcggtcactgcaaaacgtgaaccctgtgactgtatttagagtctcgttacgttggatctctctccatgaaccgtccaaagtaggtcaatttttgtgggttcactcacgtatacaacgaagtacggcgctatttaattttccgaaaattttgaaagagacttttataccagaaaagtttgtaatccaaatttttaatatattgcagatttggttcgttttgggcttaaagagcttttattggtgtggtggctcaaatcgtttttgtaggcgtcaggtcaggcccattttcaatgtcgcttgctcatttgatacgctaatatagggctttgcttaagatttgaatgggccgtacccccattttgcttcatgagaatgggatggtaataaagaaaaaaatgacaggaaacaatgaattggtcacgaaaaaatgttgtattactttttccaaaatgcacctttgagaatcttaagattcaatcatacagtgaggtccatgtccacaataagaaatcaaataccaaacaaagtataaacgtgaattgtaagctaggcagtgtatgaagatgcatttgtcttaaagttacgaatctgataaataatattattcgatcgactttagatcgctttccatgcagatttatgcaattatctggaagaagaacaaaacaatatcttagtttcttcggcctcactattcgacttctatcttcaatatattttcgcgtatttttttatttgaattatttggtttttggttagttaactaaacgagcaacagaaccaagatcgaattgcgtttgccgtttggattcaattattgtagaaaattcgacttttcagacatttgttacgttctttctagtagttatattagttattatatgtggagtggaaagagatgaaagtagatgtaaaacataagtgatttcttcatagtgattttaaaactttttgttgattttcaaaattatataatatccataaaaaatagcctatgcgtgttggatgcttacaaagaagaatttgttttcggcgttagccaaaagtcgatggcatttgctaaaggtgttatttgagtggaaatgatctagaacaaaaacgcattgatataccaccactataatgatttggagacgtatctagttctcatcaacttttcaatagtaaacgcattatcaaggtaaacgaagagttttgctttatcagtgtaccatacacacattaatagattgatggacgttagtgactttggtattgactttaacgccaaatggacatcaattctgcaaggcaatgcctagtttcaaagcagcgttacttaacatttaactaaaggtagtgcaaactggttaatactttttaacggctttgcaggaagagtctcgactaaaaggagaggaagagatgagatcgacgaagattttcatatcataaaaagtaatataggtttttgaaaatagttagaataattatttttatttttatttttatgggaaagaagttgcacgagtcggtccacagaatgacagaacaaaagcattttagaagtttagaaccaaccaatcactatagttttccacttgtccgtatctcattggttcatcgaatattaacttacatggaaacagtaaaaagcgtggaataagtcgtaaaactgaaatctaaaaatgaaaagatttcgatttcgatataaatacttaatctttataaaataatatcgaaatcttttcatttttagttttcagttttacacttttacttgataaatttaatacatctgttaattttttttcttctaaaattaacatatgatatctattcgggagataaccctaagaaaactgataaaataaataagttactttttacaaagtcgaataaattatttacccttctgctttaatggcaattatcttaatattgcaaaaaaaaaaagagagaaatattactacaaaacagaagcaagcaagtggaaaacagaccagaagagagaggaagacgaagagagaaacagaacagagtagggatcgatagaccgtggaatctcagaatcacaaacactttgcaaaagggttttcaattcctatttatttacaaagaaatcatcaatagtagtggtctctagggttttgcttgctcttcttcgtgacccctttttacctgcaaacaacaacttcaaaattggcgtgtttcgtacggtctatctaaccctaatctgtcacaaaacactcttcttctctcacccctttttctgggtttattcaattctcgtgcttttggttctgttttcttctctggggatttggttttcttgagtgagtttttctcctctttcttatgttcttgatttgattattatatagaattatggta

SEQ ID NO: 10487 - DNA, 3000 bp, Unknown; identical to SEQ ID NO: 10478
  misc_feature (1)..( 3000): cDNA_ID_2715730_gDNA_ID_2213653_Annot_ID_181662 3000 nt of promoter + ATG

SEQ ID NO: 10488 - DNA, 1855 bp, Unknown
  misc_feature (1)..( 1855): cDNA_ID_2715726_gDNA_ID_2213653_Annot_ID_132495 3000 nt of promoter + ATG
cttcgtgctcgtgttgaaattttgagtgataggccataaaatcaaaagccaattattgggcctttctttaagcccatatatgactcggatctttgtttgggtttttcatgtttagagaattagaggtggtgcttatagtaaaatcaaaaagctattcatgtgtcactcgtaatctctttgacattcttgtatatgtaaagaaaaaacaattcttttattctgtcaagttccaaggagtttcttctattcaatcaaaatgttaagtaaaaactagagttttatcaatatttctagcaaggaattttttaaaaaaaaagtctaaactatatggtagtgaaatgatggagatttgttttcaaagattaggatagtgaaatgatcagaaccacaataagttcattaagtagatatttcgtgacatcaattgtgagtgtcacgttagaatctggaatataatccaaatctaatggaagatatgattctatttatttttgcatgcaaccgaatcatttgaagtgctccaatcacaaactcgcttttcctcttatgacctaaaaaggagagtatattatataatcagatatataaaacatcacacattaatatttacattgtatctaagcacatatgattaatcggccaccaagtgctttgtgactacttagttttctatgctgatacctctgtattatgtgtaaagttactaattagtttatgtatattagcaaaagaaagattcttatataagaacaatgtaaattactcctttgaacttttatatattttcaataaacgataggatcgagttaagataagtatatgtattaactgaattaaacaaatactataagaagaaatttggattcagggccacaatgttatgataaattttgctggtgtcttaaacacttcgacgatctatatattttactaaagaggtgacaatttttgcaggagatagctataaaaattatatttagccttgatagttacagattagtagctatctgttatttacaacgaaatttacatgttataaattttcttctaattaatctatttatattgtttggaatgaaaaagcgcatacatatgtaagttggaaagtatataaaaaagtagatgattaaaaggaaaggtcgttgactaacaatagaaaaagtcaaatggtaagcaagcaggagaatagtcgtacgttcactgttcccaacttgcaatgagactcatcagaaaattggcatctttgaaaataatagtaattacgtatacatgttattttatattgtttttgttaattaagcactacgtttagatacgcaaattactttattaagatgcatatatactcacttttacttcacattatgataataaaaaaatcatgatttataaaccgtactattttatacgtaaattgtatacgtatgcgtttccttagaaaaaaacttgtagaaatagaatactcatgaatgtataagaaatagttaaaataaattaaaaaggggacgatagcagacaattattcagaactgacgtatatatcggacatatgcaagtataatcttcaatacttgtgtttatttagattaaaattctatgtaggggatatagtaatttgagtgtaccaaacatgtcataacttattagcatatacccatgagcaccaacagatgactttgaaataaagtatttataatttcaagtattctctgttttgcaattggctaagaccttcatagttcgtacgcctatttaaagcctcacaaagacccaaacataaatcacaacctataaacggaaaaacaaaatcacaaacaaaaaaagaagaagaagaacatttatcctatccataatg

SEQ ID NO: 10489 - DNA, 3000 bp, Unknown
  misc_feature (1)..( 3000): cDNA_ID_3036843_gDNA_ID_2213654_Annot_ID_181690 3000 nt of promoter + ATG
atagagtacggttttgaaagttagtaacttacgagatcatgacacatcttaatttcatcgatattagattttaaatgtcttctcaaatcttatgttattgaacatggaacttacttaatatcattcaacataacttctaatcacatgttattcaatcaataattaataaaagttttaccaaatcctatgttattcaaaaatttgctataatcttgtgatttggttttataacggatttttggagactttagacataattttagttaaaaaaaaaatatagatccataaatctaatcctcaactatgatactttgagagatttcaatcaaaatttaaaatataacgttacccacataaacttgtataaaccttcgtttattgaaatcttaagataatggcaaattctccaccattgtcagatttgttctgtaatcttccataatatattagtgaattcaaaacttgtatatcgtctataatagactagtagaacaagcacctttttcactatctattgacatcatcaatctctttccaatgatgatgacgcatcttggtccatgtggtttgctaattccactgagcatagatttctcataccctggcttcttgtttctaaaatccctgggttgcttgtgatgctttgaaacaagtaaataaaaagtaattttgttttcttgcaggcagcttggaaagagattaagcgataatctctcccggtaaatctgatcttgtcggatcattgttacctttttatctccttaatggagcagtttctcttcccaatattccctcatatatggactggattggatgttcaaggtttgtcggtattggaaagatcttcctcccggcctatacactttgctgcctttgttgcagtggccttaacccctcgggttactttggatacttgtaacacccctattttacaattagactatgaggccctagtccagcccgctaatgatttgaatccaagtgaaaacctaatgatcccacgtgattataaaaggagaacgcaaactccaaatcaagtcacaaaaaccctaagccggcaaccttgcaccactcagaccaccggagatcgttgttgtgttgagccggagtcaccgcgtgaatcatcctcaccggagagataacgcacgagaatcgattctggttttgatctcttagtttctttaggattgtttttctttaggattgttgaaccaatctaactagtgaatggaaccatcgtagatctgtgccactccgctgttccaaccgccaagcaaaccgtaagggagactcgtcgagaaaagtcaccgagaaaggtaatcgggaatcttctcgtgttgttatgtgattatgttatttgattattaaaccatgatctaaattaaaccagttaaaaccaatgaatcgtttgtttagttagaagttacgtgaaattgtgtcgtaggaagaagaagttgacttcattcattggtttagttgttagagtaccggttaattgccaaaccggaagctatcattcacgtgaatgcatggatccaattgtggacgtagtgttacatgtagtgaatgaatcaatatttaattactagatttagttggattattttattaaattaagtctagttaatttattgaaggatatatagtttgggttgattatgaaattaattatagattattaatgaaaaataatctttgatcgattatttaaaccgtcgcagattgagatcgttattggaccttttcttgttgctgttatttcgaaaccgtgttatccaaccgagttgctaaggtgagggcgggatctgtggaaacatagtatcacctttctacttttgtacttttgaagttcatttgtataggattagacattgggtgttgattgttaattattaggaattaattgttaaaacattataagatgtgttgtgtgatgttatgcgttaggtgttagcgtgatatacatgttgatttgtttgacgtctttaagacgtatttttaaataaatatataaagataaataaaagagaataatgatattaaagaaaggataacattgaggatgttggactgtaatggaaccgacgggttcattacaggtcattaatcgctgacgtgcaatgagaggaaggatcgagctacgggccgtggtcttccatgaataggcttgaggagccataaattaacgtacgttaaaaactaagaaaagaaagtaaaagatcttgtggtgagcaagacgaaagcttgtctgttatagcttactacgaaagtttaagctatttgcttgttgtttgagtctatgcttatgaaatggaaattgtgtataagtataatcgtgttattgtgattcggtggacagttttgactgccttcactgagtaattaattactcacccccttttcttttccctcaggtgaggaagagaatgttgagtagctgctcgtttggtgttatttcgggaactttgggttttatttgatttatcgatatttcttatatttctaaacacggtttctttatacatttttatccaacgattttaatttatttatgctattattttgagacaatttatttctgattcttaataaaagaaagtttcccgaaattatgatattttatttcaagatttgatttgaagaagttgaataaatgaatggaaaagatgaaagtacgccgtctcaaggttgagagagacgggtattataaatggtatcagagcagaggttaaagtcaagccggtgttgacccggaagactaactatatctgtatttatttttattaaaaaaaaaggtttttctaataatatatatttttagaaagcggtttaaaaaaaaaaaaaaaaaagttttcagtattgaaatggggaaggggattttaaaaaaaaaaaaaaaaaaaaaaaaaaaaaaccaaatgagctagacttgattttaaagtagttgtgtaaagtttcggttattgtaagggtcctaatgtttagttttgtgtaaaacagaaa

SEQ ID NO: 10490 - DNA, 3000 bp, Unknown
  misc_feature (1)..( 3000): cDNA_ID_3036823_gDNA_ID_2213654_Annot_ID_181695 3000 nt of promoter + ATG
gattcaaaaaagaatttcacagttatgagtgtttgaactggaatagttttatgatgggtgaccttccgataaatgattgtcggaactatgcgagtgaggataaagcaagagaaaatatcatgtggtaacaagtctttaaagcttctcggacgtggcataccgaccgtcggacaggggtgtgctcatggggctgagagaggacgtaggatccacatataggaacggtcggggcgttaaatagggcttcactctccttttattagtctattagaatagttattagcgtaaggcgcagcaagccggcaaagatataatggtgataagaaaaataaattaagaattttagatttattttagtgaatttaaaaagtgccaaacttattacccaaaatatatgaaatatttactgaaatgttatagaaagttggaatattgttagaatatcatacattctctaaacattacttatatattttgtgcaattgtgtaattaaaattaacactcttgattagttttttttaattaagattttttattattatttataactaaaaatgattaatgaaaattatgataatccacctcattaagaggaacgttttggtttccctccctgttattgtttcgcagcaaatttacatgttacggctgaattataatgctacacataagatgaaaggtcgcggaaatctacatattacggctaagttattacgaatatacatatttttcatagccttgttcgagaacatgtagctcagctttaactgatggctcaactcattcaaaccatagtcatcgaacaccaactttacaagcttatcgtgcgttctttccgcataaatttgcacaactcttcaccctctatcgttagtgttaaatacaaattctttacccagttaccacaaataacaatttctagaaccggattgattatatcgggcgaaggatgtaagaaaatgaaaaagaatgaggaagacgatgacgaattggaagttccagtgatgtgaaaaactcaggtgaaaaagacgagttgaaaaaaagatgtttcgtatttcttttaatgatgatgaaatgaaatgttacatcgacgtaattttttaattgatgaagtagcaagtaagccaccaaacaaacatgaaaatttgcctaaataaattagccattaaacaaaactagaagtcagccgcaacatgaatactattacagtaattaaaaaacaaaaaaaaaacgacaagttaattcagtcgtttaatgttgtaactcaacctacaatctttaactcatctgtattgtttaataagtcggtcgtaattgcttgctattaaagtaattaatcttttgctactaagtcagccgtaactaggccgagttatccgttaatccagctcattacggctgatttatgacactcgaacataaatcagttgtaaggacatcccataactaagccgtctttgataactcagccagtcgaaaaagttaactcaaccgtgtcaagagaataactcagccaaagttttgacaatcaaccattaggtaaaaactcagtcgtaacttaggctgggttattcttgaaattctcataactcagacaaatctctttaagtcagccgtaatgtaggttggattatctcataactcataaaaattttcattaagtcaaccgtaattctacgctcagttatactataagttagctgttttctcataactcagccattttttcttaaatcagccgcaacatatcgtaactcagccgtccctgccattatattattttacggctgagttcattaatacatgtcagcgattactgacgtggcgacgcggttttgctaacatggcaatgaaactgaaaaatcgatttggggatttagggatttgaagatttggggattttgagatttagggattgaaaaatcgaattgggattttgtggtttgtgttaagcacaaaacgacgtcgttttagataataacgaaatgattaacttctgttatcgtttctgttaacgacatataacgttgtggtgtttttggctttttggccaagtcaacgtttttgtatttgtaaaatggctggtcaacatttttgtgttgttttatttggccacatacgaaattcacgtattaaatggtcaacattatcatatacacatgatatatcacatgaacaaactaatattttaagtttagttatagatagttcaagattacctattacatatatttttatgggcacatatcgctagtgtacactacttaccaaaattcataatgcatgaaagtattttactaacggctaatatcgctagtgtacactacttatctcaccaacaatccatgagggtaaaaagtattgtcaccaaaaactatttcccaagattttctttcgatgaaactaaattaaaaggattaccgacttataaatctcttttattcaaattagaaaacatgcttatattgctcactaagatccacatctaatcaaatcaatgataatcaataaaatatttctaaaacactattaaaatctcgagagattgaaaacacataaaaataaaaaacacgttaaaaaaactgatcattgtaaagtatacggtcatcttaacacaagcaaaaatattaatccatcaacattggataaacagactaacaacatttagaatcaagcaaatctgaataaatcgaagagaggttatggatacctgtgttggataagcttgaaaagagtaacttgaggagtaagttattaaagaagagaaaaggaaattaagctttagtgttctaggagttatctagaataatgtatttggaaatatctaattacaaatcctaggatacatcaaggtgtgatagaacttatgagatttgagagagatcgagactttaggttttgagagagtttcctaaagatactaaaaagagagatattcgtttatacttgtgttcttaatctttcttgaatactagatttggtatcagagccttgcaacg

SEQ ID NO: 10491 - DNA, 3000 bp, Unknown
  misc_feature (1)..( 3000): cDNA_ID_3036831_gDNA_ID_2213654_Annot_ID_181693 3000 nt of promoter + ATG
acgacagatggagaatatcaaatcacatatcctaacaaacgggcaagtttctttattagatcacacataggtttttatcattcctgtatatgtatattatacgatgttattaattattgtaaaggaaagtgtaataatccagccaaatatacgagagaacatgtagaaacgggaagtttttttgaaaggtatgtatgtttttgatataaaactcgtatgaaccggttttggccttataaactttcttcttttctaaaatagaattaatcatgaattgtcagggctgtagcattgttctcgttggctcgtagaaacattgagaatagaatgaaatctggagcagagatgaagaattcctcagaaatcgtagcatgtgtatcctccaaggagatacataaagagatggagaatattaagtcccatatcattacaaatagcaaccatataaaggttaagcttgagaaagacttttagtatgttatgttacaccctgaccttttatgtattgatttcttgggtcttgtccatacctatgtttttttttaatatcaaattaaaactgagtttatcatttattgcctaaaaagccgagtaaaagaacttgggatcgtcgatctcttccttcaaaatttggatgagtcggtccatggtctgaaaacactttctaatgtcgaattctaaaaacaatcgagaggttccccactcttccttgatccgtcgtaggaacgagtgggaggcctgactaatgctaatatgtatcgcttgtccaaagccacaaacttattaaccaattagcaaactgggtgttggtcattttggaacatgattatcatcctttattgatcttaaaatatgtaaaacatttcattttgttaacataaaacattttaaaataaaagtaaaatattattaaaaattaaaaaggaatataaatgaaaatgaattacaggaaaatgtaaaattaataaaagagtagtcttgaaagagaattcatagcaatttctatagaataaaacgtagaactcatatttaactggagtgaaatatagaaaaacaaaaactaataaatccaaaaatatttttgtgaaaccttataaagatgaaacattagtaaaatctagcaccagaatttaaattgatgagtgaaatgaaaattaataaaaaatatagaaattgtctttgaggttttaaaaaaataactttagataaaaattcatatgattttttagaaaaataaatataatctgtcacttacaaaataaaataattttgaactattatgtatgagtttatatcaataatttattttgtaatttaccttattgtaaaagtaatatatcttatttttattaatataagatatcaaatcataaaagcttttaaaatattttttagtcatctacatatattaaaacaaaaaatactttataaaaaataaataaaaattgagccacgtaactcggactattatctagtaaccaatggaaaaaggcaaatatattgaacgtatcaaaactttatatcatcgattgagataatagatctgttttattattcttgggatacgtagtatttaagaattgcacaaatacgatcctttgatttacaaagcaacccctagaaattattttattcgataaagtggagtttttctttactttattccacaacagacccaaccctaattcgtttcattctctcgtttcttccccaaaattctcaacttctcgcgctcctaaccctagccttcccaatttcctcatcttctagatccgcttttgtgatttggtaaatctcttctctccctcacttctaatttcgttacagggcaatgttttttacttttgatcagccaatttcaaaatcctcgtttgtttttcagaaatttctagggtttttttttggtgtgtgttttatggattgttgctatgatttagctgaattttgttgaattaaactgttttcttttgctgtttagttctattcaaagttttgtactttgtggtgaagacccaattttgttgtttctgagtcctaattcaaagactggaactttaactctttagtaaatgtctctttgtgagtaaggcatttagctttctctcctctatatataaaggtgagattttgatgagttcttgagtgaaggaagagttaaaaatgtagggtattatctagagtgtgctaatctggtatcagagtttgtgtgggattgatttgtacagactattgcttttgaaattccaagatactcagtttgttttccctctcttagtgtgtatggaattgttgctatgattttagaggattacagaagttacttggtttggtagctgacttttgtgagattcaactatttccttgtgttcttttgctcttttgttttgcttagttctaccaaagttttatcctttatggtgcagctagcctattcaaagactaaaacttaaaccctttagtaaatgagcaactctttgtgattaaaacattcaagcttctctaatctactaaaaaggagagattttgatgaaattttggttaatgaagagcaaaaatatgcattttagttgcggccattgtgcttatctggtgtcagaactcagaatttgtgtgggtttgattatatgctagctacatttggcttttgcggtgatttgctattctacgtgtgttctctatacgttatcaagtctcagtttagttcaaactgattgtgaattcttacagttatatgcgctttttgtttatatttaaacatttgcacgcttgacatttactaaaatgaacttattgtcctatcccggtttgctagactgacccttttaccggctatggttgtagtttaggcgtattacttaagacgatacaatttgcttgtgtatctgatgtaacttttttcttccgtttcgagttcctcaggtttctgtgggtatgggaaaaggtaagcttatattgatttgtcaatctggcggaaaatttgtgactgatgatgatgggaca

SEQ ID NO: 10492 - DNA, 3000 bp, Unknown
  misc_feature (1)..( 3000): cDNA_ID_3036827_gDNA_ID_2213654_Annot_ID_181694 3000 nt of promoter + ATG
gatcctctttatctacgtcccctgtttcttgaatctccatggtagcttgaatctgtactagtgtacattagtttgctttgatcctcttgagtatcttcctcatcatcacacacacgttcttcgtatacttttatacgtccgacattgtcttcaaaacttgtgtttttcaagtctaaaacttgttagagagaagctacgatctgtatatacttctttcttggaagactcttgagaaacttcttgactaacttctctgttttatgttctctcccaaagcagctgactttgaagctatcttagacaattttccagaaaaagcatagatggtttaagattctttcatcttgagacgatcaaattcattcattaggttctgcaaccttgcctcttttacactatctgctccaacatgtttttcttttattgcgtcccagaccttcttcgctgttcccagctctccaatttgtaatgtcatcacctcgggtatggatttccaatttgtaatgtcatcacctcgggtatggattggaacaagagatgcatggctatattattattctcttcacccggttctcctgtttcaatgatttcccaagctttgtgaaccttgagagcgatcttcatctttaaagcccatattgtatagtttgttgtattaagcatagggaattgaatcgatgtagatgctccagattcttttgttcttcccgttgaaacagcgagttctgacatcgttgcaaggctctgataccaaatctagtattcaagaaagattaagaacacaagtataaacgaatatctctctttttagtatctttaggaaactctctcaaaacctaaagtctcgatctctctcaaatctcataagttctatcacaccttgatgtatcctaggatttgtaattagatatttccaaatacattattctagataactcctagaacactaaagcttaatttccttttctcttctttaataacttactcctcaagttactcttttcaagcttatccaacacaggtatccataacctctcttcgatttattcagatttgcttgattctaaatgttgttagtctgtttatccaatgttgatggattaatatttttgcttgtgttaagatgaccgtatactttacaatgatcagtttttttaacgtgttttttatttttatgtgttttcaatctctcgagattttaatagtgttttagaaatattttattgattatcattgatttgattagatgtggatcttagtgagcaatataagcatgttttctaatttgaataaaagagatttataagtcggtaatccttttaatttagtttcatcgaaagaaaatcttgggaaatagtttttggtgacaatactttttaccctcatggattgttggtgagataagtagtgtacactagcgatattagccgttagtaaaatactttcatgcattatgaattttggtaagtagtgtacactagcgatatgtgcccataaaaatatatgtaataggtaatcttgaactatctataactaaacttaaaatattagtttgttcatgtgatatatcatgtgtatatgataatgttgaccatttaatacgtgaatttcgtatgtggccaaataaaacaacacaaaaatgttgaccagccattttacaaatacaaaaacgttgacttggccaaaaagccaaaaacaccacaacgttatatgtcgttaacagaaacgataacagaagttaatcatttcgttattatctaaaacgacgtcgttttgtgcttaacacaaaccacaaaatcccaattcgatttttcaatccctaaatctcaaaatccccaaatcttcaaatccctaaatccccaaatcgatttttcagtttcattgccatgttagcaaaaccgcgtcgccacgtcagtaatcgctgacatgtattaatgaactcagccgtaaaataatataatggcagggacggctgagttacgatatgttgcggctgatttaagaaaaaatggctgagttatgagaaaacagctaacttatagtataactgagcgtagaattacggttgacttaatgaaaatttttatgagttatgagataatccaacctacattacggctgacttaaagagatttgtctgagttatgagaatttcaagaataacccagcctaagttacgactgagtttttacctaatggttgattgtcaaaactttggctgagttattctcttgacacggttgagttaactttttcgactggctgagttatcaaagacggcttagttatgggatgtccttacaactgatttatgttcgagtgtcataaatcagccgtaatgagctggattaacggataactcggcctagttacggctgacttagtagcaaaagattaattactttaatagcaagcaattacgaccgacttattaaacaatacagatgagttaaagattgtaggttgagttacaacattaaacgactgaattaacttgtcgttttttttttgttttttaattactgtaatagtattcatgttgcggctgacttctagttttgtttaatggctaatttatttaggcaaattttcatgtttgtttggtggcttacttgctacttcatcaattaaaaaattacgtcgatgtaacatttcatttcatcatcattaaaagaaatacgaaacatctttttttcaactcgtctttttcacctgagtttttcacatcactggaacttccaattcgtcatcgtcttcctcattctttttcattttcttacatccttcgcccgatataatcaatccggttctagaaattgttatttgtggtaactgggtaaagaatttgtatttaacactaacgatagagggtgaagagttgtgcaaatttatgcggaaagaacgcacgataagcttgtaaagttggtgttcgatgactatggtttgaatgagttgagccatcagttaaagctgagctacatgttctcgaacaaggctatg

SEQ ID NO: 10493 - DNA, 3000 bp, Unknown
  misc_feature (1)..( 3000): cDNA_ID_3036788_gDNA_ID_2213654_Annot_ID_181705 3000 nt of promoter + ATG
ttctttgaatataggcagaatttctaaggcgaatctacaaatatgcaaatcttcaatactttaataaaacgcgaaatcgaattgtcgtcaaatattagtgtcaagcgtcaccaggggtggtgttgatcgacagttacgccaattttggtctctggattgcttctgcaacataagtcctctgttttgctcctaaattctccataatctccaaatacatctcaaacgtataaaacctggaaagtactagaaatgactctagaaataacaaaaagactctaaaaccagtacctaaatcattactaaaatcggtaaaaatcgaggtatatcatcctgcgaataagttagcacatttgaatggtaattttgatcatatgataggttcatcgttccctacatcatctttggcccaatgatactttgaaaacaaaaaaaaatgttttgttaaaacgtattgatgtaaaagtggaaaaggtctcaactcaacaaaataaagagtagcattagtagtaaaggattcattaacccccagacttaaatcacactacctttggtaggaaaaataaacatagggatgactctgtaagaaagataagttaagaacaatgtcactttgattgtggaggcaaaccgtatgatgtttctacttgcttaacaacgacttagctcggcttagtttggtcaaattccaagatataaatctctattcgcatcttccttgaaacaaaaaataaactaaaaccatcaatagtattaacaaaacataataaataaaaacatactgataacatcgtattttagcacacttttactatgttttttttaggttttccatggaaaaatcaggagttaatggatacttcaaggcatatttcgagtatttgagcttcaaggaagaataatgagtttttatgcaaaaagaagtagaagtcgacaaaaatccgtttcaagacaatttttgtgcctcagatgaagacgttcaaaagttatggcccgaagagtgaagacatgtcctagaatcgcggttttggaaataatcaatctaaaaccgccgaccgaagagacttgaacccgggcaagaaaaaagggcaagagaagaagaagagagaatggtgcgtgaaatgagaggaatggccgagtattaataattcgcggaagccagagaagagcccaagtctcgaaaatgtggagccgaatccattcgggcagagacgacttggtgagcaagttttgtcccgagcgatgcaagccaacttcgaacccacgccttagccaacttggagccgaatccacccgggcgagccaacttggtgagcaagtttcatcccaaagccgacttagtgaccaagtctcatcccactccatatgtccgaaccttgagcctataaataggaccttaacccccttagttaaaccttagaagctttcgcaccaaaactctgcccaaaccgagagagaaagaaagatcgtctgaaccttaaaaccacccaagagagagagagatcgtccgaacccttaacccgagagagagagagagagtccaagctagagatcgtcgagccttaggatagtccgagagagtgagttccggtttttgttttgcatgtttgattttccttcttgcatgttctcgattctcccttctcttagttttgtggttgttgtggttgagtttgttgaggttgttaaccgaatagctaggattgttgaaaccgaagcaccttcccctataggagtggttgtgatagaatagcaccattcgcttgagagggatggttgcgttgtcaagacattactcgctagtattcgggagacttttagagagaagtttatgaacatgtgtgttgaaaacgaaccgcatgtttcatagtgttgattggaagatcgtagtgtgtggagcttggagagtatccaagttaacgacataagcatgctacggttaagtgggatgtatctgaccttgccttgtgattccgttctttcgtggggtgtgcttgacgagatgcaagtgacctcaaggggttcgaaagacccggagagactgggttagctacccaagggccggtgtcgcttacacgacggtgtagccaaggtgatgctccggttatatgcctttgtggttataattcgggtgttcacgatgtgctgaggaaggcagtgcattcgggtcctaattaaaactttaagaaacgttatcttcttgttgtgttgtgtgttgcttgctaccttctctgtgtactctgattatttatgttatgcatgtgggattatgggtggtgattagactaatgtttccttggggaacccgagctcattgagtaatgctagattactcatgactctacttgttttgcaggtaaccttagaggggattagagggagtggtgaacactagggaacccgcagtagtttttcagtgtccttttgtataacttaaagtatgtattttcgtatcatgtacttttgggcctcatgccttggccataaaaacgatgtttatgttgtgatttttccttgtattttcgtaactctatgatattgaaatcggtatttatttaaaattatacgggtttcaaactgataaaactttgtccgagtcgacacaacatttgggtgaagtgagggttggcaagcctaagtggatctcaaatggggaaatgagtaaccttaagtgggctaaagatcggaatgtgtttctgaacctcggctactctatgggaattcatttccattgtggtgtctccgggccgtgccggactggccgagttctagtacggaccgggggcgttataacaggaaggtatatgagcatggttttgatgcttttgggatccggtttttcaaaagttttatcgagtaaatagtcgcaaaagacacataggataatccgggtcgttcaccactattaggatagaggggggaaatattagaaacctaagatcgttgttggattggatgcagatatcaaggcaagggtcggacgagaaccagtagagagatgtg

SEQ ID NO: 10494 - DNA, 3000 bp, Unknown
  misc_feature (1)..( 3000): cDNA_ID_3036960_gDNA_ID_2213655_Annot_ID_181714 3000 nt of promoter + ATG
tgtcacatgggattgccgttacaatcatgagggcactaaatatcacatgttgacaaacacctttagccatctcgtaccagctttgttttgaaccatcacttttcctgtgtatatattctgaatttgtgctctaacatgttgaaaattcaactgtctaaaccaatcagttgaagactgaaaatttgattgctgctggtagacggatacaatcatttctgccaatgtatagaagaccaatctctataataacaatattagttatgatgactcattgaactcttacgtaaacaggtcgggtttgttcttctcagctgtgccttcatgtatgacatcttctgggtttttgtttcaaaatggtggttccgtgaaagcgtgatgattgtggtaagtttttcttttttgctccagaccatcatgcaagaagactttgttagatattccaactacacatacttatctgtctgctccacactgatattatcggagaattgtacgtcttttcccattttcccacatataggtagcccgtggtgacagaagcggagaggacggaattccaatgctactaaagatcccacgaatgtttgatccttggggtggctacagcataattggatttggtgacattatcttaccaggactgcttgtaactttcgcactgaggtttgcactgttacaatctcctcttgcgctctctcacattattactatatcaagatctcaactaaactgagttattagaagcatacaaaagtatgaaatgatgcgcaaatgcggatatcaatgtaaatcaggacaacaaaccaatagaggtgctcagcgaaaacaacaaaatgtgaaaagggtttatcagaaacattggggtcatgatatacctttatatccgcatttgcgcatcatctctgacagattttttataaaacaaaatcgcttgaacctggcaaaaaaatcttataatccgacattctggttcaatttaaccttatgtccttatgctttgtgtctgtttaatgtggtttgcaattttttgaagaacttgtagatagaaatatacattacatagtctagtaaatagatgagtgtgaatgaatcaaatgtcttcagagaaatcagggtaaggttgcactaggtagacaaatggagacaagatattgtttagaaaaagaattgataactgtagggatgtgttttcaggtgatccatcttatcattttcagtaataaaaaggaaacctattatgataagtaccttaatctaatgttaaatccgatcaaaatcgtgcaccgttctgcaggtacgactggctggcgaacaagaggctaaagtcagggtacttccttgggacaatgtctgcttatggtctaggtatgatccctcacgtaggggagaaacgaataagaaatctagtaaaggttttttaatatgattcttgacaatcacaggtcttctcataacatacatagctctaaacttgatggacggacatgggcaaccggctctgctttacatcgtcccattcatactaggtaagaacactgaacccacaacagatgttttggaaccaaaagctatgtatgttttgaaactaagaatggtttgtggtgcaatgtgtcaggtactttgttcgtgttgggtcacaagagaggtgacttgaagacgctgtggacaacaggggaacccgacaggccatgccctcacgttcgtcttcaacctcaatcgtcttaaaacaacctgctatgtatcagatgggaacagataaaaatcagatgatcctctagtttttttttattgttaatacaacacaccccttcttaggtcaatatatatgtctctgtacgctttcacacaactagacaggagagcccataccacatttgccttaaataactcttttaacctctcttgctagtttctctctattattagacatgaaaccatgaatagacttggcttcttttcctgagtcatgatgatcagattttcttctataacatacatatgtccaactagtattttacagattactaatgtaaaagggtcacaagttttttagaggaattatatatagtagcaactaaaatttttcattaatatgactgatagtaataaaaactgatgctaacacttctaatataaagttgatgttgataaaagtctagcttaactgaaaagaaaagaaaaaaaaacgagtcttgaaaataaatcagaagttgttgttgttggtttgttatgggccgataccggtgacccattagagcacgttggacctatagttaaaatgctggaaaagatcttaaaaaaattctagtgatatttcaaaatccgatattcacctaaactttcgctttaaacatttgcttttccgaatttttttgataataaatattgctccactaaaaatataatcttaaattatatcgatatcacaagtaaagtaatcatcaagtcaagttcagagtctctcagatcatcgtaccgaatctatagaggaagcagccgatctcgctatcagtcggtaatatacactatcattctactttcctaatttctcttcttctttttgttttctttgagaattgcatgacaaacccttggaaaagggttgttttaaaatcatcatgaaatttgagaatatgatcggtggcttgattgaattttcgttttgtgtgagtggtctttctgtttgagttttaaaatttcggagagtggcgttttaagattcgataccatatccttggataactattagccagaacaatactttcaaattttaaagctttgattagagttttaaagcttaggggaggatcacaaatttacaatattgatcttatgaatagagaacctctctactactactcttaagatttgttgattaaaataaacaattgtggcatgtatggttaactttgatcttcttggtatttcgttctctgtttggccaagtaatactacatactaaagctttttggttgtgacattagtttgaataaactaatg

SEQ ID NO: 10495 - DNA, 3000 bp, Unknown
  misc_feature (1)..( 3000): cDNA_ID_1010689_gDNA_ID_2213655_Annot_ID_181728 3000 nt of promoter + ATG
gcatctgttccgtccacataaacgaaagctgcgtttaaacatgtcacataaagaagccttcatgggatgggaagcataaggattctaactctaaagtggtaaccgtaaagcatgacgacttacatcttcatcgtctttgtaaccaattttttccaagatctcaaccatagacgtcaggtcttttcccgagcaagcctcagcaaaaggagacggaggtgacgcaaaagtaccactttgaggcagacccattagaacatgagacagaacctctgtgtctttctggagagatatcagtgcagtgaccaaagattttatgtttggtcgctcacgagcttcatactgaagacaacaagatgtcaggcgtactaactccgtaccatcactgtctgaaaattgtccctccaagcaggaatcggttagagtctgaagatttctgtctcgaatcaaatcaagggcctaaaacacacagcaaaaggctgagataattaataaagagaattcaagaaacgattaaagtagctaccatgggcacttacatggctaggaggaatatgctttccggtgagaagatcaagcagaagagtgccaaaactgtaaatcacactctctgctgtgattctccctgtatcaacacacacttaagtctcaagttgtagaaattgttggaaataatatgacctacgaggagggtgcaaatcaatttcaccagttcgtagatactcaggtggggtaaaagcaagatttgtgctataacttttcccatcccgactattcttcattaacccaaatgttgaaagtcttggattacattccttataaagattcataaacgcattagtgggggaatatagcataaaacaaaacatggtttcccggacaagagttgcgtttaagtaattacctcgtcaaataaaactctgtaagcattgagatcatgatatagcgtgtgtccattgttactacagtattcaagagcttctgaaatgtatagagcaacccttagtcgcatcgcccatttcattggctctgtatcccctggtagatgataaaagtggtaagcaaatcttaggagaaaatcttgaaagaaaatcgaaagacaattgatcaaaggcattttctttttacagtggaaaaggtgtttggctagtgtctcattaggcataaactcagccacaagtaacctctcgccgccttcacagcaataaccgagtaaattggccattcttttgctgcgtagctgaccaaccaatcttgcttcttcctggaaacagacatatccaaagttaatagatttgagaattggcaactagataaactgaaaggtacatgccataccaggaattggcgaggatcaggccaggcagttccagaaaagcgcttgatagcaatcttcatatgattctccaatttcccttgatagacaacatttggagctgtttctccatgttcagatacaacattctccaaagcaaaacaagaggtggcgatcttaagctgttctagtgagtattcacgaaaagaatgcacaccgtttacctcaccattctctttgttttctgtaatattgtaaaaaggggattacgatatcagccaaaagagggcttgtcgttgtagcaagagagaaaaacagagacgtcaccaacatctggagcttcaagagcagtagtcttgtgtgaacaacatgtaccaatctttgagctttgacctcccatggatgcgttgcttcaaattttcaattataaggtaactggggtaaatatgtctggaaacaaggagaaatttcccaatcttactacttacagagagatatcacgcagagatcaaaattgaaaatggggtacagaaataggtcgtaccttgtcaagtcgctaccattctagtgagccaactcggcggctagtgacagcgagaccagttactaatttggaccagatgaaagaaagaagcaaaacacagctgaactaggaagccttcttatctagtcatctagatacacatttgccgccggtattcgtatcgatgggattctatttctcgcactagctagtagctaaatccacgaagtttccatatataactttctcgatatcaataagaggctttaaaaaacactccagaagaagagagactgtattccgatgttgaagtagccaaagcagaccgggaagtgtcgctagacaaatagtataccgacagagtataaatattatggttggacttggagaaggcaaacaaagaatctaaagccgccacaaattttctcaatttaattgatcacgtacaaaaaatattggggttttatgtaagcgagtgtgtctgtctttcggtgggataagcccatgggcttatgttaggccctcattgaccaacaatttttttctgtttggtcctcaattaaccaaaacaatagaaaacgtttttgtgagtccaaaggttttattttctcgacatgacactgatacaattggttgcttattttgtccaaatccattctttggataatatgatgatcaatatctgcagtttatcatagcgcaaaacccgtttgaagagaaatgacgaaatcgaaggctaattattgtttttttcgctaaattctaattaaatccgcacccaatagattagcaaagtctacgaccaattgtgaggaaagaaaaagtcaaaaaaattgaaataaaaagaaagaaaacatgtacatcatgaaacctcaactccccaatgatgtccggaacaaacttcaccacatgtgcttgcatatacacatagatacatgtgtattatgcgaatgcgtgaataactgaatataatatagactcactctaatatatctaatgaagtaaatatggcaacaacgtgacagcatctaagtcttcttggttttaagacgtgaccagcctaacgacccaaccaaactacttgtctattcttcctcccaccctctaaaacccccctaccttctctactttcagatcatcaagccccaatttcaagcagagaaca

SEQ ID NO: 10496 - DNA, 3000 bp, Unknown
  misc_feature (1)..( 3000): cDNA_ID_3036913_gDNA_ID_2213655_Annot_ID_181727 3000 nt of promoter + ATG
acaaggttcactagctgctttataccaatgtatcatggaaattgcagtagttactagcatatatcgtgctaattcctttccagccactgttttttgtagctccagtaccaccatcagagtttcagcattcagaaactgcgcaagctactttaacatgcgggttagttttcaatactcttcctcacatgacatgtgtgtcctttctttgtttcttaaaaggtggtgtgatctatttgttggctcttagatattccttgtgttggaactattctggcttacacgaagttattcttggaacaaccggtagaaagcaaggcacatcagctaaaggagctctgtatccgtctactcaatcatctatatgcaagtaaggggatgagccttgttatccaagcatgaccttcattatttgtagttgatatcatattcatatatttttctagacagcggttactggagctattcttgaaagaaactcatggacacaaaagggaatcttccaagtcaaaaaaatcgtaccgagaactgaaggtgtgtgcgatgctgattcttttctgcagctttaacatgcttccactggaacaactaacatgctaaagtgtataaatctcatagtgagtttttgacatgtatgctgcaagattgtgattttgtgatattgttctctggttaattctgagatgatttacgtttcttttttgttttaattgtatgcagaacaaagctacggaatattatttgatgtcaaagatttttaaaggaaagtatccattcaacaattggctaagaaaacccttgaattgcgaggattttctgataaattagacgtgaggtatgtcatcctatttactctctcttttagcgtatgttctttgcatcattagttcattagcatcaacaagttgcttgaaattgccagctttgttcagggaagcaaagtaattatctattgggatgattattgcgtaccgaaaaggaaaaaagaaagaggtgagatcttgaatcacagaagatacaaatagtaaagaagttaaatgaaaaatacccaagaaaacgaaagcagaaaatatgaattttgactgaaacgaattaagatgcggtaagttccattcagagattgactcgtcccttgatgatgtcgaggctcatctcgctaggatctgttgcttgcaattcaacttgaatcccatccaattccctcttgaacctgtcctttgagcttgcatacaacatcttactcctcactcttgatgtatcaggtgacctgaagcaagttgatgtctcaattataacatctaatttttcaaatcattaaaaatacaagggcagggagttgtaccatgcgatgaaaaagattttgctcttctggcagttctcaggggtggtgaaatcatagtcatagacagcatatcggcactcatcctcgggaatagatctggtgaaatcttcgtaagtttcttctggattcccaagcttgtctatcataacttgctgagccttctcatcaattttgaacacaatgaacctatagttcctctttgcttttaactccaagaacttgagcttgcactcatcgctaacgtgcatcccagacgctgaattagcctgcacagtcaaacacatgcatagtcagttaacttatatgatcacaatacattacatgaatggcaataccagattgataaaaatgaaatgtaggaagagaccattgttctctgcttgaaattggggcttgatgatctgaaagtagagaaggtaggggggttttagagggtgggaggaagaatagacaagtagtttggttgggtcgttaggctggtcacgtcttaaaaccaagaagacttagatgctgtcacgttgttgccatatttacttcattagatatattagagtgagtctatattatattcagttattcacgcattcgcataatacacatgtatctatgtgtatatgcaagcacatgtggtgaagtttgttccggacatcattggggagttgaggtttcatgatgtacatgttttctttctttttatttcaatttttttgactttttctttcctcacaattggtcgtagactttgctaatctattgggtgcggatttaattagaatttagcgaaaaaaacaataattagccttcgatttcgtcatttctcttcaaacgggttttgcgctatgataaactgcagatattgatcatcatattatccaaagaatggatttggacaaaataagcaaccaattgtatcagtgtcatgtcgagaaaataaaacctttggactcacaaaaacgttttctattgttttggttaattgaggaccaaacagaaaaaaattgttggtcaatgagggcctaacataagcccatgggcttatcccaccgaaagacagacacactcgcttacataaaaccccaatattttttgtacgtgatcaattaaattgagaaaatttgtggcggctttagattctttgtttgccttctccaagtccaaccataatatttatactctgtcggtatactatttgtctagcgacacttcccggtctgctttggctacttcaacatcggaatacagtctctcttcttctggagtgttttttaaagcctcttattgatatcgagaaagttatatatggaaacttcgtggatttagctactagctagtgcgagaaatagaatcccatcgatacgaataccggcggcaaatgtgtatctagatgactagataagaaggcttcctagttcagctgtgttttgcttctttctttcatctggtccaaattagtaactggtctcgctgtcactagccgccgagttggctcactagaatggtagcgacttgacaaggtacgacctatttctgtaccccattttcaattttgatctctgcgtgatatctctctgtaagtagtaagattgggaaatttctccttgtttccagacatatttaccccagttaccttataattgaaaatttgaagcaacgcatccatg

SEQ ID NO: 10497 - DNA, 3000 bp, Unknown
  misc_feature (1)..( 3000): cDNA_ID_3036921_gDNA_ID_2213655_Annot_ID_181724 3000 nt of promoter + ATG
ttttgtgtgtctgggttaaattttttaattacattgaggcattattccagtagggatcttccagataagtaactattacgagttactattcctcatttggtttgcaggatgtggtttcaccgacctctaagagccgacgagtggttgctctatgtggtagttttttctatccttgtttcttatgaacatttcagatcaaatgtttgttcagaataaatgaaaatgatttttggtatagagttgttttataaacttgtttgctgtaagaggttcacccacttacaacacaaaggatgctgcttgcagattgtgagtccaactgcgcatgagacccgtggttttgtgactggtcaaatgttcaacaggaaaggagaggtactctttctctattcttttgaaccctattatacatacatatctggaaatgataagtgataaaagaattccttttggtatgtgtttttgaatatgagaacaacagctggttgtatcattaacgcaagaggccctattaagagaggctagacctccaaaaccctccggcacgtcgaagctctgaatggctctcaacgtaagttaaataagatacattattacgagtacaaggcgacgaataaaaagatcaaaaaccaatctgggtgggtactaaataaaagattttattagacaaactcataatgtcaatgtagcacgctgtatgtacattgtttgattccggccttctcacctctatcatcatctatctataaattctcttgttttttttttttgttttaaaattctttctcacaagaacacctttagatcgattcgtgggccagaaaattatgggcccaagtatcaaattagttttcgtacgacccattttggatccgcgggggtatctttgatggaaccggtacacctgcttaaccggccggtttatagttttgtatccatttgtgatttgcgggtttctgttgccacctccccactctcctcgcttttgttggtcttggaaaaaccctgggattttgggtatctctgagcacgaattctacattctcatggctttcgaacacagaaatgaagacctaaattccttggattcggaagaagatctggagaaaatggagtcagaggtggagcaaatgtcgcgcaaggtttccgagtacaggaaaagcctaccgagtaatctgagcaattctgtgatttcttctcgtagatccaattttcccaacatcgattctttgggctttcgcacaactagcacaggttcgtacgtttctttgcttatatttagttagataccttccttctcctttggtttcagctggaattttagtctctttttctttctagatgatgtaataatagattgatcctctacattattcgtggatcattcttgtgaagaccaagttgtttagcagcagcagacttgccttttgattgtgatgtcgttttttgcatttaggtttgtgtcatgccatgcgtgtagaatattgtgatacttgctactataccctctggatgattatgttcatgagttattacgcttaattctgaggtgatgatacatatacaaggcttttccattacaataaatcatgtatttttgtggcttagaatcgacaagcatgagactatgtgatgatatgtttagctaagctgagagaaaatgattgtttagccaatttttgtttacagataccatgagataagtggccacattaggtgacactaagatttcatagcattgtaatatacacaagtctctagtgaactgctgttgtgataaccaactcatcagttattttgttccttgcaagtttggaagaacctctagtgtcaagagatggagcacatataggtggaatcgaacaagaatctcgagatagcctgattcagctcaaagaaagagtgtacgagaacattgccacagtgcctctagttgtagagagaatgcgagagagtaaagagagaatcgacaagtccatttctttcaatggaactactatgcacccggctttcacaaggcggaaagctagctaactgatcagtttctacttctccctattggctttaccactcaaagaaagctaatgcataggaggagatatggctggtatttctttctactatattagtatcaaccaacatctctcgcatttagaataagagtataccataacctctgttttgattgtgttctacattgaaacaggtctttctctgattttaatatggactcttatagaatcttgggctgattctacaccctgtatgtatatgtaagaatcacataatcagatggttgcacaattgtcaagaacacccaaatccaagcttgcgatttagcaatctcacccgtgtaagaaacttaaaaccataaaaccaattgatataagagcttttctagcaaaaacttaaaaatataattaacaccgtcgaaaatggtggaggctactagagcgagatataaactttatcaccgtttaatcgtgtgggattttgaaatgatatgaacctattgcaaaaagacaaaaaaaaaatataaacggaggaactaggcagtgggaccggagatccaccgaccggaaacgaagaatccatagtaagatagagcccaggggttcggtcgtatcggaccggtcggatttggattctaacgacaagtgagtggacccccagaaacgacagacgtaagcaatgacaacatcaaactcatcgccacgtcagcaacggagttctacttgcgaaacgtgtcccggcagcgtcatccacccacgtgtgttctagaagctcttctcctcctccgtatctcgacacgtgtccactccctctccttatataattgacttttctctcattctttccaagtttcaaaaacgccaagtttcagaggtagagagagagatactacaattgattaggataggatcaggatcatcctcaacaacctcctcctaattcctcctccattcatagtaacaataatattaagaaagagggtaaact

SEQ ID NO: 10498 - DNA, 3000 bp, Unknown
  misc_feature (1)..( 3000): cDNA_ID_3036925_gDNA_ID_2213655_Annot_ID_181723 3000 nt of promoter + ATG
ctgacttttgatatatattccaacgacaagcgtgtccaagtttcttccctcacttgtcattgcagcttacgtgtttggtgttgccgcgtgatcactgtcatttgcttgagactaattccatctggcaatcggatacgtcacttgacaaatgctctttagtggaacgcattttgcaactcgaccctttagaagtacgtacggacggtgttcttctttatcacatttctttctgcttctggcaactgaatctctttttctctgtgcttctttcttctagttgaatatcttcagggggatcacactacctgatgctcctatatttggaaaggtttttggaggacaatttgtcggacaggtatcgcattttctctaggaaggttacattattatgtctctgtaaaccttgctgatctgattcatgtgcatatatatattgcttgttaacagtgataaccgtaaccactactaagtcacttttaccaacattttacaggctcttgctgcggcgtcaaaaactgttgattttctcaaggtcgtccacagtttacactcctattttcttctcgttggagatattgacagtatgtacataatctcactggggcactttctagccaccaatgatgcctttcttccctattgaaacccaccctgctgttggattcatctgattatcatagtttgttgctcttgcttgcagtccccattatttatcaagttcaccgcatacgtgatgggaacaactttgccacccgaagagttgatgcagtacagaaaggaaatatcatattcatcttgctggcatcatttcaggtttcccattttattctttacaagatagcttatgaatctctacgtccacctgccaccaagagagaatagcctttcacaaaactgggaaaattgttttcttaaattttctcttttattactttcatagaaagaacaacaaggatttgagcaccaggagtcaaccatgccctctgtaccagatcctgatacggtaaatcatttctccagatttaagggttccaataaattgttgtgtgttttatttttcaccattatctgctacagcttctatcactggaggagttgcgtgaaagccgtataactgatcctcatttaccgaggtaagtggtagtgttttccaatgtatgataacttatatcaaaagctcaagttggaccaatcttccaattgtttctttctttcaggagttatcggaacaaagttgcaactagaaactttgttccatggcctatagagattcgattttgtgagcccagcaattcaacaaatcagacaaagtctcctccgaggttaacaactcgctgaaataaatcaattatatcatagagtactcttgagtgtatactcataaattccattaagtatttcttaaaaaaaaaatcaagaaactcacaatgccttcttgcagattgaactattggtttagagcaaagggaaggctttctgatgatcaagctttgcaccggtaagtaactccatctatgtatatcaaggtaaccatctaaaaattggtattattcatctggtaacaatcctttaaactttaaaggcaagaatgattgtagacaagtgaatcaatggtgttttagtatcccaagttgataggttgagacttgtaaaaggccaaactttcttaatagcattgaaaaactgacggtatattgaaattcaatttatcattcttagcaaactaatcatttggcaaagccatgttgatatgcagatgtgtcgttgcatttgcctcggatttaatattttgtggtgttggtttgaaccctcaccggagaaaaggggtgaaatccgccgcacttagcctggaccatgcgtaggtttttattttctcttggtgatgtatgagttttgtgtgtctgggttaaattttttaattacattgaggcattattccagtagggatcttccagataagtaactattacgagttactattcctcatttggtttgcaggatgtggtttcaccgacctctaagagccgacgagtggttgctctatgtggtagttttttctatccttgtttcttatgaacatttcagatcaaatgtttgttcagaataaatgaaaatgatttttggtatagagttgttttataaacttgtttgctgtaagaggttcacccacttacaacacaaaggatgctgcttgcagattgtgagtccaactgcgcatgagacccgtggttttgtgactggtcaaatgttcaacaggaaaggagaggtactctttctctattcttttgaaccctattatacatacatatctggaaatgataagtgataaaagaattccttttggtatgtgtttttgaatatgagaacaacagctggttgtatcattaacgcaagaggccctattaagagaggctagacctccaaaaccctccggcacgtcgaagctctgaatggctctcaacgtaagttaaataagatacattattacgagtacaaggcgacgaataaaaagatcaaaaaccaatctgggtgggtactaaataaaagattttattagacaaactcataatgtcaatgtagcacgctgtatgtacattgtttgattccggccttctcacctctatcatcatctatctataaattctcttgttttttttttttgttttaaaattctttctcacaagaacacctttagatcgattcgtgggccagaaaattatgggcccaagtatcaaattagttttcgtacgacccattttggatccgcgggggtatctttgatggaaccggtacacctgcttaaccggccggtttatagttttgtatccatttgtgatttgcgggtttctgttgccacctccccactctcctcgcttttgttggtcttggaaaaaccctgggattttgggtatctctgagcacgaattctacattctcatggctttcgaacacagaaatgaagacctaaattccttggattcggaagaagatctggagaaa

SEQ ID NO: 10499 - DNA, 3000 bp, Unknown
  misc_feature (1)..( 3000): cDNA_ID_3036928_gDNA_ID_2213655_Annot_ID_181722 3000 nt of promoter + ATG
gaagatctcctcatcaacgatcaggtttgctacttaatctaaaagacttaagagttatcttctgtagatcgtctcttcttcttcttctgaagaaaagttaattaagctatgattgatttcatatttggtgctgacttaagacttaagagatgttatacgtttaatatgggtttacacataatttaaaattttagcacttgtttttagtatattaataaatatttaaaaatatacttttatttaactcttaacacttgttttaaaacataactaaatgttaaattctccccactaatattattcccggtatctaataatctatatacagcgttcgtctttcttacataaggaaaacaattcttaatatgattttacttcaatttgaatcttactaggtagaagaaattaaaagtaattatactcatcattcttctcctctcattgttttgtctacataaagaacatcatcaatccaagcaactatgttaaaagctaaaccttcaagaactcttgaataactctctaacacagcttttccaacatcctgcaaaccacaaaccataaattgttataatattcaataaaacatgattcaggtcactgtttgtttcttaattaccttgttgcaatgaatcttgcaaatatctaacgatgtctgagacaattctgggtaccgttgtttcaaacagaagagcaaagactctgctctctcagccaaaacatagttcttgtcacttctctctgtaattgacattaaatctttcaccatattccatgaagacttggaattgttaagacaagctttgcgtctccatgtgtacattgaagcttctactctatctgccagctgaagcgcttcatgttctgatacaatcttgagacgatctagaagtttttctggtgaaaaccgccctgaactcgtcatgtgtcgatagattgcatctcctgtgctcgcttttccgctctgcaaatgcataatattgtaagcaagaaaatgacaccaaaaatagaaaaccaaaacttcaaaatcatcttaagtgtggttacctttggaagagttgccatgtaagaatcaggaatatccatttcaccgagtatgctgctattgatggccatagcagctttatggatttgattagtgctctctcgcttgctcttaagttgtttccttgccttctctgataaaccttgtaatggaaccagaggaatcggtaaccaccatttctcttctttcctctgcacaatcactttcctgaatgatccagttgcggaacgcgttgacttcatcgacaagcttccttcttctgcataccaaaactctgtcttttgaaaactatccaatgcctcctgcagaaaacaaagagaatgacttttatgaggaatattaaccgagtcaatcttattgatgatagcttcttgttctggtgtagtaactaccataagcatggaatctagttttctgagtgcaggcagattgatgtagatatctgctcttggtctactctccatgacctgacaaaaaaaccgcaacagctatttttaaactattgatgtttatttcagtttttggacttatatctataagcaaatcttgtttacctcaacagtggctccattgcttagattctgtgactttgggataaactcgaaaatatagtcacacacagagagaaggcaattcatttctctcttccacgtcgtcttctgctctatctccaatggttctaatcttagattctgtccaaaaacagtagctgcaaatctcaaaatcaaaagacattaactacagtttctctagatggcttagtttgaaagtcacaaaactgtgaggcgtattagtgtttagttaccataaagattggttatagcgtttgagattgtcactgcggtgcaaacgcctttgccgcttcctgacatatcttccccaagcagaagcttcgagaatctttccttcatcgtctccagctctgctacgaaaccgataacagtttcatgattataatgacaaagaggaaatacagacacagagaaagagagagagacggagaaacacaaaacctggctctgaaatttcttggaccgcaaggtgctcatcagtctcaatctgattatgtttcaagtcgaagacagttggaaaatttgagctcgcagagttgttggattcggttaagacaggccaatcactaggagaagcctcagtgcagaaactgctggtttcatctatttggtctgaaaagcctcctccagaggtttcagaacatgttcgatgataagcaaaagaatctgtgctcattgttgagtaaaccggagtttcagatgctgaatgatcatttggatcgatgggaccaggtgactgatgatagcccacatcgtcgttttcttcgtgatttggcaaattctccatcttctcaatgttctgtttttgaaaattcctctgcttttgttgatctcttgttttaataaaagaaataaagcttagaactttcgttgtgatgtatcaggaaaactttagaatatgaatctaaatccgacaattagaatcgggaattatttttgattcttggatagtgaaattttgaggaccagatagcagtaaagtagaagaattgttttgtttttttttggccaaaagcagagaccgttaggcgtgccaaaatcaaaaagcaaaacaaaacataaagaaacgaaaagaaagaaatgaagtaatcacaacattatttatcgaaactttcacgaagatttattttattactataacaaacatttcgcttatgtcgatcaagatacatgaaagtctgaaacttgaaattttgaaaaacgatattaaggaagaagaaaaaagcaacggtctttattttatttacctttaaggctttaaagcttctgcaaatttgtctttgaatttgaaacgcttgaatcttttataacgtttataaaacactctcttttccgcattaagctttctacacaatttatcggtgcccggaaaaaacttgaaca

SEQ ID NO: 10500 - DNA, 3000 bp, Unknown
  misc_feature (1)..( 3000): cDNA_ID_3036932_gDNA_ID_2213655_Annot_ID_181721 3000 nt of promoter + ATG
ttgtgaaaggctattctctcttggtggcaggtggacgtagagattcataagctatcttgtaaagaataaaatgggaaacctgaaatgatgccagcaagatgaatatgatatttcctttctgtactgcatcaactcttcgggtggcaaagttgttcccatcacgtatgcggtgaacttgataaataatggggactgcaagcaagagcaacaaactatgataatcagatgaatccaacagcagggtgggtttcaatagggaagaaaggcatcattggtggctagaaagtgccccagtgagattatgtacatactgtcaatatctccaacgagaagaaaataggagtgtaaactgtggacgaccttgagaaaatcaacagtttttgacgccgcagcaagagcctgtaaaatgttggtaaaagtgacttagtagtggttacggttatcactgttaacaagcaatatatatatgcacatgaatcagatcagcaaggtttacagagacataataatgtaaccttcctagagaaaatgcgatacctgtccgacaaattgtcctccaaaaacctttccaaatataggagcatcaggtagtgtgatccccctgaagatattcaactagaagaaagaagcacagagaaaaagagattcagttgccagaagcagaaagaaatgtgataaagaagaacaccgtccgtacgtacttctaaagggtcgagttgcaaaatgcgttccactaaagagcatttgtcaagtgacgtatccgattgccagatggaattagtctcaagcaaatgacagtgatcacgcggcaacaccaaacacgtaagctgcaatgacaagtgagggaagaaacttggacacgcttgtcgttggaatatatatcaaaagtcagcaaatacctgggacatagcaacaatgtctgctgaatgaacgttcccagataaacctgtaggaggaagaaaaaagacaaggaagctgagcatatatcaccaaacccaaggttgaacagaaagcattcatctctcaccaacgccgaagtaatcatactgtttcaagaggaattcggaacggttatcttcttcgtctggtccggaaacctgagcctgcaaacaagaatcaaattataacaatggcgaagatagatacatcgatatctagtctcagaaacaaacctctccttgcaaaataaaataacatccatcccaagtttgatcttcacgaaccacataatcccctttcccttcaataatacaatagagaacaacacagctcaatttttttatatcgtgaaatcagagagaagaataaatccgaaattgagaatggaccgaccgtaacgtttcggcacaacaacttgagcaattttcttcagagaagagctcggtaatttctggagtaaagggacgtttccaaggaactcgacaactacaaaaacagagcagcaacaacatggaattcgccgaaaatctcactacgtcattcctcaatctcacgttataggcttacctgactcggtgttcatggcggattcggctagtcggaagaaatcgccggttggatgatgatgattaggtgtgagaaaatgtggtttcctcccacctggcaaggtaaatcaattgtatcaactaccagctccggtttatggaagaatacgtggactcggttcgatttttatttctctcacgtgttataaataaaataataataattagtattaataaatgaagaaatatacaaataatattggtgtgatgtaatttaattcttgagatgaaacaaaaagcaataaacaaatcctacaacctcaaggcccattaatggctttaaggccttaaaataaatccgaactaagtaaatttctaaatggcccatgagaagagacgataataacagaatctcagtcagctgttattttaattcgtttctagtctaatgtttctatttgaatcagtatttatttttcttttcgtttaatttgcttgtttaaaaccaatggttactatatgcaagttatagtaaccactccggacgggttttcgtcttgttcgattatcactcagtggttaattaaattgttaccaactcctgaaagctgttatttttcgtttctagtctatgtttcaatttgaatcagtattaattttctccaaatcatggatgctttctcgatcgattgggtctcactgtcacgatggattttcctcctacttaatcttaaagcatatgtacatttggaaacagatattctctgtagctatgtgtttctcgcgtaacacgctaggtacctttggggtttatgatttcgtatcttcaattagttgttttagttgaaatgtttgaaaaaacatttcacaatctcaaccgtaggatgagtcatccttccccatcggacggtccacattgttcaagttttttccgggcaccgataaattgtgtagaaagcttaatgcggaaaagagagtgttttataaacgttataaaagattcaagcgtttcaaattcaaagacaaatttgcagaagctttaaagccttaaaggtaaataaaataaagaccgttgcttttttcttcttccttaatatcgtttttcaaaatttcaagtttcagactttcatgtatcttgatcgacataagcgaaatgtttgttatagtaataaaataaatcttcgtgaaagtttcgataaataatgttgtgattacttcatttctttcttttcgtttctttatgttttgttttgctttttgattttggcacgcctaacggtctctgcttttggccaaaaaaaaacaaaacaattcttctactttactgctatctggtcctcaaaatttcactatccaagaatcaaaaataattcccgattctaattgtcggatttagattcatattctaaagttttcctgatacatcacaacgaaagttctaagctttatttcttttattaaaacaagagatcaacaaaagcagaggaattttcaaaaacagaacattgagaagatg

SEQ ID NO: 10501 - DNA, 3000 bp, Unknown
  misc_feature (1)..( 3000): cDNA_ID_3036936_gDNA_ID_2213655_Annot_ID_181720 3000 nt of promoter + ATG
aaacagtgaagagctcaaaattccatcttttggtagactaaagtaagaagatgttcatattctagattacaaagctgtgtattgttacttcaggaactaacttcgaatgggacgcagagaaggaaactgaaaggattctgaggacagcgaggaggacaaagaggaagttcggtaaccccataataattaactgaaattgaggtaacttagaagtaggaggagcgtagcctcctctgttttacatgtctatatctgaagcatgtttaagattatttaaaattgggatagattttcacagttgtgactctattggtacttttttattagaaggtatgtcaggttcatcaattagtaattgagaaaaaatccaacaaaaagttataagaaccacttgtttttttttttctaatgtaaaatcaaagaggtgttcattcaaatttggatgttacttttacaatttaatattcttaatacaaagaaacaaatcttaccatagttgttcaattaactaccaaaagtttgagttgtcttgaaatttttgtattgattttgaatagattactttctttttggaatttgaatagattacttaatgaattaatactggtactaaataattaaatattttcaaccataaatgataaatgcaagaaccaataatacgttcatttttggaagatgttaaataacagtagattgtgttcagatttgttctataaacaaaagcgatgatacaatgaccaatcaatctgttagtgaaaaatttcaccagacagaaataataatttcctctctttcttagtaaagagtctcatcgtcgaaaacttttggcttttaaatcttttgttgtcagtgtttgtaagagatctgagattctaaagtatatcagaactcgttggtcagttagtatatatctgaaatgccagtcgaaaaacatgtggaagaaaagcttcgctcaaatagaaaagagagaggctggatatctggtattttcagaaggaagaagagatcaccacaagaagaagaagttgataatgaaaataactcatctgaagattctcgtttgatgggagccaagaatttgcatttgtttctctctgagatcatgagaaaactgaaacatgcaatcagaaaggagaaaccggacaagagattgttagggaagaagaaaagctttgagaagagtttgtcaactaaagatcatttctttctcgagcgcatgacttcaatatctcaaaagagatttcatcaagaacataatgatccaaacttggcaacaagcaaacaggttcaaagaaatcacgaaaggattgtatggcttcccgagtattcgtctccttttagcagcccgggaagaatatggaaacagaattcaaccgtgcttttgaggtcttcttcatatgatttcatcaagtccgaaacaattgcaggtagtttatcttttctctcatttgagatttaaagtagttattgactatccaatgattctttgagactctgcagatgattcaataactttgaaagagataggaactgcttcatcaagtgaaggtagtagtagccctcttctatctaaaagcaatcagattgttgatgagatgtcaaaagttgcagcttatggtgcagagaatgaaggtgaattcttggaagaggcaagttcacttttgatttctatacaaatttttacatgaaaaaaacacagagaataactataaactaatttggttgcttttgtttcttctaacagacactgtctctcccctctgtgggctcaccatctcactatatatctaaaactgaggaatatgactttgttcttgaaccactattcataagtccagcaagaggtatgaaaagaaaggtccaatattactggagttagattttaacatgaactaacattgactcatcttaacacttgctcaggtgaagcaaagatacaacctttgtgtaaccaattgcaagaaaagaatcgtcacaaagaatcagtgtttaagtatgtaaaagcggtgttagaggcaatagactcaaactgggaagagctgtatctgaaaacagaaatctctgaccagcttctatatccggcattgatcagcaacataccattctatccaaatcagctttgtgttgaacatgagctcctcttcgactgcatcaatgaagttctcttcgaattctgcaggtttcctcaatgggtttcctttgctgaaaccaggacccaagtcttgccatatagtgttgaaagcattgttcccgaggttcaagaaaaggtttattgtcatctcttgccaatgcaactccgtcgatcgttggaagaaagagttagagaagatatggctaaacacaggagctggttagacattagatgtgaccttgagtgtattggctttgagactagcgaattgatattgaatgaattattggaacagctgatgcttgagcttgaagataatcacaaaaatggttaaattgcattaagatatgtaaagtaacggagatattaaaaaaattattatccaaatcaaaatgtcaaatgggtatgttgggaattttcgtctctttctaagcaaatcagaaggtctagttaattagttatcaaacatatttgggcctaatacgagattgtattactaagtcacatgggccatcgaagaagtcacattgagtgatttaaaaacgataaccatattgtgggggtagtttgggaatttcgtctgtccatattgatttcctttttcttctccccgctcccgttacaaagatttccatttttccatgtttatgaatatagcagtaagtagtaaccaaccccagagagacctaatcgatcgcaatttcctctctttctcatcagcaagccatcttcaatttcttttctctctttttacttagatcactcatgatctctattccacttttcaaatcaagtaatctatttgtgtgtgttcgatttatgaagaataacaacaaaatcgcttttcgttgtttgggggcatgacg

SEQ ID NO: 10502 - DNA, 3000 bp, Unknown
  misc_feature (1)..( 3000): cDNA_ID_3036948_gDNA_ID_2213655_Annot_ID_181717 3000 nt of promoter + ATG
tgaatcaagatgttcgagaaagtaaaaaaactttgttatgggctttgaaaaatcttcaagtcaagaagattttccttcttcatgttcatcttccattttcgttgaccacttcttgtaagtctttttcttttgttggtacattctctacgttaacttttgcaaattttgttttgttggggctgccggggatactttcataaggggaagtagcttgtttatggacgattcaattatatataacttgtcacgttgatcggacgaaataatcaatttatttaataattcttatatttacttgaattctgacacgtcttagattagatgattgatgatatagtttgttttaacaattaaaaccaaatttggtttcaaccctacctacttccaaaacaaattcgttttttgggcatatacggctattactagctatttgtagttaagtcacacatcatgttttaatttgacctttgctttatctgttcttctagtgggagttaaaaagtacataagatgttccagggagattgcaattgcacttatgtcacatatgctaagaactaaccttgaatcaatgcagatgttaggattggaatttttactctgtttttgtttgtgcattttcagcaagtaggcttgaacaaagtgagatcgatgcaatccaagattcagaactgaatacttcagtaaatagcctctacaagtaccgtgatatctgcataaacaaaggggtgagttctcttttcggttgatggagctaaaaggaaaacataatgttgacttattttatttaatagaaatctatattgatgcaggttaatgaaaaagatgtggatacatcaatgatctcaggacatgatgtgggggaagggattgtggaactcatctatcaaaacattatcacgaacctcgttatgggagcagcagctgatcctcactattccaggtaaagataacttgagaatccatcaatagtgaatcaatctaatgtaaaccaaaaatatagcaaaagactctaaccttctctttgataaagcaggggaatgtctatcacatctaggaaagcagagtatgtgagtcaacatgcacctcatagctgtaaaatatggttcatctgcaaggggaaactcatcaagcaaaggttagcttgggatattacacgtgtgtgtgtgtgtgtgtttatagtactaattgtagagttctaacataaactttcatttgtttaatagagaaagaagtttctacctcgggaatccatcagactcattctcagaattctctacttctgctgagaaaccaattagcaaaggaagaagaagggatgaggaagaggaacccgagtcacctaaagaacatccagtaagtagcaagattgtcataaagttagacaaaaccctatatataatttagtgtcaagattaccaattgagattcttgtcgtgtaaaaccaacagggttggatactagaacctgaggaatcaccaaagaaaggaaggaaggaaactatagagaaatcaaaaagcaatgagagcgatgaagacccacgtctcgaagatttcaagtgtcccatttcaatggttaggatatttgaagtatatatatatatatatatatttccttgattttcagctcttgaaacaaaactagacttgttccacatcatcaacgctgttgttcgatttcatatgtgatgttgtaggagataatgcgagatcctcatgtggctgctgatggtttcacctacgaggcagaggaattcagaaagtggctaaggtcaggaggtcgaacctctccaaagacaaacaagccgcttgagaatcacaatctcgttccaaatcacactcttcgtataatcataaaagattggctggagaagaacccaaattataaacgttgattcatctatctatatgagaaaaaacaagaaagtcaatgattatgttgtgatttttggaatttctttgtgaaataacaaataaaaccttcatgtatcttactacgaaatccatggagggtattaatgcgattctctatgcaatcaatctgtgtataaatttatcttttccattttcttgtcctccttacgaaaaagaacagagaaacagaagaaaaaagaaaccctaaatactccgtgcttattcagcacactgcaaatttacttaattgaccccgatgtttgtaagctttttggatcttaaataagaagagatctaggcgaagtaattctaatcgttcatactaatagcttcgtgacgtgtcgtaacctgaatcgttaaactccacgattatttctcgaggaaaaaacttttgctcagtagtctgttgacttcttcactggctccacctcatagaattgctcttcttcagctctccggctaattgaacggcggttgatcggacattattggtctgaaaatcggatatagaacaggtaaatttcgaaacgaaatttctcactatcaagccaagctctctacatgtatatattttttgtttctacttctccgtgacttcgtcaaagctttccccgtcactaaaccctaaaattatcttgtcttcgatttcggattccacgtatcatatatatacttttaatcttctctgagttgacattttaaattaaaaatctggctttaaaaaaaaaatctaaaatgatcgtaggaaatgtgtcttttacggtaagaattaagaaatgttctgcgattagcttaagttgcatttaatttatttgtgagaattggctcgttctgaatgatgttatcctactctgtttagatcatgtctttcgttctaatcactttctttctcataaaagacgattacgattttgaatattatataattgactaagaaaattgtcggaaacatctttgcagtgacttggtaagcgaacgatacatatgtatattcatgtgttgtttgtgtattatcttcttgttttggaaaaagagagaatttgtctctctgcgtatctatcttatagagaaaagtggagaatccatg

SEQ ID NO: 10503 - DNA, 3000 bp, Unknown
  misc_feature (1)..( 3000): cDNA_ID_1393342_gDNA_ID_2213655_Annot_ID_181735 3000 nt of promoter + ATG
ctagacatgtaaaagctcaaaaagtttttattcttctcttcgtctttcattgcaggttggagtcgaccaatcattgatcgagctagagaaatctggctacaattcaatttcagatgaggtaaagttcttttgtttccctatagacttggaaaatcatggctcagacatgtatataaggttgtaaagttttgatttttctcttcaggttttcaaaaacacagaagatgaatgttcaaatagcataagaagctgtgaattttcttctttcttttttgtccaatgggaacaatggcagaattgggaaccatgggaaaatttggagccatggcagaagagcagcaagttaaccagatgatcatggataaacaatcagtagaagaatggctatcgcgcgtcaactcgctaataccatccgtcctcagcaaggcaaaaacggttaagaagtttacaggaagatggaagacgatcatctcgaagatcgaacagataccagcttgtttatctgacctctcaagccacccttgcttctccaagaacaagctctgcaacgagcagttgcaatctgtggctaagacgcttagtgaagtgatagagcttgcagagcagtgttcaactgacaagtatgaagggaagctgcgtatgcagagcgatctagattctttatccggaaaactggatttgaatctaagagactgtggggttttgatcaagaccggcgttctcggtgaagctacgttacctctttacatttcaagttcatcggaaacacccaaaatttccagtttaaaagaacttctagcgaggctacagatcggtcacttggaatcaaaacacaatgctctcgaaagcctccttggtgcaatgcaagaagatgaaaagatggttcttatgcctttgatcggacgagccaacgttgcagctttagttcagctgctaacagcaacttcgacaagaatcagagagaaagcggtgaatctgatcagtgtattagcagaatcaggacactgcgacgaatggcttatctccgaaggtgtattgcctccgttagtgagactaatcgaatcagggagtcttgaaaccaaagaaaaagctgcgattgcgatccagagactgtccatgacagaggaaaacgcacgggaaatcgcaggacacggcggaatcacaccgcttatagatctctgtaaaacaggggattctgtgtcacaagctgcgtctgcagctgctctgaagaacatgtcagcagtttcagagctgagacaattgcttgcggaagaaggaataattagagtctcgatcgatcttctaaaccatgggatattgttaggatcaagagaacacatggccgagtgtttgcagaatctcactgcagcgagcgacgctctacgtgaagccattgtctcagaaggcggagttccgagtctcttggcttatctcgacggtccgttgccgcaacaaccggcggtaacggcactgagaaatctaatcccgtcggtgaatccagagatatgggtggctctcaatttgcttccacgattgaggcatgtactcaagtcaggatctttaggcgcgcaacaagcagcagcatcggctatttgccgtttcgcttgctcgccggagacgaaaaggctagtgggagaatccggttgcatcccggagatcgtgaaacttctggaatcgaagtcaaacggatgtcgagaagcggcggctcaggcgatcgctggattggtagcggaaggaaggattcgacgggaactgaagaaagacgggaagagcgttctgacgaatttggtgatgttattggattcaaaccctggaaacacggcgaagaagtacgccgtggcggggctgttggggatgtcgggaagcgagaagagtaagaaaatgatggtgtcgtacggagcaatagggtatctgaagaagctgtcggagatggaagtaatgggcgccgataagcttctcgagaagcttgaaagaggaaagctaagaagcttctttcaccggtaaaacgaacgatgcggagacattgaagcagccaagataaaaagtgtaatattgtctgatgtaagtttattaaccgttagttaaactttactagtaattaaaaagtgttctttgggctgtttctctgaagctgataaatatgggctttatattaaacaggcccatgaagttgaatatctttcagtagtcaactaggtttattcccagataatttatgtggccaactattaaatacaggcccatgaccttaacaaaaaaaatacaggcccatgaacgtaatatgattctgtttatcaaaattaattaaggagacaaatatcagttgtgaaactcccaagtttatttcacaaagtcgtaatcgatgtgcttaatagaacaattttgccactagataataattatctcacactatattttaactttttttttttaggtctatcttgttgctaggaaacataataataacacacacacacacacacacaaaaaaaagaacgatagagatatttagtgataattttgttgggtcaacgtaatcaacggtcagaaatagatcacggtgcgttcgtctggcggcttcatttggcacaaggagtttactagtctggacaatatgtccttaattgctcttatcggagaaggcttactctgtttttcaggcgaactctgtttatcttctccgagctcgtacgagaatattcgtaaaggtaaagtatttacttggatctcaaattgcttttatcctttgtttgccttatgaaattgcaatgaatatgtgtttgcaaagctgattatcactttgggtagaaatgttagggcttcttcttagactctgaaaatcttattacaaaagtaccatctttgctcgactaagatgagattttgttgtgaactgactaataaaaaatcgggttttctttgttttgacttttttggatatggttacctcaaacctaatttggtgttaaaataaaaggtttcttgtgagcttaaacgatg

SEQ ID NO: 10504 - DNA, 3000 bp, Unknown
  misc_feature (1)..( 3000): cDNA_ID_3036893_gDNA_ID_2213655_Annot_ID_181733 3000 nt of promoter + ATG
gtcaatcgtacactaataatacctcgatcacaaaaacttttaggttgtcccggagactctggagcctagtctacagttggcagctgctgttcttgctcaggtaaaacataaatgtttccttatttagttgaagtagtaatcctaaacagtgtatgatcattttttgggttgaaacatgtcaggcaaaattaccgacatcggaaattgcaaacacgattaacgagttcagaacccgtcacttgtctgaactgaccgaggtgtgtttcattgtcgatatatccatctatatttatcagaatctggtttggtctgattgatgtgtattgggaaatggtgtaatgataatggcagctatgtgaagcaagcggaagctctctaggctatgggtactctaggacgagtaagcctaaacctcaaccatcggatgcatctggcgataaccagataatcgaaggaggcacagtcgtaatctgatgacgttctccattctggtgagaaaaagaagagtatttctcctttggtgttcttcttaaaccaccatcaccaacttgggttgcagtgcgtggtgaagtgatggatccatcagatgatgtgtagtgtgactaatatattcattatatgttcagtacatatctctcatttaagtctttgatctcagaacaattagatttgaacaaatgcgtagcaatcgattctcggcggcagtaataacaaatgaaactacatcccgttcttgtactacagatgtgaacaccttgcagttgttggtaaaagactgaatgggccttcttttctttgacttcgactgaatgggccttaaatacagttggttttatggtccaaacaagatttacgtaattgtttgaccatcgatcattacaaaacaaaatagataccaagccataaattaaaccaaagattgggttaatgtcatgttccagaagcgagaatgataaaggcatgtaatatgaaaaatgtccaaaacacaagtgatgccccaacggaaaaaaaaaaaaaaaagaataagaaggaaaactactgatacaggaaaagccccaatagacgatgagaaaaaaacagttgctctcttttggccatttctatttgtagcttcatcagagcaactgtttttttttttgttaataatatatattgatatatttgaaacgttatttaggtcaaaagagagatttttaacaaaggaaagggccaaaagagagatttttaacaagaataacgctgaccaaaaagggaccaccaaatcacatttgccgaaaccacaagtacctcaacattataaaaacatccaaacatatatccaatgtactgtgcatgtcattattatatttgaggtcaaatatttaactaatgttttttttatgattaacatgcgagtttacataaagagttagtatatgataaactgttggaaaaaaaaagtagtagggtacatgttacgagaaaactaaaaaaaaaaattattacattgtactgacatatatgttaagaaaaaaactatatgtagcataaacgaaggcaaacgaaaatacagctcgaaaaaactaaaaaattccgattttggtgttaaaagagccaccagaaccgataacacaatcagcggcgactaagtttctttaagagagaagcatgagggtttttgaagagagaaagggtttggtttttgtacagtatttgttcgtttattcgcagaaaaaaaaacaaaacatagcagtcatggattctctttcaacgcctccgtcgactatgcaaaattccaccagaggctctcaatccttatcgtccctgctaacgtcaaatctccctccaccgtcgtttcagccaccaacgacaaatctcagtctgaattctctttcaacgccttcgtcgactatgcaaaatctctcactatacctcgggattctctagctcttgcacacttacaccatccatgctaacgtcaaatctccctctgctgtctaatctctctccactgtcgtctcactcaccaacgacgaatctcagtctgaattccctttcaacgatgtcgactatgcaaactttcaccggagactctcagtccgtaccgtctctgctaacgttaaattttcctctgctgtctaatttagggcttttattgtgctctatccaatagtgccaattctagctatggttgggttctccgtgtgcgagtgtattgtttgtctactcttctggtttcatttaggacaaaatgatgttgcagagcctgaagaagacatgtgatttggtctacttccgaagattttgatgattataattactcctttttattatatgagaattatatgttatgcacttctttctattctatgagaattatatgttatgaactcaaattaattctatactatgttttagaaacgaatgtttgctggatatttcttattaatattatattttgtgttgaaaagtgtttctagatgcgcatacaaattagttgagtttgagtagcaaatatgtatgctgcttttttcctacatttttcggtttgttatgttttcacatattcccttgggaatcgatccaagcggaaagcctaaaaagaagaatgcatcaattcgtgttgatttgtgggcttaagcccaatagctttggaccctccacactgatagcattttcttagggctatcaatgctaaaggctaaaacgagactgataattaaataagttgcattaattaagcaagtgtcacgcttcttcttgttaaaacgtttagtctgtgactaaataaatatagtatgacactgaaaaaactcctttcactttttttaatatatactataatgatgatccattctcctttgatgctaatttggaaatattggtcttatcaaaaaatataagaaatatagcggtgtctaatcttccatgtgcacacacttgtttatccctatttttttgtatatacttttttagttaacagcatgaggcttgacttttctctgtcctttcaacaattca

SEQ ID NO: 10505 - DNA, 3000 bp, Unknown
  misc_feature (1)..( 3000): cDNA_ID_3036897_gDNA_ID_2213655_Annot_ID_181732 3000 nt of promoter + ATG
accttacaatgagaggctatcaatctggatttcatcactctcctgctccatctggccaaaagatcccactctactctgttgcacatagccgggctggcgataaaggaaacgacataaacttctcaataatcccgcattattccccagatgtcgagcgtctgaaactcataattactcctcaatgggtaaagcatgtgatgtcagttctgttatcaacctcttcgtttctggaattggatgcaaaaccaatggatgaaaatgtgtcagtagagatatatgacgttgaaggcattcatgctatgaatgttgtcgtacggaacatattagatggtggagtcaactgttccaggaggatcgaccgacacggaaagacaatctcagatctcatcttgtgtcaacaagttgtgttgtaagactactttaactttgcatatcagatttttctattcaaattctgtggtaatatgttaataaaaagggagacttgaactacactatagttctaaaagataatagaaaaagaaggaatcgacttagtggtgcttcactttcttttacttctatacattaaaattactttaatttacaactggatatcttgatagatacgcatacagataagtattaaaagcattgttttgattgagagagaatgatattatatatttgtgtaatgttaggttgttgttatattcttttgcaggatctgactgacatgggttgcaccacctcagagacagttggcttaaagtaacaatcccttattggattgaaattgtcagaaaccacaacccttcttttgctcaactccaatcactttgccacccaattttatctcattcattttgcaaaaaagatcaaagagagagagagagagagagagaaagaaaaaaaggaaaaaaccttcctccgttacaacctcacaattgcaacaaagtttcatataaaagaggacagaaatttcgcaggttcctccgttgtctgaggtaaaggtttccttctttaactaattcctcagatgacctcttgatttgttggaaaaaaaattaaaaaatctgtttcatacaggatcttggagaaggaaggaaacaacaacaaccaaaaaaaaaccaaaaaaaaaaaagataaaacaaaaaaaatgtctttcacaggaactctcgacaaatgcaatgtttgtgataagacagtctatgtggtggacatgttgtccattgaaggaatgccttaccacaagtcttgcttcaggtgtacccattgcaaaggaacccttcaggtgcactcattactcattttcttgttagatcttctatgatcatattatatcaacaatttatctatgtgttgatggcagatgagcaactattcctccatggacggagttttgtactgcaagactcattttgagcaactcttcaaggaatctggcaatttcagcaaaaactttcaaccaggttcgtattataaaatctctgacatcgaatctctctatctttcaaatcatcatgatcataacaagtctctttcttttctcaggaaaaactgagaagccagagctggtaggttcatcattacatgtccttgtatatgattagcgtgtcaatatttcattttctttcttttatgatcgactaataggatctgtgtactgatttaaacattacagactaggactcccagcaagatatcttccatcttctgtggaacacaagacaagtgtgccgcttgcgaaaaaactgtttaccctcttgaaaaggttagtggtatacgcatctgcaaatgttctcatggcctaaaataccaacgaactagtctcgtagagaaatttatttgctctagaatttgttttttgttttttcatttccgtagaatttttctgttcggataaaatcattactagatcaaatggaaataaaattttgattttggtttggtttagtatacttttggttcgatttgagaacgtgatgttggttggtccaagcaaatgtggaatcaattttggcttggttctaatcgggttatttggtaacagatacaaatggaaggagaatgcttccacaagacatgtttccggtgcgctcacggtgggtgtacgctgactcactcctcctacgcctccttagatagcgttctctattgccgacatcactttaaccaactcttcatggagaaaggaaactacgctcacgtcctccaagccgccaatcaccgtcgcacagcctcaggcaacactcttccaccggaacctaccgaagacgtcgccgtggaggccaaggaagagaatggcgtttcagagtcttgaatatctcttacatgagtgtttttgagtgaatgattgaatgaatgttgttgcgggggaaagatttgatttcatttgtaatgagttgtttccatatgaagacatgattttttttgttatttttttaattcattcgttatacatttattattacacacgaaaaaaaggcaagaattgatgttttttcactctatgtgtgctgcttatgatatgctttccgatggtgatgatgatattcgatgtaatatctgttcggttcaaagataccaaactacttatataccggatcaaaccaagtggttatcgggtgatgtgaatcattcattatttcgttaggtgagagagggtgttttcgtaaaagtatctaaaaacggccttagcaatgatgtctggttggcgagaaactcaaaaaggaggagacagagaaagttgtttgactgggaaaatttgaagagacgagccaaaattatctgtttgaaacgaacggaattgaagacgagagccactcctttccgtttccacctttcttccattcttactcaactttccatgattggttagcctctctatctgtccgtggcttgtcgttgattttttttatcttggtcgtctgaatgtgtggaatttcgttttgcttcacaggagttgtatataaggttcgaggaataaagtaaggctactttttttatttgatttccgat

SEQ ID NO: 10506 - DNA, 3000 bp, Unknown
  misc_feature (1)..( 3000): cDNA_ID_4262286_gDNA_ID_2213655_Annot_ID_181731 3000 nt of promoter + ATG
ttcttgtcgtttcctgtttcgtgattaaatctgatcattcttgttgtgtcatcaggtctatgaactaggttggaattggaatgacttggagctgctagctcagggaactctcgctggccaccttctggagtgcggttgccagctcactggtggatacttcatgcatccaggtgcgttttacgcttattggctcagggaagatatgatgaactactgttttccattatcagtatggtcatttcgttcctcaatgttctttaggtgatcagtatagagacatggctttccctcttctccaggatttgtcacttccttatgcagagattggctatgatggtaaagtatgtgtatcaaaggttgaaggtagtggtggaattttaaataccagtacttgcgccgagcaacttctgtatgaaattgctgaccctagtgcctacattacacctgatgtggtaagttagctgtacaaaatctagaagaaataactgtaaaaacggcggaaatatttgatttgaaaaccttctttgcaggtaatcgatattcgaggtgtttctttccttcccctgtcagactgcaaagtacaatgcagtggagcaaaaccatcttctaacacttctgtgcctgagaaactcttgcggttaattccaaaggttgttatccatagaaaatgctggtggtatttgattgatgctaaagagcaacctatgtttggttctataattcgtattttctttgcaggagtgtggttggaaagggtggggagagatatcttatggaggaaatggttctatacaacgtgctaaagcttcagagtttctggtgcgcctatgattaatatgtctatgatgtagtagcattttttggccccatcgtcgcttgaaatgactccttatggtgccttaaattggagttcatttcttatcaagtgtatgtacgtattttacttgtgttttttccttctttctttcaggttcgatcttggatggaagaaaccattcctggtgttaaccattgtattctttcttatgtgattggggttgatagcttgaaggcgacaagcaacggcactgaatcttggcagtcatgtggagatattagattacgtatggatggtctttttaaactgaaggaacatgcggtccagttaacaaaagagtttactgctctatatacaaacggaccagctggtggtggtggaattaggtaatttcttcacgttgatgttcgctccatatatcaatccaatgctaattgtagctttacagtagtaccaaatcctgttgagttgagacatcttatgactagggacaatgtattgaaactagttatttgttatgagattcggggtggtctttttggtttgacaaaactgcttgtaaattatatgcagtaccggacacaagatggaaattgttcttgaaaagcgtttggtaggtcgtctccatcaaaaaatttaaactaatatagccttgcatcaatcaattttacggattctgatgttatatgtttggttatccaggtcagccgtgaatctgtaatgtggaaaactggacttcagcacaccaacacttcagagccagagacctctgaacatcattctccagagaaaatgccaaaggttagctcgagagttcttactaaactaattgtgatgactgatagataatggaaataaacatgacctgaattcaaattccttggtgaatcaatcctagtgtgttcgaacatcaaactaactctgatgactgatagatatgttttactatttgaaagctgaaaatgtgaaagaactctaacatgtgcatttgtattaacaccttgttattacttccatttgtagttacctaaggaaaatccaaagaaccttacaatgagaggctatcaatctggatttcatcactctcctgctccatctggccaaaagatcccactctactctgttgcacatagccgggctggcgataaaggaaacgacataaacttctcaataatcccgcattattccccagatgtcgagcgtctgaaactcataattactcctcaatgggtaaagcatgtgatgtcagttctgttatcaacctcttcgtttctggaattggatgcaaaaccaatggatgaaaatgtgtcagtagagatatatgacgttgaaggcattcatgctatgaatgttgtcgtacggaacatattagatggtggagtcaactgttccaggaggatcgaccgacacggaaagacaatctcagatctcatcttgtgtcaacaagttgtgttgtaagactactttaactttgcatatcagatttttctattcaaattctgtggtaatatgttaataaaaagggagacttgaactacactatagttctaaaagataatagaaaaagaaggaatcgacttagtggtgcttcactttcttttacttctatacattaaaattactttaatttacaactggatatcttgatagatacgcatacagataagtattaaaagcattgttttgattgagagagaatgatattatatatttgtgtaatgttaggttgttgttatattcttttgcaggatctgactgacatgggttgcaccacctcagagacagttggcttaaagtaacaatcccttattggattgaaattgtcagaaaccacaacccttcttttgctcaactccaatcactttgccacccaattttatctcattcattttgcaaaaaagatcaaagagagagagagagagagagagaaagaaaaaaaggaaaaaaccttcctccgttacaacctcacaattgcaacaaagtttcatataaaagaggacagaaatttcgcaggttcctccgttgtctgaggtaaaggtttccttctttaactaattcctcagatgacctcttgatttgttggaaaaaaaattaaaaaatctgtttcatacaggatcttggagaaggaaggaaacaacaacaaccaaaaaaaaaccaaaaaaaaaaaagataaaacaaaaaaa

SEQ ID NO: 10507 - DNA, 3000 bp, Unknown
  misc_feature (1)..( 3000): cDNA_ID_3036905_gDNA_ID_2213655_Annot_ID_181730 3000 nt of promoter + ATG
acaagcttgggaatccagaagaaacttacgaagatttcaccagatctattcccgaggatgagtgccgatatgctgtctatgactatgatttcaccacccctgagaactgccagaagagcaaaatctttttcatcgcatggtacaactccctgcccttgtatttttaatgatttgaaaaattagatgttataattgagacatcaacttgcttcaggtcacctgatacatcaagagtgaggagtaagatgttgtatgcaagctcaaaggacaggttcaagagggaattggatgggattcaagttgaattgcaagcaacagatcctagcgagatgagcctcgacatcatcaagggacgagtcaatctctgaatggaacttaccgcatcttaattcgtttcagtcaaaattcatattttctgctttcgttttcttgggtatttttcatttaacttctttactatttgtatcttctgtgattcaagatctcacctctttcttttttccttttcggtacgcaataatcatcccaatagataattactttgcttccctgaacaaagctggcaatttcaagcaacttgttgatgctaatgaactaatgatgcaaagaacatacgctaaaagagagagtaaataggatgacatacctcacgtctaatttatcagaaaatcctcgcaattcaagggttttcttagccaattgttgaatggatactttcctttaaaaatctttgacatcaaataatattccgtagctttgttctgcatacaattaaaacaaaaaagaaacgtaaatcatctcagaattaaccagagaacaatatcacaaaatcacaatcttgcagcatacatgtcaaaaactcactatgagatttatacactttagcatgttagttgttccagtggaagcatgttaaagctgcagaaaagaatcagcatcgcacacaccttcagttctcggtacgatttttttgacttggaagattcccttttgtgtccatgagtttctttcaagaatagctccagtaaccgctgtctagaaaaatatatgaatatgatatcaactacaaataatgaaggtcatgcttggataacaaggctcatccccttacttgcatatagatgattgagtagacggatacagagctcctttagctgatgtgccttgctttctaccggttgttccaagaataacttcgtgtaagccagaatagttccaacacaaggaatatctaagagccaacaaatagatcacaccaccttttaagaaacaaagaaaggacacacatgtcatgtgaggaagagtattgaaaactaacccgcatgttaaagtagcttgcgcagtttctgaatgctgaaactctgatggtggtactggagctacaaaaaacagtggctggaaaggaattagcacgatatatgctagtaactactgcaatttccatgatacattggtataaagcagctagtgaaccttgttcaaacggaaggaagtcagaagttcatccgataatgggaggatcctctcatacaaagatcttcgcaagtgatcagctaaagaaaaattgtcaggactgtgcagagattgtccaacggtgatggtagaaatatacacaggctggaggacttggtaaagcaatgcccctgaagtaagaacacacaaagagagaaaatcccaataagcaaatcttaaattacacaacaaattatctgtcaaaattcagggtacagaaaccttgaactccaagaacattccatcgagctatcttatccgaacagctaacagagagtgttgtttcaccgcgaccaggctttctttgcaccatatctgctacttgtgagccattacctgaaatagagacatccaaagtaaattgataccaacatgagcctaatccgctttctcccagcttctaaataagaggaaggcaagctgagagaaaactcttgcagcattacctttgttgctattactacctatctctggaacatcagaatgccgagacgagcaaatatcagaagcttgaactaacaatgagtcatctacttgtgttgatggaatctttttcagggcatacaagggtgaactagtagaagcataaccacctacatatgacaaacacgtcaatgccaagtatattcttgaaacagataaagaaacgtaatgaggcaaattgaaggtaaattacatggcaattgagaaatgtacaaatgcaagaggcacccagatttgagcttatatttgacttctccaggacagcttgaatctgctgactctagtattgagcttgtttcgctatcaattctctgacgcttggcttcattactcttacctgaagtcaattgcatccgctgaatctcggaatagaagaacctgatgagagctcttctggcgacaacttcggcatgagaatcgttcacaatgtccccacggggactcagcagcgacccactaacgcacttggtccccgtccctaacgctatcactttcgggtctgcacaaaatcctaattagctctaaatcgaaaaccaaaaataaagcaaagagtgacagagaccttgggaaggagaagagacgaggaaagcggagaggacggtgacttcacgtccctgaggttttcccttcttcgggagagacatgtaagccgaaataaccttctctgatactgtctttccccaatcctcctccattgctacgattcccacaaacaagtccgttgattcattcatgctactcaaaaaaagcagattcaaggacccgcatgaaaatagttataagtttagggatcgttttagtatatatactacaaaattattaaagtaatcaaaatcccaatgggataagcatctttaactcacttccgtcactcgcttccttcacgtctctctcccaaaattcaaattcctcaggcctaaccaatcctgtgatcgacgtcgtcaaatattcaaaagcagtccgtgatccattgcatgatcctcttcctgtgggattcttactctc

SEQ ID NO: 10508 - DNA, 3000 bp, Unknown
  misc_feature (1)..( 3000): cDNA_ID_3036956_gDNA_ID_2213655_Annot_ID_181715 3000 nt of promoter + ATG
gcgaggttatgtttatgtgtgatggacatctcatctacacaaagtgagaattttgaatactctctttacttatatgtgtcttgtctttgaagaaattacctgattgtctctgtgtattaaatacacagggaagccaatcttgaagactgtatgggtgaaacagaatccgaagctggacaatccaaaccgaagctctattcctctgcttcaccgaaatgctctgcagaattagtctctgcaattgtagcttacattgacacaaggagagacagagatatgttggagccaaatgcatcagaggatcaatctgtatgttctaaatattgttggtattgtgaattagatgcataatcgaatggtttgtgcaaaaaccaatatattcctgtgtctctgttatgttgcaggaaagcgacaggaatgatcaactgtatagacagcttaagcaagcacttatggaagttgaggaatcgaaaagggaagcttacgaagaatgtgtcaggcggtttaaagctgaaaatacagccgttgaggccattcgcagtgtaaaacacctgcacaaattcataatctcatacattgaaaatgtgtttttgcttagacttgtttccttttacttaaaaggcaagagagtacgaggccatgtacaacgaagaggcgaagctaaggaaagaaggtaaagaagcattagcgaagcagaggaaaatggtggagaagactaaacaagagagggacgacgcgctaatcatcattctaaatggaaggaagctatacaatgaggaactgagacgcagagttgaagctgaagagatgttggggaaagagaaagaagaacacgagagaactaagaaggagatcgaagaagtgcgagccattgttcaggatggtactgtcagaaacagaagtgaatatttcttctcagacaattagagatttcatttgaatttgtacaaattaggtatgcagctgtacaacgagcagctgagacataggaaagagatggaggaatctatgaagagacaagaggaagagcttgagaagacaaagaaggagaaggaagaagcgtgcatgataagcaagaacttgatgcagctatatgaagacgaggtgatcaatcttagatttaatttagaaactagaagttactttcatcatatattaaaagatcgttttgacaggtgaggcagaggaaagaggcagaggagttggtgaagagaagaagagaggagctagagaaagtgaagaaggagaaggaagaagcttgctctgtaggacaaaacttcatgaggttgtatgaagaagaagcaagacgtagaaaaggaacagaggaagaactcagcaaggtggcggctgagaaagacgcagcgagctcagtctgttcggagattctattactccttcagagttacactcgtcgccatggaactccttctggattctccgatgaggattccgttacacgccagcctccctcatatttcatatgtcctatctcacaggtatgtggaccaggacccccgtgggttcattgttcaaatgagagcattgtaacagaacaaacttatattcgatgtttagaagttaatgcttgtttatttattaattcaggaagtaatgcgagagcctcgtgttgcagccgatggtttcacctatgaagctgaatctttaagagaatggctcgataatggtcacgagacctcaccaatgacaaacctgaagctcgcccacaacaaccttgtcccgaatcacgcccttcgttccgcgattcaggagtggctacaacgaaactcttgagaatctttgcttttgttgtgtttacttaaaagctgttattatttgctgtgagtggtattcataaaaactgtttggttctctctagtacccatttacaaaaatgcttgctgttttgctctctctcttgagatacgtcaacatatcttggcgtttgtaaattgaattcacagacgtccctttctatgggccagtattactaaagatggcccaacaaatgacccacgaatatggtagagagtttaagcgcacgtgatattaagattaacaacgtgacgcgtgtacaaaaggacgaattggcttttttcacgtgcgagaatattattggccataacatttgatcttagcatgaggtcgaccacattagattttcagattataaaaataattatctaatggttaactgtaacatgccgtcttgtcggtacggttcatacggattcatattaaaatttgtgatgactaaaaaagtatttaataaaatatatatattattaaaattgaggtagccggtgatcggtggatttgaagtacatatcgcatgcatgttccacgcgcagcttgtctctatatatgttccacgcacatgcaattcattactgcaaatttttttatttttttctcattgaattatatttgatattagaattggaaaagatataatacatatgaaaataaagagtttagactttaaagatacacaaagctcgacccatgaagaagggtttttttcgagaacattgcaaaaaccaaactaatcttatctcgagactaaacaaagctctcgaagttcaccacaaggacttcccgcacaacaaactgagaagacgggcttcaacacttatggcaataacaagatagtggaacttggtcttctccgtaaatgatgcttctttttcaaagagtacctaacccggatgaaccgtaggataatcgagaaccacttaaacctttcaacaccacaacgatcaattaattaagctaatcgttgcttaatacaacaaaagaagaactgatatgtaatccaagagctcaaccccaaactaacaaagtctaacttagtcggggaagagaagctaagcccaaaaaagggagacaatagcccaaaagagggagacaaattaacctaagccgctgatgttaccagatctcatgaatacaaactgatcagagcaacaagtttcacaaaagcagaagacatgagagacaatg

SEQ ID NO: 10509 - DNA, 1345 bp, Unknown
  misc_feature (1)..( 1345): cDNA_ID_3037074_gDNA_ID_2213656_Annot_ID_181751 3000 nt of promoter + ATG
gaatttgcaaactgtgagagatattgatgaaagcaaggtgattgagttgctacagagaggaccagttattttgtgtatagaagtatcatatgaatttaatttttttacgggggtgagtaaattacacatatagacatatatttttcaattactatacattatgattttcattataatgtttcttataaccaaaacgacaggataaagttcttagaggatatcaaagaaagggtctataagatcatatgattgagttgacggttatgacactactctcgaatgcgctaactactttgaatttaaaaattcatacggtttttgctgggggaaaatggatttggaaaactaattcgaaaaagtaggcgaaaaaaacacgagccatctctaatcaatgttttcatgtatcgagagatatacataataatataatattttttttcttggtatatgaatttgtattgtttatagaatatatgaagataaataacaagattttacaagtcaaactcaaactacatccttctttcttagattattgtacatcttgttctccatatccgttgtcttctttggatcctacacctttttgtacatattctaactagatcattacactgtaagtcaaattgttcctgttttgcacttaaaatacatgtttagtacgaagtcttactagatcattaccttcaaattcgtttctagctatatttttaatatgcaactaattgtagaatcacttttggaaatagagttcttcaacaatatattaatatagatgcttaatgctaataatgtggagcagtcaacaatgtataaggtcctaactcctaatttaactcctaatccaaatcaaagcaagtttcataagttaccacatattaagtgggtctgagcccggcccacaattattacataaagcccagaaagagctcgacggacttgagacggtaaattaattttgttaattgccagcagcaacgacggacttcaaacggaaatttttatagcttctctcgttcagttctgcttccgacaatcaaacaccactttctttggatgatttggaatctctctgttcagcttctctgctactgccgcaactggagatgcataagtcgagttctagtttctgttcagaatctggagtctaatttcttcaggtgatacggttcttgttcttgaaaccctgagctcttacgttctcgaatttgagggatatactttgattcctagggtttgttagaattgacgaattgggttgttataaaaataggattttttttaagttgtgtgtagtttaggcgaagaattatagaaattgggggttagggttttgtgagagatg

SEQ ID NO: 10510 - DNA, 3000 bp, Unknown
  misc_feature (1)..( 3000): cDNA_ID_1009068_gDNA_ID_2213656_Annot_ID_181759 3000 nt of promoter + ATG
ccaagacaatggcttgtcaatcaagtcatcgatactctgtccaccaaatgggatggaaagaacgtttccaaagtaagtgttgtcttctttctccataagtcttctccttccgtcgacaacaatacccattttcgagttcttgttcgaaactagatctcttcctgtgtgtttcgccacaagtttccatagaaacgcgctgaacgactctagtttcgtcctctgaccataaccagtcttgggggagctaccgcttgctagagtttggagatcttccaacgcattttctttgatgtaatagatacggcttgtgaggatattatctaggtcatttgttgtttcttgtggaaggggcaaagacgtgacaggcatatacatcttgtctatagatgagtcgataatcagtggtcgtcgcgggtttagtatagatctccggaacgatgggacagaagagattggtgcattgaatctagagatctcagcccaagaaacaaggaacatgttcatggagaaagcatctgcaattcgatgatcaaatgtgcatcctaccactatgctcccacatttaagttgagttacctaattacacatacaagttagttaagtcgttataagaatatgtttctgaaactgaatcgatgaaagtatgatttcggtgttatattacctgaatagctataactccatgcttcttcttcggaacaagcttggcgatactttcatcaggatcatgcaagttaagctcccggagctccacgtcagcaaccgcctcaaggaagtctacgccgcggttgttgcagagaatctcgggttctccagaggagtttttcacgagttcaccggcaaaggcatagtaggagacgagagcctcagccaaagacgcttttagggtttcagccacggataagaaatgacgtggtttcttgtagcagaagcaaacgctgatttggacaggagggaggaggaggtcgaggtttgaaagaggaagccaatggtcttggaggggaagagcagccgtgactatctgcttccttatggtgatcacgtggaaaccacgttcttgctccgctgcatcttccatggtaggatgttgttttgtagagaagataaaaagaaaaagactgtggtgtgttggaaagctactgtgtgagtcagagaatttataaaagatgtaaatgtgtaggagagaaattacgtgactatttccattttacttggatattttttttttccttttagccactagtggccggttactgtatagtagtactgtgtgatagtaccttttaatttcggcgaatacccaccaatgaagaaaatgacttaaacgttgcaacttgcaaggctacttggaaactgcagattttgtgtaatacactattcccacatatctagtactatttctgaattgtcacacattttcatttaagtaattgatcttatatctcattttaaaaaaataactaaattatggaaatgattggagttatgttccaatgtttggttggaatcatagagatgataatcaccacaacaacatcatcagatccttgatgattccttgactcctttggttttggctagctcaagtggtatcctctcggctacatgtccaaatcttaacaataatttattgttccggtaaggtttacttcaatatggtattataagagagcatcgaattcggataataattagttccgagtttatttttttttcatatccgaatttattttttttatggtgacattttttcttctgactatggatttattagattgtcagtatgattatggtttttaatattatagacttgtgagacatgaataaacatggttttaaaaaataatatgatggaatttctgttaaaaaataaagacttagttttaaatttatgttaaaatgaagaatttggacggatgatcatgagattataatatgaaaatataaaatgttcatttcacgaatcataattttgtgtccgaatttaagaaataaaagttaacgtcaaaatgggccaaagactatgttcttgtggatgcgtgaaactgtcttggagagattgcaacatcatcacacgatctcctatgttgcgacaaatcactcctaaccgtccacaataaccaaaaaatataatcatgacattaactcctttctaacattccaagatttgttaaacaaattactacttaagatgtgactaatggaaattaaataacttaaagtaattgaaagggaaggaaaaatgatggtgcatgaaaaaattcttgaaataatttatttggctagcctctgatatatgtgaatctaaattatacatatatacgcaagaaacttgaaaattatgcaatcacattgacattatcaatttaaacttaaaaattgctatttagtaataatcagtggttaagcttacacaaaactaaataaataaaacatgacaaaaattctcgaccgtgaattttaacaaatgggccaagaaaaatgtcgtccaacggtacgttcatgaggatgcacgacgacaacagaaacacttgtgtaagcataggacccactaaaagagtcccagtttcccaaaaccaacaaatctcagccgtcgattcttagccactcggaccaaaacgtacgcatcaaaatatcgtcctcccaaagtataacctcaagattctcacatattctcaggcaatgccattgagtatttgagtattgaccctcatcatgtgattgaaaatcgccactcaacaactataacaacgccacgtgtcactcgtgtcagtccaagcctccactcttcttcttctctacataactgaccattcttctcctctgctctcttcactttctcatctcctccattggctcttatttcctcagttgccgtgaaaatctgtgagctttttcttctgtttaatgtaaaatttgtcaaagattgtatctttctatttaaagtatcgattttgattgttcatctgttgaatccaggtaaacgggtagttcataatg

SEQ ID NO: 10511 - DNA, 3000 bp, Unknown
  misc_feature (1)..( 3000): cDNA_ID_3037062_gDNA_ID_2213656_Annot_ID_181754 3000 nt of promoter + ATG
atattgttagcgctagtccaaatcctctcaaatcatatttctcttttgcccaagttttctcgtccattctcagaattgaatttgatagaacactgaatgcttctttacccccacggttgggctgtgtacatctcaaaatcagaagcatgctgcaatcttggcaaaggtatcttctcttttccatatggtgtcaaaagaattccttcagtcaacactactgcagcaagacacaacttttcttcatcttcaacagcaagttcaccttccttaggttttaaaaacaatcgatcttcgagatcaccaagagtataggatcctttactagcccaaaagtatggttcttttacaggatctttcccctttcgttgaagttccctatgaacaggttcacattgaattcttgtatgaacaaaagacagtgtagagactattattacaggttttatagtaaatactttaaaaacgattgtaaatcatgtttaacacttttaaaagcttttaaaatcccttataaatcattcaatgccactaatttatggtttaaaaacgattgtaaaccatgcagacacttttaaaatcccttgtaaatcattatatgacacttacttatgctttaaaaacgattgtaaatcatgtttaacccttctaaaagcttttaaaatctcttgtaaatcattctattcgacttacttatgcttaaaaaacgattgctaatcatgtttaacccttagaaaaggttttaaaatcccttgtaaatattctatgtcacttacttatgttttaaaatcgattgtaaactatgcaaacacttctaaaatcccttgtaaatcgttttaagacacttacttatgcttttaaaatcccttgtaaacgtggttaacacttctttaaggttttaaaatcctttgtaaattattctatgttagttacttatgcctaaaaacggttgtaaaccatgcataccctttttcaaatcccttgtaaatcattatctgccactaacttatgcttcttaaacgattgttaatgaagtaaaccccttttaaaagcttttaaaatcccttgtaaattatctatgacacttacttattttttaaaaacgattataaactacgcaaacagttatgcaaatgccttgtaaatcattctacgacagttaattaagctttaaaaacgattgtaaaactttattacatgttgtgagatagaactctctcaaggagaaacggataggttgagaatcaactctaaaccaaagagttgatccttttgttttcactctctgctgcatgagatagtgaaagatttttccagaaaatctgattcccttcttagccttcatttttggtcccaattcaactagaggaccaagaaacgaacttctaatcttctgaaataaacactcgcctaaagcttcctctactttactaactaaattccaatccgagtattgttgaacggttcccagtgcaatagattcctcaccttctctgtagatttgttcaggctatgtaaggatttcactctctgaatccatctgcaaaacatgttatgaaacagcgtcagatttactataaaattgactataaaattgactataaaatcgattataaaaacgattaccgtcggatctatcgatatctctggggattgtttgcgtcgtagagatatgatctgaatccttcagcgaagaacaggtttatcggagaggaaattcgtcggcgattttggggtttctcagaaagaaaattcgtcgacgattttgagtgaaatcggagaggaaattcgttggcgattttgagtgaaatcggagagggaattcgtcggcgattttgagtgaaatcggagaggaaattcgccggcgattttgagtgaaatcggagaggaaaatcggagaggaaaacgaagaagtttgtgccaaaacgaagaagtttgtgaaacgaacgtgaaacctaatcattcagagggtaagacagtcatttggcatattagaaggggtagttttaaaaatggtcttcaggaaagggcacttttacaaaagtttattagaataagggcagttttgcaaatctcccaagattcaatttaatgtttcagatttgttatctgtattcgtgcttttagcattaaaaggagttttcttgaaagtaatggaattgatatgcaattctaaatagaaacatatactatgtatctaacaaagacattatttcactaaatcaaagacaatttatttttgaacagaaataagccaattgtagaaaactttcttctctatattcctcttctagcctctgtaaacttccaaaataaataggaggaaatattctaaaataaaattttctaacaaggtaaaatatctatctttcatgacaaaaaattaccatttttattactcaaaaaaatgaaaggggccaattttttataggatgaaattgtatttacgcaaactaaatagaaaaacttagaggaaaaggcaaataatactatatactttgctttactaactctttaaaggaaaacaattctggtaaaatttaatataatttttttgtttttataaaaagataaaaatgttaaagtaagaaataaaaatcataagcatagattagagacattaatatatacaaatatatagaataataataaaaaaatgaatgaaatggccgttacttggtgaagacgcataaaaaggttgggcgtttctcttcttatcatctctgccgatttctctccgtcgtggtccgtcttctctttctctctatcttcctccaatatagggttcttctaaattctcttccttgtattattcttctttgtcgtcgtctttaacacagaggaaaaactgcttatctcgatttaggtttcctcgactttgttcggtttcttccggttcaaatgtacgttgacatattcccgcgtgcgtcattgactttttcttttttggtttgacggattttgattttgttgttgatcacgttgtagtttggttcggatacg

SEQ ID NO: 10512 - DNA, 3000 bp, Unknown
  misc_feature (1)..( 3000): cDNA_ID_3036987_gDNA_ID_2213656_Annot_ID_181780 3000 nt of promoter + ATG
gtccttaactcagtgatcattttcacctactaaactaggaatctttaagagctttcaagtggcaaaccaattatcgcacattcttagagaaaaaaatttgagaggaaaaaacggtaaacaaatactgatatagatcaaagaagaaagaaatagcactacaacaaaaatctagtgtaactattataaagctgtcgtaacaaatcaaagccattttgttttgttagcattttgtttcgaatttttcttggctatgctatagatttgcagataaaggtagaattattttttcattattatgatttttcaaaacaaaatatacgttgttttcttattttaacatttcttctaccgaatttttattcaccaaatttttttatgtagtataaaatttaaaactatttttctttcaatgtcaaaatctatactattaattgggaagtattgtaaataaacaaccttatgaagggtagaatattacatagaatgccattgattgttagtgtttttaaataaattcattaaggatacaatagtaatcacaaaattaatagatttaaattaaaaattgtaatattttttaaagtaattattagtttcccaaaattaaaataactttctctttcctattaattatggacgaaaaattaaactttatttcttaaaatttattaaccaataagaattgcaaaactaagatttgatatccaattatactattttattaaactaacatttttgaagttaatttttatttattttttttaaaaaatcataaaacttgcttgataccattaataaaaatcataatttgcgatagataaataaatttaattttagaattttgggttaagtattttgaaatataaaatgaaaacaattatttcacaatttctaaaaaacaagattagatataacaaagatttatatttactatgaattaaactaaaaataattaatttaaactaattatcattatgccattcatttagaaatatttaaacaagaaattatacatattaatttccatatattttgggggtttttttcttctttttttcaaccggatatttctttaaataaatccataatatattattgcacaaactttttttaataatgtaaataattatacatttttcattcaaaacatattatccagcaataatagattgcttttatgggtgtatttcaaaatgtaattatatttcaaaaatccaattaattatgattaaacaagggaaataagaatattgaaaaatgtagctaaggaaataaacattattaaatttcttacaaaggtatttgttaaaatgttatttatatttttgaatttgaagaaggaacaaaaatcaagaaaggatatttgtgtgtttaacttatgatatatttgtaaaccttaacatcatatatgtttatccacaaaacacagtcatatagtataacatgatatttaaaggtaaaaaaataagacttttggaacatacttttaatgtaatgaaatgaaaataggaattttgagacacaaacgacatgaaaagagacggaagcactatatataaaaaaaaatgaaaccaaactaaacatcaaattaaatatccaacgggtatgagtttgggttatgagcactatatataaaaaaattatttacacacataactctgcatgtatgtattttgtgacacaaattctatttgtgatgattacggataacgggttggtagtattttatttcacatatacagacgagttatgagacgaaaaatttataatagcacattatgggttttccgttccaagatagttatgcctagcaaatatacatgaaataacccaatctaaaaccaaatccatatcctattttacactgataatcaaactgttataatgttttgattagtttagaaaataataacgtacaagcacttaactttacaattaagtaatatcttaatttatcttactaatataattttgtcttgtgagtccggatcttaaaatataactatacacgaacgcaattgaattttgatcattactcttaactttataatatctataatattacaaagtttactcataacaaaatattatatatttttaaaatctattaaacaatttatactataatatatatcacaaaataacaaaataatctatattgaatttaaaatatgaaaccccgcacgtatgtgtgggtcaagctctagtgtcttgttaagaatggtttttgcaactttcgtgcaaacttgtgtgcttactaactctaacacatattggaataaacatgttttattaattgattaacatttttaaaaaatatgaaatccttaatcgtttatcataacaaaattacgaacttgtttaagaatttatattggtaatatattttaaaatgttttcaggtcgtcgtggctaaaacgtttgaaccatttggttgaactagaatctataagtttaaacgaggctttaggaaaagaataataattatttgatactggaaatcctcttaataaatatgataatcttgattcactaaataaactgtaattgcttaattacgttgatctcacaatcttgttagctagcacaagaatgtgacttgattcttgttttatttatttattatggtttttggtgaaacacatagtctcacgacctatgtgtaacaagaaatatgaataaaaccatagtctcacgacctatgtgtaacaagaaatatgaaaaattattcataattgttttggacaaatgatcgatgagagcacgatctaaggtgatcttaaaatgcatctatttcttaagagtattttaaccactcactggtcactgcaacacgaggcattgacggatttttgtatccccgctaaaacaaaactaaatacattaattataaagattgcttctcaaacccaaactctctttttctgccttctctcttctatttattgactacttctcccgaaactaactagtccataaaatacaaacatagactccaag

SEQ ID NO: 10513 - DNA, 3000 bp, Unknown
  misc_feature (1)..( 3000): cDNA_ID_3036991_gDNA_ID_2213656_Annot_ID_181779 3000 nt of promoter + ATG
taggcttcatcggacaaactcgagtaacaaattcgaaaattgaaaagcttgactatacataactcaaacttagagacacaagctgcagtaaacttcataggagatcaagagaagtgtcgaaactaactaacacaagcatgcccatgaggaaggaagggataacgaagaaactttatgagttggcaactctctgcgacatcaaagcatgtgcggtaatctatagtccgtacgagaatccagtggtgtggccgtcaatcaccaacttctgtagataacaataattcaacgttagagaaaaaagaagaagttaccatcaaaacaattaactaaaagtgttttgaaagatttacaagggattttaaaagggttttataagatttacaagagatttttaaagggttttaaaagatgtacaagggtttttaaaagatttttttaaagaatttacaagaaaaccctttaaaaactcttgtaaatttttttaaaaccttttaaaatctcttgtaaatcatttaaaacctttttaaaatttttttgatggaaaatagatttactagggattttaaaagagttttaaaatatttacaaagaatttttaaagggttttaaaagatttacaatggattttaaaagggttttaaaagatttataagggattttaaaagagttttaatattgataaatatatatttatatttatgacgagagaaataaaaagaagaaaaaagtaaacgtacgtcattttagaagaaaactttttcttttgctatatgtagaggaattaaatcttctactttactctgctttttgacttttcaaaaagaaaaagattttttatttacaatagaaaagtatattacattacataatacacaatcaaatttcatatttcaaataataattcagtaaattttgtaatttattacaatatctttatttaataattattttgtttccagcacataaagtatctacaatactattatttaataaaataacacaaaatattatgaatatttctgatttataagaaataaggttgaattttgatgaaattcaaagttattatatttcacatataatcaggttacctaaaacacgaatataacatatgttcttaagttaataacattatctaaaaactcttaaaatgatccaaaatgtcaactgtaactcataaaacgttaatgtagattttagtacaaatttaaattaatatatttaaaagttttatcaatcataattattatatattttggtgatttttaacaaaacttaactaatctttctttttttttgtaatcaaaacgcaaactaacgaaaccaattgtgaaaattttgatttacaatattaaagtatacataatttattaaaaacataacaaaaataacatcattgaaaacctttataaaaaatatataactaaatgctgtgactactttcctaagtttctctcaagtttttttcaagttttgctcaattatttatttggtaaattatatgcagaaaaacaaaacaattccacaactttttctcaaggttttttttttgtgtgctcataatttataaattgaaattagaaagatacatgaagattaggcttcatcggagaaatccgagtaacaagttcgaaaattgaaaagcttaaccatacataactcaaacatagagacacgaactgcagtaagcttgataggggaagaagtgtcgaaactaactaacacaagcatgcccatgaggaagggacggataacgaagaaactccatgagttgacaactctctgcgaagtcaaagcatgtgtggtaacctacagtccgtacgagaatccagtggtgtggtcgtcaaccgaaggtgtttaagaggcggttttaatgtttattaaaaggccggcgatagaacggtccaagctgatgatgagtcatgagacctacttgtagaaccaaattaccaaagaaacaaagaaactggagcgtctacgtcttgaaaaccgagaaactcagcttacacattttatgtttgattgtgttgagggtaagataagtgagcatcagtatggtgcaagggaccttcaagatttaagttttcatattgatcactatatcaatcagcttaattccagggtcaagatccttacaaacaatggtgagtcttcttcttccgttcctcctctacttcatacttcagttgcgggtgcgggtgcagctcctcttcctgttgcgggtgccgatcttccgatggatcagaatcagtatgagccgattcagctctatatccctattggtcttagttatcatattcaataccaacatgaaatctatgataatttcagtttggatccaaatcattagtatccgtttcaacatgatccactcatgaatatgttgatggaatatccttatcaacaagtgggttatgttggagagcatgcgcacatccttttcatgaacggaaactactacaactaccaccaaacaccaaccgttggtcttactaccaccggtcacatgccttccaacaacaacaccacccccaccaccgatgtgtgatgtgtttcaatagtttgcatttttgttttgttcgtttcaaaaaaccttaaactcttacaacaattaattggatttggtttggttataaaagatgtgtctattcaaacaccaacttttggtaaaatatttgtagaggccatacctcgctgtgatatatatttcgactatctcatcccattttttgggtgatttgttcaaaactagctatgtctttttcggtatgcaatgtataaatgtaaatgtaattttgacaaattttaaattttatttaaaatttatttatgaaaagtattcattttgcatataaaataccaatttggcaaattaaagaatcttaaaaagaggtgtaggccggcttttcatttcctccgtacgtaaataaacaacccaccaaacaaaaatctctcctcgctccatgccttctctactctctcttcattctctcctaagct

SEQ ID NO: 10514 - DNA, 3000 bp, Unknown
  misc_feature (1)..( 3000): cDNA_ID_3036999_gDNA_ID_2213656_Annot_ID_181777 3000 nt of promoter + ATG
aaataacttgtgagttataaatttatgatattgtagtatataaaaccgatttttagtgtatacctttcaataattgtataaagtatattttaaaagtcaaattttgtataaattaatattgcaacctcatgaaatcgtagtgatttacccgtagggtaccacggggtaattttaattttaattttttataaactgataaatttgttgattttagttaaaaataaaaaataaattaagttatatttgtttttttattgtttcagattgtataactatattttgattgttaattccatgattttatctatggcataatatttatcaacacccggctagtttcttttaatctagtgttgaccctgaaagaaaaatccataagaatacgcataaatgaatagtaaattaggagataaacatcattagaacatgaagtaatttacttatgaatctctatctatttttttttaaagaatcaatatactagattaattgtgaggcaatgtgaattacatattttcaatttaggatgacgaaaatattttttaaaactacaaaatagtttcagtatatattttcttttctataattcaaatttagcttagttatatatttttaaaataatgaatattacatgtttaaaaaaaataaaagtttatatcatttaaattctaatttaattgttaaatattttaatctatactgaaactattttgtacataattacaaatctaaaatccaaatctaaattattttttatgtgtactaatcaaaaacaattaacatagttttgttaaggaaattgtataaaatctaaattaaataataatttgttattaaattggattgtagtttccgaattatctaataacatattaccaaaataaataagtttgcatatatacaattcaaattaaaatagcctgatatgttatggaaacatttttaaatgattttcgaaaatattgggtagttattaatttattgatttaattcaatttttttaaaaaaaacaaaatctctgatatttatttagttgtagtagttgttaatttactaaattacgcatgctaaaatttatgcgtagttagttttaaactactcttacaatgttgtagtttacacaatgcttcccaattaatagtatagataatagtatactagatagtttatgtgcgggaaacaaagtaattattaaataaagatattgtaataaattacaaaatttactggattattatttgaaatatgaaatttgcttgtgtattatgtaatgtaatatacttttctatttatttgaaccagcgatattttgcatagaaattattattacctatacattgattgctattaatatcttcgttagcatatcatttttatgtttataaaaaaaaaggtatatatattaagttccgaaagattacttgcttaattattaggttgttttaattaaatttagtttttaattatttattacttttaattggaatttgttgatatttttatgttgttgagatatttatatataatactaatgacaaatttttgtaaataatctaataaatggtggacaattaatcaagtttgttgagaattgttctggttgcgacacgtcatgacatctctataaataacacagtagctaaaggttattctcttaagtgtatttctctattaagatatataggggatttctctattaattctagtttataattttagaagtttatttgattagttaaaatttaaaataatttagctagattcaattgttactatttgaatattaaattatatagctagattccacaaaaaaatcacatataaatttagttagattcagcaatttagctaggttcctcaatcctcacttaccatttgaaacttgaatgtgtctctatatcaattaaggtttacattcttttcgggtttcattaggatttaaggtttcaatttgtggattcatcctaaaaggttttcctagcgacaataatacttgaccttccacaaattccggagaatttcaactcagtatcccttgttcttattagggctctttttcttatgacaaaagaactggcatgtggccaatacgatgtgaagagtgaacgagaacctatgtcgatcgataaatcaaattagtactgggccaatttataaaaagatagacaagaaccttagtgggcgtaaataccagattaaagcccattataaaaggagcaataattggagatggaagttatggtcacggacacgtaaacttttacagagctttattatactttatggtaataagactttaacctttttttagtacataaagaattgttacacggctctatgtaaatcttccaagtagtagtaactccgacaatagtactatcatgcacagaattctcaactctgttttggtaacactatagttaacgaaagtagaaagaatctagtgactcgaatggttcgtgctaactcaacaaccttaatttggttgttgaataaattatctcatacaacaaataaaacaaaataaacgaggtatggtcttaaaatgtattcattgattacgacaaaaacagacaacaattataatcttgcctgatgtcaaacatatgcatgcacgatattattagtcaaaattttcccatgtagtagccagaaataggacaagttaaaatacaaaaacaatctaaattgagcaactttataggagaaccacgtgaaggaatctaacgagtggaccctgacggcacgtagcctatcgagtcaaaaagatagcaaacggcgcctaaaaaaggatttgagccatggcatttccgtaattatattattaatacgagggtaaaatagggaaatgaaagacaactgacgtcacgtgcgagtcaggacatggaacaattggcagaccacagtaaccaagtggtcaagctcaagctttagctcaaaggtctgtctcttcaggttttgtttatgaaccaaataaaaaacaaaactttaccggagatg

SEQ ID NO: 10515 - DNA, 3000 bp, Unknown
  misc_feature (1)..( 3000): cDNA_ID_3038276_gDNA_ID_2213656_Annot_ID_181775 3000 nt of promoter + ATG
aacaaccatttcgttttttctgttttgttttgctaagtaaatattcattaaaactaataaattgttttggtctaacaagttctataacgcctacaaatttgattctatagaaacaaaacaaactcagaaatcttagactatggacagaaacaataaaatttacagtatcaaatgaataaacgattttgaagttctaatcaagtatattagaattttgatgtcgtttacattctaaggatatgaattttttaattaaatgacataagaaaacaagataaagtttggttttgcggataaacatcaaacgggttcggagtggatcccgcatgataaagaaatggtgaggtccatttccatccaattcaatgtgcgttttctacaggtttcgcaacacttgtttctcttctatttattattcaaatctagaccaattttggcgcaacgttacacaataagtactttttaaatatattcgaatatttcttatgtttgtagtgaataatttaagagaaaaaaaagtcattaatgtcttcatttatttggttatagccaaaaatgtctaataatgtagtataaactaataaacatatatagacaattctagtataatgtagtataaattaatgtaccacctcgatggttactgaattatttgtactatccatttacaatataataaagtcagatgttaaaaaaaaaaaaaaaagacaattctagtgaaaaaaatacaaattcaaaattataagaattttgcgttctaaaagttgagggctaataattttgaatttgctacttattcgatatagtgaagtaaaaactgcaaattatattaattttgaatatgttaaccattagatttttgattaaaaatttaattgataacggatgttgtgaaaaaaaaaaaaacttttatcattagaaaaaaaattgtctcgtgattttcactagatattcactcttatttcctactaaaaaaaaaaaagatattcactcttatttgtttatttaaaattattttgagatgtttctttcatataatcttgtactcaataaaatctgttttttaattactaaatttaacattaaaatagaaaaactataaatatgattagtcaaatagtatagagcatttaatttaatagtataattaattaaaaatgataaattaagaaagttagtataaaccaagaccaaaaaaaataccaagagcggagagacagtagaagacacacgcccctagttttcacttcccattctccaactatatatataactaaatacaatcgtataagaaaacacacagagaacaggaaaactaagaagattccattgaagctaaagaaactaaaaaatgttgctggtgactttgattgctgagatgatgaaggagtacacggtggttctcgccggagttgtggagcatcttttttctcaggcgccttttccgagaagaatccgacttcatattttatactctcttcctttccatagttccaatacctctctccctcttcttcttccttcccctcctccttattctcgttcttcttgatgtttcttttcttgcttactttgtgatttttctttgagttgaaagcttttgtgtaaataagatctttagcaaaaggtaatagaaaaaatgttacagagctttgttttatgattttcttttgttgttcaaaaagaagtttttttttattgatttgaaaacattattcaaatttgtaacgttttggtttggaggtgaaagttctcatcatcgtattcgtagagttgagtagaaggctctatttttccgacgtatcttcttagtaaagaatagatgagagacaccatttcctttagaacctctaaaatctcgagttatgtgattctgaaatcaagaaccaaaagacaaaagaaaaaaaaaactgtttactcggttcaatttgtctctttccggtcgagccactcaaaccatatcaattttgagaatgatttacttccctttggtgttagagaatgatttacttccctgtagtttattggacttaatggtagttgtattatttttttgaagcttaattggtaagttagatgaaagttttgaatgtgagattttttcttcgagacttttctaagattttattattaatcttctgtttgaaataagggtctcattttttgagattattcatatttatctgaatagtctcatttctcatctgaatttatttttagtaattttttggcagttctagtaggtaatatctatcatttctttctcaactcaacaaaaccatcttcaatattaataccgagtacaaagtgtttgcttctccgtgtctaaaattgacttaagccacaagggagtactactatccaaggtacataggaaaatacatggctctcttagcacattggctatcttgttatcctctaaaaggaataagttggtccaaaatcatctacttgtagttccaacttccaagcctccatgtgagtaaatgtaatcttattacttatcttcaaacactctcaaatcttactttttcaacacccaaattgtctaaacattacacacgagaccacgataatgtcgtgacctcagcttcaagatgatacctaagcttaggatatacattggccctatactactacttcacctctcaattttcatctctcaataccattcaaaatttaaaatatgtttatgcaaaattcaaaagagaagagaagtttagggacacataaaaaatatgacaaaaataaaaggttgaaaatgtcaaatcaaaaagttttcgtcctaatccgaatttttgacagagtaaacagagaacgacatttttttttgtttaatagaatttgacctgaggaaggaaaaagcttcgtcctttcgcaaacccagggaaggggaaggtgaataagctctgcaaaatccctcccttcccttcttcttcttctacaagatttcaccatttctccatcctaaaccataacaacagagatatagagaagatg

SEQ ID NO: 10516 - DNA, 3000 bp, Unknown
  misc_feature (1)..( 3000): cDNA_ID_3037003_gDNA_ID_2213656_Annot_ID_181773 3000 nt of promoter + ATG
ctccaaaaatggatgtgaagaaactacttacaacgatgcatgggctgtcagagttactaacacttgcacatggttcagaatcttcagattcaccgaatgcggaagagcttgatctcattaacagtactgtacagaatctcaatttgtacatccaaaacaacagtcaggaacatgctgggaatcaaagcgttgcacaatacaattcatatgatctaaagctgttacctaacaagagtaaggtatgttgttctaactgtttctatgcctataaattgctagcttaagccacatgagatttcattatacttggaagcccattacattcgcctagaacatattttattcaaggtcaataagaaaaatatactatcatgtcttgtagaatttaccaaaatgatattgttttaatgggtcacctcttccttttgttaatgggtcaccatgattccaaatcctgtctattagctatcgattagagaccatcagtttccaacggcaaacaatatgactgtcgaccttgatgtgaaaaggaaggataagtactctgtggtttcaagggagactgtcccaggttctcgttcgtatcaatatggtgcaaccgaagataacggctttggtcaggtatgttttttttctccatacctatgctgtgataattggcgtttagtaggaggtagaccgtcagtttgatcatgtgggcaggttgtgcctacaaatggttaccaacagcatcaaggtgtggagcagattaaccaaaatgcactgttctataaaagcttatggctgaaggctgaagcagacaggtgtttgatggtctacgagacttctctttcgaacccatatccttgaagatattagaaaggtgacatcaaatcatccatcccctctaaaaatactttgaagggcaatgacatgtcagattggtaaggcttgcccaagattttttttgattttgcaggttggcatgtaaaatatcaaagaacagcctcaagatctccaatttctggatggagactagataaggcatacaaatcattttcctaagaagtggctgacacatgactaattgtgcagaaagatgaagttggtactcctttctacaagttaccctttattttacttatggtcatgtcgattcaagagaatgaacactgatactatttctcagaatcactactgaataaattggtcttttttcttatcagaacctgggaaatgtttggacgtggagcctattgattgctgaagattgtaatgttttcttgttatggtcctgactctttgattaagagatgtataaacaaaccactgttactcttttgttaactactacgtcatcacacttttgttatatagtgcctataatgaccgcaaattaaatactttgatcagagtagacagataatgacttcaaatcaaggggagacataattaataatgttcaaagaaaatggtagctgagacaagaaacaatgaaacaaaagcacaatttaggtggctctactactcaactctatgtagtgagttccataatggctgaaacgatatccccatcattagcctttagagcactgacggctttggccttggagacacctgcttgggtcatgacaagatcaatgtctctggcttcaacaccagtgtcatcaacatcgtcttcgtcttcttcctctgctagtggagccatggtagcttcagaaccggcgttaggtagcatggatgtcacatcaggcatcttaaacctctgagcagcttgagtctgtagctgagagctcaaatcgtcgaccttggcctctccaaaaatgacgtaagtctctgcattgggactcttgtaaacatctggcttcgagatgacaaataacacctgacatagatgcaatattttccacaatcatcaaacctatgttacttataaccagagacatgagagtttattgattgttagaagatttgtttacattcttggctcttttgattgtcactctgctgacatctgagacaggtttcatgccaagctttagaacagctttgcgacttttcttctcgcttctactttgctttgcattctcatttccaccttccccttcaactacacagccaaaacattgaaacaaaacccgaaattaacaaaggtttctctttttagtgttccatagagaaacaaattcacatttaagagctatagctcaagcttaatctagggcttatgaacctcaagttcaacaattttctgattttctacaaacctaaaagacaaatcttatctatacactaacgtttctagaaacatacatagaccactcgaaatcaaagcatgaatcagaatcaaacgagtaaattccggttaaccgaaataaatcaaaccggaaggaaaatgaaatgaaagagagagtaaggaaaatgaaatgaaagagagagtacattaccttcgacgtcctcatcgtcttcatcatcgtcttcttcctctccgtctttcacatcctccacaacaacatcatcttccttctgtttccaccagaaaccattatcaaattcgacgacaacaacaaatcggaaacaaaatcgctcggaggaaaagaaaaaaaaagacgaacctcgagtttcaattgctctttgatggattcaatctgagatttctcttcctccacaattgctcctggcatctttcttcttcttttctttcttagcgcagcaagaccttccttaacagtgagtgacagatgaaacaaataaagtagataaatgatcctctgctccgcggttcactataaacaaacccaatggtcgtcaattaaaagcccattgggcctcagtctcaaaaactttgatttgttctttagtttacttggcgaatttacgtacgtctccatgccagaatggtcaaaaaaaagagaagaaactattagtctaaagaaatgaagcattcacaatttgactagaattgacaaaagcttttgctttgtttcagagattcaggaagcaagaaaaatttagaaaatg

SEQ ID NO: 10517 - DNA, 3000 bp, Unknown
  misc_feature (1)..( 3000): cDNA_ID_3037026_gDNA_ID_2213656_Annot_ID_181765 3000 nt of promoter + ATG
caaattgcaacaggaagttgataggagccaagtactttatcaacggttttcttgctgaaaaccaattcaacgccacagaatcccctgactatatatccgctagagactttgacggccatggcacgcatgtcgcctccattgcgggtggttcatttgttcctaatgtaagctacaaaggccttggtagaggaaccttgagaggtggtgcacctcgtgctcgcatagcaatgtacaaggcttgttggtatataaacgagctagacggagtgacatgttcattttctgacatcatgaaagcaattgacgaagctattcatgatggtgttgacgttttgtcaatctctctcggtggtcgagttcctctgaattctgaaaccgatctacgtgatgggattgctaccggagcattccatgcagtcgcaaagggcattgtagttgtttgtgctggtggtaatgctggcccatcatctcagactgtggtaaacacggctccttggatcttaacagtggctgcaaccactctagaccggtcctttgccacacctattatacttgggaacaatcaagtgatattggtaaaacagagtagctcttctacaaatgtcgtttcttcttttctttaataaaaaaaacaagttaggccttcgaactctctgattatgggtattgttactgcagggtcaagcaatgtacataggtccggagcttggcttcactagtttggtttacccagaggatccagggaacagtattgacacctttagcgggtaattaatgataacaaatctattggtgcttgcttagaaatttgttcagtttccctaaagaacattattctctgatatccttctgaatacgtaacatttttcagtgtctgtgagtcccttaatctcaactctaaccgtacaatggccgggaaagttgtattgtgtttcacaacagcaagagatttcactgttgtatccacagctgcgtctattgtgaaggcagccggtggtcttggcctgatcattgcaagaaacccggggtataatctcgctccatgtagtgatgattttccttgtgtagccattgacaatgagcttgggaccgatatacttttctacatacgttatactgggtatgaaactatgaattatgatcttcacttcttatattagcacatgctcagttgtttcattcccttcaagaaacacataatcataagaaaaaaaatacagatcacctgttgtgaagatacaaccttctagaacactcgtcggagaacctgttgggacaaaggtagcaactttctcatcaagagggcctaactcgatttccccagcgattctgaaagtatgtctggatccttattttctgacttatcagtttttctgcaatatctctaattttttacacaatgcagcctgatatagcagcacccggtgtgagcattttagctgctacatctcccaatgacaccctcaatgccggtggatttgttatgcgttcaggaacatcaatggcggctccagttatttcaggagttattgcacttctcaagtctttgcatcctgattggtctcctgctgcttttagatcagccattgtcactacaggttctttatcttcttgcaactagaaaagcaagagaaacttgaatcccccttcaactcaataatcttctttattttgtagcttggagaacagatccattcggagagcagatagctgcggaaagttcatccctcaaagtacctgatccgtttgattatggtggaggcctcgtgaacccagagaaagctgcagaaccaggtctcatactcgacatggactcacaagactatgttctctacctgtgttccgctggttacaacgactcatcaatctctcggcttgtcggtaaagtaacagtctgttcaaaccccaaaccttctgtcctggatatcaacttaccttcaatcaccatcccaaacctcaaagacgaagtcactctcaccagaaccgtcactaacgttggaccagtcgactcggtctacaaggtcttggttgagcctccgcttgggattcaagtggttgttacaccagagacactagtgtttaactccaaaaccaaaagtgtctccttcacggttattgtctcgaccacacacaaaataaacactggattctactttggtagcttgacttggactgattctatccataatgtggtcattcctgtttccgtgagaacgcagattctgcaaaactattacgatgagaactgaatgattcgtaatagttatttattacccccaaacatttgtttcttacacttcagcctcgtttaataaaccactaatctctgtgttgacaatgaactagaatttagttgaccatgtatgtagtgagtgtaaaacattctttagtttctgagtgatccaattccaagaaaatgtaaacattctttgaaggagacatcagacctctatgtataaaatgttcgtgcttccacaaccaaacctttttttttttgcttggaatgagaaattttgtcatcaattcttgtggtgctatgtccgataatagcttcgctttgcttgtgttgtgataatctcaagtaggtttaggttcatatacagtgtatatggattggccgagaagcagcatgatgatatatagtgcatgctcgtactactcacaagctagctagctttattatgtataaatagtataatcttccgccaagggattggcatggaacatagtaaggaaagtgctgcagatactttgaaattattatatcttgttcatctagaatacattagaccccacaaagaaaacaaaacattcttggccacacaaagaccaagacatttccgtttattttgaattttcgtctcagtctcccacaagtcgtacgtagtataattgcatacaaactaaaacacgtttctatatatatataaatgctggtgcttctttaaaaatattcaagtagattgaaagaaagtgaaggaacactatttcttttctgga

SEQ ID NO: 10518 - DNA, 3000 bp, Unknown
  misc_feature (1)..( 3000): cDNA_ID_3037046_gDNA_ID_2213656_Annot_ID_181760 3000 nt of promoter + ATG
agaagtacttgctgctgttcaggttcagaacctgtggtgcctcaagagcagcctaccaacgatcaaagtaaatcaagttattgctcatgcttgtacgctattcaaacacagattctgcattatttatgaatttaatctctgtaggctacatgtttcaatcaaatgagaacccacgattcagaaacaacacaactgtaactacagaagtaagaggaaagagtgttacctgacacaacaaactgaaccggagttggttgtcattgtagtctactccagttataggaccatagattttggatcctgttttgcccacaacctgcattattaccattcctcattagctcaaagtacaatacacccttgtgattatctaaccaatataaacagaccttagcaagaaagattggatggtcaacaaagacacgatcaactcctcgtttgtagcaatggaagaaacgaacattctcaactttatccccaactttgatctgcatcaaataacattccaagatgacttacctaagcatccaaaattcatcaaggtccatacagagcaaaagaaacttgagagaattatacctgaaccacaacacaagtgtcccaagcatctttatattggtcataccgaggacaaattgtcatcacacggtggcctctagcctaacaaaagtcataacatgtaggttcatcaaaaaacaagtaaagacctcaaatcaagctaatgtttatatgaacttacagcaagagctggaggtagaccaccgagaacatcaccaagaccaccagttttactccatggaccaacttcagctccaataaaaatcacagacattcctttctcacacacaatcttaccagcagtcttaactttagaagatctctttgaggatttagcagaaacaggtttagcttgagatctcctctgaaggttatccaccatgttgaatgaccttaacccacaatgagtcaaggattggccttttaaggtaatctgagcgacatcagagcatgaagaagcaccatgattgttgaaaagtgaagttcttgacacaaagttagaagaagcagtcacagttgccattatgaactacccgtttacctggattcaacagatgaacaatcaaaatcgatactttaaatagaaagatacaatctttgacaaattttacattaaacagaagaaaaagctcacagattttcacggcaactgaggaaataagagccaatggaggagatgagaaagtgaagagagcagaggagaagaatggtcagttatgtagagaagaagaagagtggaggcttggactgacacgagtgacacgtggcgttgttatagttgttgagtggcgattttcaatcacatgatgagggtcaatactcaaatactcaatggcattgcctgagaatatgtgagaatcttgaggttatactttgggaggacgatattttgatgcgtacgttttggtccgagtggctaagaatcgacggctgagatttgttggttttgggaaactgggactcttttagtgggtcctatgcttacacaagtgtttctgttgtcgtcgtgcatcctcatgaacgtaccgttggacgacatttttcttggcccatttgttaaaattcacggtcgagaatttttgtcatgttttatttatttagttttgtgtaagcttaaccactgattattactaaatagcaatttttaagtttaaattgataatgtcaatgtgattgcataattttcaagtttcttgcgtatatatgtataatttagattcacatatatcagaggctagccaaataaattatttcaagaattttttcatgcaccatcatttttccttccctttcaattactttaagttatttaatttccattagtcacatcttaagtagtaatttgtttaacaaatcttggaatgttagaaaggagttaatgtcatgattatattttttggttattgtggacggttaggagtgatttgtcgcaacataggagatcgtgtgatgatgttgcaatctctccaagacagtttcacgcatccacaagaacatagtctttggcccattttgacgttaacttttatttcttaaattcggacacaaaattatgattcgtgaaatgaacattttatattttcatattataatctcatgatcatccgtccaaattcttcattttaacataaatttaaaactaagtctttattttttaacagaaattccatcatattattttttaaaaccatgtttattcatgtctcacaagtctataatattaaaaaccataatcatactgacaatctaataaatccatagtcagaagaaaaaatgtcaccataaaaaaaataaattcggatatgaaaaaaaaataaactcggaactaattattatccgaattcgatgctctcttataataccatattgaagtaaaccttaccggaacaataaattattgttaagatttggacatgtagccgagaggataccacttgagctagccaaaaccaaaggagtcaaggaatcatcaaggatctgatgatgttgttgtggtgattatcatctctatgattccaaccaaacattggaacataactccaatcatttccataatttagttatttttttaaaatgagatataagatcaattacttaaatgaaaatgtgtgacaattcagaaatagtactagatatgtgggaatagtgtattacacaaaatctgcagtttccaagtagccttgcaagttgcaacgtttaagtcattttcttcattggtgggtattcgccgaaattaaaaggtactatcacacagtactactatacagtaaccggccactagtggctaaaaggaaaaaaaaaatatccaagtaaaatggaaatagtcacgtaatttctctcctacacatttacatcttttataaattctctgactcacacagtagctttccaacacaccacagtctttttctttttatcttctctacaaaacaacatcctacc

SEQ ID NO: 10519 - DNA, 3000 bp, Unknown
  misc_feature (1)..( 3000): cDNA_ID_2704610_gDNA_ID_2213659_Annot_ID_132500 3000 nt of promoter + ATG
tttcattcttaatcaactgttcttgatacttgcgaagagaagatagccctagcctctactatatatagttaggactgccttaaaacacactcgcacaatgttttatgtgcctcagtcctctgaaacgaatcttcatttttcagattgatataagggtagcacctggttctcatgcaacagaagatgcatgtatgtcatttttcaatatctatccatcttttttggtatgcatgttttgctttacatcgagtgtacttctttaacatgatgtctggtttcttggtgtttaaaatgcagtgaataaacaactaaacgataaagaacgtgtggcggctgcactagagaatccaaacctcgtggagatggttgatgaatgcctgccatcagaagagtgaattgcttttattttcttgtgagcaagtaatttacacaagcctggtggtctcagtttacactatcaatacatgtctctgttttatttgcaaagattttgatccatcacatcgactaggacttgcattgtaatacttactctgatttcaagtttgttctcaatcatttcaataaagtctcaaacacaagttctttttaataaaagttgacgtgtcatttcgatttcaaagtacatatacatcaatcaagttgggaacttcacatctctctctctcttaatgcattattacaaagtcagcaaattgtttatgaagcaaaaagctgttttcttcttcttcttcttagatgtattgatatatgaaaaaggaaacaacgataatgagatggatatttttggaaaggatatgtaaacttgaaacacacactttctttttgtgtcccaacttatctttaggttttcgattatccagagtatatgatgtttattgtttcgttgtataatgtatgggactcgaatcatactttaacaagaatcttgtatatagcaacttggtctcaagatcaacctagttgcataacttgtaaccctccgatagaatcttgcaatcatatatatcttgtagatgttgacgaactcgagaatcgggtaacaatcaatcatcttcttttgtagtctcgtgatttgattattgtcgtcgttaattgttatgctataagtagagtttaaatttgaaaatatgcgtatgtgagttgtagacgacaaaaaatatttaaatttgtttacgttagtccaattatatggataatatttgaaggaaatgaatgtaactgtaattctatagaacaaaaatgactgttactaataacatagtaacaattatgtcattgttgattatataataagagaggataatgaagacacaaatgtcaaatcgactttgttttctttattcctggtctttaggctttatttacatgttgttttggtttttgggagttatcatcttcaaaagattgggttgaacagtaagtgagagttattagcaataccataagttttaatacatgcacatagacattttttgacttgccggtgtaaagcgacacgacccttccttatttttccaaaattattatttgtttaacaaaatattatacaatacgatttgagctaatgaaaactaatataggaagaagaatctttgaatattcaaagtttgaaaggataatatgctatactaagtccgcataaattagctggcttctagaaaattgttgttaaaaatagctgtcttctagttttaccatttacataaaagttacaagaatttatatcattcattacaccatatgtaatatatggatatgaattcggatgatgccacatcgaccacaatagctcaaagctactaaacaaaaagtcttgactcttgatcaaacatttggagtgtttattccaatttttggattgttttggtacaatttttatttaatcaataatttgtgggacagtggtttattaggttttgtaatatcttgtttgtctcgagtcaagacacatgtatcatgtatgcttcttgttcccataccaataattatgttaaactatgttcaatctcaatattcagcaacattaccaaatagaaaaccaaaatttttataaaaactgttagccaaagttgggataaagacaattttagaagtagaagaaagaaaaatgactagtatacactatcacagaggtaagagttaaaaatgaactctatagcatattatgaatatgactattgtaaacttttcctgtatagttaatttagtatttaagaatctaaatcgtactttcttcttccaaaattctgttccatattcttttcacgtgaacatctaatccatagagttaaatcaccaaaattccatttctgtttcatcgtcgcataaaaaagtttatgaaactgtatcgatatattctatgcttctaatgaattatatacttggaccagggttcatcgcaggattcgactaatccaaaacttttttttttaagaaagtcatatttaactgaaacaaaaaccagatgatttaaaaaaaaaatgtttgcatatatcatatatgtgttggcttttgaacaatggtagctcgaaaaataatttcagaaaaattgcatgcgtaagatgaaaacagagacgcgattaagaaaatgtcaatgagatattttgtgataacaaatactaatgagttaaaacatgttttttgacaattttagaatgtataaatgtccttggcaatgttaaaaaaataacaatattttgtatgagttaaaaagagaagctaatttagtaaaacaatttactttaatttggaaacgtgtgataattaatttttcattggaaaaaagcaagctgatggctaaagtaacaacattttccaataccacgaccacgagtctataaattcccaagaacctgttgaatcactttcacttctcaaagcacctaaaagtctatctctctctctctgtatacagtcatgcatgcatagagcttaaaagatacgaaaacaccacaaaccaaatatcattaagtaattaggaaacttaaactaagtatg

SEQ ID NO: 10520 - DNA, 3000 bp, Unknown
  misc_feature (1)..( 3000): cDNA_ID_4268675_gDNA_ID_2213659_Annot_ID_132503 3000 nt of promoter + ATG
acaataccaatgtactataccggtttaatgcgcaagcatattttagattgaactttttgacattttagatataaaaaatataatatcaactatttaacttgcggaatatttaaaaattcaatgtgataaacttttttttttcatttggaatccaagctctttgagaccacttgaattgaacatcttagaaagtttataaaaattaagtacacataactttacttacaaaaatttctgataattctttatcaaaagatttttttttataaatatttgcaaaattaaaattatggctaatttgctagaaaagcaaaacttttagccgaaattatatatatagttttgtttaaaggcccaaaaatcgttattttgtccaaaattgtccaattacatcaatcttgcatttttttctttcaaaattagataaatctaaaaatcaattatttataaaacttaaatatttttgcgtaatatgggggttcgtatagtgaggggtaaagttgtcattaaacttgaataagagatgtgagcagtgttttcatgcccgacccgaaccgtccggtccgaccggttgaaccgtgacccgaatactttttcggtttgggtttagtgctaaaacccgacaagttcaaaacaaaaaaaaccacaaaaactcaccattaacccgtgaaccggttgaaccggctgagtgtgggtttaaaaaatttttcttcatttcggaataaaatatgggattttagactttattcaatcatttttagaaaaaaaatcagttcttaaactcatttgatgttttagattttgataaagacttcacaatgccgctttaaaaaataaatcgaatactgagtgagacacccaatattagttctgtgaattcacgatgttttattagtttatttctgtcattggtgatctcctactatatttgttacggtattagatatttagttgaattttaaaaatttagtcacttcattattattgtttgcttatatatatatatatttggtgcaaatgatttaatattttattaaatataatctgattttatattttataaacatgatatgattattttgtttttaaatgtataagaactctaaaaactctaaaatctctattaatattaaatttattaaataaattttaattaattgatccatggtccaacctggttgacccgatgacccagtgacccagaaggtagtccggttcactgtctgggtcgggtttaaaaacattggtgaaatgatagaactaggtacaatacgtttgaacgagtagacaatccttactcaagctcagctctgttaagttaagaaaaaagataacaagcgattctgtgtggacgacaaagcattgaatagagtaacagtacctgacaagcttcctgttttaatgatagatctgttgctagatgagtttaatggggccaaaaatcgtctcaatattggactttggaatagggtatcatcatatatactaatatagagaagacaacgtttagaactcatgatggacattatgagtttgttgtgatgtcatttggtattacaaatatgcacatgttacattccaagcattgatgaatgaactttcaagaccttatttcaggaaattcatttttgacatctaacgggtttcgggtttacttcaaatggaaaaatagcacatgagtaagggatcgctctaaatggaattcaaaacatgtaccttctttttttgcaatagaatccaaaccgaactattatgtcaaaaaatttcattgcaattttgttgttcgttactataaatttggtttcaatgttcgtaaaagaatgcacatcacaatacacatcgtaatattcatgacaacatattaactaaagataagggatcgctgatacagttttaatggttaagttaatcgtctaatacttttttctctctctttgttatcgtcaactagagtatcttcccgaggcatttatctcaactctctgtaactctcctccctagagtgttctccattaccggctcaatttcaagtggtccaaacatatcagacacaaacagtaaactctcacatacatcatgagtcatttcgtgaagtaactgcctcattgttcttctgtctccaattaatttaacacacatggctcttctaataatggttttgattttggttaattttgtagatatccaagatatggatgtgaaagttgaaacacaggttgaccatagtgagttgatatgcttggtattattaactgtggatcaaaaacaatgagaaggaagttgaccaaaaaaaaaataaaaaaaagtgagaaggattgttcatagttttttataaaaacaatctgggcctttttatgggcatttattttttcatgaaaaatgcttctaagcccaagtaggtgtcgcacccctgcccaccccatgtgggccgtacctaggtgtgtcttagatgaagctaaaccatttttcatagactcatccataaaaagtatgcaagttaaaacaaaaaaaatactggttttggtaaaatttgcaactcctgtcacaattactaaggcttgaacctttcttcacatagatgtagcacaactacaatttttttttatatgcaaattagttgctggaaacgtgaactcgatagaagcaaaatgaaaaaaagaagtcaattctgttttcaactgaatccttttgatttcacacacgattcatttcctaaactgagaaaaagcaagaaaagatacagtatctaccaaatcataatgtacccatttctttcttataacctttaagagctttcacacaacttggccaaaataaaaataaaaaagaagctttcatttcacacaccaacacatatctctaaacacataaatctctggaatttacttccttatacgtctctattctttatcagcatatttatacaagagagccaaatgagaactcactcatctcataaaaacaaaaacaacaacacacatttcaaagaactctgaaatg

SEQ ID NO: 10521 - DNA, 3000 bp, Unknown
  misc_feature (1)..( 3000): cDNA_ID_2715815_gDNA_ID_2213659_Annot_ID_132509 3000 nt of
atatcataatatagaatctgtgaatcaaagtgatgatatgaagatagacgataactttgatgattatcgtgaatgcatggattggattaacgaagagatgaataaagatgtatgaataatggtgaaaaaggagaacaacaagattaaaagtagtttataaatttaatatgtttttgtataatgcatattcatatcataaatatagatgtatgttaatcataaacaatatgtatgagattctaaaagtttttcaggttcttaatcgtaccataagttttctttttttgttaatttgtttctcagtctttaattaaaatgtagtcaaacacttttaatttgaccaaagttagtatttctattaaaatcagttctaataaaacttatgaccaagtagtagatgctctagtattgatcctaaatctaattttttattttttttaaataatagtttactactttacttccaaaattatagtcaattgtcattataactattatcattgaaatatatttttgtcaacaaatattatttactatagataaccacgaacaaggcatcatatctgtcaaagaagcattggcatgacttcatgtgctctctaaaattaaaagatatgttttgtctcaattgacatcatattattttttgttacgtcgtagtaatttaatgacaaattactgagtctttgatttttagcaaggtcgtcttccaactatgtttctaaatctaatcatgatttcggggtttgaaggcaaaggatggagcgtgcaaagtcgatttcttgttgttctgatgcttgagctggtggttgtgctaccacttaaagctacaatatgtataaatatacccatttaattacttactcttaatcaaatatctctcaaaatttctccactaaacatttgtaaaccacatccaaaaaataaaaaaagagtaaccagatataatgattagatggagacactttgacaattaagtcataaatattagtgttcaaaattctaaaaaaagagaaaaagagaaaacaaatatcagtgttataaggacactttaacgtttcttcacttgcccaaagctctctgaagataaaagacaaaagagtaaagagagaaagaagcacgaaaaccaaatcaatggcggtttcagtttcaatcctcaccgtcgtcactgctcttcacctccttgctttcgtcttcgccttcggtgccgagcgtcgccgtagcaccgtacccaatttatctctctcttactaaaatttgtcatttttccgatttgtgttgtgaattcgtgttttcttgtttattcaggctgtgccggttccggatcagtacgatgagaagactatttgtaagtacggaactgaggcgtcgacagtgtacggtatgtcggcgtttgggttgcttcttgttagccaagcggtggttaacggtgttactaagtgtctctgttttggaaagggtcttgttactggtacttcttacactgtctgggctattgtcttcttcgttgtttcttggtaaagtttattcctttactctctaattgaatcttttgtacatcaagatttgaaattgagttgatttaagtggtatttggtaaccaaaatttgaaatttctgattaggggcttttaagttagatttggaatgaactaatttgtgatttgattgtgtatatttatgggttttaactttgaagtgaaaaggaaagttttttccaactcttttcagtattgtgaacatgaaaagtaaacacttttagattagtgggtattgaaatttggttatgtgatttatgattaataagtcactttgttgcaaacttgacttcttatttacgtccttaactcttacttgtgagttgtggatgtctctatctaaagacaatgatagtggtaggcttcgtcatggtcacaattgaatattctatatgtttggttttacagtttgttatcttaccaaactatgtggattctataagaaaagaaacgaccttacaagaataagaactagttagttcatctctatgtttgagtacgtttgtcttagtcattggttttgtgtatctttagggtaagctttttaggagctgaggcgtgcttgttgggtggatcagcgaggaacgcgtaccacactaaaagtgaaggcatttacaaagggaaagagctttcgtgtgccgtcttacccgttggagtctttgctgctggagctgctttcactctcatgtctttgattgcaaccattctttactacttggctcattctaaggctgatactggcggatgggagaagcatcagaacgatggcattaacattggtatgaccactccttcagatgctccaaagcaacaaaacaccgagtttaacaaggtctaaaccagtttctgtttggtcttatgttggctatgcttttaaaaacagggtaaaactataaaaaaaatagttgtttgttaattgtcaatataaacttgtgtcgtcagatataatgttggcttatgtatgtctatgagaaatttggtttggctcagtcatcatcttagcttcccacttgacctcatctagattgttatcatctgctaaaagtttagacatgaaaacaatatgggcacataatggactgggcctacgaagaggcccaatgattgcattcctaacatatctagcctcaacttggaatatacttgcatgggaaagggtttagctatgatcaaaatgttgataactttttggaatacatttttgatcattaactcaagttaagaaagattctctacaagatataaaactaatttattcatgtagcaataaaatgatgagtttttgcaatatgctaaagccatacctttcctgttttttctcaaatcgctttcttctttatgaatccaagaacaaaaccgttcttatcctaaaagttcggaactatataataaaccatgaatcttagaccttagctcacaaaaaaggccacagttgtttcaaaacctgaaaccaaaacaaaatg

SEQ ID NO: 10522 - DNA, 3000 bp, Unknown
  misc_feature (1)..( 3000): cDNA_ID_1024257_gDNA_ID_2213659_Annot_ID_132510 3000 nt of promoter + ATG
acttatgaaacattccaaaagagaaaaagtattgcaaatgttgaatggaaaactacaccaagttatgctattgagattgagaataagagaaaggaatggaagaaaagtgttggaagacgtaagagtttgtggaatagtgagcgtcacatgaagtttatagctgctatctccattttgggtgaagaaggtaagatttatatttcacattgaccaattcgtttttatttattcaagtttagtatactagttttttactctcttttaccttgcagattttcgtccaaaatccatattagagattatgaatgacccaaacttaactcatcgtcaagtcggtagccaccttcaggttcatatataaaatatatatatttttaacatagaaatatgtttgtcttcttattatagctttatactaatatttttattctatgaatttcagaaatacaaggctcaaattgaccaaataagctatacattgccaagaaatgaatcgagatcgatagataaaacattcgaatatccttcgaactacaaatatcctttcaaaatatcagacttaacaaataatctcattgtaagtaattccttgtggaattctttagaaaagaaaaactctgcatcagcctctatcactcaatgtaagtattattctattatatagattttcacggtgttacaatttgtgtcatataagtattaacaatttttttttaatgcagttttgtttaaaaaacctattggtgagaaagaggaaacaatgccaaagtttcatataggcgggaaattagatctaagcaatcattcagttcatggtaacgtccttaacaagctatctatgaatgttaacttcgttccttcaaccataagtaataatccagcttacaatattctttctatcgatagctctagtatcgatagctctagctatactggtttagtttcaactggcttaagtagtgaaaattctcctatcctttatggtttaccatcgaatgatggtgcatctaacacatgcacatctcagatggaatccgaaaggatttctattccgcagtatgatcctaatcaatgtcacccacatagatccatccttgaaactgatgtaaaccaaatagatttagattttacttctatactagattctttcgatcctctagtagatgagtgccttatgaaggaaaacaatagatttcttccaaaccctaccatgaaccttttggataccgatatagacaagatggattgggtttcatttatagaaaaccttagtcaccatgatatcaatatgaaccatatggattgggatccttcaacagcaaattacgttcttcctgaaaccaacatgaacataaattttcctgaaaaacatacaaacgagataggttgggtttcttcacaagtaggttatgttccttttgaaaatatgattccctctgaagtagatataaaccatatgggcatgggttattctggaggaagtattccccctcaagaagaaactaatacaaataatgtgggctttgtttcttgtgaaatacatagtgaaatccctcccaaaactaatatggccattctagaaaccaattattcaaatccgttagattgggttttccctgaagatataacttcactcgaaaccaataccatccaaaagagtttggtttcttgtgaaacaagttacgatgctttggataatatggttcctttggaaaccaatatggaagagatgaacgatgctctttacgatatttcgattgaagatctgatttcttttgacattgatgccaatgagaaggatatattctcttggttagaagacaatggtttttctgaggaaaataatatgatggagtcatgcgaatatcataatatagaatctgtgaatcaaagtgatgatatgaagatagacgataactttgatgattatcgtgaatgcatggattggattaacgaagagatgaataaagatgtatgaataatggtgaaaaaggagaacaacaagattaaaagtagtttataaatttaatatgtttttgtataatgcatattcatatcataaatatagatgtatgttaatcataaacaatatgtatgagattctaaaagtttttcaggttcttaatcgtaccataagttttctttttttgttaatttgtttctcagtctttaattaaaatgtagtcaaacacttttaatttgaccaaagttagtatttctattaaaatcagttctaataaaacttatgaccaagtagtagatgctctagtattgatcctaaatctaattttttattttttttaaataatagtttactactttacttccaaaattatagtcaattgtcattataactattatcattgaaatatatttttgtcaacaaatattatttactatagataaccacgaacaaggcatcatatctgtcaaagaagcattggcatgacttcatgtgctctctaaaattaaaagatatgttttgtctcaattgacatcatattattttttgttacgtcgtagtaatttaatgacaaattactgagtctttgatttttagcaaggtcgtcttccaactatgtttctaaatctaatcatgatttcggggtttgaaggcaaaggatggagcgtgcaaagtcgatttcttgttgttctgatgcttgagctggtggttgtgctaccacttaaagctacaatatgtataaatatacccatttaattacttactcttaatcaaatatctctcaaaatttctccactaaacatttgtaaaccacatccaaaaaataaaaaaagagtaaccagatataatgattagatggagacactttgacaattaagtcataaatattagtgttcaaaattctaaaaaaagagaaaaagagaaaacaaatatcagtgttataaggacactttaacgtttcttcacttgcccaaagctctctgaagataaaagacaaaagagtaaagagagaaagaagcacgaaaaccaaatcaatg

SEQ ID NO: 10523 - DNA, 3000 bp, Unknown
  misc_feature (1)..( 3000): cDNA_ID_3037140_gDNA_ID_2213659_Annot_ID_132512 3000 nt of promoter + ATG
acggataacgtaatcaccattttttctaagtccccacccaaatatctacgtggctttgccacgtcatcctaaccaaaccgacggatttgttcagataatatgaaaaagctcctaaaaacagacagaagaagcttttgtcaccaatctctgatctttttagttctcttatcggtaaaaacttattcttctctttttgttcgatctgtgatctctaataaactaatttgatattttttttgatgtaacagggaggaatcttttatatgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattcttgtaagaatcagccttgtgttgttcgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtttgatgcttgttttgtatacatatttacagtttcttataaccggtgtaagatctcgggtcgaaagtagactaatacacccgaggcttgtagaaagccgtctacaatggccaaaagagaaccacaacgatctgtggccttaaaccatagggcgagtctttcacctacttgaacaaaccactggaccatacgctctttagtttttttttgtatatctttttatagctttgtagatgaatagatctctttatagctgatgtaccgatgattttgatggtttcaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcaggtttggtttaaatatcacacagtacatagtcttagtgggaaccattagttacatgagattagctctgtttctgcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgaggtttgaaatctttcatccactactatagagtctagttcagtaaccactatatatgttttattgttatataacctaagatctctctacctttgatgtgtgttcagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtgtaagtcttaaacaccgatgatcctaattcacattaaatagtatatcttaaacttttcataatgtaactagcattttcttaattcagggaggagaaaaaagcttaatatggtcccaagaaaatggcagagtaacacaatttcttgcaatgcctttgtacataagacactaatctacctcttcatctattttacatggctcagtttcttgcatgtaactgtgaatctgaagattcatcacttgttgattattttccattttgtaaccacagacaggtttgcaccaaattcaccagaattaacctttttagaagtcaaatcacaaggtttaacttacaaaaacaatgatgagatagcaacagtgttaccaataaccataattggtgtttggcttaaatcatattgacaagacccattaaaaagaggttagttatagttgtgataaataagcaaaactccttttttttcttttttgcttaagttccactatcttgcaagttttgtaaaacaaagaccaatcttatccctccaaaataatcttcaaaaccaagcaattagttgaaacaaatgattctcttaaccacaagctgggcctttggttattagtatctccagctacttattattctcaaaaaaatgaaacacacttctcttaatcatttctacatcaaatattaattttaatatatagttttcacacaaacacagtggcataaccgtaattactattagcttaagacttcaagactctggtttgttttttctgttaaaccgtaacaaccaccaaattttccttttaattttgtatttatttttaaatgattaattcctcataatttccctcgcgctgcgaatccaaagcctgtataaatactctctagcttcctctctcaagctactttctctctcaacttgaaatctctctctctctagccaaagaaaacttttctcggaagcttctctctcgaaattttctcggcggtttctcttcttctccaattttctcggtaaatttctatcgctttacatgtcaatttcttctccgattcttgatttcatcgttttgaatttgaaatccactgtgaaattgctgagattatctttctcggaaactagatctgacttattttccgttgtttgattcttcgcgattccgtttccgatgcataaattctgatttctctgtggcgattttgtgtaacagaattgtcaccgggaaaaatg

SEQ ID NO: 10524 - DNA, 3000 bp, Unknown
  misc_feature (1)..( 3000): cDNA_ID_2715803_gDNA_ID_2213659_Annot_ID_132513 3000 nt of promoter + ATG
gtgcttcttaatcgccgatgcctctcttcatcaaaattcaaaatcacttttgtcttttcaaaaatcacagcaaaataatattcaaattcaaaatctgtccaaattcatctagggtttctgataaaacagacgaagaagatccaaattcgctaacaatggtgagaattttatgaattcccaataccccaatttttaaaaccctaattttgtctgttgtgggattgtgttgatgcctgagtttttctgaatttgtattactgattgatgatcagggaggtgaaggagaagatctagagccactttttgattatcgtcgtgttcagccagcgaatttcgtttgtatcgatggtgagtttcgattatttgatttggtcactgagctcgacactcgacagtgataaagatgaatcctttattatcgcttgaatttttgtagatgatgatgatgatgcctcggtgacgccaattccgaagaaagcgaaaacttcacaaacagtaagaattgatttttattgattggttgttgtctcattgagctctttgtgttaacttgatagatacttttggtattgtgggcttgtaaagagttttgaatcaatgtcagtgaaggaacaattcgattatgtacttcacaattcataggttgaatctatcatcattccttttggaacttgaatctttttatataggttgagaagttagatgatgatgtgaaagtgattgaagttacgggtgatgacgattggttgcttcctccaccaaaggttatcttcgacaaaagtaaagactctgttgaagattcaactattaaagcattgaggtaacttttgtatgtctttgagtatttctcatctctaagcttcccatgttgctgttagaggctatggtagtgttatttgctatccggaaagagtcccagtgttacaatttgattataaatgaaatatgtaacgtaggtcgaagaagatggagctcatgtcatttacaaaaactgtaggagatgtgatgcaggaagttgaggagtctgctaaaagggaagttgaagaatctcgcaatccatcttcagagactgctgctcagttaccatcagagcctacgaatgacagggccaagattgttattacaatacaggacaaagatggacagaagacactccgggtgtttgcggtaagttttttcactgcttgccacttactatccaaccttccatcgacaataagcttactatccaaactttttctagctagatactagatatttagtagagataagaattagttgttatgtcaccttcgctactatctagatagctagatatttcgagctttctaggaaagcaagagtataaatacagggattaaagaaatcattgaatggggtcgagtatttgagacgtgtattagttgatggatctttaaactattctttgagttcatctaataaactagagaacgagttcatgttcttatcaatgtatcatcaccacatagcatttacacacagaatacatattgcttgctctctgtcatacaatgagccgctcattaatagatatgcatattctgttaaagcttgtaaaatatgagaatgttgatttggtatttaccattttcttgtaggacgagaaatttgagagggttatcaaactgtatacagataaagctaagcttgacccgcaaaatcttgtatttatttttgacggtgataagattgatccatcaaccactccttctgaacttggcatggaggatcatgatatgattgaagtgcacaccaaaaaaacttgacaaataggtaacttatgaagtcctccacatctttcttcttgctcttattgtgatatgatgataactcattatcttcgattgaattcaagtcaggcgctaatcggaatctggaatgtcaaatctgttccatcttttgcgaaaaaccagagttttgtacatcaacatgggcatgggaagggatctctctgctaacatctggtgtttgtatctgtgacctttctcattttatcggaattttgtttctttctttctttcactctttctgtcactctttattaggcgtgtataatatataaggtaaaccaaaccattttgattttaactaatcctattgaatccaatctaaaaatctaactaaacttttgtttggttttaatcgttatgctttctctatctcttgagaaacataaatatatatctcactaatctaagacaaaactaaaactattgtatgtataatcagtattgctttttactaactgacaaaaactggaatcaatggtaaatcggttaaattcggtttagtgtactttttcctttgtttcttagtaaatgtcgttttacactgatattttttatattcaaatatagtctcatgactctaatatttcttgttttgtaacattagcttttaatataatcttgatagaaaagaaaacatcacattagtcattaataaaattcttaaaaatgtaaaattataagaattaacacattcaagtactatttatgtgttttagttcatgtgaaaaataataaaaccaattaacgaactaaccaagtcggataattgtagtttttgtttggtccggagttagctacgacatgtggcatacaataattggttaggaaaagctaagctttaagagttagagatgatgggtcgtgaaagaagaagctgtcacagtggcacatacgtccgtggcttccccatatctcacgtgcatacggataacgtaatcaccattttttctaagtccccacccaaatatctacgtggctttgccacgtcatcctaaccaaaccgacggatttgttcagataatatgaaaaagctcctaaaaacagacagaagaagcttttgtcaccaatctctgatctttttagttctcttatcggtaaaaacttattcttctctttttgttcgatctgtgatctctaataaactaatttgatattttttttgatgtaacagggaggaatcttttatatg

SEQ ID NO: 10525 - DNA, 3000 bp, Unknown
  misc_feature (1)..( 3000): cDNA_ID_2715797_gDNA_ID_2213659_Annot_ID_132515 3000 nt of promoter + ATG
ttactttatgacttttcaccatattgatgataaacttaattgaaatctaatattaattattttccaacacaattagttgaaatggaaaaaaatggattttgactataaaagtaagtaggaatggggaattttagaaaagattctcttcctaaattgaagggagagatatgactaagaacatattcatttttttttttttactaccaaaattagtagaaaaaaataagaaaataggtaaataaataaaagagatggttggcagatcgtggaatttagtaaatagtgcgaatcccaataataaagcatttgatgcctttctttcttctacctcactttttttattccaaaaagttttatcaagtagacaagattttttttttttttttttgttttctaataatgtcaatgtgtgacatcctcgttgtcaaaatctcaagatatatgaatttgattcatattttttctttatgttaatacaaaaattaatcttagcatctcaataattgtgggataaactgatccgttcgtacaatacttttacaattatatgcgactatgaaaataattggactcatagttatgaaccaataacagaagcaagcatataaaaatcgatgaagagtttttttttttttttttgatatttaagaaattattgatacactaaatagatcaagaaatatattcatacaccaaaatgatgttttgatttctgtttttttttgtcaacatttataaggagcgagactcgatcctcgatgtcatgttctcagtggacttatcatttgcaacaagactactatcacttaacaattttgatttctgtttactatctaaatgccatcagcttttataattttcattttttttcactagataagttaggttttttaaaatttgttattaactcacacttcaaatcttatcaagattttactaaggtaaaattgatgtaccgtcgtttctttgtcgttgcaattttcctcgattgatgtatgctctattagtccaaattcaattttcattatccccaacccgtataagtgaattaacataagcttctggtaaaaaatgcttatcaaatgaaacatgttaaaagtcatggacacttaaacatattatcaggcctgacgtttatattgggccacatgctatatttgtaaaagactaattttatacgcatttaagattttgcttaagaaacgaataaatttgggctctaaaatgctatgagcccaataaactgcacattatacttgctccactaacagtaatacagtttccttttttttggtaggctaatctgaacagtttcctaataatgcaaatcaatataattaattaaagatttgtttcattcaagttaatttaactccgaacattatgttatgaagaagagaaagactttgttgttggacttgatgcactctttcgctcattaaggtgatccatacattttaatttcaaaattgttggcaggaactagattttggttttactgatttacaatgttattaactacaaaaaaaacaaaaaacaaaacaaataagttatcatatctatcaagtctcaactattaacttgtggccttagcatctccaaatttctacattatccctgcttttggtttctttaagactttaatcccaaccttaattcacagtttttttctcatatatatagtcctcatcatgtaagtaagtcctagctaattttgctgaaaccactctctcatattaatttttcgtaatatgtttagaaattagaaaataaaataaaattagaagctatatataattaaagtttgttccactaaagaaaatctcaaaagtgtaaaattgtcagagataattcatctgtataactttaaagtaacggtgtatactgagttataacacacaactgacgtacgttactagaactatgttcgtgaatagaaataaagatgagattccttaaagctagataaaaaatcaacggccaaggtgaagcatattttcataaaccatgcatgcctacatgaaactacttgcgacagacactaaacaattcgaaacacttcgtattttggaaaaataaaaactattgatgggctacaagcagaaagcatgcatcgcacgtgtcaacagcatctgaacacgttgctggattctctttttgttcttatgcattccgatttgtatataaacgtgaacggtgaactactttttggacaatttatactttttttttctctatctttaaactagttttgtaacaaaatcacccacttacacgtacactatctacgtaaagtggagtgcaaaacagttcatatccgtggaggtctagtaatttatttcaagaagttcttaaatttatttttttggtcaggaaatttagaatgttcttatcacattattcttaaaatgcattcgttatgttatgtgaatgcactagccaaaaataaataaatgcaactaccatcattggttaatattcatgaaactttttttttttttcatgaaacttatatatctattaaaagtttaaaaccttattatacgaaatgtttgagaatctattatctgtcaccacccgtttgtgaccagagagtagatttctaaagtgttttggataagtttagtgttttagagtattaaaaaatttagaagcacttttcattagactctatatatgacatatctataataatattcctgaatttgaatttagcatctacttatatcgcataactcatttatggtactgaaatttagtggaaaacagctagtaaaagagaagtattggtgtgataaataaagctcagaggctcaggataagtcaggattccttaactcattttagctagcctatctctctctttctctctctctgtctctccctatatataaatcgataaataaatgagtgtgaggtaattaaggaactagaaaggaataagaaattatggagagaatatgtgaaatgtggagagaaatgaaagatataacggcaatg

SEQ ID NO: 10526 - DNA, 3000 bp, Unknown
  misc_feature (1)..( 3000): cDNA_ID_2715789_gDNA_ID_2213659_Annot_ID_181816 3000 nt of promoter + ATG
cataaaagaaaataaaaaaataacaaaagatgtgcagacatgttacaagacaaccaaaaggaacatgcttcacagaacaactcacgcgacatgacagtgaatcaattattaaacaaacaaaggagaaaccttagaatctaatctaatccacatggaacaaagacctttgacacatctcagatccatagaaatttatataaaaatgttagcataaatgtataagaaagaacgaaatgctctcgataaccctagaattcaaaaacataagaatacacagatggattctgacaagttcaattatacaattcaacaaattttcaatgactcatgaacctaaccagaaatcggaaaagtcatagctacacaaaattcagtttttccagcggcgcacaagttcgaattacatcaatatctcgataatctaacacggacccactaaaatccgtaagaaaaaaacactaacccagatcgcaaattagacgaataagagtagaaacgaagacagagaagacgaacacgcaataaagacttcacctttagggattgaaatgaaaaagattagggtttcaagacacagcgtaagaagacgaataggcttgaatcgagggagggagcgagaccgagagaggtaaggtattcaaaggaagagagggaaggaggaagacgagtgggactgcgagattcgcgtggaagcgtctccactgctccaccaagctctggtatcggagtttctctttccttcacgtcaagtaaaacgtccacgcgtccttacaatacgtaagactgacgcgcgtgcttattgttttaaaggccctctaaaagtccctaatgggcctggccacgaattagacatatacttatccatagttaaaatttgatattggacagatcaatatatggaggatttcaattaaaggttgacttagtgacacaaagagatacaaagagacaatgggaaatgcatttgaccttttcttaattgtaattataaaatttgaacgagagatatggctgcggcgccgcttgctctcttgtcccacgtctcctctgtcaaatgttttagttttccactatattactatatgctatatttttctatatctaaaatcagcaaaaagttcttttttggtaagataagtaaaacaaaacacatgcatattcttttgacacatgctttcccgtgtaaagacggatcatcatattgttgtgttgaaatgttaatccaaagtccataagcttgatttgttgttgaaatgttaatcttaagtctataaactttttggtactctaataatatagtaactcctcatattgatagtcattcgatgatactgcaacattgtgtgttttgactatagattttatacaattgtgaaacattcattatccaatttgatttctacggattaacctcttttttttgtatccgtaatcaactctgaataaaatggatacttataaaaaaaaagtactgtacgaaaagtatatgtggataatcttacatgatttgcaagtaaccttatattgtatgctaattcgatttaagataacgattttatataggattagatctactaatgtaaatactcttaatagatagacaatttcaaacggttgtctcggtaataatattagtacagagctgataattttgttgataaagtttttggcaagaaagaaattaagttaataaaaggacagttagtatgaaaataataaaaattaaaagtcttctagttgactatttttagatccgatcccgaggcaagtatcttgttctcggtatttttggtacgaattattaattgctaatttgaatttcacgttagtgattataataaaaataaataagatatcacatatagacatcttcttaaaagcacactaactaaaagaaaaaagaaaaaaagagacatgtcaagtttcttttatttttgtgtacatgtcaagtttgtaaaccatagtttattgcttaaataaatcacataacgcttaaaagaatccaaaatccggacttcacatatgtcacacatattctatcaacataacctgtatgtacatcgaaatcatagaaagaatattttaggttagctagtagcctagtactaatgggataaatgaaattagttatccttctcttaaagatgaatccttgagatcaagaaattttgtgagattgttcaaccaaactaacaataaaacttatattatttgatacaatctaaatatagaatcagttaattctttcttttttctttctcatatatatttatgatctcataacaccaatttgactttaagaagatatctattgaaattttcaaaacaactttaataggaaaattcaaaatatatagacagcgccatattctagaatattcttactcattatgaatttttgaatgttttgatttatagacctatctatgatgttgaattgagtaaataaaaagtttaatggtgcgtttgatctcacccatctttttctttattcagtattcaatctttataactctaccttattcgaagagatgaattcatctagctataaacacatcagtgacaagtttaaaaaaaatatctacacgttcgatggtcttctgtatttcacatggtaccatccatgtgaatgtgatgggaaatttcgcagaccctaatgccggccataaactggatttacaaaactaaacaatgtaatacaattttcaaagaaaccggatctaattatcttattgtcacttaataaacaaactatataagagaaggggaggaatatatgtatacacttttttatgactactaggatggtaaccaaagtcatgattccatagtaactccggtttaattgcttcaaaggccaaaactaagctctttattaagtaacatggattagtttcttcataaagataaaactaattatttaaacaaagtcaaagctagctttagatgcgtactagagtgaataatacaaatagtaaacgatattctgatcagaaaatg

SEQ ID NO: 10527 - DNA, 3000 bp, Unknown
  misc_feature (1)..( 3000): cDNA_ID_3037140_gDNA_ID_2213659_Annot_ID_181813 3000 nt of promoter + ATG
tctgtctctccctatatataaatcgataaataaatgagtgtgaggtaattaaggaactagaaaggaataagaaattatggagagaatatgtgaaatgtggagagaaatgaaagatataacggcaatggtggtggttcaaatagctacggcagggttaaacatatttttcaagctagcaatggaagatggtatgaacccaagtgtactcgtggcctatcgtctcttgtttgctacacttttcatgattcctatatgcttcatctttcaaaggttgtttttctttcacataatatggttgtgtttgtatgctttgatattaattaacttcatgtgatcgattaggaagaagaggccagagtttacatgcaggctgatgttactagcattactctcagggttactcgggtacgtaatagtcacacacacacacacacacacacacacacaaaacgaaaaatcatttttcgtttttttggatgtcctcttgtgtcctaaggttatatatatgttaacttttttgtgataaatttctcaaaataaaccattttataatatacgaaattgaaaaaaataatctatatacatggtttgagtgttacagaagtttaatgcaagactataaaatttatatattcctatatatgttcaaattcgatttcctattggttttcaaacatattagccactggctaggtaagtcgtcggatattttagcttaggtagcatgagttgaatttagttcttaccaaaatctcctcaccacaaaaccacaatccagagcacactggttttataaaacgtaattaatcttctagagtttaattttacttaaatttactttaaagttaaaaaacgtatacttagtctgaaaaacttaaaatgtaccaaaacatagagaactctagaagattatttgaacgtattcaatattattatctaacattcaaacagggtagtacttagtagttttaaccattctactcaatattaccaactagtggtttgacaataaaaaccaacatgtaccaaaaaacatagaagactacgttttggctgaaaatactagttgataatattgattatcattagtaaaatgtaaaattgttgaagaatatatatatattgggattataagacttctttaatgtggtgataattgaacagtgtggtgataccaagtatcctaaccattacgggtctagctctaacgtcagcaacattcacctctgctgctggcgttctcactccattggtcactttcatcttcgctgcacttcttaggcaagtctaatcaacgaatcacaatttagttaaccccttttaatatatgtttataccattaaacaaaatataataaacttttatgggtctcataggatggagagtgtacggcttggatcgagcgtagggctggctaaggtttttggaacattgtttggtgttggtggagctcttgtctttatattctatagaggaatagagatccgactatggtcaactcacgttaacctagtgaaccaaccacgtgactcctcacgtgatgctaccactcaccatatttccatccttggggctcttctagtttttgggggaaacatttccatctcactttggtttttattgcaggcaagttttttgtttgtttttcagatttcttatttttgtgtttgttttgtgtactaaggcattaggcatgtacgtgtttttttttgtttttgttttgtttataggttaagataagcaaacaatttggagggccttattggaacgcgactctaatgaacatgatgggaggcgtagtggctatgcttgtcgctctttgctgggaacacgatttagatgaatggagattaggatggaatatcagactattaaccattgcttatgcggtaaatatcaatccatccattattaagtatatatatatatgtcttgttgtctaattacaaattcatacaagtctatacatgtgtgaagattcatttaggttggccttgaatatatgtgctttatgttgtccattgtaggcaattctgatttccgggatggtggtagcagtcaacgcatggtgcattgagtctagaggaccgttatttgtatcggtatttagccctgtaggacttgtgatcgtagctcttgttggatcatttttgctagatgaaacacttcatttggggaggtacaaactcatgtatattgtattgttttgtggaaatggatttgatatacgtatgtatatataatatggtttatttttacttgaaaacattacagcataattggtacagtgattatcgttggagcattatacattgtgctatgggctaaaaacaaggaaatgaagagtatgcttacgacatcggatcataatgaaacaaataagactagcaaagatatcacagtcaacaatctcccaacattaagtacaaatgtcccttgatcaaccatcatttatatatgttgaacgacttgttgttagtatatttgattaagtgaatattaacattattattctatctaacgatgatttattgaaccatctatgtaagttattatgtgcatatgacctttgtactaccacatccacaacttcataagatgttgcatggattttttttaacgagcaataataaattgtaaaatcttatttgggtctaattaatttcacttctgagtcatacaatatgtacatgaactagtaagttggaatgggcccataatgggccgctcaaataactctcctccaaacctaaaaccctttatcgtaattgattctccaagcatccttttgaatctctgattcctacaagacaaatcactaaaagattcgcaagttgacatagcagagaccatacgacaccaacctaaacacagaaaagaataactcattcactcgtataggctttgtcttgcctcttcttgaaaacatgtacacgtatttaattataaatgcatatataaagatcctaccgacgaaaaaataaaaagattgaaaacatg

SEQ ID NO: 10528 - DNA, 3000 bp, Unknown; identical to SEQ ID NO: 10522
  misc_feature (1)..( 3000): cDNA_ID_1024257_gDNA_ID_2213659_Annot_ID_181811 3000 nt of promoter + ATG

SEQ ID NO: 10529 - DNA, 3000 bp, Unknown; identical to SEQ ID NO: 10521
  misc_feature (1)..( 3000): cDNA_ID_3037148_gDNA_ID_2213659_Annot_ID_181810 3000 nt of promoter + ATG

SEQ ID NO: 10530 - DNA, 3000 bp, Unknown; identical to SEQ ID NO: 10520
  misc_feature (1)..( 3000): cDNA_ID_4268675_gDNA_ID_2213659_Annot_ID_181802 3000 nt of promoter + ATG

SEQ ID NO: 10531 - DNA, 3000 bp, Unknown; identical to SEQ ID NO: 10519
  misc_feature (1)..( 3000): cDNA_ID_2704610_gDNA_ID_2213659_Annot_ID_181799 3000 nt of promoter + ATG

SEQ ID NO: 10532 - DNA, 3000 bp, Unknown; identical to SEQ ID NO: 10215
  misc_feature (1)..( 3000): cDNA_ID_2685858_gDNA_ID_2213659_Annot_ID_181791 3000 nt of promoter + ATG

SEQ ID NO: 10533 - DNA, 3000 bp, Unknown; identical to SEQ ID NO: 10526
  misc_feature (1)..( 3000): cDNA_ID_2715789_gDNA_ID_2213659_Annot_ID_132517 3000 nt of promoter + ATG

SEQ ID NO: 10534 - DNA, 3000 bp, Unknown
  misc_feature (1)..( 3000): cDNA_ID_2715906_gDNA_ID_2213660_Annot_ID_132519 3000 nt of promoter + ATG
atgaggaggaagatgaaagagagaaacttggttaaagaaggaggttgcagttggatagaagtgggagataaaattcataagttctacgtaggtgatacagctcacccgaatgctcaccaaatatatgatgaattggatcggttaattacagaaataaaacgctgcggatatgttcctgatacggatcttgttcttcacaagctagaggaggagaatgatgaggcggagaaggagaggttactatatcagcacagcgagaaaattgcggttgcgtttgggcttataagcacgtcgaaatctagaccggttagggtgttcaagaacttacgggtctgcggagattgccataacgcgatgaaatatatatcgacagtctctggtagagagattgtgttgagggatttgaatcgttttcatcattttaaagatgggaaatgttcttgtaatgattattggtgaatggtgactttgagatttagatacacaaatgaggcttttctattcaatgttattttaaatcttgaggattttgggttcaatgtgatcgttctttttaaaaataaataaagagaagcattctaatttatttaagttattacagttgaagatgattcagacaagttttaagatactagtggtattagcaatatccggttttccgatgatggaatcccgtatccaaagcaatttgggatcaacaagcaataagagtattgaatatttggctttgaattgccggaaacacagtgcggttttgacgaattttggagctattggagatggaaaaccctcaaacaccaaagcgtttcgagaagcaataagtaagcttactccgttggcggctgacggtggagtccaactcattgtaccgccggggagttggctcaccggaagtttcaacctcacaagccattttactttgtttatccagcaaggtgcaactattcttgcttctcaggtaataaatatatctaagctcaaaattttagctagtatcgtacacctatttatgaatgcactaaaaaatatcaaccattctatttgagataaataatcacatttggttttatttcgtttgtaacaaacaggatgagtctgaatatcctatgattccacctttgccgtcatacggagatgcaaggtttactggtttagtatacggaagtaacctaaccgatgttgttatcaccggtaagcacaacaaaacttaaatcattaaaatggtttgatggatatatatatatgagattgaatcaaaattatatatttagtttataagatcaaatttgttgttaggtaacaaaagaacgactaatggacaagggaagtcatggtggttgaagtatcgaagtggcggtttcaagtcgatatcaagacctttgttgatcgaaatcatcttctccgaaaactgaagaggtgacactaatcaacacacaatccgctatccgaatcaaaaccgctataggacgtggcggttacatcaaagacattttcgctaggagatttacgatgaagacgatgaaatacgttttctggatgaccggttcgtataagctgcatcccgtaggcgggtttgatcccaaggcgttgccggagattagcaatatccattaccgtgacatgaccgcagaaaacgttacaatttcggcaaagctagaaaggatcaagaatggtccatttacgggtttatgcatgtcgagtgtgactatagctttgtcgccggacccgaagaagctgcagtggaactgcacggatgtctccggagttactagtagggttacaccggagccgtgcagtttgttaccggataagagaactacaatggactcagactgtgattttcccacggataagattcctattgagagtgttgtgttgaacaaatgttatgcttagaaatgtgtttgtaactttgtaccgatttataggtttcattattcccgtaactaaaagattgaatggtttatgttcattcttcagtttacaaatccgctaataattttcacaaactttctaaaaaacatccaataaatgaatcatagtttcaataaaatgtaatttagaaataatgtgtcaaattttacaaaatctaattaagcaaacttagccattcttatttttttgttcttacatggttaaaagttatacatatatttgaaatttgaaatagtcagttaagtgtttcatatattcataaacgactttgtctaattataaaactcttttacaataggagctactttcccaaactcttttaaaatttaccaaacaatttccattgttggaatagataaaccaaattaatcagttttcacggaattggtttggttaaaccgcatggaccggtctttttttttctatctttgggtctcttgtctgaataggtttagaaaaacaaagcgacgtcgttttataatggggacctttcagcctcatccgtccgtgttactagattccccgagaagatgaatctgacacgcgctcgccacactccctttttatccttaaccacaactttttttatttcattaagaaaattcttcatcattctttcttctgcttcttcttcttcttcttcgttgaaaaatctgtcttctcttcttcttcttcttcttcttcttcttcttctcctcaagacgagagcgaagacattatctgaacaaagcgcttctccataacaaaggtatttctcatgttcttgtcctctagggaatgagtttcggttgattttgattccttccagatattttctcaattccagtagcctagaaaacttatttgcttagatatgatttgtttcctggattttgatttgtggtaggcttgtttttgtccttttcacgaacttggaatttgtttgtttttttgttttctttctttgcgttatacatgtttcgtttcttgtctttgtggttatgcctaggttttaacctctgtgtcaatctataacagtttctcctttttcgttttgattctcaggtgattcaattagtcgatatg

SEQ ID NO: 10535 - DNA, 3000 bp, Unknown
  misc_feature (1)..( 3000): cDNA_ID_2715902_gDNA_ID_2213660_Annot_ID_132520 3000 nt of promoter + ATG
aaaattaaaagcaacacgatcaaatagttttagttgatatagttgacactactttggttatgatgattattgactaatttgtaattaatttgcaggtggcggctagtataataaacagaatggtgtcaaacacaacgatgacgttttcgaacatggttggtcccgttgaagaagttagcttctatggacatcccatcacttactttgcctcaagtgcttatggccatccccatgtaagttgcttatttttatcattgttcataaaagttgataaaatgatgattccacaaacttcattgttctattttttccttttgttatgtctatctaatgaaatgtaaatcttttttttgttgttcaatttgattaggcgttgacgatacattgtcaaagttatatgaataagatgacaattacactaatcgtagatccaacggtgataagtgatcctcatcggctttgtgacgactgggaagaatctctccgaagcattaaagccgctgtcacaaaaagagagtctctccgtttgtgggattatctcaggattctccacaatagagtggcttggctactttaccaaatcgctgggctactttacagaatgctatgatacctaaatttgggatcttgataaaacatatctttagtgacgacttcatatgccacttgacaatatctcttaatgtaattccaaaaatgtgtagaaacaacaataaaaagctttcaattggtaccaccgatttgttcttcttccataaccacttgaagcaaattctcatagttcttctgccattgttcattcatctgtaaagatcttttgtattcaagtttcagtctttccatttccatctctgttgctgcagagccttgttgctgaaacaacaaacaaaccgagaaaatattatgttttgagtcatttttaccaaaactgtttactgtagacagtgaggaaacacaaacctgaagttctttaacttgctcgtcaataaggtcagcactgaggaaagaagagtaaacaggaacatcagaaaatggcggcggatcaaccgtaacgataccatccatagtatcttctactggtctttcatatttttccaaaggcggtgggattaaagccccacgacttttccaggaaacttgggttttgttggaattagcaacaatcgtttttctaacaatttgaatattgttcacaggaccttttctagaacctgtaagaaaaaagtttgaaaagcaagaaagggttgttaaattgacttattcattttgtagaagtaaaactcaaacagaagaaagtgctagcaaatataccttttgcatggatgagagtacgaacatggcgaagtgatttgggatcccaaacacaaaccacaccatcttctgatccagatatcaaaaggtttccgtctgcacaatatgctaagcaagtaatagctttgctgttcagacaaaaattattgatcaatagagattaacttagacagtcaaacagccacagcagtcaaatagattactactagctaatgttcaaatatataaaagatctcataaataccatcttagtcaagaattactacaagctccagttcaaatacatgtattatgatttagaagatgttaaaagtaagaagaatattgactaggattgttgacaacgattgaaatatagggaacggttagtaccctttttcagatactgaaccaagaacttgtgtcccgtattcacttgtggcattaatggcaccgatatagattttgctgtctctggcaccagcatagaacacacaccctccagggtccaatgcgagtgcattgatgactgaaggaaaaatgatatttttcaacaatttccctcttgacaagctccaaacctatatggatttacaaatccaaccaaggtcatcaaataaaaaagctatatcaggttctatttctcagctatatcaaaatgaatctcattaacaatacaagagctaaactttcattgcagttaacaaatgcataacattagtgatccaaataagtaccttgcaagtccgatcttctgaagaggaaattatcacagcattgcagcctccatagtctataacaatatcagttacagacattgtatgctcattaaaattgtgttcataaagagtgttcccttgctgcctctggaaatcatcaaatagcctaactaaccacaaagagcaaagaatcagaataaaagacaatgccttgcaaaaaaacaagcatgataatacacaaagttttaaccttataagagaccaaactctaatagacccatcttgagatccagaaaccaacaaagaatcatctccagagaacaccaaacatgttactgaacgataatgaccatgccacttcttaagcaacttcccagtcgcaacctcccaaaggtaaatatctccagagattccaccaccaactaagtaagttccttcattgtttgctgcaagagcctttattggttccactgggtagctcttcacttcagcttgaggctacaattcaaaacaagtttcaaactttctatccaaagagaacaaaaaaacagtgatttcaagtttgagaatgagaccttagtccaagaccagtaaaaaatcgagccagaagtatttctcgccgagagctgagaggaggcgagaaatttttcgccgacggcggtgagaccatgcgccggagaagcacacggcttgaattgaagctgctctgtcccggttttgagatcccaacttccaattccttcatcgattgaggaagaagcgattacagtaatctccatagctcagagaaagagggaagtaaagagaaactgattccaagtctgggttttgtgatatctataaattagggtttatgaactatgtatgtaatttgataaattaatagttttgtgtcttattgataatttccacaaacttaagggactataatgtaaattttgtgtgatattgataattaacagtaacggatcgtttagattggagaacaatg

SEQ ID NO: 10536 - DNA, 3000 bp, Unknown
  misc_feature (1)..( 3000): cDNA_ID_2715890_gDNA_ID_2213660_Annot_ID_132524 3000 nt of promoter + ATG
ggaaaaattacgagtttactttttctcaatttcatcgcttgtatatttaagaaatttggaaaaataatgttttattaaattggtttagatgtgttggttaaacttaaattgacattggtttaaagattttagttggtttaattcaatttacaaaacttgatgggttaattggataaaccattgaaaccattaaccattacaacccaactcattttacccatcaaaccaattgacccaataactcatttgacccatcaactcatttgagtcaaaattttctaactcattagagttcatgagttgagttgagttgagttgacccatgaattttgacctattttgacacccctaataaaaacattgtaaagttcatgttaatgagagaaacttccacgtcgaaaggaaaaattatttagtgatcgctaaaatcgctaaaataaagagtgaaggggcagaacacaaaactataatagagcaggtccaatggagagctttaaagagctctacagcaaaagactcttcccataaaaacccaaaattaaatcaaaacgttcctaaattaagaggtttttgtgaaactaaagggacttgacgtgtcacggcctgattggtcgtgagtttgagaaaacaatttttttttccctttcccatctctttctcgagctgctcttctctgtttttcttctgatctctctcaaatcaattgatcttcaacattttttttctcaaagagacccaatttaagattccactattagacaccaaaaaatataaggacccatcataatctctaaactatacaaattcacaaaatttattagtataaaatttaaaagagactctctcagggccataccattgaacatgctaaaacttctctaaaatgataatgtcccatcaaaaacataacagtgaaacccatatcaacttgctagtaaatagaaatactaataaaacctaaatcagtagataaaactgagaaacacgtatttaaacattttgaaagggtatggctttatcaacttactttccttttatccatattttactaggaacgtataacgtcgtttattgcaccctaattcaagaaatttgtattatataacatagagaaaactattttataaaaaaaaaaaacagagagaaaaactatacataaatgtaaactaaatatatatggttgtgaaatataaaggcggtgctgatatatggtgggtaaacgactaaacgtcgatgaactggtttatatggcgaatgttattattgatttgtggtcgtcacgtcactggcaccgtgccgtgttagaccatgaatttatcttcttgctgttattgttattaatatatgtccacacagttgccaattgtcgacgttgtcaattctagacaacaggatattatcgacgttgtcaattttgtgggttattttttcttctgtgtaacggtcgtattattatcagaactatacattatactccatcacgggagtaattcataatttactagttaaaattgtatatctgtcgtcagccaaccagcaaattgaccaataaaccataattagatattgaaatgaatgtgtcttcgtctttcttttattatttattagaaaataactggcattttatttttgttctacataaactaacactagaaaaaatattaaattcttttctcagcatcttatttttttttctacattaagtttaactaccaattttctcgtgcctaatattttaaaattttcagtaagttcatcttgtcttgttaatttagggattccagaagtaaattttgggtatttatttgcgtggtcgcggatgaagagctatttaaataagaatctagacttttgaagcggacacttaaaaccatctttttggtttaatggaagacaagaaaatgaatgtgctgatttaattgttacatttgcaaaccacttgtactctctattttgtactttctacccctcatggttaacaatattggtagaaagggcaaattattgtacggttcttagtattcttatacattgaagtatgattttgagtaaaaaaaataataaaatatttctaaatttaataatcttcatcgtattttgtaaaagaagttgggtttagatatcgatgaatcatcaagttgatcattgtgtttttttttaaagtgggagtaaaccaaaatgctatactaaaaaaaaaagtataattataaataaggttttgtgcaaaaataccgtaacgtcgtttgtttttgtaattttactttttacattcaaaatatataaaataattttatgaactctaaaataatatgatatatagtccatttttgtaactttacatatattgtaatcgttctcacgattatatatatctgtgtttgaaaattttaaagatatagttgaactcatcatttcgagggtttcgatttgatatatgattatcaaattttaaaatttaccaataacgaaaagtggctaaattacatattattttggattttataggtttattttgaattttattgacgtgaaaagtaaagttgtaaaaatggacgattttgatgtttttttttgttgtaaaaactcttttaaatattgatttcaatattatatgaatttagtagaatttttaacatagcaaaagtagtaaattttgaaaaataatgataactgaaatatgaaatagatttgtgttaattaactcttaaataatctaagtaaacaatagaattataaagattttgtcataagatataattattagtttattactatcaaactttaatattactaaacgttttgtccattattgcgttatgtgaagattgtgggtccgagttactaattttttcggttagatataatccaacacatccaaaaagttatataaagaagaaagtggcatagaacaattggaggctatatatcaagaaagcgaatattaaaagtttaagaaagagagaaagaaaataaaagagaaagactaagcagcaaaccatg

SEQ ID NO: 10537 - DNA, 3000 bp, Unknown
  misc_feature (1)..( 3000): cDNA_ID_3037219_gDNA_ID_2213660_Annot_ID_132525 3000 nt of promoter + ATG
gtataaagaaaaaatggtgatatgtgaggatatttaactaatcactagtataatgaagcatatccatatcaacatataatactactatactagatcaaatccttaatagaaaaatcgtagtcgataaaaaagcaagtttagatcaaggtgaagtcatggttaatttatatgggaggatattgaactaatcactaatgtataattaatctttaaaagaaatatgaaattaggtcgcgataaagtgaggagccaaaaaacacaaacactttggtgatgggtttcgattgatgacaaagcatcaacttcttatgtactaaaattccatgtacagaattattgaataagcacagaaacagtatcatatatatggataataatgatattgattatcaatttaaaatatagaatttaattaagagattttactctattttatatataatcaatcgtgtttgctagttatactcttaaatactaaaaattgtatcaaaaataacaagttaaaaaaaaaacaggagcgtgcgcctagcccgcaaaatccacaatcttagaacaaggtggataataaggtttggtttttctaaaaccacggttcataacgagtgtccactagaatccaaaaaaaaaaaaaaactaatttcgtcgtagaacaaaaaaaaatagtgagacaagaccgatttgaaacatgtaatgatgtaatacatatgatgattttatatctatagaatgaagaattttaagctttagtttattctagaagacgtttattttgttaatggttgcttcagatgtaaatttatataagatcattttggtaggtatttactctatagtctatagtaatatacactctacaaactggcccttttggcactcatgtataaacacgagtatttaattttcacattagtagacacggtcctgcttcaataaatctattttgacattagttcttaacctcattgttgtaattatttacaaacgagattaaaacaaaacacatggacatttttggataataatatttctcaacatattgttctagctttgatcgttgccaatagatcaacatatttgttactctcgataatcacttaagcccaactcatgtggttttaatgtaatggtgaagtgtttcctttcaaggtgtagtgtagcttcaaattgcacatactagaatcccaaagattaatgcactaaattcaacctcttctgcatcaactccatttgaagtctgtataatccatccaaaacaatcatatcttgcgctgtccatatccaaaattatgtgaagcgtcataattacacttcatccacccttctgtcggcatcctccatggcattgatctggagcttcataaacacatttggtttgtattaaatatttatgaaaatccatagtcagtcacacggatagtgaggtagaaatttagagagatcatcttatgaatctttttatttaagcaacaagcttttatccgtgttagtgttactttttatcatttcttttggaacaacctatagtatttaatttattcagagcgttcttaagaatttgtttgataaatatattcacgtagtttcgactacgtatagaaactttatagcaaaatgaatgttgtgcgtacgtacattgtttctatggtagataagtataattccagaaagagttaatgaggaagaattttattactgtggcataggatgaattaaattgatctatataaattttatgttacaacttacaaacaattttcacatggatttataaagaagccgctataaataaaaacgattgtagtttagttttggggtattcgaataaataagaaacttactccttaagttagcaactttttaatactaaaagagaaaagagatacagaactttccaaaaaattattgaacatgttctgatacttcactaaccatattgaaacagatggcataatcactttaattatacaacacacacatcttatctatatatgttacatctattataataattaaaccagatttaatataaatccagctatttaaaattatgccacagtttgaaaagaaaaaataaacaacgtgagatgtctatgtaattagaaacaatgggggtcttttctagtcgcattctggcattcgttgagtcgattttttttctttgttaggttgatgttggaacaacagatagatttatttattataaaaaaaaaaatacaatgtatgatttaattaattgctgtgaactgtttaagtgtttctaactattacggaatagtcttaaaagaataatgcgactagtttatatagagttttcctatcatttcatcaagtttaatctttggttggtaagtgccagctcatgttctttaatagccacattgcacacatataaattgaaacagtttctagatttctacgtaaatgttttaaatatgacaaaaatttactatatgtttcgaatcgaaataatctagcgtagtagtattcataactaccatctaccaccaacattattttgatactgtaatgtttgcttttaataaactgtcgaaatagaaaggcgcaattagttgtatgtagagtaacttaatagtctactcatctctaaacaaatgtgaaaagacttttttctcgatcaagtcgacgaataacaaacaaatacgatagattttttaaaaattaaacttttcgaaatcataatacgtgtatttttagggaattttctcttctttttttctttctaattcatgtcgacgaataacaaaagctcaccatcaaacgaagaataataacacaaacaattagaactagaacaaaagaaaatgataaagcaattttattctcatgtaaaaatgacataattcaatgacgcgtgtcccaccaattatcaccactcactctccatatatacttcacatacaatctttcactcatatatataccacacagtcacacattctttataatgtaaatcaaaagagaactaaaccaagaaacaaa

SEQ ID NO: 10538 - DNA, 3000 bp, Unknown
  misc_feature (1)..( 3000): cDNA_ID_2715880_gDNA_ID_2213660_Annot_ID_132528 3000 nt of promoter + ATG
gcttatgattacttcctttttagttttaatgtttacgtccaaagtatttaacatttgtttttactatatgtctataataaattttgagaaccaatagaaaagggctagagttgagatccaaaatatataaaaagatgataaagattgtggggactttggatagtggtaaaaagagaacctctatattatggtaatgtgaagatatgactatctatagatacaagtttatgaaataaatttaatgtatatatctataggtggggaaataaatggggtggagtgatggtgagggaacaaagcaatgcacatgaaaattgggagatggaaaaaagatttttttcggtgtcacaaaaatcatatttagatgctcttataaggagccttcttagtctatctctttcacaaggggaccaatctttttcggcttttaattaataagtatatacggtctaaacatttactttttgtaactcaacttgtcatacatttataagatgaaagatcgtatattgttttttcctcttttaagctataatatgcataaatatatcttacgaatcctattaaataggtagaaaaataagaaaaaagtgttcaatgcaaaaaaaaatgttatttatgtaattagtatggaaaattgctttcaatcaagaagaaaaagacactaaaccaaattgcttacttatgaaaaagtagttatgcggtcgtattagttatatcttattattaaagttatgttttgttagcaatgctaaaatcacttgaaacgttatgcatatttgtaatttgattactatagttctatctttctttaagctaggatatgttttcatgaagatcctcatatatacttctacacatcccacttaagtgtcctaattttctttaatacgttgtcatacataaatatatgtatatataatggtggttgacaaaataaaaatagtaattaaaggtgtgattagaaccttggagtctttaggagaggatttgaagactttcttcttcaccgtcgagaaccatccaccactccctttcttccccatatttccggcaacactctttgatcataagctctattaatactgaaacattatgtttaaagattcccaaaaatagctgtaattacaccaatagcaaaaccaattccaattgtagccaaaaccaaaaatgtataacattgtcatacatacaacaacatgcataaaagttagacatatatgttaattgaggaacttacatgtttgtgcaatgtgatcaaacgattagaagcgattgttgaagtttagagaaagagaacgagagagataagaagaggtgagagagagaagtcacagagagacttaagttgagaaggagaggatgtctcactcatttcaccaccgataaaatgaaaatcattaacggagtcacgtggggttcggttaaacgccgttaagtgtttttacgaagttcacgaggtttctacttttgtcttctcttattttaacgccaatcgcctttatttccatttgttataaagtcttctgacatttgtaatgatcgaattctgtatttacatatttgttatatcctatataaaatattatttgactttttcttaaattttgtggacttgtggacctattatgtttacatatttttgatgagaagatgccatatttcgaatatatatgtactagtgtaatctgaggaaattcaagttgaagccaatacatactttggaatttatatatttaaaaacaaaaaaaaactatattctataaataaatttacttatttactaattagtttgataaaattcagtttttaataatacttttatttgtatggttaaatatgctacttaacaaaatatttttaaatatatatattcatgagatttatccttcctttatatcgagcttaaaataaactattggtcacatgcatataatatgcatttatacataaagttctgatttatatgattaacattggtaacatgagtttagaagcaatatttatccgacacattttaaagaatgaacgaaaaatttaaaggtttcattcgtttaggtatacatacagaatttactcaagaactacaaaactttgatattaaaatatcaaatgatgccgatcatttgtcttaagatgtaaattaaaagagagaaaaaaaaacacaaaaatgaaaatgtgcagttgttttaataacggcgacctaactttctttatgaggacccaagacctacaccacctccaaaattggaccacctttcgatttcactactcattgagagtctcatacatccacacgagtagctaaactatttttttttaagcataaacaaagctggaattcattttttttttctttctaatgtaatcaaagcttaaattcaacattccttataaaatatgttataaatgataatgtttaggcaaaaacataacatcatgtcacatgatttttttttaatagaaaaccagtacggcgttcgacaatatcgatacacagagtcgttttcctaacgaacctaacgcatgacacagaactagttgaatttgtaagataaaaactggtttgacatgtatcggtatcgaactcaaatacgagaaattacctctggttcgggttttttcattatcaaactaatatgctacaaagtgagaaagtcaggctcagaaggaggtatgaagcacaaagcccacttggaatctccgaagattattgggccttaaataaggccagaaaatataattgaatgataaaaggaaacttttcttacatttttggcaaaatacgttccttttattattggtgtattttaatttagtttaattacttcacaacaattggctgtttttctccagaagaacactaaagacaaaaattaaaccctcacactcacagagaccggagaagaagcagagagaaagagagagagagagattcaccggtgataacattgaagcagaaagattctccggtgataacattgaagctgaggagcaatg

SEQ ID NO: 10539 - DNA, 3000 bp, Unknown
  misc_feature (1)..( 3000): cDNA_ID_2715876_gDNA_ID_2213660_Annot_ID_132529 3000 nt of promoter + ATG
tcgacaaaatcctgcatttttaaagtaccacgagagagaactagttagtttcagatcacaaaaaccattgcaagaaaggtttcttatataatcagtggcattgagaagttgaaggtaatctgaaaaagtgagagaaatggaactaactggctgagattttcatcattgaccttcccaagtttcgctacaacaccaacaacaccttttgtcaacatcaactgagaagcttgagcaccatgaagagtctcaaccagacttaaaactccagcagctgagttttcgtggcgaaggatctgtgcattgatatcttcaccctgaagactgttatcagagttttcacttctaggagtaggagacgagttaagcttactcatatgaactgcagaagaaacgaaacaaagacatattggataatctcaatcaacataaatcactgaaacgtaaaagtctatgatatctcagaaccttgcaagtcgacgatagcttcatccattttgtttttctgagacttgagaaacttgagattatcctcatgctgtttgattttgttacccatagcttcaagatcagattcaagcctcttggaattgaacatagcaaactcagcgtgagcaatgcctcctccattctgagtttcatttcttgcaactggtgaagattgatccaaattcatcatccttgttggatcttgaacattcaacggagtggtctgaaacgaaatctacaaaattggatacaaaaatgactcaaaaactattcctgtataaaccctaactcttaaaattcgtaaaaaactgaaacacaaaccctcaaatttaatccaatgtggtcgcatgcaataaaaaaagaaacaaaatgtcgagagtagatacatcaataaacaataaagcacgagtcttttctccagattcacagaaaaattcagagagacttcatcgtttaagagagatcatagactaaagttcgttcgttttttcccaactaatctagttccattttgcaattgaactgagtttttttcaaccaacctgttgaccagtcggatacattgctcctcagcttcaatgttatcaccggagaatctttctgcttcaatgttatcaccggtgaatctctctctctctctttctctctgcttcttctccggtctctgtgagtgtgagggtttaatttttgtctttagtgttcttctggagaaaaacagccaattgttgtgaagtaattaaactaaattaaaatacaccaataataaaaggaacgtattttgccaaaaatgtaagaaaagtttccttttatcattcaattatattttctggccttatttaaggcccaataatcttcggagattccaagtgggctttgtgcttcatacctccttctgagcctgactttctcactttgtagcatattagtttgataatgaaaaaacccgaaccagaggtaatttctcgtatttgagttcgataccgatacatgtcaaaccagtttttatcttacaaattcaactagttctgtgtcatgcgttaggttcgttaggaaaacgactctgtgtatcgatattgtcgaacgccgtactggttttctattaaaaaaaaatcatgtgacatgatgttatgtttttgcctaaacattatcatttataacatattttataaggaatgttgaatttaagctttgattacattagaaagaaaaaaaaaatgaattccagctttgtttatgcttaaaaaaaaatagtttagctactcgtgtggatgtatgagactctcaatgagtagtgaaatcgaaaggtggtccaattttggaggtggtgtaggtcttgggtcctcataaagaaagttaggtcgccgttattaaaacaactgcacattttcatttttgtgtttttttttctctcttttaatttacatcttaagacaaatgatcggcatcatttgatattttaatatcaaagttttgtagttcttgagtaaattctgtatgtatacctaaacgaatgaaacctttaaatttttcgttcattctttaaaatgtgtcggataaatattgcttctaaactcatgttaccaatgttaatcatataaatcagaactttatgtataaatgcatattatatgcatgtgaccaatagtttattttaagctcgatataaaggaaggataaatctcatgaatatatatatttaaaaatattttgttaagtagcatatttaaccatacaaataaaagtattattaaaaactgaattttatcaaactaattagtaaataagtaaatttatttatagaatatagtttttttttgtttttaaatatataaattccaaagtatgtattggcttcaacttgaatttcctcagattacactagtacatatatattcgaaatatggcatcttctcatcaaaaatatgtaaacataataggtccacaagtccacaaaatttaagaaaaagtcaaataatattttatataggatataacaaatatgtaaatacagaattcgatcattacaaatgtcagaagactttataacaaatggaaataaaggcgattggcgttaaaataagagaagacaaaagtagaaacctcgtgaacttcgtaaaaacacttaacggcgtttaaccgaaccccacgtgactccgttaatgattttcattttatcggtggtgaaatgagtgagacatcctctccttctcaacttaagtctctctgtgacttctctctctcacctcttcttatctctctcgttctctttctctaaacttcaacaatcgcttctaatcgtttgatcacattgcacaaacatgtaagttcctcaattaacatatatgtctaacttttatgcatgttgttgtatgtatgacaatgttatacatttttggttttggctacaattggaattggttttgctattggtgtaattacagctatttttgggaatctttaaacataatgtttcagtattaatagagcttatgatcaaagagtgttgccggaaat

SEQ ID NO: 10540 - DNA, 3000 bp, Unknown
  misc_feature (1)..( 3000): cDNA_ID_2715864_gDNA_ID_2213660_Annot_ID_181848 3000 nt of promoter + ATG
tgcaggactacaaagcgatatggttctcggatgcaactccgaagtatgcgtttgtcacttggttggtggtgaagaatagaattgcaacagggagagaatgctgaaatggaacaaaaacgtgggtactagctgtcttctctgcaactatcctttggagacaagagaacatttatttttccaatgcccttattcgagaacggtgtggagtgaactggcgggaagactactagctagcaaatatacggacaattggctagatatcatgaaggagttagtgagtaaagatcttgacgccactacaaggattgtgcttcggtatgtgtttcaaaacacgatacattctatatggagagagagaaatgagagaagacatggagagacgcgccatcgaggacggagaagataatcaggctaatcgacaaaaacataaggaatcgattaagcacgctaagggtgagaggtgaagagaagtacccaagaggaatccaagtgtggtttgcttcaaggcaagatcaaaatcaaggatagataagatacacatttgatctattttttttaaaaaagtttgcatttatatgtataaacagtttatttttctttgaatataatttaacattaaattttttaaaaaaaaatgcctatgttgcctactcttagagaagcgcataatgtatctttggactttcgacaagaccaaaagttcgactcacacgatgtttttataacaaattttaaccaaaacgacgttgttttataatatatatgatgttatatagtctgttaaagttgagtcttatattgcagcctttgcaggtggagaataaatttaccaaaaaaattaaaagttgtgaatatttatttgcaatttttcttcgctttagaagtttttaaaaattagtattattaaaccgtagtattattgaaaaataatactttttagtttttaaaaaatgtttcacacatgcaagaatttgaagaaaaatccgactgctaaccaaaatactaaaatagcgaattaaacatgggactcataacttttgtattaaatgactaaactaaaaaagatgcaattgaaagaaaatgaattgcatgtttaattggttgcaccaaaaagtttgtttggtgataggaaataactgatgatataaattttcacaaaatgacgaccgctccaccatagtaactactcaaaatttgtcagtgataatgagcatgacaaacatgatttataaagacacggcgagtccccaacacctgcagctcaactaatcaagtttcttgatatatgatacgcaacaaattatcttcagtccgtcgtcgggatccacacaaatacgaggatggacttcggttatggttcgcctctaggaactagttgtttcaatctctttacaaatcttttctcaaaataacatttaaaataaggttgcattcattgtacaaaggttttttggttgaataaattttaaattcattcaaaaaaaaacatgatttataatcatggaactatagttactattttaaaaagtaataaagaactacatggttatccaaagacgtgcgtcccttaatcattgcatgttttttcaatttttatcttttgtctcaaaagttattttgttaaaaatgtaatgaaattgttatcctagatatactcatgttacagaccacacgatcgtaagcttgttagttaaaaaaaaaaacactattatgcctactttattaaaaaaaatctaagagtccactcaaaagtcaaaacactccaaactcgcctaccaaaaaaaaaaaaaatcactccaaacttaaaatccactaaaatgaaccaaaatgcttagtacaagatatcatcttaattgcaatcgaactacctaatgcatttgattcaatatcttgtttcttttaagttttaactatccacaaagccatgacttgggaatgtgattgatcgataaaactttttcatttgattcaatatcattttactaactattcggttattttaaaaagttcggttcggatgcggttttgtttttacggttcggttcattcggttatttgcttaccgatttttctgcaagagagcgcgtttcgtttgtctccgcaaacgatgggacaaagtgggttaagtctgaggttgtttcttcgacttgtctctctagtctctataccaacaacactcaacgagacaagaccatcatcatcactcacttccttccttccttcaaatctcaactaaatcaatagacattcctctctttgtctctctctatccaaatttgaactgtaactgtcttcaaaatcttcatttttctcagacaaattggatctctccttggagcagaaacacccattaaaggaacaatagagagagttttggattgaataatcacagttccacaggtttccttccactctcattatcttaaatttcacttaaaggtcgaaacttttggtccactggtttcattatcttcttttaaacacatcaatttgtttaggatttaacttgtgattttgaattggttttactacttctcctctctcgatttagcaagttaaaagcttttttttttttagtgttcttgagggttttagggtacaattttgtttcctcaggactgggttttgctttcttgtttcatatgtgttttattgttcttgatgaattcattgtacattataaaatattgtctcagctattggtacacagttttctttctccctgggaattgtttgttaatttttaatagagtactaataaaagattagaaaatctgtggttactttagagagctgtggattctacttgtttgtttgtttcttcttattggattagttatggagcaaagtaaaagccttgttcattttctttgttcatatgtaataaaaacaactagtgatatacaagtgttcttggaaaatcttgaatgaaacagctttgaagaagactgaggtttatcttcctctctgttgaaaaaatagaagactgcagtggctaca

SEQ ID NO: 10541 - DNA, 3000 bp, Unknown; identical to SEQ ID NO: 10539
  misc_feature (1)..( 3000): cDNA_ID_1663020_gDNA_ID_2213660_Annot_ID_181845 3000 nt of promoter + ATG

SEQ ID NO: 10542 - DNA, 3000 bp, Unknown; identical to SEQ ID NO: 10537
  misc_feature (1)..( 3000): cDNA_ID_3037219_gDNA_ID_2213660_Annot_ID_181841 3000 nt of promoter + ATG

SEQ ID NO: 10543 - DNA, 3000 bp, Unknown; identical to SEQ ID NO: 10536
  misc_feature (1)..( 3000): cDNA_ID_2715890_gDNA_ID_2213660_Annot_ID_181839 3000 nt of promoter + ATG

SEQ ID NO: 10544 - DNA, 3000 bp, Unknown
  misc_feature (1)..( 3000): cDNA_ID_2715902_gDNA_ID_2213660_Annot_ID_181834 3000 nt of promoter + ATG
attagggtttatgaactatgtatgtaatttgataaattaatagttttgtgtcttattgataatttccacaaacttaagggactataatgtaaattttgtgtgatattgataattaacagtaacggatcgtttagattggagaacaatggcgatgataagcttttcgtttccatctcccgccaaacttccgattaaatctcaaccgtccgtttcaaatcggatcaacgtcgccgaccgtttgattctccgtcatctcaatgccggagatcttcgtggagcggtttcagctcttgatctcatggctcgtgatgggattcgtcctatggactcagtcactttctcttcacttctcaaatcttgtatccgagcacgcgattttcgtctcgggaaactcgtacacgctcgattaatcgagtttgatatcgagcctgattcggttctctacaattcgttgattagcttgtattcgaaatctggagattcggcgaaagctgaagatgtgtttgagactatgagaagatttggtaagcgagatgttgtttcgtggagtgcgatgatggcttgttacggtaacaacggaagagaattagatgcaattaaggtttttgttgagtttctggagttaggtttggtgcctaatgattattgttacacggcggtgatacgagcttgttcgaattcggattttgttggagttgggagagtgactttagggtttttgatgaagactgggcattttgaatctgatgtgtgtgtgggttgttctttgattgacatgtttgtgaaaggagagaatagctttgagaatgcgtataaggtgtttgataaaatgtctgaactaaatgttgttacttggactttgatgattactcggtgtatgcagatggggtttcctagggaagcgattaggtttttcttggatatggttttaagtggatttgaatcagataagttcacactaagctctgtgttttcggcttgtgctgagttggagaacttgtctttgggaaagcagttgcattcttgggctattagatcagggcttgtggatgatgttgaatgtagtttagttgatatgtatgcgaaatgttctgcggatggttcggtagatgattgcaggaaggtgtttgatagaatggaggatcatagtgttatgtcgtggacggcattgatcactggttatatgaaaaactgtaatctcgctacagaggctattaatctctttagtgaaatgataacgcaaggtcatgttgagccaaatcatttcactttctcgagtgcattcaaggcgtgtggaaatctttcggatccacgggtaggtaaacaggttcttggtcaagctttcaaaagagggcttgcttcgaatagcagtgttgcaaactcggttatcagcatgtttgttaaatctgacaggatggaagatgctcagagagcttttgagtcactttctgagaagaacttggtttcgtataatacatttcttgacggaacatgcaggaacttgaattttgagcaagcatttaagcttttaagtgagatcactgagagagaattaggtgttagcgctttcacatttgctagcttgttgagtggagttgcaaatgttggttcaataagaaaaggcgagcaaatccattctcaggtggttaaactcgggctctcgtgcaatcaacccgtctgcaatgctttgatctctatgtattccaaatgtggaagcattgacacagcttcccgagtcttcaattttatggaaaatcgtaatgtcatctcgtggacttcaatgatcacaggtttcgctaaacacggattcgctataagggtactcgaaacattcaaccaaatgatagaagaaggggtgaagccaaatgaggtcacttatgttgcaatcttatcggcatgcagccatgttggtttggtctccgaaggatggagacatttcaattcaatgtatgaagaccacaagatcaaacctaagatggaacactatgcttgtatggttgatcttctatgtcgagccgggcttctcacagacgcatttgagttcattaacacaatgcccttccaagccgatgttttagtatggcgtacgtttcttggagcttgcagagttcacagtaacacagaactcggaaagttggctgcgaggaagatcttagaacttgatccgaatgagcctgcagcttatatacagctctcaaacatatacgcttgtgcaggtatctatataattcaaacacaatcagataaaactctttcttctactgatctaccttgtgtgaaagtgacactttgttgaatatttctatgtagggaaatgggaagaatctacggagatgaggaggaagatgaaagagagaaacttggttaaagaaggaggttgcagttggatagaagtgggagataaaattcataagttctacgtaggtgatacagctcacccgaatgctcaccaaatatatgatgaattggatcggttaattacagaaataaaacgctgcggatatgttcctgatacggatcttgttcttcacaagctagaggaggagaatgatgaggcggagaaggagaggttactatatcagcacagcgagaaaattgcggttgcgtttgggcttataagcacgtcgaaatctagaccggttagggtgttcaagaacttacgggtctgcggagattgccataacgcgatgaaatatatatcgacagtctctggtagagagattgtgttgagggatttgaatcgttttcatcattttaaagatgggaaatgttcttgtaatgattattggtgaatggtgactttgagatttagatacacaaatgaggcttttctattcaatgttattttaaatcttgaggattttgggttcaatgtgatcgttctttttaaaaataaataaagagaagcattctaatttatttaagttattacagttgaagatgattcagacaagttttaagatactagtggtattagcaatatccggttttccgatgatg

SEQ ID NO: 10545 - DNA, 3000 bp, Unknown; identical to SEQ ID NO: 10534
  misc_feature (1)..( 3000): cDNA_ID_2715906_gDNA_ID_2213660_Annot_ID_181833 3000 nt of promoter + ATG

SEQ ID NO: 10546 - DNA, 3000 bp, Unknown
  misc_feature (1)..( 3000): cDNA_ID_3037207_gDNA_ID_2213660_Annot_ID_181830 3000 nt of promoter + ATG
aaattgtcacagccgttttcgatgcacatgatccgacaaccattttggttgtaatgatcctgaaaaccttcacactctcattacataacgtcgcaaatttactatacaaccatttcttgacaaacaaatcggtcactagctattcttctgttttttttatttttcttgtaatatttatatatataacgagtgtgacttgggctttgacaatgttagtatagctttaaaacgggggaaaaaaaaatactagaacattaagttttgagggtgcaaatatgtaacatatgtgttgtagaaatactttttaaaatttcaataataaccttggtttagtttccattgtttgaattggtattcatatctgactaccgtagaattcaatttgttagtgcagaatctgaaacagaaattgtgttgtctgtatattctttttttgggctctcaaatatttcgtgtatttttgtggaattttatataaagttggtgtcttttttaggacttttcgttgcattcaattatgttgaatgtgtaaaagtagtggctttccttggtcacatttatcaaacgtgttttcgcctttctttaattttccgtgttcaagtgaattctagctaacttttcggttttacgttgtatgaaaataattggctgtcgtcggtcacatgatcacatagagtttatttgattcaaatccatttaatatatgctgtatctttaatgcatacatagagatatattattatacgttatcttttaataggacattatattttgtttatatgaaagaaaagaatgtactgtatatgcagttatattatgctggtttatgtcaaagatagaagttaacgcaaattaatttctttatttcaattgtgttttgcgttacgatctgttttttttttttttggacaaatgacttaagattttattacttcatttgatattaataaattagtatgggtgatgcaaacgacttgaaggctagggttggtaccacggctgctaaagtctacttttggttggatctgtggtcggaagatcttgacgtgatcacttctataattgaggattgtgtgttgctgctactctcctctcacgataactcacgtggcctttttcttgtttttctttcttcatattttcacaaaacaaaatagtcagagatcttgagagattttttcagaagcatattgggcccaaatgtggacaatttcatgtggttgaattgttaaatttcagatagattagacaactaatcttgttgacgtgcatgcggtgaggatattaagtcgctatacgtcatatacgtgtatacttaaaatctcgtttgatatttctttcttttgtttttatcttcaacgacaattattgcctcaggcatgtcagcagaaaacgacaccgttcatattcgatctcgttattaatatgtttttgaagcaaaatatcattattagctatggagtttctgcagtagcctaaccggaagtctcaaaaagataacgtttatgccggttataattaaatccgataaggcgataaataagtgaacccgtaaagtctaaaattttcacatatatatgaacaaagaaatagtctatagatctccatgcattcttgtacaaacatatttaattttttattttattttctttatataagagttggtgtatgaaactttacattttgtaaatactaacattacatcataatgtcagaaccaataattctagtggaatgatataatctccactttaaattcttatgtctttatccaaagagatcatgaggaacttgagcaaaggaagagggcaccgtttagtagtataggtgaataacgtggcggacacgaggctggtctcattttcaaataaagagagatagagagaaaatggaaggaaaaaaaagctattggcgatgttgatatttgttcgtcttttagtggagacgaccaagagattttgaaaggtcgtcgaggagttagtttattatcttacaattattatggatttcttctgactaaagttttagtgcaatagttttctgagttattatatatttttcgaaattcatccaaaggctaaaactttgtaaggtattctgagtctattacgctagaaatagacacgcttacgtttttaagtcattttaatctgatatatatatatatatatatatactacaattttataaccaattatctttgtttcagacaatttatataaattcatataaactatcagaaataaagagacaattggctgtaaaattgtattattttgcatctatgaaatttttatttctctttatcaaaattgaagacgagttgaaattctatttcttttttaaaaaaatttatatatgggagtgtcaaaaaataattttcctttgtaagagaatattcgtatttggacgagtcttgatttgtgttttccgttagcgttccacattagttgtaaagagcgagaaagatttaagtgataattaaaaagacaagatatgcattttgaatatactctagatattaatcttaagcatttttcatattggttatattttatggtcgaattttgacatccgaaaaatacatcccttattcttcaatttatattgaatacttaagtttttgatagtaaatatgtataaataaattttaaacaattgtcaaaaagacattataacttatacggttatagttgttaaaaaaaaaacttatacggttataccaatagataaactgacattttagatttgagttttttttttttttactttccatgtagatagcgtggaataatacctcatttatatgtatcgttagttgaaataattgacaaaaggaaactattcgtttgctgttctagataaaagcctttaattgagaaaaagaaaatgcctccagctttgacccgttttgcctataaaaggattctctaagatatggactttcctcatcttctcgggtaaacagaatcaactagttttgtttttcctctttcaaaa

SEQ ID NO: 10547 - DNA, 3000 bp, Unknown
  misc_feature (1)..( 3000): cDNA_ID_2185690_gDNA_ID_2213660_Annot_ID_181829 3000 nt of promoter + ATG
gtggttaactagatgtccttgttgtagtcttcttgttttcattcttgtccattcttattatgtgaagtatatatatgatagatttatttctacttttcctttaacttagtgtctcaagttcaagacagaccaagcacaagaagcgaagaagatggagaaactgaataacatatttttcaccctcatggccagaggacctgatggtaaaaatttcattttctgcatatctaacttaaagaaagaacatgcatcatctatctcttagtgtttgagaaaaaaacctcctttgttttattgagctatgaggttatttctattatgagacaatgtatcacatcgtcaccggctattattttctcaaaacatcgcttttctcctaccaatcttgaaagaatggaacttgaatgtgcatcatctcacaacctttaaaaggaaagctccttttgtgctgtgtaacattgggtgtattatagcttactttgtttatttatgttggttgtataatgcagtcgatctctcagaagtcaccgggaaagaacagatggagacacagcctgccaagaaaggaagaggaaggaagcaataagtctcaagatttgttttccgtttgtcttggtatcaagattttgatccatttttgtttgatattttgagatggtagggttgtcaagattcgttctaaagcttacgacttttttttacactttgatcgattaatcacttttggattagcctaaacccaaaagctaacctttttaacttggattttgaaagttggccaactccttatagcttgattagtaagaagactaaagatagtctttgaaaagagaaaaacacctggtcaattatgatggagacagagaagaaaaacgagatgattttcttaaccgatgatctatcagcaaatatcatatcgagattaccgcaaagaatcatcaccacttccaaactagtttgcaagcaatggaaatcactcgctgattctccgtattccagccaaagtaccatcaaaactcgcattcatgactgtcatgtacacacactcacaagaagaggtcatgggttactatgcacgcaagatttggggacttccacaaaataaattaagtatatttagaaatgtaagaattgtgggacccactggtaggggcggttggggcgatacaatacgattcgagaataatatcagaccttagaacttaagctttagttgacaccctacatacaaatacattttgtgtcacaacgttagtgcaaaatataatattaaatctggtatctatcttatacattttgaacataagagaaagcacgtaggaacatccattgattgttatatgaagcaatatggtatttcatggggaaaaagcttaagaagagatcaaaatcatggcatttgattcaaggaagagtcttaattaatcaaagaactaatgacgagagatcactcttttccttttcctttccctatcgtcatgtgattcctaaacctctcgagggtcgtagaagttttctacaaagagactgacattttcacacatcctgagttgatgaaacatcacgttgtttcttaattccttaacaatacatctcttttgatcagaactatacgactatgcaagttctttttttagtttctccgtttaatcttttatgttgtgtggaaataagcggttttcttatgtgacaatgtgcgtttttttttgtctgtttcgaatcctcaatatgacgaagattaatacatttatggttgtgtttcttttgtgttgtataaatatgtgtttgttttattttcaataataagcttggtttggtttccattgtttgaatttattgggtatacatattagaccaattagaattccacttgtaaatgcatattctggaacaataatgttgactatactaataattttttcttgggtctaaaacatttagtatacttttcttgaattttatgtaaagttattctgtttttaggacttttatcctcactgaattatgttgtgttaaagtagtagcttatatggtcacatatctcacacgtgtttccattttttttctatctaagttttcggtttttacattgtatacaaaaataaatggcatgccttgggccttggccactgattcacatgatcacgtagagtttgtgtgtgattcaaatcctagatgagaagatcatccaattgatctaagatgtgtctttcttatatcacacgttttattttaataatactcttcagttgggtttgattccatttatgatttatctatgaaaacagaatatgtcctcatgctgattatttcgtttgtggttgcattttaccatctgtagttttttttgtttactgacaaacaactaagattttatgaattcatttgatgataaatagttaatcaaatatattattatgagtgactcgatggcgaaagctggtattatcttatggctgctaaagtctacttttagaagaagaaaaaaaaagggtctgttgcattaccctgttgttgcgactctcctacaataactctcacgtggcccgtttcttggtttttgccctattttcacaaaagtaaacagagattttcactagcaaattgggcccaattggagacaacttcatgtggtttgaatcgtatatttcagatagattagacatctagtcttctttgatgtgcggtgaggatcttaagtcgctataacgttgtgaaaaaagaaaagaaaaagtcactataacatagatcgcaactaaacaaataaaggacactatacatgtacgtaataatattcatttattttcaacgacaatgttccctagggtggtaacccaagtatttttcatagatattatacttctagcgaaaagccatcaattgagaaaaaaggcctccacgtttgacccgttttgcctataaaaggattctttaagatatggaccttactcatcttctccgttaaacccatttaaatagttttcattgtccttgtgaaaa

SEQ ID NO: 10548 - DNA, 3000 bp, Unknown
  misc_feature (1)..( 3000): cDNA_ID_2730994_gDNA_ID_2213660_Annot_ID_181864 3000 nt of promoter + ATG
cccgaaacctggttcgctgtgactttaaactatctcttttcagaattagaaaacttagacttctcattgaaattttgcaggtccgcaactttaacgttgaactcttgaatccaatgtaccaagccaggtaattttcattcattcattgagaagtgtttctgcgtcctgcttcttacaaaagctgactgttcattccttcttgcttccaggtcgcagaaggctgctgtagaattcctctggaatggtgcacaacaatctggtgagtcagaagattctacagagacggtaaccgaagctattctgggtttctcaaagaatgaattcgcaaattgggaatccaatattctctggtcgttaaaagaattcaactatttgaataagcctctagttctttgggatatggtagctgcaatgctggcgttcaaacaatcaatgccagagtttgttgaattagtattaactaaatggctctctgtgtcataccttggatttcatgatgatatctccatggaagatctcgtgccaaagatcaccaaacgcttctctgatgttccttccaggctgttacacattctcaacgtaatctctagacgtgtaatgttatcggaactcaaaacagaagaaatcaacagaaaactgcaaggtcagagaacgaacgatgaaggagaaattgatctgtggctcaaactgcttcaagaaagtgaacgagaactccgagaaagactggttggtctcagtttctcggcttatttactcgctgagtcatctcagggtactatttcgcctccctcttggaattggcgtccagctggattggctctgttgcaacaatgggttgagataaatcgtgatattgtccatagtcagctggaaacactttccttagaagtaaaatctagtcgaacgaggtaattttctcatataccttcttcttcttcccttgataatagatactagaatgttttcaaattcatatgttctgtgtctttaattcatcacagatcaagtaatagcacagaaactgcattagaggaagagaaatgtccttattgtgcagcgccagtaaatttccactcagcagaggaagccttttgcgaatcttcgcaccaaaaaaaaaagaagagcaaagacaaagagagatgtgatgaaagccacaagcttgagaggtgttgtgtctcaatgcaagtatgtccaccaactcctttatggttctgcaaatgctgcaaccgaatgactttagaactcgctccagagaccttatttgcattgccttcgttcccgagtgatctcaaatcacttccaaaatcttcctttagcaaagttgcctcgaaaccgttctgcctcttctgtggagttctcttgcagagaaagcagcctgagtttctgctctcagcctcacctgtgtgataacttcatggttatttataaatgattaagtagatcatgtattttattgtttgtgtaaacttgtactttacatatatatacaaggatggtccataagcatgaacatgtactctcgtgaatttcctcatcgtcccataggcgatggtgtatatatatattttattaaccttttaagaatttttgttacggtttttttttcacttaaagattttcatttataacaagggagaaatacatggttgtaataaatttttggaatgcgattttgaaatacaaagagccgatagaaaacagagaaatctccgaaaacaaaagcctgatatacgggaaatacaaaacatttcaaatgtcaagaggtgtacctcacaaaatcattggaaagtcagagaagaacaatagtcgcggagttaagagctcaaaagtcatggactagaagaccttcactcaccaacggaggaaacccaaggatagaggaaacggcgaagtcaaaactcaactaaaaacgattatccgaacatattaagcatcatcgtgaatctaaaacctaatcacttaatcttctaacaaataagtctaaatctaaaaaaaattatccccactaaaggttagtcttacaagaacataaaggaacagagattacgagagaaaacctacttattatttaaactagaggcattgtattttttattacgtttaaaaagtacatgttttcgtttggttttacaatatagttttaacttttaacacaactctgatatcaaaccgaactattgtactaccggtttagctctactagtaacatctgtccattgataacaactgaaactggtttgaggaccccttcggtatatggttgtagaaagcatatttgaacattgattaataataataaaaaatcaattattaaattaaatctatcatttctaattttttggataaaaaaaataaaaatattgagattttaaattaaaaattgattaaaaaaattagattgcaaattttcatttttccaatattattaaaactttcagttaatagagtgttcataattatgcatatatatatatatatttatatgtatgttttaattaaaaaggaaaagtaggaagcttcctaagaaagaagataaagtaaaaagagataaaaatattctgatgatgatttatttaattttaatgttgtccaaactccaaagggcagaagaaaactagcttaagtttatttaattttataaccaaaggggtctcttgtgttccttctattctaatcatccccttgaattttccaagttttctccttttgtcttctctaactattttcccttaaaataaaaatccaatttttctttgtttcagtcctctcttctgctcattgatcttttaattaactttgattctctccgtttatggattaaccatttgatcgagataactctccaaggttcgtatcaaattctgagtttttttttttccatttcttctcattctcaaattctctttcttagtttggttgttttgatgcagaaatcgactgagttcgtaacttgttgttgtctgatcttttaaagattcaaccttttttggtccgatcatg

SEQ ID NO: 10549 - DNA, 3000 bp, Unknown
  misc_feature (1)..( 3000): cDNA_ID_2730998_gDNA_ID_2213660_Annot_ID_181860 3000 nt of promoter + ATG
acaatgtgttttcagatgacatcagctttgtcgattgaagatgttcgtcgagaggtgaagttgttgaaagctttgtctgggcatagtcacatggttaagttctatgatgtgtttgaggattcggataatgtctttgttgttatggagtaagtatgtctctttcatgcttcttatatatcaaaagttgttttatttataatctccttgtgtttagatttggaccattgcctctgttataggaaaaaaaaaagtatagttctaatagtaccagtggtaggagaaagtttaggaattgagatgaccttaagatattgactccaatatgattccaggttatgtgaaggtggagagctattggacagtattttggcgaggtaaaatcaaaactagtcctttttctgttttccaccttgaattttggcatacttaggttaaagaggtaactttgtgttgcatatatatggaggatgattctgtgatgtctatatcttactgtagaggtggtcgatatccggaagcagaagctaagcgtattcttgtacagattttatctgcaactgcttttttccatcttcaaggtgttgtgcaccgtgatctgaaaccggaggtacacacattgttcttctaccaatgtgaatatcataagtagttgttgcttctgtcttgaacaaatgccatactgttgtatccagaattttctctttacaagcaaaaatgaggatgcagtactcaaggttatagattttggcttgtctgattacgctagatttggtaattctttgttcctctttcttatacatgactctgcttgtagtattttacttagaagactaaggatggaatgtttttttttttttttatgttgggctttaactagatcagcgtctcaacgatgtggtaggaagtgcatactatgttgcacctgaagtacttcacagatcctatagcaccgaagcagatatatggagcattggtgtcatatcttacatattactctgtggaagtagacctttttacggaagaaccgagtctgcaatttttcgttgtgtgcttagagcgaacccgaatttcgacgatttgccgtggccttcaatatctcctattgccaaagactttgtgaaaaggcttttgaataaagaccataggaaaagaatgacagctgctcaagctttaggtaagtttataaccactattgttaaaactagtgacattgattggtgaaatgaaaacatgagtatgattaataattttgcagctcatccatggcttcgagatgaaaatcctggtttacttctggatttctctatctacaaattggtgaagtcttatattcgtgcatcgcctttccgaagagcagcacttaaggtaattgtctgcttttcatcttgtcaagattttcttaggattttgatcacaattttcatgcaaaaggtaaaagaatagacacacatgacaaaatacttcctctgtttgtttgatcctagcttttgttcttgatagatttgatcatctatatgtcttgtatgtatcttaattttgctgtcacttgtacaacagtctctatccaaagctatacccgaagaggaactcgtgttccttaaagcacagtttatgctcttggagccagaagatggaggcttgcatcttcacaatttcaccacggtcagtggatgattaccacatttcatcgttccttgtttaacaataacttctaatgccactgttcttcaattgatgatcaaacaaaatcttgtggtaaatgcaggctctgacaagatatgctacggatgctatgatcgaatctagacttcctgacatattaaacatggtacgtactaacacatctttttaagtcccatcatttctagtcggtgctaaaatacatctgtaatactcttttcttctgtgtgtttcctttttgttcattgaagatgcaaccattggcacataagaaacttgattttgaagagttttgtgcggcttcagtcagcgtttatcaacttgaggctcttgaagaatgggaacagatcgcaacggtagcctttgaacactttgaaagtgaaggaagccgagccatttcggtccaagaactcgccgaggtatgtagagacttcaatatttatatctcttagatatgtgaaaacgacatcttttgcatcaattatgggttattatggaatatgtaggagatgagtttgggaccaaatgcgtatcctctgctcaaggattggatccgtagtttagatgggaagctgaatttcttaggttacgccaagttcttgcacggtgtgactgttcgaagctcgagctcgagaccaatgagatgactcctaactttgcaaatcaaaccctaatcattaaaacatgaatctcattattatactgtcgattcaagacaaaaacatcgactgaaaaaaaaggtacctctttttgtattaagcattttgttttcagaggaaccaattctaaaccaaacaaacaaaaagaagatgtttttttattgtattgaaattccggtttgtatagaaagaattagatgagtttgttgtggttcggttctgcttttgtttcctctaagcatatggtattggagttattaataaatcgaggtctagatacaataaaacttttgtgctaattcgagaattaattattatcattatcttcctttaaaattttgattttgtttcggaagatatagtgttatgtagaataaatccataacgacgaaaggaataataaaaggttgtaatgagtaaactacaaacagaagaaaggtataagatacatttagatactaatcttccaaaaaacaaatcaagatgtagttttatagaaaatcatattctttcttagaagaaaacagatttttttgtctcattcacttggaaagaatccttcactcactttccctttaagaagcaagtctcctccacttgtacgataccaacatcatcagcatcacaaaaagtatcattatcatcttcatcgaattagatg

SEQ ID NO: 10550 - DNA, 3000 bp, Unknown
  misc_feature (1)..( 3000): cDNA_ID_2715851_gDNA_ID_2213660_Annot_ID_181858 3000 nt of promoter + ATG
tcagccttggtttcattttccatgaggccatgtttgttttgagttggtttgtaaagtttatatagtttatcaacaaatgatgcaaaactcaaaaatagatcaagtaagtgcaattattaatgtacataacatatagctaaagaagggttatgggtcatatggacatcttatgtcagacaccatgattgtgtctacatcatgaaagacatgagcagacaaaagcgagaacacgaatctaattcacatgatggatccatcgcagtatacatatctatgtattaaaaaaatgtattagttttatcgacgaattattgacaaatacatgacacaacaaaaataaattaacatgcctttctattttgttttaatcttttcttccaacaaaatggtatattgattaacatgcctttttttgtgaaacccaaataatatctgttttcaggatttaaaatcatttatattattatagtagtcattaagcttgtggaagttcttttcatttgcattataaaacattttaagtattatataatcaaaattttaactttgtagatttttctaacattgatatttaaatacaaaaaaaatataaaaaatattcgtgtagctgttggatatatttgttaaaccaaatattaattagtgcagcctgcactcttgttaaatggaatcattgttacaattgagacaatttgtgtagattttgatgactcccccctagaagataatgataataaaggcttaatataattccaaaggttataatttaagaacatatcaacatccatttgccggttggatgacgaacgagatgtataataaagtattatacaaaaaataaaagatggtcgaagaggtcagacaaattaaatcaaatattagcttttctaatttcggttttagtcatttcaatttagtttaaccaaaatgtctttatcttcaatgatagaaatataataaattaacgctacaagaatctacacattgatagttatgtggttgatagtaacttccaaacaatcacattttttgctttaccaaatttgaagtattttgtttgacaaagatatatacgcgtctgtttttgttgaccacactagatcggaagaagagactcagagaacgattgttaaactcttttttttttagtgaatcaatttatttcattcaaagccaaaccatgtcaaattaaataaataacacaataaactctattctagtttcattttccaaagtcattttggttaaatacttctagaatccacagacaaaaaaaaggtacgaaactaaaaccggatccaacatttgtacgtaaggtatataccagaacagacgcatgatttgtgatactttgcatctgggatattcccaaacctaatccaagtggttgacgagtcatatcactcagcttaataaataaacctatctttgcatttgataaataatagcgtaatcgacccatttattttagttataaattaatgtaaatatggcataatccctaactgtttcaattgaataagacaaattattaccataaacgggagactcgtaaagcaaaattttatttgaaaagataagaaattgttatagctaattaataatcacagcgtagaaccaatatagtcattgttgtctacagattttttgttttcatgattacagatttgtttagttgtattatcaaatatactaacatatatgaacaaaactgctatgtaggtcgattcctaaacaacaataatataatttataccaagaaatataaatatgtttcttttgcttgatttggtcggttgaaaacatgggaattatttcatctcactcggtggaagccattatcactagatcgttgtatccattcgaccaattttattttttaaaacatttaactcatacacagtaaataatggtgtatttaggtacgacttactatcaactgacgctatattttctttttgggtaaattgttaactcaaaaattaacctagaaacatagaaatattcaataacaaaaaaaaaaacacatcgaaaataattcaacattatcttaattcactgaacttgttttctatgaactatagtttacgttattcataaatttttctttccatttttttaaatttagttggtctgcatgttaatacggattcaaaatctgaatgggaacaacatgtggagagggtaaactatataaacttgataaagaaagaaaatatgcaacaaataattaatagctctttttcacacaaaaaaacaactaattaatagctaatacataaataacatgcgaaataaggaagtaaatattttaaatcactaaattttgactacactatttataaattttgcaatgttttaaattttcttctaactgaataaaataaataacaaatacattattacaaattaccatatttcgcaacaaaaataattctgattatgtaatggtcaaaaaaatacttaaaacaataaaagaatcggtgagatacaatgactaaaaatataagtctgaaacaactaaataatatctatcggggtaaattaaaaatattagtgaaagaaacaggactaaagtgtaaattttaaggtttctcaccattaaaagcctctctccagtcaccaccatttttctctgaagactttttttttttggtcattaagattctcaaagagatagagaaaattacaagtaagcccacacgtttctacagagacaaaagagaaaagcaaaaagtaaacgaaacgaagaagaagcaaggaagcaaggaagcaagtggtgtagaagaagaagaccagacgcggcaggagatttttttcaaattttcattttcttgatcggtctccggcgaagacggtgtcggaaagttaatattgacggcggatatcgccggacatttgaagttatcgtctagttcaagttattggttggtgaaatcgtttgattaggttttaatctgaggagaggaagaggtttttagattgttaggaacatagatg

SEQ ID NO: 10551 - DNA, 3000 bp, Unknown
  misc_feature (1)..( 3000): cDNA_ID_2715868_gDNA_ID_2213660_Annot_ID_132531 3000 nt of promoter + ATG
tttaaaaaatctatgattgccttttcagattccttataaagaacaaacaaaattctaaaagataaataaacatatatgtagacagtttattagtgttttcaaaaccaaattgatgaaaatgatctgcagatgaaatttcttggttcacaagtttattaacttgattatttaagaagaaaaaaaaattcaatgattcaaagtttgaattcttttaccgaaagtaaaaatgcaaacaattgaccaattctttgaccaagtttattatagcttattattgattagtttgacagttacacatcatattttcatctctacttcatcatcataattcttagttcatccgcggtggcggtggcgacaaacgaataacacggtttattgtctgatcgtggcttgggtttgggtatgttttcggataacccatcatccgcggtggcggggcgacaaacgaataacacggtttgttgtctaaccgcggcttgggtttgggtatgctttcggataatccatcatccgtggtggcggtggcgacaaacgaataacacggtttattgtctgatcgtggcttgggtttgggtcttttttcggataatccatcatccgtggtggcggtggcgacaaacgaataacacggtttgttgtctgaccgcggcttgggtttgggtatgttttcggataatccatcatccgcgatggcggtggccgcgtaggacgaccccaaccgtttgttgtctgatcgtggcttgggtttgtgcctgtttccatcattttcggaatactctcttcaacctacattatttttttggtttggtgaaaaaattcacgatggttatcatatacagatctattttgaagtgagtgaaaatgttgattattaatcagagagaaaattaaaatctatgacaaatgtgaaatgtacattttggttaatgatactgcttaccatatttagtgaatattggtcggtgtgaggaactccatcttcatggctctctccaaaccctaaaagcgaaaatggaattcaataaacaaccatattaatagattataattgtgaaaatggtaataatcagaatagatctttgatattaaaaatgtaagactatctaattagatgatataaaacattctcaaattacttgaagaacacaatggaagaaggagcaagaacgacatgagaaccaccagctgcatctttgaaaacatgtttttttttccgagaaaaaatatatattttggttttgttgtttggaagaagaacgcatgcttctctatatatagtagacatagttcgtaggccaatgaacgcatactggcagatgcggacgtacagcatggggaaagtaggcacgtgcctactgttttttgttctccctcgaatagctatataaattaagaccatctccatcaggctaatactgcgtgggtttctcaacaatattattttaatcaatttataataattaagttatttatttaaattttaaactataaaaaaaaagaattgggccattaatataaagacacgtggaaagatattatctctaagtttctcaaactagaaacgtgtctgactctctctcctattttttcattattttatatttttttgtctccagatactctctcagatactcccgatggagatgctctaacaaaacaattcaagtaaaatcaagaagtgctttagtccaattttttatttatttcacaaccatataaattttattttttatccaaaattttataaaacccaatagaccattgaaacgatgattggcctaccatcatcgaccttatttttatagaaacaaaatttctttctcattgattcatcgtaatactatttagtatttatttttaatatatgtagctatataattgtactctggattaaaaaaacatattctggatcttccactgtctactggtgggaaaatggctaagtaaagtaactatgcactacacatttactacaattcaaactaaatgttttggtccaagattttcgtctctgagaattaacatattaatagtggaacatgtcatctcaagtttttaatgtcacggtattataccaccaaacgacgagcataaacaacttggaaggaggctgatcgaggagttagtttggtaaaaagacaattccataatccataaaagaaaaccttgatgtcctgtttctcatggttaactcaaagaacgctcacatctctttatagtgagaacaagtgtagttgcggaatggaagagtccgtgagtatgggaactaggcagccccatcttgacgtgaatctgtggccaacgagaccacgagatagtgatgaccaaacttgagaggagtatgaccaggaaaaaaaagatggtcccttgtctctacttgttcactacaaaatacacaattactactcgctcccacattccactttaccaatctatctcacgtagctaggccattatgattagtaattttgaaatagagcttagatgtgaagttagggaaccatacatccttgtaccaatcaaaaattggatttacttgctgaaatcaaatgctgtgtgtcttgcgaagcaaacttacaagtgaatgagtcattttttccttctccaaagaggttgatccttgccggttggtaacttgtttcttctccatggaaaaaaatgtccgtaagttattactattgaaactaggtccgtcttaatctatgggacgatcttaggcaaaaccagtaaaatgttaaagtttcttactaatttttttttatccaaacattggacatttttactctaacaaaaattttgaaattgtttttgaacttatggcaaaagcgaaggtggtttagggctacgatcaattgaggaggcaaataaagtctgcatattgaagctaatatggagaattctttcagcgagaagttcattatgggttgattgggttaaaaaacacctcataagagacggctcattttgggcagtgaaagataacacaactagcgggtc

SEQ ID NO: 10552 - DNA, 3000 bp, Unknown; identical to SEQ ID NO: 10540
  misc_feature (1)..( 3000): cDNA_ID_2715864_gDNA_ID_2213660_Annot_ID_132532 3000 nt of promoter + ATG

SEQ ID NO: 10553 - DNA, 3000 bp, Unknown
  misc_feature (1)..( 3000): cDNA_ID_2715858_gDNA_ID_2213660_Annot_ID_132534 3000 nt of promoter + ATG
ttctatgattataacttaaggtcccacgattaaaacaatacatttggtacatgaaatcactttaatatgatataaacagaattttgataattgataaccaaactgtggtcagtgtggtgatcaaccatatttggtaggtcaaccaaagatcatcaactctattagaagattccctaagaaaataattccaaaaatgtaaaattcaaacggcgtcgttttagtctttcacaaagaaaacacatacggcgtcgttttatcaaatcccaaagttgacgaaacgacggcgttataatgtcaagcttaaacccgcgacgtcgagggtttagttgtagaagagcttcttcttctctctcttagccatgtttgggtcaagaggtctctgttgcagcagaatctggaatcgttctctgtttctcaaacgttcttcaaacttccgagctagtttctctacgaaacgtgttgggacccataatggaacattccactgcgacgaagctttagcttgcttcatccttcgtcgttccaatagattctccgatgctcaaatcgtccgaaccagagatcatcaggtaccctttgttcaatttaccctgtatttgagtttctctgtgtgcaaagttcccttctttgggttcaattttggattttttttcgaaattctcgagaaatggttaatttagtttgatttttatgtaaaattcttgaatttttgtgtgtgtagctatgaatttgtgcagtaatttgttttgagtgtgcgattttgcatcaactctgtattagttagtaattttgtgatgtggttatataaggttttggagaagcttgatgcggcacttgatgttggaggtgtgtatgatcctcagagtgaacgttatgaccatcaccagaaaggatttagtgaagtgtttggccttgggtttaatactaaactcagtagtgctgggcttgtctataaggtaaaggatgatactttcttgtgatttggtgcttaatttgagaattgggctgatattttttgtcttgtagcattatggattggaaataatttccaaggagcttcaacttgagcagagacatcctgatgtgtttcgattgtttctagctgtgtacaaaaacttcattgaggtagtgcttcgtgctctagaaaggttgcttattaagatgctagattcttttggtatctattgagtgaactatccaaactatgctcacaaaacagtctaaagtttttggctatgccttcgaaagtttagtgtttgatgggaacaagttgctgaatctgttgttttattggcaaatatggctctgtctgacattttttttttcaaattgagtatgctaagaaagaaagaaattgcaatattgatgttagagatagtagaccagttcttgaactttcgtatactgtgttttttttacatgtttctaaggtaatgtactaatgtcttgttgtatacaatttcaggcagtagatgctttagacaatggtatccatcaatatgatactgaccaacctccaagatatgtaaacaatactagcctggggcataggattggaagattgaacttagactggattgaacctgatcagtctagtgccaaagaagatgaagcctttcatcgggcaatggagcttgctggctctgagttcttggaggtttttcccccttctatatctcgttctgttacataaaaccatttggttctgattcttcatggaaatgaggtgcaactaggaaaaatgctagtacctaagccaaaacttgtttggtaactactttgaatgaatcaacctaatgagatgctattaattcttataacaattgttgcctgcatctgataaaaaagtggcactgtttcattagaagtgattggtacaagaatatgtttgcctgcctatttgagtatgaatcgagaatacaaccaagcagattctaaagctacctgtgtttctaccttttgacagtgtgttcattttcacgcgaaatcgtggttaccagctcggtcaattgttatggagtgtcttgcaaaacggtatgatatagactccagtggagaaattatgaagctcagtaaacaatgcccagtaagttaaaatgagctcctttacatatatcatctacgtcgtggtttggggttataatttgctagagggattagaattgatgaaatggtgggattagtcttcaaagttgtaagatttatgtgcaattgacagtggaaactccatatattcgagctcgaggaagaaatgaagattgatcctccaataaaatatgttctttaccaggtacaaccaggtttatgcaccaattttactatgttgtcgtaacctttatttctctttaagccaatgagtgtgtgtatgtggtggttggtgcaggatgatagaagcgaaaactggagaatacaagcagtttcggtttcaccagagaggtttgagagccgtaaagctttaccattagcatggagaggtttagaaaaggagaagctctcagaggaaagctcaattccacgctgtgtttttgtgcatatgagtggtttcattggtgcaaaccaaacctatgaaggtgccttagcaatggcaagagcttctttgatggcttagagtcactgcataaccaaacatcggtttcttttggtttggaccggttcctaatcctatacatcgaatttaaatggtcactaaagttacattgtatttagattttgattaatacttaatattcaaaagtttcctttaaaaatagtttttttgagtcaaaatccatgtgaatgtacataattcataaataatgtgatcttatttagcttcaatttttttattgatgtaagaaatagtgaaactcaccgactaatgcttacgtgtacgaacccgcgttgtagaggataatttccaccttaattggtttggtacaatcgcgcataccactccgtgacattttcttcttcttcgtcttcttctcggtactctgagagagtgagagagaagcaacaatg

SEQ ID NO: 10554 - DNA, 3000 bp, Unknown; identical to SEQ ID NO: 10550
  misc_feature (1)..( 3000): cDNA_ID_2715851_gDNA_ID_2213660_Annot_ID_132538 3000 nt of promoter + ATG

SEQ ID NO: 10555 - DNA, 3000 bp, Unknown; identical to SEQ ID NO: 10549
  misc_feature (1)..( 3000): cDNA_ID_2730998_gDNA_ID_2213660_Annot_ID_132539 3000 nt of promoter + ATG

SEQ ID NO: 10556 - DNA, 3000 bp, Unknown; identical to SEQ ID NO: 10548
  misc_feature (1)..( 3000): cDNA_ID_2730994_gDNA_ID_2213660_Annot_ID_132542 3000 nt of promoter + ATG

SEQ ID NO: 10557 - DNA, 3000 bp, Unknown
  misc_feature (1)..( 3000): cDNA_ID_2785827_gDNA_ID_2213663_Annot_ID_132596 3000 nt of promoter + ATG
gctagggtttgtgtgaggagagagatcaagtggacaaccatgtttgagtcaaaactacagggaagagagatatatttttaattcattgaatatatacattggtgaatggagagggaagttgtggtagattagattttgtctacgtatgtctaccacttgtctacatatgttaaagatttagttgtgacttaggaggtcgtcaagcgcacgtgctaagcacaccaacgatttcttgatcttttcttcttgttggtatgaatatgatcctagaggttagtttaacaattttctaatgattttatgtatagtgaaacagtaatattattcacaatttgtggaactggctgatccaaaatatgttaaaaatgacattcggctactagcggaggtctgattcttagcctaacccttattcaattcttttaatactactagtgttggtttgaagtaagagaataataatgtacgtaaatgtatgtaatttgaaagtaagaaaagctttcgatgaagtcttagacagtaacaaactaacaaacatatccgctcaactaaatttacctaacaaatttccatagttttcaaccaagatttaaattaaaaatacactggaaattctaaacaaccctaaattatgttttttttttgttgtgtgagagcgaaatagtcggaattagagtaagaccaatcaaattttaaatatttatcgtaacttttatttcaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatgggtcggctcaagttcgcatgtccggttcttgagatcaatttaatctcagctcaagacttagcccctgtctcaagaaacatgaaaacgtattccgtcgcttggatcaacaccgatcctatgagaaaactcaccacgcgtgttgatcaatccaacagagctaaccctatatggaacgagaagtttgtgtttcgtgtcaacgacaagattctctacgttgacgcatcagcgattgtgattgagatctacgcagcggcttgggctaaagatgctcttgttggtactgtgaatgttcttctcagcgatctttttgctccttggtctggttttggtgatggtaacgacggtggtggtgggaataacaacatgaggcttgtgactcttcagattcgtcgtccttcagggaggctacaagggtttttacgtctcggtgttgcacttcttgacggtggtcaacggagtatgcctttatctattgaggttttcgatggaagtcgaaaaggagagaggaatagtgttaaaagagaccaagaggcttcaagaatgatgcatcgccgtacgaatagcgatcaaacggatttaaccacgtctacgaatgattacggtgtgaaaacaggggttgttactggcaatggaggagaggtggtggtggtggcggtattgttgttggtgcggatagtatggttaatggttcgctttgtagctctgatattggaccatcagcgtctgtggttgcggctgcgattgcgcaagggctttacaatagacagaaaacagcggttaaagcggctaacaaagaggacgcaagttcgatacttgaagggaaaacagagggaattgagcatagagttgaacggtggagagcagagaaaaatggcacgggtggagcgggtggagcggctggatcaagcgatgattctagcgggaaaggaggagcgggaaggagaagaaggaggaggagaagaaaggagaaacaacaagggaggagaaacggtggaggagagggtaagaaagggttgttttcatgttttggaaacgtgtttggatgtgagatttcgataacatgtggcggtggaagcggcggagaaggagacagcacaaagaagagatataataacaataaagtagtaaatcttagtgctgtagacgaaacgtttagtcattctgcgacttgagataagagaaaatgtttacttatttttggtttcttttggtggtgtaaaacgtttgatgatgggttaaaccatacagatttgaaagtattgaggttaaaacgtatgaataaactttcccgttacatttctggtaaatggactaatttgaatatttgtataatactggggttattgtgaaaagcttttaaagaaagggaaaagaaaagagagctttttgagaaacgcattaacacaccataacttcatcatcaaccttctcctctttcttacgcaattacaacttcaacgcctctctatctcttcgccgtgaatgtcgagatagtcgtaagctctctgcttttcaaatttctctcaaattgaggtagagagagagggcacagagatagagagagaggggcataggaaacggtgattttcccagttcccggaggaacaatcggctgatttctctgtaatcgaagaatctaaacctcacccactcgaaatcagctcgtgggttttggggggtctctattaatttccaaattctggagaaaaatcttgtatttcttcaag

SEQ ID NO: 10558 - DNA, 3000 bp, Unknown
  misc_feature (1)..( 3000): cDNA_ID_2715994_gDNA_ID_2213663_Annot_ID_132597 3000 nt of promoter + ATG
ttactggaaattgctaatttatctataatttcaaattgaagttgcaagattctgtatatggaattgagtttttcagctaggcttggtctaatcaaataattgagctgacaagttataatatcgatactttatctttcatgcgtacataagataaggttaattatttatggatccttccttggttaatgacaatcttatctaattgtttggcttaattttatataattgtttagagagagaattaatttctggtttattgaaatttgaaagggtagactgaggaagatgctttggaatattctgcatgggttgttccgttgtctacttgtcttgttcattcttctttggttgactctgattcaagatttttgtatacacaagttaatttcaagccttaaagagactttctatttttgctataattagatatgattggttttgttaagttttattggctcaataatgtaagcaatgataatgttgtctctctgatcatagaaaaaaaggctctatcttaaatgtgttgaagagtagatggatatggtatcatgttatttaatactcttctatgggacaaaaacttaagttttgtttgatggaaataaatctcggtattggtaatgaatttgaagctgatgaatttgtacttttgaatgcatcaagctaagcgccttcttgttttactgtttcaatctatcaattgttctatatagaagtgtttttagttctttgatgctgaaagtgatgtacttttctgttactgtcaatctctttgcaggtaaaggttttgccacaggaagaattagcctaggagaaatagaagtggtgaaaatcaccaagttccatcgagtttggagctctgattcatcacacgacaaatcaaaacgtgctacattttacagagccgatgacattccagaaggattccattgccttggtcactattgccagccaaccgatcagcccttgagaggttatgtacttgcagctcggactagcaaagccgtcaatgctgatgatttcccgcccttgaaaaagcctgtgagttattctttagtttggagtgcagattcagagaaaaatggtggtggttatttctggctacctaatcctccggttggttacagagcaatgggagttattgtaacccatgaaccaggtgaacctgaaacagaggaggtcagatgtgtaagagaggatcttacagagagttgtgaaacctctgagatgatacttgaggtgggttcttcgaagaagtcgaacggctctagttctccttttagtgtatggagcacccgaccttgcgagagagggatgctgtcacaaggtgtcgctgttgggtcattcttttgctgcacgtatgatctgtcgtctgagaggacggtccctgatatcggatgcttaaagaatcttgatccgaccttacacgcgatgccaaatctcgaccaggtccatgcggttatcgaacacttcggaccaacagtctacttccacccagaagaggcttacatgccttcatctgtacaatggttctttaagaatggagctttgttgtaccggtcagggaaatcagaaggtcaaccgattaactccacgggctcgaacttgcctgctggaggatgcaatgatatggatttctggatagatcttcctgaagacgaagaagcaaagagtaatctcaagaaaggaaaccttgaaagctcggagctttacgttcatgtgaaaccagcacttggtggaactttcaccgacatcgttatgtggattttctgcccctttaatggcccagccacgctcaaaatcggcctattcacgttacctatgacccgcataggagaacatgtcggtgattgggaacatttcactttccgcatatgtaatttctctggtgagctttggcaaatgttcttttctcagcatagtggtggtggttgggttgatgcatcagatattgagtttgtgaaagataacaaaccggctgtgtactcatctaaacacggacatgcgagtttccctcatccaggaatgtacctccaaggctcgtcaaagctcgggattggagtcagaaacgatgttgcaaaaagcaagtacattgtggattcaagccaaaggtatgtgatagtagcagctgagtatttaggtaaaggagctgtgatagagccgtgctggttacagtatatgagagaatggggtccgaccattgcatatgattcagggtctgagatcaataagatcatgaatcttcttcctttggttgttaggttctctattgagaacattgttgatttgtttcccattgctctttatggagaagaaggtcccacagggccaaaggagaaagataactgggaaggagatgagatgtgctgaaagaagacaaacctctttgtgatcaagacggtttaatggaagatgaagtctcttgttgaatcggagggttttgatctctactctactagtaattgtgactaatatgtaatttacagtatactagaatagggtttgatcttggtggttgtaatttgttgatgtaagacctaaaacgctgtgtttgcggctgtaatcagctgcgacagctcatgagcaatatgaatgattgattttgttgtactgctatcttctcgtatctctctgtgttctttacgctattggttagattgaattcataaccacccccaactgttccggtttgacacatcgttccggttagtgtgtagtattggacgaaatcggttattgataattcggttccgataatcggttttaataatgtgtatattgtaaacttgaaccgttctctagtctctatctctttctctttcttctgataaacctctcggcactgcgctgtgtagtgagctttcacttccgtcgttagctgcagtttaaaatccggcgaattgcggacggagaattcaatcatatagcattattgaggagctgaaatggaggttgtgacaaagatatggtgttgattttcacttcgccgttattgctgcg

SEQ ID NO: 10559 - DNA, 3000 bp, Unknown
  misc_feature (1)..( 3000): cDNA_ID_3037283_gDNA_ID_2213663_Annot_ID_181915 3000 nt of promoter + ATG
tataaataattcataaaggaggagagagaataacataactaaaaataattaaaaaaacgtttatgtagagagaaattttgtagtaatcattgagaaactatttgcataagtgactgtttataattagataattgaaaaaataaaaaaataatttaattagaaaattaagttataataaaatattacaatttaactcgccaaaaatatacgaatttaatacaaatatataaatggagaaacttcggctacataaaaataagaacagtgtacttttaaattctataatctccacaacttgcggtccacattatttttttgtaatatcaatttttatttttatacagttttctattgatggacatatacaataataaaggtgatattggaacttgtttaggaagtcgatcggtaagaaaataaaaagtcggtcaataatatgaatagaccaaatcgtgattgcattagaaagcaggagttaattgtttttgaaaatgatgaattaagtcggtgagttgctgcaaatactattattgactgactttttctataatatcggaaatagtacaatttaggagtttaattgttaaaatacgtacatatgaataattaattatgttaatcttcttgcagaccaccagctcgaaccatatgtgagttttgaacatgatattagttcaaataataagggattcagtaactaaattaaattgaattttgattacgattatcagtgcgttcatctagtaaatcaaataatatgatattttggaaattactatccattattttttatatgtaaatacccagacaattggaatgtaatggacaatatagacaaatagacagttaagttagttggagtttaggcgtcatatcgttgaaactttttatatatagcacccagagaattttattctaattttttttaataattaccaactatctttattggcacaaaccccaactagtagtcatcatatccagaaaacccaacgtgtattttcgctcattaaatccccaacttttaatatactcccttcgataaatactgaatttatatttatcgtattgtttgttcagtttcataggcaatgagccaatgactcgaaagtcagataatttatgaattgtagaaattgttgataataggactaaatttttaaaaatctacagcggcagtttataattgacaatcatgtttttcatttgaaatatggacagtcatctgagaatatttttgtgttcaatcagcacaaatatacaaattttaatctataatttcaaaaattaaattaggacgctttgatttggtattttttcctagttaatctttgcaggcggtggtttctttgacctttttattaaacacatgattatgccgacattaataaaaaaaagagagaatatgttcttattacggtgaatttactcattgaaactatgacttcaaaaatataatattataataagttatagtatatatgttcttattacttatggtatatataaaagttaacattgatatttaactctgtttaaatataagtataatttgatcattgtgttttgacataatatttttctccattgatatgaattctaaaataataaacatatatttatttatataccaataataaaattgaagattacgtcacactaccaccaattggttgataatttacactattttattccttcagcttaactggtaaggttaagaaacacaccacaaatggttgctaaactcttagggtcgtttgataaatgtctaatcaagctacaaagtacgatcacatatataatttagattatatatattatccattaaaccacatccaaataaatatccgaactgagaactcattgaaccacacccataggcatagctatatgtactgcatatcaattttatgtgatcgattttatcatttactctcgtatataaaccttcatagaaacttaaaatttcaagtttaacaaaatgaacattaacatacaaattcttttgaggttttcattagggattcctttcagtaggataataaaattaaatagtaataaaattttaaaagggacatattttcaacaatatgggtccacataacacgaagaggagccaaaccttttaacacttttgagtggtatattttccttcaaacgttttttctgccatacgactctttattttctttccaaaagaggttattttcaaaaggtagatgaaggtcatgtggctatcgaacccatttttttctggtggttggctaaggaaccccataagatgactatactgacatagtcctatgtaatgtacaaggaaaaaataaactaaccctcatatggaacataaaattattcgacagacgtgtcaccctatggatctaaaatttaatggtaggatctaaaatctaaaatatgaaaatttgtggaaaattccataaccatcccaataaattaattgttacatatagcaatattttattaattaaaatacagtttttatttgacactaagaagaaaaataatatttagcttatcttgaattatatatataaattgcttattaccctgaatttcatacagatatgagatatcatttaagatatttttgagtgttttctaattgtggggctttttcaacaagtaaggaagttgcttagagcttacgtgtctcttctacatcaccaaaaaaataagaaaaaaacaaaacataaagaaaagaaacattattgttttttttagctcttatcttcctctatataaagacattttttttctaccttcacatacttttattttcatttcctttaactgcatagttcttcctcaaattgctcatacctttgcttctctttctttctttattcaacctcttatttcttcttcagcaccaacgtgtatctgcagtaaacacatatccatcgatcgatctcctcaaaaagttattgttttcttgaaggatttttcttgttcttgatcaagcatacatatatatag

SEQ ID NO: 10560 - DNA, 3000 bp, Unknown
  misc_feature (1)..( 3000): cDNA_ID_3041647_gDNA_ID_2213663_Annot_ID_181914 3000 nt of promoter + ATG
tagaaaacgattataagcatagatatgattcatttcaaatgaacatgctccacctataattctagctaggtgcaaaattgttgacatagacgaatcaaaagtcacacgtgtggttgcatgcacgttgactatataatcttccatgcttcttagtttattacaacgttttaattggttgattatatattttaatatttgaaggagacttttggagtttcttaactttgacaatcttagtataactacgtatgagaaactccatttcatacaaaccaaaccaaaaagtcacattttgatcaatttcttgccgagtgttttattcgagatgttttgaaagacttgccgtgtaacatgtatcctttacttacagttgcagtttttgtcataggtttccttctatgcgaactttttcataatcagtatatttaacgttgatgtcacattattcgactattaataaaactaatgaaactaatttaacaaaaaaaattaactacatatgcagtacaataaaaaactgttcataaatcttttaattcgttagcaatataaatagtgcacaaaaacttaaacaaaatcaactttttaaaacaattttttttttgtaaataattaaataataaaaaacagattgagtaattgacaaccatatatttttttctaaatagaagaaacttgtttttgaagtatcttttatacggtgaagggtgaactaaagttcaattattgttttaatctctctcttttttttttatcaaaaactattgttttgattgactgcacgattaccgaaatataaatagctggaaaagtaaataactgccacgtataaaaatgagaagaaatcaaaatcaagggtattttggcttagcgtgtggttagcgtgtgtgtgtgaatgccgatgtggcatgtcattttttttaagtagaaaaacttatctaaattatgtatgtataaataacataattctaggatatttaacttagtaaactgcgttttaaagaaaacgttaactagatcatgtgggtgtttatgattccacgtttgctcttctgagaagaaacaaattaaatgttttaatttggtttgcatcccagcaagaaacatatcaaattaagattagtttaatacttgcttcattagacaaaacacgttattacttataagttatactactaacattaatcaaaattattggtatttgattttgtcaacaaattattgttgatctttagcctttacacatttatttttatatatggatttgattcaaacttttgggttagttcttatctcatttaatccaatcagatctcggtttgtttttatgttttactttttgactcgatttattatttttcatgatttttttttgttctacatcacagcaaagatgagatacatatcttgttaagcatgatatatgtataactatgcagtatactttttgtttatgcatatacattaacaactgtgtaaaggattttatcattttaagttgttcttatccctttagtttatatttgagggaagaagaaaatcactttcatatgtttgatttctatttttgtacatactacctaatttcaccatttatgcatgataattgctatatatgctagaaaaacagggaaaattcaattaacctaacaaaattggaaaagttcataaatcagataaagcagcgagcatcgcattcaaaacaatacgttaggctgtgcgtactgttttattaattttaatttctttacaaaaattgaagataaataactcaaaaacaaaaaacagaagtgaatttacagtctcatgatcttattttacattatatatacgaatatgcattatgctatagttcttctattcaagttttctcgaaatttttcactcagaaaaaggatacaataaactaggactatagtatgatgattgcgtcatcagccgcatctgggcttacgtggatatggttaggacaaaagtaaaactaaccaatcagatgtcatcccagaggacacagctgtctcatttgggtccacttctctaacaaaacttcttcaattattcacacacaatacaatgacacatataaacaatttaaataatttattaaatattgaaacggaaattttgtgttcatacttaggttcttactatgttattgtattttttggaaaagcttgaggactatttctcataagtatataaattttttgtactcaaaatttcggattcaatccctagaaatacatttatcaaacaaatccaatttgagttttatttacaaatacaaatttgcaatttaatatgacatgggtctcagactttacaaaataataaagtctagatactacgaactcgttcgtaattagcaatatatatatatatatatatatatatttttccacttagcaatctttgttttgaatgtataaacaatgaagcctttacataaaaagtctaattagacataaataatgcatttaatattaggagaatatatagactacgtgcacaaaacgaccaaaattgagtaagatattaataagaaatatataaattatatattcaagtttctgttcataaaacatgcttgagtttcgatgacgatatttgctagtttctccataaagttctaataagttttttaaaaaggttcttttatttggttgaagatattaatactaactgattttatttactttttatccactacttgacactattttggatcttttcctccggtctactttacagaaaataatattctatatttttcataaatatttcaatctcaattttctttaaaaaattatacattcaagcactaaacgacagaactctacacaccataaattgccctcaaaacctgctctacgaaaaatttcaatctttggctcacttctttgtttatctcatagctcttcaccaaaaccaatattttctcctttgttgttctttcttttctatcaaaactttctacttaaaatatcattcctttaaaca

SEQ ID NO: 10561 - DNA, 3000 bp, Unknown
  misc_feature (1)..( 3000): cDNA_ID_2715914_gDNA_ID_2213663_Annot_ID_181912 3000 nt of promoter + ATG
aaatacaatgtaaaatacatatgcaggggaaaccataatactagatatattagcttatttcgcaaagtcaattcgtagaagtaaatattcgagttcaagtgataggacaaccaagtgatatataataaaatctaccacaacccgagaagctaaaaaaaatcacaagctggttagttcaactcgtcgaggaaaaatcaaatcaagagattaaaactctagtctaggatgatcccacagtcatctccttctacaatcattaaattattactctatcgaaaccacacgctcgcgaatacttatagagtacatgtggaatgagataacgttaccagggagattaggagacttggcttatagaatacttatggaatacatctccctcgcgacttacctgcgcaatgaaaactttttctcgtcttgttcaatagttgtacttcgcacaaaggataatacgatcataaaaagactcataatacgatcttcgatatacccgcgcaacgatggatcacataaacggtcgcatggttggaaaatttagggctcatctctgattgttttattttcttcacaaaggggcaaaaatatatatatacactgtatatatatatggggttttttttatggtcaaatgttattgcccttcgaataagagacctttgattcgtaagaagagattattattttataagagaaggttatgaccgaaaggtttctgaagaaaatgaaaaattacttttaaaaggaattttatctttaaaaggaaacaaaaggaatggttaagttttacatgattggacgcaaaaatggaaaattcttttgattacttcaaaaaaggaaaccctcatttcttattaataatacatcaaataaaaaactaacatgatttttcgcaaaatatccaatttgtgaagaccctaacgctcgaatttgtcatcacttggctcagtctttcaacttttgaaaactgaaactccttttttctcaatactgttagataatagagatatactcgagacgattgagcttcgtcaaatggatacatgcagtattaaaatcagcagttcaaatacaaagaaatttaaatcatcaagtatgaatatgtatgatcatgcttcacgatcgaacagacgaacaccaccagaaactcgacgtcccacacgaacagaagatgaaccaccacagtcttttcccaatcgtaagtgagccatattgtcgcataagttatcacgtaactcgagcatcgcttggtacctttgctgcagctccttcgcgctcaaaccttccgaaggaaagttccaccacattttatctaacttcttttcatttctcgattccttcaacagtttcaacttctctagatccatcgcaagctcctcttcgagcgcctccattttttttacgaggtcgtggagccttcgtttcttataagcttcgacgaggggtctggtatcgtctctctctaatggttcttgtctcgaagggttctttaaccggtcagccactttcttcatagacggatgtgcgaatgtatagggcttcttgggttgagagaaaatcaagaaagccacttcaacgtcacacattgctacgagctcgttcattttcttaaaaattccggttttacgttttgagaacgtaatcatcctatctccatagttctccaccttcttcatctcgatcttttgcttcccctttgtttttcttccctttgcttgcttcgtagatgacatgtttgcagaaaccagaactagtgtttgatttcttgtaggtttgttattttgtatgtaatgataaaaccatgcgcaaaacacaatctatttatagaccaaagaaagagataggattacaaagtttggagacattaaatttaaatcttagttatgaagaaagtgtattgactaatttacaaaaaaaaaaaaaaaatgttgactaaacacatttggcaaccactttaacatcttcattaatcagtcaagaaactattatggtaacccaattggtgtaatagctggtgtaaaggctaattgaccattcaaggaggaatgttcttttaggtaattacgagtttgtgtatcccttacagggaacatacctcagatccaaaattcttttgttacaaaaaaaataggaaaaatttgatataaaagatatctactacaaaatttgtccataatattcttatttttttgtagattagtcatataatttttttaaaaaacttcaaaatccaaatttatcttatttttctatcaaatttcatttaaaaaataaaacttttttgtattagtataagtccgttcatttgattagtcataacttttgctataatattttgtttgacttgaaatcactatcgttggaaagctaattgaaactaatagaattgctataatattccgtttgacttgaaattactaccgttggaaagctagttaaagctaatagaattgaagtcaatatataaacataaaaaaaaaatttaaaaatttaattttaggttaaaataactttaatctattttctctaaaataacaataacttaagggatgcaatttatacttataaatttccaaatttatataacatgaaacacatgaaaaatatttcctctcataggctacagctagctaatataaaataaaatccacgctttttatatgcttaatttaaactctaattattaactctaataaaacctagtttaagtccacgtataatttcaactgatattcaataactaataatttatatatttgttgcaatctctgtaagactatcggttaggttaatcattcaaagatatcttcgtttcataaaacaagaaaaaaacaaaaaaaaacaaattttcaaaaagaaaaaaatctatttgaggagaaaaatagctgtgagagagaaagctaaagaggcgacgtaccacccacctaaccacaaccagatccccaaaagacagagaactttctcgatacgaacgccaaagagaagaagacgaagacgaagatg

SEQ ID NO: 10562 - DNA, 3000 bp, Unknown
  misc_feature (1)..( 3000): cDNA_ID_2715930_gDNA_ID_2213663_Annot_ID_181909 3000 nt of promoter + ATG
ataacagagctacaacggtaaataaggaaaatgattaagggcaatttggtcttttaggttaagaaaagtattgaatcagatctgactttttggccaagaaaaactctcagccactagatcattccgacccctcctccacgttcttctctcttttaaataacctcttcacggaacccttctcactcacctatctcactctaaaatctctctctgccaatctcatcttcaacctctctctaactctcgttttcgattctacaatgggttagtctctcgcttttactaatctctcgtcccgtcgctgctattttacgttgttgagttttctgatctgatcgtttttctgattttgtttgttgttttatgtagctgacaagaagattaggatcggaatcaacggtgagtttcgaatcgattttgtaattcgggtttgtatgttctcatgtatctagatctagaatctgactgttgatttctgttatcgttaggattcggaagaattggtcgtttggttgctagagttgttctccagagggacgatgttgagctcgtcgctgtcaacgaccccttcatcactactgagtacatggttagtgttccttccttggttttgacggtgattcgatcttggtttgcttcaatattattttgatctcttgacgataagattctgttagtcgctctggtacctttgctttcgttagatttgatagatggatcatatcatttatggattatgcatgtggatttaagtgtcagatgatttgttcaattagtgcacagatctggaaactggtttagtgttcattgttcatactgtttagctgatcagtatacttgtggagctgttgtttgttttgctgtgtttgtaatgttattgattagcctgtttgtgattagagttgatatggttgagttgattttgattgcgctctgtgtttgattgctgcagacctacatgttcaagtacgacagtgttcacggtcaatggaaacacaatgaactcaagatcaaggatgagaagacccttctcttcggtgagaagccagtcactgttttcggcatcaggtacatttatcaaccagttctctgtctctttgcgtgtatacatattacaaactgttgtgaatttcaatctcattagtttttggtatttgtgaaggaaccctgaggatatcccatgggccgaggctggagctgactacgttgttgagtctactggtgtcttcactgacaaagacaaggctgcagctcacttgaaggtttgtcttatttgaattggttatttttgtcttgtaatgatataaatagtttatgtgctagaatttgcttagtatcattcaactaaatttgtgacttgttgtattttcagggtggtgccaagaaggttgttatctctgcccccagcaaagacgctccaatgtttgttgttggtgtcaacgagcacgaatacaagtccgaccttgacattgtctccaacgctagctgcaccactaactgccttgctccccttgccaaggtaaaatatctgatattctatatgatcaaatttgactttgtatttcaagttgaagtgactaatttcatttaacgttctttgatttcattgtgtaggttatcaatgacagatttggaattgttgagggtcttatgactacagtccactcaatcactggtaaatttatcaatcagttagaagtttattacaaacttgcttgcctataggtggaaaatttgtgatttaatggggtttgctttatgatttcagctactcagaagactgttgatgggccttcaatgaaggactggagaggtggaagagctgcttcattcaacattattcccagcagcactggagctgccaaggctgtcggaaaggtgcttccagctcttaacggaaagttgactggaatgtctttccgtgtcccaaccgttgatgtctcagttgttgaccttactgtcagactcgagaaagctgctacctacgatgaaatcaaaaaggctatcaagtaagcttttgagcaatgacagattaagtttacttatattccagtagtgatcaaattactcaccaagtgtttttaccaccaatacatagggaggaatccgaaggcaaactcaagggaatccttggatacaccgaggatgatgttgtctcaactgacttcgttggcgacaacaggtcgagcatttttgacgccaaggctggaattgcattgagcgacaagtttgtgaaattggtgtcatggtacgacaacgaatggggttacagttcccgtgtggtcgacttgatcgtccacatgtcaaaggcctaagctaagaagcagatctcgaatgatagggagtggaaagtcatctgttcatccccttttatggtctgaatttgtcgttttcgaataaaatttctttgaacttggaactttttttttttttggttttcttaattctcattcatgtgaggtgatgggagtttgtagaccgatgttttactggaagccctttgtttttggcttttgatatattgagttaacgttatggttttcaattttgttccacttctctttttaactatatactaaatcaaatctgaacgaaaaatgaaactaaatgagctcccgttgatgatgacgtagcaaatctaaggaactagaggtgtacacttattaatctagcttcttctagttttcgaataaaagtttctaagtggaacctatattttatgtttgcgattctcatttatgcgagtttgtagactgatgtttgaatgaaaagtatttcatgttgccttttgttattgattcttctcaaaacataagaaattcattaacagatgtgcggtttataaagacaacgaaatatgtgttcatctgtaaaggtactttgaacaaattattaaaccatgttacacaaattcacgtatagtggcacttcaattatttgtacacatccgcatcgaaaaaatggggaggtcgttgatatacgacacaagaaggcccaatg

SEQ ID NO: 10563 - DNA, 3000 bp, Unknown
  misc_feature (1)..( 3000): cDNA_ID_2715934_gDNA_ID_2213663_Annot_ID_181908 3000 nt of promoter + ATG
attgatgatgataaaaatttgattttcctatggttgcagttgaagaaccctgttctgggttttagatttaatgtcttggcttattcaaaatcgcattggaaacaccttgttacgccttaatccttcttcgtcttctatcgctattttctctacgtttatcaagaatctctctactgcttcggagcaattacctgagacacttgatgaatattcacagtctgaggagatatggaatgttattgtaggtagagacggtgatagagatagtgaagatgatgtttttaaacgtctatctagcgatgaaatctgtaaaagagtcaatctttctgatggtttggttcataagctgcttcataggtttagagatgactggagatctgcgcttggtattttgaaatgggctgagtcttgtaaagggcataaacattcgagtgatgcttatgatatggctgtggatattctcggcaaggcgaagaaatgggatcggatgaaggagtttgtggagagaatgagaggagataaacttgttactttgaatacagttgctaagatcatgaggagatttgctggtgcaggggagtgggaagaagctgtgggaatatttgataggttgggtgaatttggattggagaagaacacggagtcgatgaacttactgctcgatacgctttgcaaggagaaaagagtggagcaggcccgagtagttttgctacagctgaagtcacatattacaccaaatgctcatacgtttaatatcttcattcatggttggtgtaaggcaaatagagttgaggaagctctttggacgatccaagagatgaaaggtcatggttttcgtccttgtgttattagctatacgacgattataaggtgttattgccagcagtttgagtttattaaggtctatgaaatgctaagtgagatggaagctaatgggtctcctccgaattctattacttacacaactattatgtcttctcttaatgcacagaaagagtttgaggaggctttacgggttgctacaaggatgaaaagatccggctgtaaacccgattctcttttctacaactgtttgattcacacgcttgctcgagctggtcggttagaagaagctgagcgggttttcagagtcgagatgccagagcttggtgtttccattaatacatctacctataactctatgattgctatgtattgtcatcacgatgaggaagataaggcgattgagcttctcaaggaaatggaaagttcaaacctttgtaatcccgatgttcatacgtatcaacccctgctgagatcttgttttaagagaggagatgttgttgaggttgggaaactattgaaagagatggtgactaaacatcatctcagcctcgatgagtcgacttatacttttctgatacagaggttatgcagagctaatatgtgtgagtgggcgtattgtctattcgaagagatgattagccaagatatcacgccgaggcaccgcacttgtttgctgctcttggaagaggtcaagaagaagaatatgcatgaatcagctgagagaatcgaacacattatgaagactgtgaaacttactgcacctgtaaagtgaggtttattagttattatgacgacttgactgttacttcgcagattgggatgagaagtggtctcttcatgcttgcgaaagaagacaagaccagatcatgcataaagatgttcattgtgttgtttattcaaccacattgtagtgtagatttcaagttcgttggtcaatggatatggacaagaaacttggacttcgtattcatgaaaagttgttaagattggaactctggagttgattgatctgacacattcttgatgataagaggttaggcaagttttgtttgttttctgttttgactcgatctttgcaaaggtctcgagacatctcaagatctagagttatggcaggcttattcacatcaagactaatttatgggagagtttacacaagtgtgggatccaagagcatatttttttttgtaatgagcattgagtttatggacaaatacatgtgcatttggatgcgtccacacttcacagttcacaccgacagaaaggtagatccatattaccccaaacaaaacaaaatatattttttgggatatttttgaaattattaatagaaaataaatttgagtagtcttcttcaacttcataagatggttaagctttaactacgaattattgattagatattattattaagggccctcaaatgttagctgccacaagtgggcactttttctttggtctacattgttcgaaatttatgtattaatttagaggcagagcaatttacatgtcgatttattatgcacgaaataacaaaactactagtatcaataataatacatccacgtctgtttccaaccaaaccagggatgcgtctaatttgatgaagcatcattcaattattgcttacacacttcttaaacattttaaactttactgaataacagattatttttatttttttactgcaaaagggaaccataaccaaaattcttgctagattttaatatacttacacattcttctttcttgctgaaaaatcaacagcctttcagaaatcagaataatacaaaactttttcaggatcataataacatgcttaattgattagaaaaaaaggataaatcccgtcagatatggtccactcacggggatggaatctgcatattgtcgatgctcccaaaaatactatttttttctttttctggtgaaacacacacacaagttccgtcttcgccacaacaacacaatcttcaaaggtttctcctttttgttgtcttctgcttcatcactttgtgttcgtcgttcaaaaaaacttctttgatttcaaaccactcaaattcatctttataatccacttcctctgttttctcgttagctctgtttcctttgagattcattggtttggttcactaaaaccgaagaagacccggataattttctagaccggaaatg

SEQ ID NO: 10564 - DNA, 3000 bp, Unknown
  misc_feature (1)..( 3000): cDNA_ID_2994661_gDNA_ID_2213663_Annot_ID_181906 3000 nt of promoter + ATG
gttggacatcaatatagtaagatatcttcgaaaagtgttttctcctcaagatgatatcgttaatgattaagaaataagttgatggttatacaacagataaaatatatactaataaagggtaagaaatacagattaaaaatgaatgtgtgggaaataactacgaaagtgtgtgtaatatgtaaatgtaacagtttaatgaataaatatacacaaatcttgtatttaaaatttaggagaacaggacttggggcttataaatacgtttgtgatcctgtttaagaagagtttgaatcagaatcatgaaatgtgaaagattaaacatctcgttttcttgtcacagttcacaacgttttttattactctatcgacttacgatgaatattttaagaaaaataaatatgggccgaataaagacactaatgggcctaattaaatgggcagtatatccaattaagtagtaaacagaaacgtttcgtttcgaatcacacacaaactcacaacgtttctgtgaagctcgccgtcaccgtcgccggaactcatggatcgaccaccgtcgttgccacactatcaaaaccctaatccgaacctcttctaccactatcctcctccaaattctaatcctaatttcttcttccgacctcctccacctcctcttcaaaatcctaacaattactccatcgttccgtctccgccgccgattcgcgagctctccggtacactctcttctttaaaatccctgttgtcagaatgtcaaagaaccttagattctctctcgcaaaatctagctttagatcactcttctcttctccagaaggacgaaaatggctgttttgttcgttgcccttttgattcaaatcactttatgccacctgaagctctctttcttcattcacttcgttgcccaaatactcttgacctcattcatcttcttgaatcctttagtagttaccggaacacgctcgagttaccatgtgaactacagttgaacaacggtgatggtgatctctgtatctctttagatgacttggccgattttgggagcaatttcttctaccgagattgtccaggagctgttaaattctctgagctcgatggaaaaaaacgaactttaacacttcctcatgttctatctgtggaatgtagcgattttgtaggttctgatgagaaggtgaaaaagattgtcttggataaatgcttaggagtcttaccgtctgatctttgtgcaatgaagaatgagattgatcaatggagggatttcccaagttcgtattcctctagtgttctttcttcgattgtgggttcaaaagtggttgaaataagtgcattgaggaaatggattctggttaattcgacgagatatggtgttataattgatacattcatgagggatcatatattcttactctttcggttgtgtctcaaatctgctgtgaaagaagcttgtggatttaggatggagtctgatgctactgatgttggtgagcagaagattatgagctgcaagagtagtacatttgagtgtccagtcttcattcaagtcttgtcttggttagcttctcaacttgctgtcttgtatggagaaggaaatgggaagttttttgctttggacatgtttaaacagtgcatagtagaatctgcctctcaggtaatgttgttccggttagaaggaactagatctaaatgctctggagttgtcgaggatttggatgatgcaaggttgagaaataaggatgtgatcatggagaagccctttgagaatagttcaggtggggaatgtggcaaaactttggacagtccacaggtgatatctgtgtcccgtgtttcagcagctgttgcagctttgtatgaaagatccttgcttgaagaaaaaataagggcagttcgatatgcccaaccactaacgagatatcagcggtaggtttgaaatctttcaaaggcgattctgttttgccgacttgatttttagtttatgaaagcatcatttcatgtttgcatttgagtttgattcctcatgatgtctctgtctgtcaatctgtagggcggctgagcttggttttatgacagctaaagctgatgaggaacggaatagacgttgtagctaccgacctattattgatcatgatggtcgtccgagacaacgctcattaaatcaggttaatactcaactaactgttatctaacattaagtaaacaaatattactgtagggaacttttattgaaggtactgaaatacatatattttactgtctataatgtgtaggatatggataaaatgaagacaagggaagagcttttagctgaagagagagattataagcgtcgtcgaatgtcataccgtggaaagaaggtgaaacgaacgcctcgacaggtaagagctgtttccttttcatgaatgacaatcacaaattccagtgttttgaatgtgctacaaaatgctcaatgtttggacaatctcattgaaattttgttggaaaaagtgtagttatatgctgactctactattgtcttgtcgaggcattttgcagattttgtgaaaaaaattggtccttgctaaattcatacttttagttatgaccacccttcagttagcaataaacttatactatcctcttcttccagtgagttttctccttcttttgtcttgtaggtcttacatgatatgatagaagaatatacagaagaaattaagctagcaggaggtattggatgttttgagaaaggaatgccattacaatcccggtctcctataggcaacgaccagaaagaaagtgactttggatacagtataccatcaacagataagcaatggaaaggagagaaccgtgcagatattgaatatccaatcgataatagacaaaattcagataaagtaaagcgacatgatgagtatgattcaggtagctcgcagagacagcagagtcacagatcatataagcacagtgatcgaagagatgacaagctccgtgatcgaagaaaggacaagcacaatgatcgaagag

SEQ ID NO: 10565 - DNA, 3000 bp, Unknown
  misc_feature (1)..( 3000): cDNA_ID_3037308_gDNA_ID_2213663_Annot_ID_181897 3000 nt of promoter + ATG
ggttgaacgacaagaaagttcttgttgttattgatgatgtgaatcagtcagtacaagtagatgccttggcgaaagaaaatgattggctaggtcctgggagtcggattatcatcacaacccaagaccgaggaattttgagggcgcatgggatcgaacatatttacgaggtggattatcccaactatgaagaggcccttcaaatcttttgcatgcatgcttttggtcaaaagtccccatatgatggttttgaggagcttgctcaacaagttacaacactttcgggtagacttcctttgggacttaaggttatgggatcctatttccggggaatgaccaagcaggagtggacaatggcactaccaagggtaaggactcaccttgacggaaaaattgagagcattctaaaactcagttacgatgccttatgtgatgtagataaaagtttgttccttcatctagcttgctctttccacaatgatgataccgagttagtagaacagcagcttggaaagaagttctcggatttgaggcaagggcttcacgtcttagctgagaaatcgcttatacatatggatttaagactgatacgtatgcatgttctgctggcacaacttggtagagaaattgttcgtaaacaatccattcatgagcctggacaacgtcaatttttggttgatgcaacagatattcgtgaagtactcactgatgatacagtaagttttgacatatattttttcttcctttattgttcttatcatttgacaactaaactatataatttcttcagggcagtagaagtgtaataggcatagatttcgacttcaatacgatggagaaagaattagatataagtgagaaagccttccgaggaatgtctaatcttcagttcataagaatttatggtgacctttttagccgtcacggagtatactattttggcggtcgcggtcaccgcgtgtctctggattatgatagtaaattgcacttcccgcgaggtctggactatttacctggaaaacttaggttattacattggcaacaatttccgatgacaagtttgccctctgagtttcatgcggagttccttgttaaactatgcatgccctacagcaagcttgagaagttgtgggaaggaattcaagtaactgtttgttctctttatttacttctctccaactttcatttttttttctttttcgaatggattatttgatgtatacgaacggctttgaaacgctttcacacttctaaacttctagttgtggtttttgtactgcagccgcttagaaatctcgagtggctggatttgacttgttccagaaatctgaaggagcttcctgatctttcaacagccactaatctccaaagactgtccattgagcgttgctcaagtttggtgaagctcccttcctctattggggaagccactaatctcaagaaaataaacttgagagagtgcttatctctggtggaattaccctcctcatttgggaatcttactaatctccaagaattggatcttagagaatgctcaagtctagtggagctcccaacctcgtttgggaatcttgctaatgttgaaagcctggaattttatgaatgctcaagtttggtgaagctcccatcaacttttgggaatcttactaatctcagagtgttgggtcttagagaatgctcaagtatggtggagctcccatcctcgtttgggaatcttactaatctccaagtattgaatcttagaaaatgctcaactctggtggaactcccctcctcatttgtgaatcttactaatctcgaaaatttggatcttagagattgctcaagtctactcccctcctcgtttgggaatgtcacttatctcaagagattgaagttttataaatgctaaagtctggtggagctcccctttttctaatatatatatatatatatccgttggtatagttctctgggattctagttcttcgcatgcggtcttaataatttgttcaacctcttctcatggtatgtgtgatttgaatgttatttttcccattttcttgcatgcagatgattttattgcaaatagaaacgtattttgtagttttcctttgttattgcttgtccgatatttttcgatgcgaaaacattcagtgtagttttcgatggagttaagaagacaactttatcattggtccatccatgtcttaatctattagctgtgaaatttcatgttttgacggagacatagatttaattaatgtatccttgtactttattccttgctaattccttcttagagatagattgctccaaattacttgtcatatagataaaacgattctgattattctcaaatttgtttaatacgaaaatgtataaagaaatgcaacaaatgtatttacattacaattataattactagatgatttttcgtttttttctgattgctaaaagttattctatttatgcgactaagaaatatgtatatgttacttgtatgatagagatccgtttgagcctactcaagacttaaaatcgaactagcatatttcttcctcgtagattttggatgagtctgaagattagtagagcccctcacgaattttccatgaagagataaataacaacaaattaagcttcctctcttgccatcttatcattctagatcgctgaatatttttacgccacacaattttgtgcgaaaaagacttttgcaagttggcttatataatagagatccgtttgactgtttgagtacaagaaagacttaatagagatccctcatttttctgctaagaggacattttatatagactcacgtggtggagccacagagaattagccgcccctcacgaatattcttcccatgtttgcgttgctagtcttcttattctaagtcaatggagttagtgtactaatctaatatatatacaacaaacccttttatctgttttgaataccattgcttcatatagctctctaaaaaagctctttgttcgtctctatatcatacgaata

SEQ ID NO: 10566 - DNA, 3000 bp, Unknown
  misc_feature (1)..( 3000): cDNA_ID_3037312_gDNA_ID_2213663_Annot_ID_181894 3000 nt of promoter + ATG
tgatccttcatgttaataataatgataaatttgtgtaggtgattgaattgggtggaattccaacgattggtgattgtgcagtgatattacgagctgctttaagagctcccatgccttcagccttcttgaagatcttgcagacgacacacagtcttggctactcatttggcaggtaactcagttacaacctctctttgggtttagtctgttagagaagctagtctaaggcgttcgatatgactaaacttgactataaacaatgacatttgaatacacgtggtaaaaatctgttgcagcccgttgtacgatgagatcatcacattgtgtttggaccttggagaacttgatgcagccatcgccatagttgcagatatggaaaccacagggatcactgtccctgatcaaacccttgacaaggtcatatctgctagacaatctaatgagagtccgcggtctgagcctgaagagccagcatcaacagtaagctcttagttatcatatcctcttctgcttgttgtgaagtctctataagaaacagaaatcggtagaaggagctgaatctgtcttagttatgaaagttttgttcattataagtacaagtcatgtagttccgagtgtagaacagtttttactagtgttgcaccaggtccctccagtctgatacttaattctttagtgttggatctttctatataagaaacgcaaatagcaagacgcagctgaattggtcttactaacaaacgttttgttcacgaaaaagataggaagaaacaaatgaacgatagtaacaaaagttagaaaatcctcatcatattgcataagataggaagaaacaaaataaggatagtaatcttattcaatgagaaaaagagtgagtaaacgaaggaggctaaattaggctttaaaattcgtttgcttcttcagaccctcgaggactcgttttttccatttattatcctcctgcttggttcgctttataaaggcggcaactctcaacatgttttggtcatatcgacgctgttctagaatgggttttcgtttccttttgcctcccggaggttgtttgatttgcattgaatttggaacgtaagggcacaaatgtggcctacactttatgccggctacatgtactcggagatccaattctctaaaatatccagtttttccaatgatgttgactctgtggtgatcaaaaaccatggagactttcttctcctcgtcaatgaagaaactcccatgtatatatgcaatcggcatgtcagccaatggtcctgtatccatttccaagatcttgctccacgacactttatcatactcgatcttagtcgtgatccatatctcaaactcatatggattccagtcgttgtgcgtaagtaaagccgcaagcttctcttctctaacacaagataaagtcacatagtcatcatggccagcgctaaacggtagacgcaaaagtggcccaaatctctcacttgtgaaatcaaaacagattatgtgatcgtcgattttgtttattgcgttactttttgtagcacaaaagtaggtatttcccttgagagaaacaccacgctgataacacgatactatccaatatggagggacatcaagagttgtccataaatcggtttcaatatcgtagatttcataccatgaaaaccggttttcgggtgcgtggttcacggccgaagagatgtaatgatctataaacctcaagactttgtggctacgacaagagttgttcttgttcacgtaccctagagcgtacctgtacatgtccatatcctgttctacgcggtgctgcttctttactaatgtgcagcttcataaagctctgactttgggataaagcgtacaacgttttgcaagttaatttcaatgtcctcatatacttcatgggaagtctagatacaatatcctctatcaaatcccttggaagatttaagatcatcgttgtcgttttctcaagttgcaacaaggtttttttttttttaaccttaaaaaagtgttcttcttttcctctgatttttttcccgcagaagactatacataggaatttgaagttgggcccaatcgtgggcttcagaatcttctcttgttttctttttggtaatcacattcataacatccaagttctttaccaacaatgaccatttgtatggggagagcatcaagtttgtatgaagctgggctaactatgggcttattggaatttaaaacagtatcttaaattccatctttaattgaaacatttgataagtggaagctgccaaaacacgcgtccatctttaattaaaatcaaatgtgaattgttttcatttttgtgacatttaatatttacttctagaaaaagaagatcaagtaaacatgcagttaagttcaaataagattagaattgtgatacccttgaattcgatttagtatgcaatttttttgtatttaaagaaaatatattggagtagacaaagagaggaagatattgtaaattttttgttattttcttttctcaatatatttaaggtaattaatcaggattacgttttattgttggcacatttaatgcctttgcggcactatttgggaaagattaaagattgtttttgggtggattgtaaattacaacctttgagaagaaaacactgttgcgtcttagacacgtgttaactaaagacaaaagaatttggttttgtccagatttttgttgactctttgaccccgatacgtaaaatcaacggcgttgaaatttacacgtgtcaaatattaagtctaattatatgtgtgaaatcttgattggtcggaaagaggaaattgaaaaaaaggcaaataaaagctaaagaggaaagacgaagctacagcttctgaggtcggaaaaaacgaattttgataatttagggttttgcccttttcttctctcttgcgttatcatcggtgttttgattctccggccaagtcccggagacttgtgatctgggggaatttggtgttcaatttcattaagacgcg

SEQ ID NO: 10567 - DNA, 3000 bp, Unknown
  misc_feature (1)..( 3000): cDNA_ID_1031488_gDNA_ID_2213663_Annot_ID_181891 3000 nt of promoter + ATG
gataaagaatggcagataggttcagaatgaaaaaaaaaaaaaaaaaaaaaaaaactccatgtgaacacccttgtgaatttgagaacagggtcttgctttggtttggtctggtcatatttccacacatcgaaaacctttactctcagatctcgaagaaagtttgtacacaaaagcttggtgttttactgagttcctaattttccacttacatttccaaggaagttgacaattttctacatcggacatgtttgggatcagtggtaaattaaatcctaatgatcttaaaatcaacagcttttgttttgggaataagttaaaatttcagggtaataatctattcatctgtatgatcttataagcttgattttatttatcatttataactagagctacactcttgtttatctaatcaaatacaaatctcaaaggtatggtgtatataggaaatattcgaactcaatcctttatttttaggttcaagcacccaaacattgccgtatcaaaccaatacacatgaaaagccaactaaaaatttggtttgtctaaacataacaaatttgaactttcactaattagatgctttgaaaagtgaagtatagatataaacaactcaaaagtgtaggatatataattccactctaaacacttgcatgaccaaaagtttttaagatctagggtcacgaattttggctgcaaaaggaattgaggattttgacaccaaaacaaaggaattaaggatacttcatagaacaaaaagaaaagatactcactagttacgaatgcacagaaaagtaaatataagtaattattattaattcaggtttacttctggttcggtttaaggtttataaagagtagaagtagatgatctctggcgaggtatcatttggaaaaggaaagaaacgaattcgattcagttttagactaatctagttgggttgattaaccagtgctggatcacaatgcaaaggagcttggaatcgatcttctctccagaattccattgtgttagaatgctccaattctgtttggtttaaccaaaccaaagtcgaattgattcggaaactttgttgaattttaatgagcttttcaaattcattctcatgggtcaagtttgttgatcatttgggcttgtgagatgtttgtggagtcctaacgcaagcagagagcccaaaacaaaaccatgattttccatagtggtacagtgaagtttttattttgggccattctgtttctttgatataattttatatttaaaaagtctattttcttctacagaaaaactttgtgttggttggtttttgtttacggatagacatcatttaattttactgtataactttacgaataaagacactgatatattttcacctttatggtaacgaattttatcaaaaaaaagaagaaaaaaaagtaactaattaaatagccggaaaaggttggtatgatttggagatgatattttacgttttttttttaatgtatttttcaaaaaatcaaaattcataaatcatgatgcagtcggacagggtagcttcatcatgttaatttatgacgtgagttggttgagttggtagatctcttaatttcacttctatctctctctctccaataattttatttatacagaaaattacttagtagtataaaaatcaagacaaatgaaaagtcttcttttgatcattcttgagtaattagtggaatgtattctgaattatccatttatgcatcgtaatttgttaagtcaacattttcaagtctcatgtattaacaaacataaggtgtatatgattaattaacaagtagtataattgctcttttaccaatttcatgaaaacatcaaatggtttgtgtaattttatcctagaaaatatcaagcataacccgcatttcaagaaaacaaattaaaatacattttataattacacaccaaccaaattgaacaacactcctactataaaatacatcaagattttcaaaaagtatggtattgaacacgacccattacattgacatcaatggctctaattgttatatacaccttctttttttttttgaatgcttttctctttctttctggatgctttatttatgtaatattccagctttgaaaattcgtaggtagtacgcgttaatgtgataacgttcaaaggggaggcatagttggacagaaaaagtttatccaaaaatatatatttaaccaattgaacttctcgtaattgaacatttagatggcatgagtttgacattgtataaatcttagtgaagtctagtttaaatttatccatccatcagctgatggaaacatttttagttttcaatattaaatattatgtcatgtaaaacccatgacaaaaaaaggagaggatatgattgatgagccgcctaaattcacgtatgttacgttaactatatagcatatagatatttcacatattaaccaagtagttcgaaatggatgggttatacaatatggtttctttggggaccgtccggtcactgcatctcgatttgtgacattggatataaacacaaaactacacaaaaatggagatgaagaacggtaaagattagtttctttggatcgatatacatatacctaatcacttcaaaatttacacgtagattgcagacattgagatcagtaaccgtcaatcaaaaaaattatgtcacatcgaatttcaatggttgaaagataattccattttaggagaacaagcagtagtacaatttctaacatttattacatccaaacaacaaacaagaccaatttttatggtgtatcagttggcagcctctattaatgtctctattttcttaaaatcacaccaacaacgaaaaaaaaaaaaaaaaaaaaacagatacacattacttattgaaccctaaacctattgtcagtgtatatatataacacacactctccatatgctctcatatcatacgtcaatttataaacgtttcttctcattcgtcatctagtcccattctctgtccataaca

SEQ ID NO: 10568 - DNA, 3000 bp, Unknown; identical to SEQ ID NO: 10558
  misc_feature (1)..( 3000): cDNA_ID_3037323_gDNA_ID_2213663_Annot_ID_181885 3000 nt of promoter + ATG

SEQ ID NO: 10569 - DNA, 3000 bp, Unknown; identical to SEQ ID NO: 10557
  misc_feature (1)..( 3000): cDNA_ID_2785827_gDNA_ID_2213663_Annot_ID_181884 3000 nt of promoter + ATG

SEQ ID NO: 10570 - DNA, 3000 bp, Unknown; identical to SEQ ID NO: 10567
  misc_feature (1)..( 3000): cDNA_ID_1031488_gDNA_ID_2213663_Annot_ID_132602 3000 nt of promoter + ATG

SEQ ID NO: 10571 - DNA, 3000 bp, Unknown
  misc_feature (1)..( 3000): cDNA_ID_2715972_gDNA_ID_2213663_Annot_ID_132605 3000 nt of promoter + ATG
atcctccaccgtgacggcgaagcatctttcgaccttattctaatggataaggaaatgcctgagagggatggagtttcggtacttaatgatcttgaatcttaatctgcttaccaaatagacaatttaagtgggtcgatcatcactatacttaaaaacctcctctttaatatagtttttatgttctttgttgatttaatttagacaactaagaagctaagagaaatgaaagtgacgtcaatgatcgttggggtaacgtcagtagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataaggttttctcttgttgaatgagctaatttacttcatatggctcatgcaaatctccatatcagttaactttaaaaaaattatacatagtttcgcgataaattctaaattttaaataactatcacatttactaaaaataaaataatgtatgtatgtaaatatgtaatgtaactggctaatttaattgaataattataatacttacaaaaataatatatatcgcgaatctgactatatttatgttttgtttatcttattcaaaaagatgaaaatataaacactttactagctatatctattttcttttctctatttttcaaaaacataatttacataatatttcatattatttcaattccagtttacgttccatatttttaatgtatatatattttattcttgttcttcgcatatatacgtcatattattttgtccaatactatatgtcattaagaagatagggtactactactgggtacatcatatcttactttggatttgataaggtttgtgtaaataagagtaaattctattttcaacggcgtgtatcatcttagccaaatttgattaagcattgtgtgctatacactcagaaagtacctatactaatgttgcactataaataataattattacaaatttttaatcaagaaactagctatgggtctaaagatcagaacataaaatgtaatttttttttcttctaattttgactttataacacaatttttttggacatctttttatttatttatttagaaacgttaaatttttatttgatatctgttttgaattaaatcagaaaaagaacatcaaacaaaaatttaacgtttctgaatttctttggttgtgaccacatttcttgcagccgtataactcgtgactctaaatcttaaaagctttggttgtgtaagtgtttgaagtggagttatattctacactttaattttgagttgttttgtttgaactctatatctgtacttcacttttcaaagcatctactatgtctctctggaaagttcaaatttgttatatataggcaaaccaattcttcacttggcttttcaggtgtattggtttgattcggaaatgcttgggaggttgaaccgaagaacaaaggattgatgagttcgaatattttctatatataccatagctttttgagattatgatttgtttagataaacaagatcgtgttgtgttatttgtctctgcttctttatttaacatacgtatggcatcgtaacatcttcatatgtttgtaaatacaattattttcacttttgttttgatattactttcgaaaatatatgaaagtgttatctataaactatatcaggaatcagtggttcaacaattaatgatatccaagaaaaacgctgtgtattataatgtggattacgaaagttctgacaaaatttgtgtgaaattttgtatgtccgctttttctgttttctttcttatgcattttcgatcattttatctgaaatgtgttacaattaaactaaatattcctctactacataactcaagctcacattttttttttttgttacttcggcgcaaagtcttcaaacactaattaacaagatttcccgtgtggatgcttagcatttttctccaccctaactaagatggaaaaattactcataccagtaaacgaaactattcgtaaaaactgatttcctttttgtaagtgtagaacaaataatttttttcaccgacaacttccatttttttactatctctaaaattttcaacacgtattccaagtatttccttttattttgagtaatactcttgtttccaaaaataagagttaacatgattagcttatatacttgatcttttgggttcttgttgtgattatatgaatgatgaagacaaagaagaaagaatcgagaggagaaattgggaagaacatgtcgttgatatataagaagaaactaacggtgttggtcgttgacgatgatccatcttgtcgtacactccacatgggaatcattcaaatggctggaggattcccttacatggtgaaaaacggcgagaaataagaagctacgtgacatgaatgtgacgtcaatgatcgtggggatgacgtcacatgaggacgagactagggcattcatggaagctggagttgaccactgcttgtcaaagcccttaacctttggaaagatcgcatccatcattgaccatctcaaaaccgcataatctaccgattaacaaaatattacttggtttagttcggttatgtgactactgatataaatcttgttcaatgcaatttggtctagttcggttctgtctggttcaatccaattaactcacgtgatctgcacatgatcatcgtctacattttaattaaataaaaatctaaatttcaaatcactttatccattccccagtaaaaaaaaagtttcagactttggcaaaaaaaaa

SEQ ID NO: 10572 - DNA, 3000 bp, Unknown; identical to SEQ ID NO: 10566
  misc_feature (1)..( 3000): cDNA_ID_2715966_gDNA_ID_2213663_Annot_ID_132607 3000 nt of promoter + ATG

SEQ ID NO: 10573 - DNA, 3000 bp, Unknown
  misc_feature (1)..( 3000): cDNA_ID_3037308_gDNA_ID_2213663_Annot_ID_132610 3000 nt of promoter + ATG
atgattggctaggtcctgggagtcggattatcatcacaacccaagaccgaggaattttgagggcgcatgggatcgaacatatttacgaggtggattatcccaactatgaagaggcccttcaaatcttttgcatgcatgcttttggtcaaaagtccccatatgatggttttgaggagcttgctcaacaagttacaacactttcgggtagacttcctttgggacttaaggttatgggatcctatttccggggaatgaccaagcaggagtggacaatggcactaccaagggtaaggactcaccttgacggaaaaattgagagcattctaaaactcagttacgatgccttatgtgatgtagataaaagtttgttccttcatctagcttgctctttccacaatgatgataccgagttagtagaacagcagcttggaaagaagttctcggatttgaggcaagggcttcacgtcttagctgagaaatcgcttatacatatggatttaagactgatacgtatgcatgttctgctggcacaacttggtagagaaattgttcgtaaacaatccattcatgagcctggacaacgtcaatttttggttgatgcaacagatattcgtgaagtactcactgatgatacagtaagttttgacatatattttttcttcctttattgttcttatcatttgacaactaaactatataatttcttcagggcagtagaagtgtaataggcatagatttcgacttcaatacgatggagaaagaattagatataagtgagaaagccttccgaggaatgtctaatcttcagttcataagaatttatggtgacctttttagccgtcacggagtatactattttggcggtcgcggtcaccgcgtgtctctggattatgatagtaaattgcacttcccgcgaggtctggactatttacctggaaaacttaggttattacattggcaacaatttccgatgacaagtttgccctctgagtttcatgcggagttccttgttaaactatgcatgccctacagcaagcttgagaagttgtgggaaggaattcaagtaactgtttgttctctttatttacttctctccaactttcatttttttttctttttcgaatggattatttgatgtatacgaacggctttgaaacgctttcacacttctaaacttctagttgtggtttttgtactgcagccgcttagaaatctcgagtggctggatttgacttgttccagaaatctgaaggagcttcctgatctttcaacagccactaatctccaaagactgtccattgagcgttgctcaagtttggtgaagctcccttcctctattggggaagccactaatctcaagaaaataaacttgagagagtgcttatctctggtggaattaccctcctcatttgggaatcttactaatctccaagaattggatcttagagaatgctcaagtctagtggagctcccaacctcgtttgggaatcttgctaatgttgaaagcctggaattttatgaatgctcaagtttggtgaagctcccatcaacttttgggaatcttactaatctcagagtgttgggtcttagagaatgctcaagtatggtggagctcccatcctcgtttgggaatcttactaatctccaagtattgaatcttagaaaatgctcaactctggtggaactcccctcctcatttgtgaatcttactaatctcgaaaatttggatcttagagattgctcaagtctactcccctcctcgtttgggaatgtcacttatctcaagagattgaagttttataaatgctaaagtctggtggagctcccctttttctaatatatatatatatatatccgttggtatagttctctgggattctagttcttcgcatgcggtcttaataatttgttcaacctcttctcatggtatgtgtgatttgaatgttatttttcccattttcttgcatgcagatgattttattgcaaatagaaacgtattttgtagttttcctttgttattgcttgtccgatatttttcgatgcgaaaacattcagtgtagttttcgatggagttaagaagacaactttatcattggtccatccatgtcttaatctattagctgtgaaatttcatgttttgacggagacatagatttaattaatgtatccttgtactttattccttgctaattccttcttagagatagattgctccaaattacttgtcatatagataaaacgattctgattattctcaaatttgtttaatacgaaaatgtataaagaaatgcaacaaatgtatttacattacaattataattactagatgatttttcgtttttttctgattgctaaaagttattctatttatgcgactaagaaatatgtatatgttacttgtatgatagagatccgtttgagcctactcaagacttaaaatcgaactagcatatttcttcctcgtagattttggatgagtctgaagattagtagagcccctcacgaattttccatgaagagataaataacaacaaattaagcttcctctcttgccatcttatcattctagatcgctgaatatttttacgccacacaattttgtgcgaaaaagacttttgcaagttggcttatataatagagatccgtttgactgtttgagtacaagaaagacttaatagagatccctcatttttctgctaagaggacattttatatagactcacgtggtggagccacagagaattagccgcccctcacgaatattcttcccatgtttgcgttgctagtcttcttattctaagtcaatggagttagtgtactaatctaatatatatacaacaaacccttttatctgttttgaataccattgcttcatatagctctctaaaaaagctctttgttcgtctctatatcatacgaataatggattcttattttttccttggcactgttgttgttgttgctcttgcaatctacacgcttttgggaacaatatctttt

SEQ ID NO: 10574 - DNA, 3000 bp, Unknown
  misc_feature (1)..( 3000): cDNA_ID_2994661_gDNA_ID_2213663_Annot_ID_132615 3000 nt of promoter + ATG
atgaggatagaggaataataaagaggtttgtgatcgcctactattccaatgggctttgaatcagaaaattcagaatcgtggaatgtaaaatatataaaacatgttccaaaacttgacaatgtcccaacgaaatcttaataacgcggcacaaaaccgctttaaggacgtatatatatatagaaaagacacattgtgatacttaagaaaaaaaatcatctcaataacacaaaaaagaacataatctaagatttatatcagaaaatgcatgatttataggttttaataattttacatattatataaagagcacaatattctaaatggccacgcggaagcaaaacacttccacgtacacagtagaggggcacattactaaattaaggattatatatgttgttctctctgcatattccacttatattttaaaaatgtgtttttagtagctattccatattgtaatttaattaagattaagaaatggccatgtcttagtgtaagtggtaaaggcatttgatcttctagctcgcatgaaacaatgccaactttgtttgcttaatttcaacttccactctcgcatatgcagccattgctatattcacatacttgaacaataatcacaacaaaaactaattagttgataatttttctttagtagagtttgtgtgtagcttatgtttatgataataacactgtgggtttttaatttctaaagttgaaaaatatgtggtttatgttttgattgtgtgcaagtatacatttgtgtatgcttgtatacattgatcatcaagcaaatttaaatcataatcacttcttctcacgttttaaattttcaggtaattgtggaaacttcggtttcaacacttcaatagtttgtatcatatttcaaaatttaaagaattataccacataattaatggagtaaatttgtttcataattcaacaaaaacaatgaagttacgaggaacctagctagccctctcataacgaacttgattcataaatttaaaattagttcaagaaaagaaattagcaaatgatttgtttcaaacgtatatatttacacgtttttttataacgatatttgcatttcattcaagatttttttttttttttatagtgatcaatttctcttacaaattgtaaaccccaaactaatctaacatgaatatagcaattacatctccttttttggtgcaaaaaataccagttacatcttgttatatatatattattttattttaacatctcatcatcattatcatcttcatcatacatcacatcttgttatatatgtttacattttaaacttacaaaaaaaagttaataaataagagaaactccataaacgttgcgacttgcgactttatttaacatgttatatatttatatatacatgtatataaactgcatacaattaaacctgcatgtgttatgtgttcaaacagaaaaatgaatgccaggatttccaatatttttaaaattttacttttattaggtcttgatatttccgtacaaactcgatcaatctatgtaaattacttgtaaactaaagtcaaatattattggaccactttttggactatatatagctcatgcatatgtttctcatgcaacatcgcttaatccacaaagaaagggaaaacaaaaccgcacgaacaattctatttgaaaaacaaaaagatgaaatatccttttcagtgttttctagctaaaatcattttgctggctttagcatcttcgtttgtctcttgttacgacccatctcctcttcaagactactgtgttgccgtccccgaaaaaaacggaggtaatctctaattattgttttatacgtaaaacaattagtttatacataagaataaccctatattttttatgttatttgatatggaagacgatgttatgatcataaaacttattatataactttcaaattcaagtctacatttcgttctttttttttattttatcgtagttttcgtaaatggagaattctgcaaagatccaaaactagtaacatcagatgatttctttgcttctggccttaacatcccgggaaacaccaacaaacgccttggctcctttgtgaaccccgctaatatccccggtctcaacactcttggggtcggcatcgcccgtattgactttgcccctggtggtctaatcccaccgcacatacatccacgcgcctccgagatcatcttagtcatcaagggaaagctcctagtcggttttgtatcgtcgaacgactacaactacacactcttctccaaaattctttatcccggagatgtgtttgttcatcccatcggattggtacaatttcatgcaaacatagggaagacaaatgcggttgcgattggggcggttgggagccaaaatcctggttatatctcggtaggtgatgcagttttcgggtcgaagcctccgattgacccaaagattttggctaaagcttttgcgttggacatcaatatagtaagatatcttcgaaaagtgttttctcctcaagatgatatcgttaatgattaagaaataagttgatggttatacaacagataaaatatatactaataaagggtaagaaatacagattaaaaatgaatgtgtgggaaataactacgaaagtgtgtgtaatatgtaaatgtaacagtttaatgaataaatatacacaaatcttgtatttaaaatttaggagaacaggacttggggcttataaatacgtttgtgatcctgtttaagaagagtttgaatcagaatcatgaaatgtgaaagattaaacatctcgttttcttgtcacagttcacaacgttttttattactctatcgacttacgatgaatattttaagaaaaataaatatgggccgaataaagacactaatgggcctaattaaatgggcagtatatccaattaagtagtaaacagaaacgtttcgtttcgaatcacacacaaactcacaacgtttctgtgaagctcgccgtcaccgtcgccggaactc

SEQ ID NO: 10575 - DNA, 3000 bp, Unknown; identical to SEQ ID NO: 10563
  misc_feature (1)..( 3000): cDNA_ID_2715934_gDNA_ID_2213663_Annot_ID_132617 3000 nt of promoter + ATG

SEQ ID NO: 10576 - DNA, 3000 bp, Unknown; identical to SEQ ID NO: 10562
  misc_feature (1)..( 3000): cDNA_ID_2715930_gDNA_ID_2213663_Annot_ID_132618 3000 nt of promoter + ATG

SEQ ID NO: 10577 - DNA, 3000 bp, Unknown
  misc_feature (1)..( 3000): cDNA_ID_2715914_gDNA_ID_2213663_Annot_ID_132622 3000 nt of promoter + ATG
gttaaatacaatgtaaaatacatatgcaggggaaaccataatactagatatattagcttatttcgcaaagtcaattcgtagaagtaaatattcgagttcaagtgataggacaaccaagtgatatataataaaatctaccacaacccgagaagctaaaaaaaatcacaagctggttagttcaactcgtcgaggaaaaatcaaatcaagagattaaaactctagtctaggatgatcccacagtcatctccttctacaatcattaaattattactctatcgaaaccacacgctcgcgaatacttatagagtacatgtggaatgagataacgttaccagggagattaggagacttggcttatagaatacttatggaatacatctccctcgcgacttacctgcgcaatgaaaactttttctcgtcttgttcaatagttgtacttcgcacaaaggataatacgatcataaaaagactcataatacgatcttcgatatacccgcgcaacgatggatcacataaacggtcgcatggttggaaaatttagggctcatctctgattgttttattttcttcacaaaggggcaaaaatatatatatacactgtatatatatatggggttttttttatggtcaaatgttattgcccttcgaataagagacctttgattcgtaagaagagattattattttataagagaaggttatgaccgaaaggtttctgaagaaaatgaaaaattacttttaaaaggaattttatctttaaaaggaaacaaaaggaatggttaagttttacatgattggacgcaaaaatggaaaattcttttgattacttcaaaaaaggaaaccctcatttcttattaataatacatcaaataaaaaactaacatgatttttcgcaaaatatccaatttgtgaagaccctaacgctcgaatttgtcatcacttggctcagtctttcaacttttgaaaactgaaactccttttttctcaatactgttagataatagagatatactcgagacgattgagcttcgtcaaatggatacatgcagtattaaaatcagcagttcaaatacaaagaaatttaaatcatcaagtatgaatatgtatgatcatgcttcacgatcgaacagacgaacaccaccagaaactcgacgtcccacacgaacagaagatgaaccaccacagtcttttcccaatcgtaagtgagccatattgtcgcataagttatcacgtaactcgagcatcgcttggtacctttgctgcagctccttcgcgctcaaaccttccgaaggaaagttccaccacattttatctaacttcttttcatttctcgattccttcaacagtttcaacttctctagatccatcgcaagctcctcttcgagcgcctccattttttttacgaggtcgtggagccttcgtttcttataagcttcgacgaggggtctggtatcgtctctctctaatggttcttgtctcgaagggttctttaaccggtcagccactttcttcatagacggatgtgcgaatgtatagggcttcttgggttgagagaaaatcaagaaagccacttcaacgtcacacattgctacgagctcgttcattttcttaaaaattccggttttacgttttgagaacgtaatcatcctatctccatagttctccaccttcttcatctcgatcttttgcttcccctttgtttttcttccctttgcttgcttcgtagatgacatgtttgcagaaaccagaactagtgtttgatttcttgtaggtttgttattttgtatgtaatgataaaaccatgcgcaaaacacaatctatttatagaccaaagaaagagataggattacaaagtttggagacattaaatttaaatcttagttatgaagaaagtgtattgactaatttacaaaaaaaaaaaaaaaatgttgactaaacacatttggcaaccactttaacatcttcattaatcagtcaagaaactattatggtaacccaattggtgtaatagctggtgtaaaggctaattgaccattcaaggaggaatgttcttttaggtaattacgagtttgtgtatcccttacagggaacatacctcagatccaaaattcttttgttacaaaaaaaataggaaaaatttgatataaaagatatctactacaaaatttgtccataatattcttatttttttgtagattagtcatataatttttttaaaaaacttcaaaatccaaatttatcttatttttctatcaaatttcatttaaaaaataaaacttttttgtattagtataagtccgttcatttgattagtcataacttttgctataatattttgtttgacttgaaatcactatcgttggaaagctaattgaaactaatagaattgctataatattccgtttgacttgaaattactaccgttggaaagctagttaaagctaatagaattgaagtcaatatataaacataaaaaaaaaatttaaaaatttaattttaggttaaaataactttaatctattttctctaaaataacaataacttaagggatgcaatttatacttataaatttccaaatttatataacatgaaacacatgaaaaatatttcctctcataggctacagctagctaatataaaataaaatccacgctttttatatgcttaatttaaactctaattattaactctaataaaacctagtttaagtccacgtataatttcaactgatattcaataactaataatttatatatttgttgcaatctctgtaagactatcggttaggttaatcattcaaagatatcttcgtttcataaaacaagaaaaaaacaaaaaaaaacaaattttcaaaaagaaaaaaatctatttgaggagaaaaatagctgtgagagagaaagctaaagaggcgacgtaccacccacctaaccacaaccagatccccaaaagacagagaactttctcgatacgaacgccaaagagaagaagacgaagacgaag

SEQ ID NO: 10578 - DNA, 3000 bp, Unknown
  misc_feature (1)..( 3000): cDNA_ID_2715910_gDNA_ID_2213663_Annot_ID_132623 3000 nt of promoter + ATG
caggcaatcacttgggctccgttggtgattttgacgtcgttgattttcgtctacgtctcgatcttcaccgttatcttcggtagcgctagcttcaatcctaccggaagcgctgccttttatgtcgccggtgtccccggagatactcttttctccttggcgattagattacctgctcaggttttctaaagatccaaacttttttctgaatttttaaacttttttcagcttactgttttgggtttacttggtttctatcaatatttgtgatctgtgatagtttctttcaaatgggtataggcttgtgtttgtctgcgaattagaatctagttttgtctgcgaattagaatctagttttgcatgaatcattgaatccaaagctatgtagtatatgcttttcccgtgatttgtccccacttgtatgccccattttagattagttgagtagaattcgacttttttggtacatatgagtctgatcttctgtttttcgtatattctcacctttgatctgtttagtatagttatactcaggtttgatatttcttggaaagaagaacacacagaatcagattctcttttgtttttgatgtttgtttttttgttgatgtatgtgtttcccacttaatttaaagtaggaaaacgaaaccttatctttctcgtcgatatgtctttgtgttttctttagccttttctagagtttcttgcgtgtccatgtgtttctgtgtactacaataacataaatagatagaaagactgttaaatttggtaacctgatttagcaaggagtaatttgtactctttttgagagttgaatcaagccagatgactttattgcctttggtaggaatagtcttcatgatcccttttttgccactgtttcttgatttcgacgggataatgtttgaaaggagatgtgatatattatatctgttattccaggcaattggtgctgcaggaggtgcattggcgatcatggagttcataccagagaaatacaagcatatgattggaggtccttctcttcaggttgatgtgcacactggagctattgctgaaacgatcttaagttttggtattacctttgcggttttgctaattatcctcaggggtccacggagattgcttgctaagacgttcttgcttgctcttgcaaccatctcatttgttgtcgccggatctaaatacactggaccagccatgaatcctgccattgtaagtatacatttcttgcttgctctttcagatgttctatactaagaagagattgaccccgaataagtcacctgataaattacagaagcaactttatgtttttgggccatatattcacatcattccaacactcttaaacccgagaattatgattgtatcttcaaagatagatgattaatcaatatctctcttgtgtttgcaatgcaggcgtttggatgggcatacatgtacagctcccacaacacatgggaccatatctacgtctactggatcagttctttcgtaggagcattatctgctgcattgcttttccgttctatcttcccgccacctcggccccagaagaagaaacaaaagaaagcctgaggaaaataaaacaattgggagaataccggtcagattcttcaccggtttgggctgtagaaagattcacaaagctgttccattctaaaataaggagaccaacaacaacaaaaagtcaaaagtctccttgtcattgtttagatccacacgcttattttacagatttgtgcgacgtaacttttctcttttatgttcataaatcattcagactctcttccggtttagaaacatttatgattacatggctggtttagtttggtttattatcggttcactctctattctggttctgatttctgacaacaaatcaaaggcaaaagttgtggatttccatccacaaaatttgggaattgggcctcaaaatttctttccaagggtggaagaaatctcaagcgagatctttcgacatttggtagtgttactgcgaaaaggaattgggcctggctaaggcccaactgtatactcttgctgaggcctgaccataaaagaagaagttatttacaaattaaatcagccaaacatgttggaccaggactcaccaactgtatataaagcctaacaacattttctccaaactgtaaatagatcaagactctgctgtgttgcaattttgttcccagtttcggtctacagttaaaaactactgattccctttgccataagagtgatcctaattaaactgattgagtaactcttaaaatggtggtggtgtgttttcagggatgtgaagacaactgatagtggaaatgcttcaagctgcgaagtctgttgtttccaactaagattaagaaaatggttccattctcaaataaggagaacaaaaaaggaataaaaaataatgtctgttacctctatcacactcttctctgctagtttcggtttagtaacgtctagattatcaatgtctggtttagtttggttctttccggtatgttcctaattttggtaggatttgtttggcttggttttatagcaagtatttaattaacattagctcaaattgcccttaatttattgaattttgttaaaaagttttgtctaaactttacactaaaatcagcttttcgtggatgttacccatttctcttccgtaatcgttaaattatgacataacgtctttgttttggtcgtatcgttcacgcaaaacttcacgattcagatctgtgtgtggcagaatttgaatcgaagcataggatcaatccggtaagcagccgtaacttgcaatcgatcgccgatctggatccgttaaaggatccctcgcagtccttgaagatatcggcgtcctccgccaccgggaacaggatccgttaccgttcaccttccgcttctgagctattggagtctggactagccaccggattatccggtaaccattctcctacttccgactctcatcagggacttgtgtctatcgacggaggaaaa

SEQ ID NO: 10579 - DNA, 3000 bp, Unknown
  misc_feature (1)..( 3000): cDNA_ID_2716108_gDNA_ID_2213664_Annot_ID_132624 3000 nt of promoter + ATG
gattacctaaagagcagaatgaacactattgctcccaatctgactgccctggtaggagagcttgttggtgctcgtcttatttcccatggaggtagtttattgaacctctccaagcaacctgggagcacggttcagatactcggagccgaaaaagctctctttagagctcttaagacaaaacacgccacacccaagtacggtttgatttttcacgcatctctggttggtcaagcagcaccaaagcacaagggaaagatctcgcggtctttagctgctaaaactgttcttgctattagggttgatgctcttggtgatagccaagataacactatgggccttgaaaaccgagctaaggtaacaaaattcttcaatagctttcctcttgttggtatctctctgaacaatcttttttcctccttcttaactgatgatgtttctgatatgtgttaaaaactcacagcttgaagcgcggttgagaaatcttgaaggaaaagatttaggtcgtctgtctggttcatctaaaggcaaacctaagattgaagtctataacaaggataaaaagatgggatcaggcggtcttatcactcctgctaaggtcacgatcattctctctgtttttgattcatcatcttttcttctaattttggatgtgtgtacatattgtctttgttcttgggattatgatgaagtgatcttgactgttttttgttatgtgcagacttacaacactgctgcagattctcttcttggggaaacctcagctaaatctgaggagccatcaaagaagaaagataagaaaaagaagaagaaggtagaagaagagaaacccgaagaggaagagccatcagagaaaaagaagaagaagaaagctgaagcagaaactgaagccgtagtagaggttgcaaaggaggagaagaagaagaataagaagaagagaaagcatgaggaagaagaaacaacggagacaccagccaagaagaaggataagaaagagaagaaaaagaagagtaaggactgagggagagaaaccgattttgagaaatctcttgagtgtaagattaataactgtttttgttgaattgcattttatctagaggaataggtgttttaagatgaaacttaaattttctgaaatcgtcattttgaatgatggattcatatttaaatccttttcacccgaactttatttttgttctagccttccagactctagattattaattttggaactcttttttcaatttatagtttgtagttgtacaatattcttcttgcatgatttatatatatctggaagaggaaagaattgaagaaaaataatatattctgaaaaaatcaaatagttttttgctactaaacgtgtctgtagattcaccaaataaaatactctttgattttgttttgattttaaagattttttacaggcgttagtatctttttcatgatcgtatttctctttgttgactatgcatgtttatctttggttattgtctggcaagattttaatcaaattaatgaggtcaataaaattagtatatcgtctacaagaatacatagtagttagcaataatgctgggaatgaatgaataaatagataatatatgtagctttaagtcataaaagaaataaaatggctaattctaaaggacagacgtaaatcattagttccttaagcttttgttccttgtttggtttacaatagagtcttgataaaggagcttctttgattggatagatgaagtaaactctcattacataccatatttcttattttatttgtttttccaattcctattttaatattaaaaaaaactcttagtgtttattttaataataaattccaaaattaggtgggtacataccaaatattctttacatatgctaagtaatatattgtttttgaccaacaaaattatagatcagttttaatattctaatgtcattgagaaaaccacttctttaacaccattggacctcttacacattaaaatctcccccaaactttatagacttatagtactccacaaatttttaaaattgaaaattgtgatagagaaaagagagaagaaatgagtacaaaatggtgctcagaggtttttaagttggtgggggctgaagaagagtagtaactttgagcctttttgaccgtattggtgttgcgtccaaaaacaattacttacacataataataataataacaaagagccaacagatcttcgtctgtttctatttattcctttttcttgtctgattcgcagaaaactaaagagagttctttttcaagtaaaattcgaagagcagttcaacgaatccttcttctccttgagacatttttacccaagttggtctctttcttccttcttaaacaatagtagagttattattggtctacgactctgttgtatatgtgtatgtatcaccttgccttttctccaaagccctaattgatttttctttcttctttttttgtgtatgctttaaaggtttcatttttaaaatcttcttggactccatttcttttccttttcctttatctttttgcctctctttgtggagtttttgaaatcatccctcatttcattcctattttcgttgtctctttgagtttgagtcagctttgtgttgtgtctaaattctaaacaagtttcagatctttaccttcctttgacttgtctcctgtcttaaaactagggtttaattttctttctctgttcaagtctcagatttgaccagcttggtccagaatttcgcttctcctcgatcataaagtaagtaaatttcaccaacccttttctctaagtctcctgttttagtcaaatctgatcttcgatgtgtttctagttggaatcaattttcttgtttgttttctgattttttctgtttcaatttttcatgtatgtgtgtgtgttgcagtcaaagttgattcaaagaggtttgattgagtcagagatctctcttttagaaacatgttgagcaaatgaaggtttgtttgatgagatg

SEQ ID NO: 10580 - DNA, 3000 bp, Unknown
  misc_feature (1)..( 3000): cDNA_ID_2685704_gDNA_ID_2213664_Annot_ID_132625 3000 nt of promoter + ATG
aaatattagaaaaaggtgaaaacttgtggtaatgcattatgttggtgtgttgtcaagataaaatttattgagcggctccatctacttgacagtttttacttgggaaggtgatttcatattaggtattttcatcagaaagaaaaatagagatacttgagttggtagatttttcatgtgagctttttcacaactcctgataccaaagcctttgtagattgctctttttggtttgaaacaaatgataggaacaataatgttatgttgatcgaagccttgaaattgaatatcaccatattcatttattgctctacagattgggatctgtctgctggtgcatttaatcacatggaagtctatagcttttcattgcttgttccttcgaaaagcatatatcttggtttaccttggcctagtgtttacttagcttctcttctttggagcttggattcatgagaagtgggcaccaataaaggtccaagatatttaggtgagatggtgtcgaaagctttactgaatttgtacattaggtttgagctttggaaaacaaaaaaacttagtatctatttttgattgttcggtattaataaacaaatattgtatctaaactccatcatcccactgtggaagcaacatgccgagaagaaaggtcttagaagctctctgtgttgttttcccagactccaaactaaacccgtctagcccgaatcaaaactttggtttctagtttgggatgtctttatcaaaccacagtaaatcgaatcaaaccaaaaaacgcagttccattaatgatcaaactagattaccaccgatgttgaaccaaatttagagaaaaaccggaccgcacttaattctactcggaaataaattgcgactttctttgattcacacaagaagataaacctactatgtctatgccaatggctgtaggattttacatggtctactcacttcgaatgctttaacagttaaacaaaatcgagtagaatatactgttcagtggtggctttctttgatgacgtcgttgggtttcaactttctatggtgttaccatcagcttcagccatctcacgttctttctcttgctcctctgcaattagatgatgaaagtgcatgtgttagttccataataaacaaacaccaacagatcactctattttggacttctatgatttggtatcatactaccaacagattcagtgaaatgttactcacttactcacgaaccacagactaatgtcttaattatcaagcttacatagaagatatcagtatgtagatacagttgccacttacccatgagtttatgcattgccttttgagtccgcctttcgagcttatcaagcttcttctgcacatctcttcggaggtcccagtttggcttctttggagcgatgttaacaaatgggtcctacaatgataacattttttgtaagcttaagaggcacaagtaaaggaaacaacaatgctaaacagagtcgcttttggtgatccttgtacagagaaaagaaaaactgtcacacacacctctttcttctctacagcaggtggaagtgcaacgatcggatcttcgaatttgggtagctctggtggcgctagtttaccatcctgaagctccttagcttggggaacatagtttctaaacttcatggctggaccactgtaaaatcaaagacaattcatatgaataaaaagggaatctacctcgaataatcaatcaacaaaaccaaccacctaagcaaagtatacacaacaatgcaacttgaaattggaaaaaattgttaggtaacagatgctgcaagagcaccattattgattctctcacaaacagtgatagtaaaggcgagaagcaaagcacaagagaagctcctagttatgctaaagccaacacacaacattaacaactccatgtgctagtcaagacaaacaaaataagcaaagaacaaagcaaactcactcttcttcgacagcttcatcctctccgtcttccttggtctcagacagttcctgagctgcccttagagctttaagtgcctctttacgagcagcagctttttgttcaatcgattcatcttcactagccattataacttcctgcaaaattaggttatcgacgtaaacatcgaacactagcccagcttcttcaaacactaatcacacaactacagagtataaccctaaacaacacgcaaaatcgtgattttcaggatccacggaactaatcagatgaagttttagcaaaatcagagctatactatgaaataaagttgaagagaagtatggaaaacgctatctacccagaaaatcaacgagaaaatttgaaaccgtaccttgaagcttcgagctctataaattcgagacaaatttgttgaataccacagagaaacaaagggattaaaaaagaaaaactattaagggggaagagaacaataaaacgcccacgtattaatattataaacgggccagattaaaatatccattcagtcaggcccattaatcttaaaacctaaaccctaactatggaagttatagaaataccccttacaatacgcggcgttttaagaaggctcggctcgtctttaactgctataacaacacactcttaaaaccctaagtgattgtccgtctccgtcttcatcttcttcctctctctcacgcagctgctttgattaactcttcaggtatttaatatctctcatcttctctcttcacggtgtttcacttttccattcttgctggagattgtggagtttcgaatactcatactcggacagagttttaaggctattgtagtttatctctctgttttttcttctcctgtatttcttatgtgatctaaaagtaggattagggtttatatggaatgctgtttctcgctagtttttaatctcaaaacgaacttttagtttaattagtgtgactcggacacgtatctttactgttctgagttaagtgttgtcttaattttctcttcaggtccagcttaagagttttgtgaagatg

SEQ ID NO: 10581 - DNA, 3000 bp, Unknown
  misc_feature (1)..( 3000): cDNA_ID_2716098_gDNA_ID_2213664_Annot_ID_132628 3000 nt of promoter + ATG
tggcgtgtagagaaaagcgaaacacactcaagataatacttcaactggcggctttatgttttaaaccgtctaaacccgaaccagatctcatagtgattaaacagcaagctatcatgtgtttgttttccaagatactcaagtcctaaacttgctagcttctgagaacacttgtcttgtcctaaccgtgaacaaaactttacgttatgtgacacgaagattctcccgtcgtaaggttttaacctgtctactaatctttcgagtccagtccacacgagtttatcaggcatgtggagaaagactgcacttgcgtatatcagatcataggctgtatctgaaccaaacttgctgaattccatatcatcgcctctgactataagaggtcgtttatgtagaagtccttgtgatggaagctcgtacctcaaagcagccattagagaaagctcgtccttttcaaggcagtgaaaatgttggggactaagatagcgaatgaaatgcaaacccacgcgtaacgtgccacatccaatttctagaacacgagagtttggtttaagactggatgattcagctaagaactcgaatacatcgcgcccacctgcccaaggttcaccatagttgctgtgatgctgctcaactagtaactcaccaggacatggaagagctgtgtggttgtttgcttcatctccttcgtaatgggatatacccttgtacctgattttccaacacagagaaagctcaagtcttcagattataaaaacagaacgggaaatgattatttaactactggttaagcaaagtcagtgactattaagaatcaagaaaagagcagaacgtaataggatctcatcaaagagcctacattgatgaaacaattctataacaacaatacaatccacagctaaatctttaagcagcaatcagattacctcacagatatggattcaaaagctgagaacaatgtcactttctaatcacttaaagaggaatgaagccatatagctagtgaatttcacatacatatatcttcaattccatctttttgttccgaaatttagagatggatttagcaataaccaaactttaagcactaagctaacatcaaatggaacctgaagacaattactagccactcaagtttccaacaataaaggagcttgaagctcagacaatagagaggaagtaaaaaaaaaagattttttgagaaggtgattactgtatcagatctgcaagttgttgatctctagtgcgaggattaatccctttacgaagctcattcttctgcatatgcaaaccgttggatctaatcagatctctaacccactcaatatcatcctgcgtcggagatatcctgtcctcaaatctcacatcaccaccgcttccaccgacagaagcttcaacggcgtcggtcggggaagaagataaagcttcaggacaggagcaagaggagaaagaagaagagaggaggaagaagacagcagctacaaaggaaacggtgagaacaagtacaggcatggagacaaagattcctttctgcatcgccggagaagaagaagaggaggaaaacgccattggtgaagacagaaagaggagagatctcagtgtgtctctggtcgcttaaggaaactagtgagtggaaatgagttcgtttaccaattatagtattgtcaatatttagttttactctaatcaaacatggtcattgcacgatcaacggttaaactgtcaaaagttttccttttttttgtcaaccaagtaatccttttttctttctaacaatattagctggaatatgagatgtgttaattagaagaatatatgtgactttaaacaagtgaatgattattactaaaatacaaatgaaaagaaaatgcataaatttttgttaaggattatttgtggttttagcataaatttattaaatctcaatagctaatttttgtgtgaggtcaaaaattatgtcacttatccaataagaaaatacaagaggattttgatataatcttatccaatcccaaacactatttcgattttatttactaaacgcaattttgtcctctatgggctgattttaccaagtctcgctcgagagcctttgagagaagagtttgtgtttcttaaggaaaaaaaaacacttttttttttttgtttcttcttcttcttcgtcttcttcttccaattctccaaacgccatcacgcctttggaaaaaggctgctcttttttgtttgtccttcttgactcttaaattaaattttgctcataatttccaaatttgtgctaaaaactttcgactttctagatcaatccgattcccaaatctcgttattcactcccgcccccaacgagcgattctagggtttctctctgtgtgttttgggttgctgaatcaccttgttactatcatcgatttcatctgaagttgagatttttaaaggtatgttgatgatttcgtacacgactgattccactttttttttgttgttgttattgttcagtttttgttctcctgttagaaattgagcaagtagttgaattaatcgtatatgttcaatggtgatgggtactgtgtatggatcaaaactgaagagtcttcttatagctgactagtgatgatgattttgtaatctatctcaattgagtgtggccttttgattttgatcttcttcttccgactattttccttttgatgagtcaatggaggattttgggagcttatcagctgttattcgatgtggataattgttgattttttttcttccggaatatttgagattctcgtgaagagaaagaatcttactctcagctggatctctatgtctgtcccttaggttcttatcactctactactaccagctttttcttagtagcaatattcggtttggtcttgttatgttttggatgatgatgataactagtctgcttgaagaagagattgcttgtccctcacttgctggttttttcccttttgtggttctcctttcaggctttcagaataatttgaaatg

SEQ ID NO: 10582 - DNA, 3000 bp, Unknown
  misc_feature (1)..( 3000): cDNA_ID_2716094_gDNA_ID_2213664_Annot_ID_132629 3000 nt of promoter + ATG
aggtgagaaacacgaggaaacgcaagtaagtcagagaaaaaataggtaccaaaaggccccaaaataaaccattgctggcatgtacaactaaaaaaaaaaaaacaagttacctgccagttgagtccagaagcagcactctaacattatctgtatgccctctcagcttcatactctttgaaccggttctagggtcccagacacgtaaaacctgcaataaataaaaaaaacttagttttaagaaatcaaaaacccaaaaaaattatccgttgttgttctcaggtatactctctgcaacttgggaatgtacgaataccttttctgttccaccagaaacgagcatcgttccggtatcattcatcgccaaagcatacacagactccttatggcctttcgcaattgttggtgtgtacccatgagatggagatgactgcacagagatattgttgcttgaaccaacagttcttaaacttgtaacaggaccatttgcaccatttgaagaactatcttcattagcgtcattaggtttggtaactggtgacaaagcagcttcaatatcccatataaaaacctccccaccaaggccaccagatgcaacaacattattctaaaagttgtgaaatcaagatagaatcagaatgcgacaatgagaagcacatatatcctcaaaacttgcaccaccataccaatcaatttttttcagtgggaactataaagaaaaaagcatgacaaatgagaaattacattttttgccgcaactgccaaacaagtaacatagtcagaatgctgacggagagtcctcgtacagactccatctgataaaccgtcccatgtctagatacaaaataattaagccgcatttagaaaccaatatggaattacaaaaacaaaacaaagtaaaatattggttcggctagcgaaacaaattcacaaaccttgaccgtagtgtctgaagaacaagaaacaagagtgctctcaccagccagagcagcgtcgttcacctgaccagtcaacatggggtttgaaattattagatgcacaatagaacagcatccacctcaggaaacacaggatcctaatcactgatcatccctatacaattaaatttcagtgtcaagaaaactatatacccagtcaacatgagactcaaatgtagctgagcagaaggtcgcatcctcgtcaaatgcccatctcttgagtgtaccatcacgacttccagtgaagaggtagctttgatcattagaaacagacgacttcaacacatccaagcaatttatgccagcacaatgctgcagcttgcaaataacataagaagaacatcatcaggattgagttgagaaggagatgtcttataacttcaaactatttcaagtcatgtcttaatgtataatacgaaggaactagaaaataaatcaaacaaagagtaacacaactcctgatggcaataaaccatattggtgtaaaaaaactaacctttgtatcgttggcatcatttaacacataagtaagctttttctctttgcgagtgcgaacagaaccgccattactgccggcacttccaacccggtgcatttcaaattattctgaaagcctgaaaggagaaccacaaaagggaaaaaaccagcaagtgagggacaagcaatctcttcttcaagcagactagttatcatcatcatccaaaacataacaagaccaaaccgaatattgctactaagaaaaagctggtagtagtagagtgataagaacctaagggacagacatagagatccagctgagagtaagattctttctcttcacgagaatctcaaatattccggaagaaaaaaaatcaacaattatccacatcgaataacagctgataagctcccaaaatcctccattgactcatcaaaaggaaaatagtcggaagaagaagatcaaaatcaaaaggccacactcaattgagatagattacaaaatcatcatcactagtcagctataagaagactcttcagttttgatccatacacagtacccatcaccattgaacatatacgattaattcaactacttgctcaatttctaacaggagaacaaaaactgaacaataacaacaacaaaaaaaaagtggaatcagtcgtgtacgaaatcatcaacatacctttaaaaatctcaacttcagatgaaatcgatgatagtaacaaggtgattcagcaacccaaaacacacagagagaaaccctagaatcgctcgttgggggcgggagtgaataacgagatttgggaatcggattgatctagaaagtcgaaagtttttagcacaaatttggaaattatgagcaaaatttaatttaagagtcaagaaggacaaacaaaaaagagcagcctttttccaaaggcgtgatggcgtttggagaattggaagaagaagacgaagaagaagaagaaacaaaaaaaaaaaagtgtttttttttccttaagaaacacaaactcttctctcaaaggctctcgagcgagacttggtaaaatcagcccatagaggacaaaattgcgtttagtaaataaaatcgaaatagtgtttgggattggataagattatatcaaaatcctcttgtattttcttattggataagtgacataatttttgacctcacacaaaaattagctattgagatttaataaatttatgctaaaaccacaaataatccttaacaaaaatttatgcattttcttttcatttgtattttagtaataatcattcacttgtttaaagtcacatatattcttctaattaacacatctcatattccagctaatattgttagaaagaaaaaaggattacttggttgacaaaaaaaaggaaaacttttgacagtttaaccgttgatcgtgcaatgaccatgtttgattagagtaaaactaaatattgacaatactataattggtaaacgaactcatttccactcactagtttccttaagcgaccagagacacactgagatctctcctctttctgtcttcacca

SEQ ID NO: 10583 - DNA, 3000 bp, Unknown
  misc_feature (1)..( 3000): cDNA_ID_2716090_gDNA_ID_2213664_Annot_ID_132630 3000 nt of promoter + ATG
ctctcaataagattaacttcatcgctcgcagccatttctgataaatccttttttttttttttgttattttactaatcaaaaacaaaaacccagatcgaattcagtaaaaaggacgagaatttgcaagtcgagaagtgaaagctcgaaactttgatttgggaaatttcttttctgggaaaaggaaaatctcctgcttttaaaaaactagagatcaaaatggggtttaatggttgagtgattaaaaacaaaaaaaaactgggataaacaacaaaaggcttaaaaagaaacaaaaagatatatattccgccaagaggtggaggataaggaatatctgcgtattttagcgtcggtaagagtctggggtaacgtgcgcgcataagtttggacgcgttgagggatgagtagggaggtgtgtgtgtgtgtgtgtgatcactgttgggtcatgggtgggcctcaaaacaaaaattatttaaaaaaaacaaattgttactttaatttttgtaaaaaccttttagtttatataaaaatgatattatttcaaagtgtcactaacaaaaaaagagagaatattttctattaagaaaatctaggaaaaagaaaagaattttgttaaaagatttagtatattcttgatcaatactatgcttattcgagttgaaaaatatagtaacaattattagatttcaacattttgtataaaaataatagtaccaattagtttaattgtgcaaattagatggagtaggctagtctttttcttaattagatcatgtgtcaattttattcgtggaataacttttaaaaactatgggccgggaaaaagcatttaaatttgtgtagagtgttgtctatcattatgtcattgttgataactcttgccaaataacgacaaaaaattagctaagtgtaattatgtcaagtaaattagattggtaattaaaaggggaaaaagcatatgactatttttagtaattataccgatagctttaactttataaaaccagttatctaaaatgttcctaattttgtttctcgttttttttttcttctaattatgagttacgtagaacggtagaatcactctgctaaataactggactgaaagaagtgtgtcaagctagtcaataatcaataaaaccatgtatgcatggtccttaataattgtatcaaatgtatcttaagaatatgcaatactgtacatgcatactaaacaagaattagtgaatgtttagttgagtgagacgattggatgctggaatgtctaatagctgcttttcaacgtgcttcttattgcctactctagctctgtctctctctaagctgtttaattgtgatgagtgtcacgatctcgctcgtgaaatttcatctaaaaagtaatgtcggtaatatataagatgtttaattagaataaagcagtgtcggtaaaacgtttaatgaaatgaaaacagtaaggtaaataatgttgaaaattagtcaactaggaaaaacagtataattgattttttattagaacaataaaaagtaaaacatccaaaaacagtatgtgtacgactgacggactgagacttatatttttctagatgcttttgttaagagtagcatcattgtatcaccatccacatgaccatattcaacacaagcctgtatgtgcatatgtgagtgacgatagacataacctgtatgaaatatataaatatttgaagagttccgagttagatatataggtaacaaaaaggatatggagaggcgtgtggcttgtaaaatactaaaggtttatagcaaaaatatgataaatgaagatttggaagcattagagtttggcggtcaacatctatggacaacagcttgtttctactcaaaatatttattttataaaatagagtaatttagtggcttgtcctattattagggtttaaatttgatcacctcaccagtccctatctcctttaataattctttgtcattttcctctaacctttttatctctttcccctcaatttgttttattcatttatcactatttaacttctttaataattaacttttgtttctttagatcaagtacataaacgagtagatggatcatggatgttacacttatttattacgacgactattcatcatcatcggtctccactattctctcggatttatatgtttttccgattctcatttacatgattttcttttttggtttttttctcctcacattaaacatacgactaatctacaagatcattaatcccaaaaaacaagtcatatcttgaacaaaatcaaacctacaatcacatcctagcgtacatataattatgttacttaatcctcaatataaaatatattacacctaaaattaatattttaaaatataccattcgcttatcctagacattccaagtaacacaatatttatttttaatttctcaaattttgttctcgtctttcaatttctcaattattaccactggatttctaaattttttcacaagaagaatgtttcatactagccacattttgttttcttattgggctccgaccaaaaaaatactattgggcttactatttttcttttaactaaaatataatgggcctattcatcttatgaagccctttaagtgaccatttacgaaaaccaagccccttccatggcatctcgtgattctcatcccttaaacgaaatcgaacggctacaaagtcattagagagtctggtcaaacaaaatcattagagaggaatccaacggttaggagtattttaatccaacggctgtaaatcaattgacgtacatatttgtcccgatatatgttacaaactttttctgagcttcctccctccattttcctattttcagtaaacatcaatcaattaatcatcatctctctctcttattttcaaatttgatttcaaaattgctctgtgttcaccggaaattaaaaagcaaactttcttagtctttctactttctagagctcaaaaactcaactcttacagcaaccagtaatg

SEQ ID NO: 10584 - DNA, 3000 bp, Unknown
  misc_feature (1)..( 3000): cDNA_ID_2716080_gDNA_ID_2213664_Annot_ID_132633 3000 nt of promoter + ATG
gtgtatattgagataaaaacaattttgtttaggtaggttttacccctttccgaccgatgaaatcagaaatcttccccgatgtaatggcgccgagcactgctcccatattcaatatcgatccgaaaaccgaaaactagattccaatagagaaaaaaaaaaaaaaaagattaagcaaaatattgttaaacatgcatctataaacgtagaagacttaatcaatttaatataaacctgggaatatgataaattaagctcttccataatcccaaactgtgttggagcggagtatcccacctattaaaaaacaaacacagattttctcgtatcaaaaagattaatcgtcacaaattcttaggttctcatcatcttttatttccaaagtaataggtgtcgtaaaagaatcttacgcatgttccaaactcgtaggaaccgcaaacggcaatgatcgtgcttagataaaccatccatgatgcttcttctgagacgtcggatccattctccggcagcagcaacggctcggatttgtcgttccttttctccatgtcgtcttttcttgtctccattttcttcgtaaaatgccctttgaattcaacgaatacttatcaatttttatgtagataaaatataggatatatgataagaaacacaagatttggataactcaccggaggaaatgagaaggcaccgtgtttttagatctaaaaactctgatttgttcctaatttattgatatatatcatgtctatatttatctctgtataaatcagtacatgtagctaggctggcttagctaaaacccatgcaggataattttggacgaattagacaatttgaattaatttattcgagattttatgaaagtcccaactcccaatgcattattacacgttgggggttctctatagttttaatgttgattgactaaacttgaattttcttaagtaagataattcagaagtaattacatggtatttcatagtaataatattcactaatactttcctcaaaaaattcacaaatactatgtacattatggatgcattgtgttactgggtaagtaagatgcatggtttgttattttgttttcctttttggtgatggtttatgacatgcacagtaacgtgtaattgactcaaaggtttgacccgataagacagttgttttccacagatccgatgctcatgtgttttttcctggcccaccgcaagatccaagctgtgatggatagtttttttttttttttttttctataaatgtgatggatagttgatactataataatttctaatttgggagacaaaatccaaaaaaaactctagatcatatagtataaaactacagggattcaaaagacagtatttggatttgtagttggccatgagatattcgtttccactccgcattaaccacataagtaatgaattattcttcttctcgtcatatgggctaatatcattcaaattcttgcgaatgtaagatgtatagaaaaaaccgcccactatagaaatcatcaaaatctatgaaaatgattttgtcgcggaagttgaactgagtcattacaatttggacccagcgtcattgagcaaaaacctatttaatcgagggtacagaaagttagcgtagggactattgatagattgatagaacagaacagtacctaacaagatttacataaatgatcgatgtcccctctcttatacaacaatgaagtattgaacaatcacttccaacatgattgtggtccgtggtttaactatccaaaacttatataagagtcacttgaaataatatttgttaatcacaaaaataagaatcataaaaataaataaacggtgcaaagcaataaagccaatgcaggttttaatgcaggctttctgcatcatatacacacagaaaatattctattcacaagaaagaaaatacaaaacagagtactacttgaataaaaacatatagaaaattaaagataattactatcaggtcgcaatatatacaagaatgtcaatatctacaattgattagtaacagtaaatgaaattagtaaaactaaaactacttagattactcaagtttgatcttttataaattccttatcaacaagataaagaaagtagttttttaaaaccttaaaagacctaaattaggaatatgagtttggataacgagaccgacagatgaagcgatttttaaggacccttaaccctttctgccataaatgaatgaagctaagagaatgcctctgagttcaatccaaaaagagaaaatcaaaagcatattgccaaatataggatttagtcattttagagtctaactattagcttaacaaaaaaactactagtagatataccattggtcaacggaaaacaattaaattagtaaatcaaattttaaacacacagacaaaaccttttctttcgggtgtctcgagacgaacaccaacttcaaaacttctttctatttttatttatttttggtttaaatgttaacttctttctatttcctttctatgatcctcttctctatttttaggttttcaggtttctgagaaaatcttaaaagtgtcctaccaacactctttcatggcggtagaccaaagcaaagaagcttctcccgtgtgttgtgctcttccaatgtaatcattcaatcaaatcacttttttctctgtttgttcttatatttgatttgagtttttttttggtagacatgatattaatgtctagaagtttatcttctgttctgttatgattttcattgatacttaacgaacgtttaagcagaattaacgaactttccctgaattttcaccgattttctcttaatttcccgcaaaatttacataagaacgacatgtttagtctgttcttttcttttgaatctcccgaggcaggtacaactctaaatattcaagttatgtcactgaagaagatccaaacgacataaatcatacgtcaaaacataaaagaaccaacgcgtttcttatgaattctgcttcagctcatg

SEQ ID NO: 10585 - DNA, 3000 bp, Unknown
  misc_feature (1)..( 3000): cDNA_ID_3099737_gDNA_ID_2213664_Annot_ID_182044 3000 nt of promoter + ATG
gttgaaactaagatgtagctcttcaagattgagatactgagatacagattcggggatcgagccattgaattcgttttgagcaaagtttagaaacttgagactagacgatgaagacatgtttccaaactctacaggtcccttgagatggtttccctctaagttaaccctttctaacgtgggaattgtgaacaagaacgtagggaaagatccagttagattgttgaaactaagatctaactctatgagattgagatattgggatagagtatcagggattgggccatcaaatttgttttgagaaagaaatagatattgaagcctagtagatggtgaatacatattcctaaactctataggtcccttgaacatgtttccctctaaattagcccaacgtaatgaaggaattgtgaacaaagatttaggcaaagtcccggaaaatgagttttcaccaacattaaaatagtccaagttttggaatccactcatgtcaagtgggagcatggattcgaaggaattattatagaggttgacaacgagcagttttgttaaattggagaatgtaacaggaatattgccactgaatttgttgtgtgaaaagatcaagtattctagttgggttaggtttcctattgaagctggaagttgacctactaacttattatcccaaaggtcaagaattgtgagtcgagaaaggtttcctatagaaggtggaacttgaccaactaaataattatacgaaaggtcaagaagtgtgagacgaaaaaggtttcctaatgaagaaggaatatctccatagagactacaattactaagggttaagttatgaagatgttgaagtttgaaaagaccactatttggtttcaatgagttattaagaggaacatgactaaggttaagtgaaatcacctcgctagatatagcatcgcacgtgacaccctcccaagaacaacaatcaatgctcttgttccatgaacttaacgatacatcataaggaatttggttggattcatttacccgcggaaactcgtgtttgaactccagaagagcattcctttggtcatggcggcaatggcgaagcgtaggagaagcaagagtgtgtagaaagaatgaaaccatgaagaaaaaacagaagcaagattggcttggaatcatcattacttctttttttttttgttaggagtttgtgtggtagtttataggttatcctgatatggcttctttggctctgttcaaaaagcaaaaaaacgaaactcagttgcttaatttgacttgcgcaagtctttccaatgctctctttgactaatgatttggcctcttgccataatatccatcacaaaattgaaaactctcttcttcgttattaatgtcaagttactttgggtttctataggtcatgagtttgtatttgggctttttatttgggccagatagaatcagatgtaaccaagtctatttaatccgctgtcgtttttaaatagtttatctattttttttttataagaaaaaacaaaaatgattaaccctatctaaagttgttaaaaccaaatgttttagcaaatctaaccaaatatttttttctttgggaagctctaaccaaaaatgattatccttggataattactcaattagtaagatcttcaagaaactgatttcccccattattattttatttatatttttcggtttataaaactccagtaatttcaaatataatcctctgctaccgataccagaatccacacaagtgaaactaaaacaatccaacgatgtaaacaacctcacaatccacgtggacgttcaagatcacacatgcactagcttcagatattaagagtgaaacaaaataaaaggaagaaataaatcgaaaaaatggaaaaaagtgacaaatctggaaagctgattggctgaagtcgtccatgtattcaagtttcgcggcaacacctctcttctcatttttctcattccctaattcttctatatctctctctctttctctcacttcctttttttttttgtttttaaacaaataataatctttctttcttcttccttaatttgccttctctctctctaaaacccttgtttcaaatattttctcatcgatctctttttgaaactaaaggctcgagctttctctatctctctttcgaacccaccggtggttcgggtatctctctattcactcttcaagtcacctaattggttagtggatctgcttcgattagggtttttaaaaggcttttcctttttccgtttcaaattttttcttctttcgactctcaaaattttcccggattttttttttggattctttaacactttctgtgttagctctttttcttttgactcgagttccgttttttctcagctgaggtttagtgggtatttttggaagctcactcgattgaagttttttttttttttttgaggaatcagtttcagatttgtagaatctgcgttttatttatatttataggttagcgattgaagtttcgaattcgattttgttttactatctgaaatttaaacaattttctcaacacattttctcaaattttgtcaaagctcctgacttttgtggatgattttcgtgtttcttcactgtgtgtaattgattccttaatttggtgtgttttttaaaatacccaaattctgattttcgttaatatttcctctcatctcgattactgcagctatttatcttccccaacactgctttttactgatccaagaattggttctactcttttgttaaaaaacgtagagttttgatttttcttagctctaatccctaaaccctaaaccctaaaaacgtcttgatttttcccctggtgaaatgttgaaattcgtagtttgtacatgtcttagaggaagccaaatttgcttatcgacttagtgtcgtatcttgtccgtatcagtttaaagtgtgtcttttgtcacaattgcattttttggtttctaactatatatttgaatatacttgtgcagagaaacgtgcaa

SEQ ID NO: 10586 - DNA, 3000 bp, Unknown
  misc_feature (1)..( 3000): cDNA_ID_3037363_gDNA_ID_2213664_Annot_ID_182042 3000 nt of promoter + ATG
aacctctataataattccttcgaatccatgctcccacttgacatgagtggattccaaaacttggactattttaatgttggtgaaaactcattttccgggactttgcctaaatctttgttcacaattccttcattacgttgggctaatttagagggaaacatgttcaagggacctatagagtttaggaatatgtattcaccatctactaggcttcaatatctatttctttctcaaaacaaatttgatggcccaatccctgatactctatcccaatatctcaatctcatagagttagatcttagtttcaacaatctaactggatctttccctacgttcttgttcacaattcccacgttagaaagggttaacttagagggaaaccatctcaagggacctgtagagtttggaaacatgtcttcatcgtctagtctcaagtttctaaactttgctcaaaacgaattcaatggctcgatccccgaatctgtatctcagtatctcaatcttgaagagctacatcttagtttcaacaatttcattggtacaatcccaagatctatatcaaagttagccaaacttgaatatttttgtcttgaagacaataatatggtaggtgaagtaccaagttggctatggagattgacaatggtggcactttctaacaattctttcaacagttttggagaatcatcagaaggtcttgatgaaacacaagttcagtggttggatcttagttcaaattcatttcaaggaccatttcctcattggatatgcaagcttagatcgttggagatcttaattatgtccgataatcgcttcaacggctcaattcctccatgtttaagcagcttcatggtttctcttacagatttaattctacgtaacaacagtttgagtggacctcttcctgatatatttgtcaatgcgacaaagctactatcacttgacgttagtcgcaacaagttggatggagtactaccaaaatctttgatccattgcaaagctatgcaacttttgaatgtgagaagcaacaaaatcaaggacaagtttccttcttggttaggatctctaccgtcattacatgtcctcatcctacgatcaaatgagttttatgggacgttgtatcaaccccatgcatccattgggtttcaaagtttaagagtcattgatgtctcacacaatgacttgattgggacgttaccgtcattctatttttctagttggcgtgaaatgagcagattaacaggagaagatggcgactttagactttctgaggctccatacatgggaaaagttttgaatgctactgcattctttgttgattcaatggaaatcgtgaacaaaggagtagagacggagtttaagcggatcaacgaagaaaacaaagtcataaacttttctggaaacagattttctggaaatatacctgaatccattggattgttgaaagagttacgtcatctcaacttgtcaagtaatgcattcacaggaaatatcccacaatcattggcaaatttgatgaagcttgaggcgttagacttatctctgaatcagttgtctggtcaaattcctcaaggacttggtagtctctcgtttatgtcaacaatgaacttctcttacaactttcttgaaggtccagtgcctaaaagcacacagttccaaggtcaaaactgttctgcattcatggaaaaccccaagctcaatggtctcgaggaaatatgtagagaaactgatcgtgtcccgaatccaaaaccacaagaatcaaaagatttgtctgagccggaagaacatgtgattaactggatagccgcgggaatagcttatggtcctggtgtcgtctgtggattggtaattggacatatattcctttcacacaaacacgagtgttggttcatggaaaagtttcgtcgaaaaaagcccaaagtagtcaccagaattgctcgtccctctaagcattaatttgtgacgtatatgtttgttgactagcgtatattgtttattacaacagcttgtatatttttaacttatattacaacagccagcttgtgtaatcaattgttcaattttttttctttattcaacaaaagaattcatatattgttatatattactgactacagaagctgagagaagaatatgttcttacaagttgggatgtctatgagactagaaccaacaaggatgtctcttgctagttaatttatatgacaaaaggctgaaacatgaacttttaaagatgattccagtcttgattgcaccattaaacgtatcataatccagcgtcaacctcacataagccttcttgtgaacctcacgcaagccttactggttccagtctgatcaatgagttaaagtttcttggtcttatttaacatgtttagaaaatattcaactcacttagtttgattctttgaatcaagttttcagttattagttccaacttgtaaaaatggttgcagaacaaaatgatgaggaagttttttagtatcacataagtccagattcaagtttttttcaattgtatctaaaacacacacaactttcagattgaataaaatctgaatttcattctcagcagaggctaatataaaaatgacaaaagaagaggaggaggataggagctatatgtctactatttttatttttttagccaatgagagagctccacttcataccccacttttaccaatcgagcgatttcacaaccagtctcacccatgtcgcgttgagcgcgtgtctacgatttctaaaggggtttgtccacagaaatcatgccttttttgatccacgcaactcactctcaaaaatccatcgcgtgtcttattttttttggttttcttctctaaaccaaattaaaccgaaccgagatcaatttgaatttcaaaaccaatgtaaacccatcaaacccatcgctgtgaaaacaaaaagctcggccactgtaacaacaaaaatggagacgacacaacttggaagagaaatcaactctaaatagccaagagaatg

SEQ ID NO: 10587 - DNA, 3000 bp, Unknown
  misc_feature (1)..( 3000): cDNA_ID_3099721_gDNA_ID_2213664_Annot_ID_182041 3000 nt of promoter + ATG
ttgaccttagttatgtccttctcaacaactctttgaaaccaactagtggtcttttcaaactccaacaactccagaacctgactctcagtgattgccatctctatggagaggttacttcttcactaggaaacctttctcgtctcacgcatcttgacctttcgagtaatcagctgacaggtgaagttctggcttcggtcagtaagctaaaccaacttagagaccttttactttccgaaaacagttttagtggtaacattcctacttcatttaccaatttaacgaagctttctagtttagacatctctagcaatcagttcacattggaaaatttctctttcatactaccaaatttaaccagcttgtcctccttaaacgttgcctctaatcactttaaatccacgcttccatctgatatgagtggactccacaacttgaaatattttgatgtgcgtgagaattcatttgtcgggacttttcctacatccttattcacgattccttcgttacaaattgtttatttggaaggaaaccagttcatgggacctataaagtttgggaatatatcttcatcttctaggctttgggatctaaaccttgctgataacaaattcgatgggccaatccctgaatatatatctgaaattcacagtctcatagtactagatcttagccacaacaacttagttgggccaatccccacttctatatcaaagttggtcaaccttcagcatcttagtctttcaaacaataccttggaaggcgaagtgccaggttgcttatggggattgatgacagtgacactttcccacaattctttcaacagttttggaaagtcatcatccggagctttggatggagaatcaatgcaggagttggatcttggttcgaattcacttggaggaccttttccccattggatctgcaagcaaaggttcttaaagtacttagacttgtccaacaatctcttcaacggctcaattcctccttgtttgaaaaattccacttattggcttaaagggctagttctgcgtaacaacagcttcagcggatttctcccagacgtatttgtcaatgctagcatgttattatcacttgacgttagctacaaccggttggagggaaaacttccaaaatccctgatcaattgcactggtatggaacttctgaatgtgggaagcaacataatcaaggacacttttccatcctggttggtttctttgccatcattacgtgtcctcatcctcagatctaatgcattctatgggtcgttatattatgaccacatatcttttgggtttcaacatttgagactcattgatatatcacagaatggcttcagtggaactttgtcacctttatatttctccaattggcgtgagatggtgacatctgtcttagaagaaaacggctctaatataggtacagaggattggtacatgggcgagaaagggcccgagttcagccatagtaattcgatgactatgatatataaaggagtagaaacggacttcttgcggatcccatatttcttcagagccattgacttttctggaaacagattttttgggaatatacctgaatccgttggtttgttgaaggaattgcgtcttctcaatttgtcaggtaactcattcacaagcaatatccctcagtcattggcaaatttgacaaatcttgagacattggacctatcccggaatcagctatcaggtcacatccctcgagatcttggtagcctctcttttctgtcgaccatgaatttctcccataaccttctcgaaggtccagttccactaggcactcagtttcaaagccaacattgttctacattcatggacaacctcagactctacggtcttgagaaaatctgtggaaaagctcatgccccgagttctacaccactagaatccgaggaattttcggaaccagaagaacaagtgattaactggatagcagcggcaatagcctacggacctggtgtgttttgtggattagttattggacatatcttctttactgcacacaaacacgagtggttcatggaaaaattccatcgaaacaagcgcagagtagtcaccacaagtgctcgttgaacaccatcacctctcacaatttctctgagtgattgtgaaacgtatatgtttgttatgatatctgtcagttgtgttatgcataaactctttgtctttgtaattttctactttatggtattgtaagaaacggctttggtggtatctgatcttctatatgttgggttgaaaatgcattcagatttttcttcctagtcaaatctcaacttgtcataagaggatgtttcaattgtagagccaaatggaagttcttcttcttctaaatcacagtatgaaattctccaactcgtgttttatttcattctccccaaagtttcttgctccgctcacacgtcaatcttgctgtccctgagtataccaaattcgatttggagattcaagataaaaaataaatatgatttggaccagtgcgggggttgttatgcatctatgcaattgtttttgccattttgatatgggtaatgtgttgtttcggtgaattttacatactaggagcttaagatctactttcataactgatgttgcctgtaatatatttctgtgccattaggaaagtcacaaatttatgttttacttctaaatgtatccataaactgcctgagtttttcatggcttgagtgtgatttttctccatattttgtactagagcgagttcatcgcagagtgctatgccaggagggcttatatatcaggatttactggaagtgctggtaccgctgttgtcaccaaggataaggcagctctatggacagatggccgctattttcttcaggttttgatcattatcgtcctttaaaattatttgattgccatctcatattgaaaggaaatgtggagtttcttatctacattctctgcaattattctatcaaaggcggagaagcaattaaactctagttggattctcatg

SEQ ID NO: 10588 - DNA, 3000 bp, Unknown
  misc_feature (1)..( 3000): cDNA_ID_2716029_gDNA_ID_2213664_Annot_ID_182032 3000 nt of promoter + ATG
ttccctcttggctaataatgtatacaccttaaatggaaaaaatatccggcttttctataaaacctcggggattagaccggtttcggcctaggattaaccccggttatcgacaaaatattaaactattaataacaataaattcaattatctttgccttatccacaaaaccttatcagaaaattctatgcataacctttttgatgtcaatgtatagtgtatagaatcaggagaaacatttaccttgaagaagtgtcgataacagtagcgggaatacggtcagggaagaattcagaaggtaaattggtgtaaggtaacagagaagggatgtttggatggaaagtatttcttgctgcagccataatcaagcttgattttccactgcccttttcaccaaccacaacgattcttatcggttttggcgagccactagaatctcccacacccatccacatcatctgatctttgcaaacaacatcaaatactttcagaataaacagatactgatcatgagactgaacacaatggccaatctcaaattactaaacataaccctgagaactttgagactcaagaatcaagattcaggtattgtaagttgaaaaggatacagcttttctacaacccacaatatgtaattactgaaacagagaaagagagcaaatgatcagagaatcttacagtgtctcagaaacctaagatatcaaaaggcgttaacaaagcttattcttcttattcttctacaactatgtcatgtttttcttctttgttatttcgtctaatgttatatattgattaatttatcattagccatttccagtaaattagccatgtgtctacttagtgaataggttttgttttttaacggtgaaattggcgtttgtggaagagcatcggacgaaggagattgaggatcttgacgtggatacaactggttttcttagtattcttctgtttttaccttttttgggttcaaagcttttaattgcatgcattaatttgaatatccttatcttgcattataataataatatagtttctttgttaatatcccttttaatttatacagacaaaatttaagttacaaataaacacataacaatgggcatcaaatctgaagaacataataacacagtgcattagtagatatgttgttagatttgaattgttattaaatatatataattaagtaacacattcatttatttttaagggtctaatttttatcgcacatttatcaaaatacacctcggcaaaatcttgcagttactagtagacttgattgtatatgaaaaatcaaaaaatgtaattttttagtttgaaatacgaatgacttgcattgtcaaaaaaataaatatgaatggcatgctaacaacggagatgtacataggaatgtattatttgaaaatggcgggacattaaaattatgaataagacacacagacatatcgcaatacaaaaaaaagtattagatcaaagcccattgggccagagtagttcagtttgagagcccactttgttcctcagagtcagagagctgtgtgacggacgggagaatcggaaaagcgcataaactgataaacattaaagaatcggacgatgtccggcgagaataacactatcaccgaaacacagaaagtctctgcttctgtaactgtaagctcatcaaaattttatatttctttgcatgcaacagtgtgcgtttgattcttctgatctgttctctgttgttttatttgtgacggtcgtagtctgttgttccagatcaagaccatgccaccgtcgaattcgccggtaaaaatattaatattttctaatattttcggtttcttagatggattgatagttaaacatgcaggaaagaaacgatttcatttagaattgagtatgttgttgatttagctaagacgacaagaatttgtttgaatttctttaactgactgaccactttatatttctgcagtctttacgttacttgtttcattgtttgtcgatttgatcagctaggggcgataaatttttaagccaagctgttgaagaggcatatattggagttgagtgtggtgatggttatccgtttgggctgttattgttcataagaacgatattgtagtgagctgccacaacatggttttcaaatacaaagatccaacggcacatgcagaagtcatagccattagagaggtagtaatcttcttcaagtaacaaaacaaaaatgacatgtttctaattatggcgaacacacaggcatgcaagaaactgaatgaaattaagctatcggaatgcgagatttacgcatcatgcgagccttgtcccatgtgttttggagccatccatctctcaaggctcaaggtaataagaactttttgtttcttctttctgaaacctcgtcttgattactttgtaaacagagattggtgtacgaggcgaaagtcgaagcagctttagccattgggttcaataggatcttagcagatggtgtgagaggcgttgggtgctaccataactctaacctagagattacaaaactcgatctgagtatcgccgagcaagtgtttcagaatacaaaggggaagttcagtttatcgtaactcgtaagctctttttatcttctttcttttcttcatcagaaatgtatttgcttaaaccctctttatcagttactgttaatgttggcttgtgtttactttcgtccatttagaaattgtatgtatgtatgtaatatactttcttcttgcaatgccatatatatcaactttcttcttgtaattttatcattttatacggtttaaactttaaaccaatgtctgtgtaccaaatagagagagaagcatcaaatctcagcataacggcgatgttaacgccgtcaatattgacgtctttttaaactcccgaggcaaaatcatatgatcgctttacggatttcacctacccaaattgtcttcccagaggcgaggacacacaacctcaatctgttcgtcgctgtcgcagatcggagagatg

SEQ ID NO: 10589 - DNA, 3000 bp, Unknown
  misc_feature (1)..( 3000): cDNA_ID_1029967_gDNA_ID_2213664_Annot_ID_182026 3000 nt of promoter + ATG
caaaattttgagatttactatctgtgtgtcctccatttatgtcaatttcccaaaactatatgaagaattttttaatcagtttggaataatctgacataaaaagttcctaattttaaccatagagtccaaagtcttgaaatttaactcatgagctgtccattcaccaaaaattactcaaaattatgttactttcttgagaagactctgacttctggtttacttgatattccttgatttcaggtgtttactctgtaaaagcagatgtagaacaggggagagttactgttacagggaacattgacccagctcttctggttaagaaacttagcaaatcaggcaaacatgccgagatcttaggcggtggtggaggaggaggcggcggaggtggaaaggggtttcctaatctgaatgggcaatttgcaaatctcaacatgggtggaaacaataagcctaaaggtggaaaagagagtaaccaagtcaagggtaaagctggtggtggcggtggaggaggtcagaatcatggacatggtcagccaatgcaattgaatcctcaacagattcaacagatgatgatgatgaaggctgctcacggtggtggtggtggtggtcagatgaagatgccgcctatggcagctaaggatcagaagaagtcagttaagtttgctgatgatgaagacgatgagtttagtgaagatgattatgatgatgaggatttcagtgaagatgattatgatgatgatgagttcgatgatgatgaagatgatgatgatgagatgggtcatggtcatggacatggaggaggtgggggtaatcacatgcctcctaataagatgatgatgcctaacaagatgatgcctcagatgggtggtcatcatggtaatggtggtggacctaagggtcccaatgagataatgatgatgatgaatgggttcaaaggcggaggcggtggaggaaagaaaggcggtggtggcgggtttgagattccggtgcagatgaagggaatgggtgagggtaaaaatggaaaggatggtaaaaagggtaaaggaggagagaagggtaagaaagaagggaaagagaataaaggtgggggcaaaaccggaaaaacagatgccaaaagtggtggtggtggccttctagggtttttcaaaaagggtaaaagtgggaacggagatgagaagaagagcgctgggaagaaagatggccatgggggtaataaggtcaaatctcatggtgggggaggaggagttcagcattatgatagtgggcctaaaaaaggtggtggtgggaccaaaggaggaggccatgggggccttgacattgatgagctcatgaaacacagcaaaggaggaggaggaggaggtaacaagggcaatcataatcatagcgccaaagggattggtggtggcccaatgggtccaggcggtccgatgggtccaggcggtccgatgggtcaaggtggtccgatgggtatgatgggtccaggtggtccgatgagtatgatgggtccaggcggtcctatgggtccaatgggtggccaaggcggctcttacccagcggttcaaggcttgccaatgagtggaggtggaggatattatccagggccgcctcaggcaagtcagcaaatgaaccaacaacaatatatgcaaatgatgatgaaccaacagcagcaacaacaacaacaacaacaagctgtagctcatggtggctatggcggtggtcacggtggcgacatgtaccatccgatgatgtacgctcggccttatcctgcagttaattatgctcaccctccaccaatgccgcctcctcactcggattcttatactcatatgttcagcgatgagaatccaggtagttgtagtattatgtgatcatcttttgtaatgttatttagaatatggacatgtatgcttgtcttagtcttatgtttttttttttggggatgtccttatcttttttactttggaggattggaaacaaaatgtgctttaattttgttagtggaatgatgtttataatatctcgatttcggaaaaagaatggttattggttattaggttgcagaaaaagtaggatgtatgttatgtagtgtttatcttagtgtgaaaaggatgttgcagccgcctatatagtaggtataacagcattatcatttatgataatcaacttgtatagtgtgccactactgttgtgtgatcacaccatattaaatttgacccataaagtaccaacctggagactcatgtgttgattatgatgtttcgaaagtaaaataatccaaaaaagtgtggagaaaactttgagaactatccattgtgttcgacccagttattttcgaaaggtcaaattagtgtatgattcgagaaatcactacagttgttttcactagtaagttagtaaccgttgtgtctcttatcaaaacttgaattcatattttggccaatatagtacaatattgcagacaatgtttccatttaccactcctttgccaatgggcttttttagagtagcacaagtaatactttggtataatctattgggcctgaaagagtggcatgccttagccttgtaataaactaatcccggtttaatcagtcaatcatattaatatgataccacttactaatacggaaaacttcccttctatgcttaagtcaagtcaaattttatgacaaaaagactccaattcgtaacaagaaaaattatacataaccaatatctcaagagatttattcttaaaccgaaataccggtttacatagtaccgggtgggtgattatacgtgtcttgaccaatcacattacagagactataactaaagagagaaattaatggatacttgaaaagaaaaaaagaaaaaaaaacgctcgtcttcttcttcttcttcttcttatattacttcttcctcccacacagacaaattttgtaacgaagacgggatcgcgataagatcacggtgatcgaaaagccctaagaagtattttcaagggaaagggacttaaag

SEQ ID NO: 10590 - DNA, 3000 bp, Unknown
  misc_feature (1)..( 3000): cDNA_ID_2992756_gDNA_ID_2213664_Annot_ID_182025 3000 nt of promoter + ATG
caccataaatggattgatatatagatattcattttcaaaatacagaatttggaaattgagaggataaaatttttaattactgcagtggatttgtgtagagcactagatgagaacataggttaggtccaacgtctataaagcaaacaaagttcataaaacaacagtttgatttggatactcattggcatgtgcttcaaaaataccccacatcttataatggttccaaaacattcacaattttattgattagtcaaaggtgtatagtagtggcgtactaaaagcaaataaaaatatcatttttatgataaattctatggaaaccgaaccacaaaggaaaagttaaagcctagtttcctcttaaaaataaaataaactgtagaaatattttaggaacatagctatgatactttcagtatgaatattatcttttagggactaacgtgtgtcatttttcttttgtcttcaattagatttaattcaaagatacctatagctgagcttttaaaatctttataaactgagttatacgaggtaaataggacccaacgttacaatttttcttaacgaattaattctaacgttctcttataattataacagcaatgaatttgaagttttgaacaataagaataaagtaattaaagaaataaccaaactgatatgtgacaaaagaaattaaactgacagcaatgttcgtcacgaggttggttttcttgatataagacgaaaaaacaacagagaaagttaataattttatctataaaaaagaagtgtctaaaatacctccgaaaatgattgctcaaaaaccctttaaaacaatgctaatatttatcccatctttttctcttatatatttagctttcgtggttttcttttattttctttggtctagcctttgtttttagctttcgtgttttatttgacttttttcggtcggagaaaaatttgacttcttaaggttccatggaccgacaccatgtacgcggttcaattcgatgacatgtgaatctatgcaagcttagtctgtgtaatttgtaattgtaggttcgtagagtatgtgagattcgaactatgaatagttttttttttttttttttttaaacttaaatcagttgattttagttattttccagatttgtcactttttgtataatcttaccacagatcctacacgtgtattcattctatctacctaacgcttactcacttagtgtggggattattttaatcttagtaactaaactcagtcaaagtcgtataaaatttaaagctgcactatgagaattaaaataacaagcacaaaatatcagtagtctatttattttcttatggaagaaattaatcacttactattatctcagtgaagtggtgcacatgcgtcacatgcattagcaagtaaatcgattttattgctaacatataaacccacaaaatatttcaactatacaattaaatagttcattaataattgatataaatcggaactaattggtggttgaaagctggcccaagaaaactctatctatcctccacagcaaagagtggaagcgacctacctgtcttatgacccattaaaaccccattaacattattgtaccctttcctgcttatatatttcgatttaaattcaattatacgtttgttattgtttaattttctaatcgagttttctaatcgagttttcaaaagatttggtttgatactactagtaaatttaatcgaattatacaattttttaactaattgagctaaccacattatgttgacaatctaacagtttatgtgagactttttagtatatcgatggtgtatgttaagtattatacgtaagatctagatcgcataatttagcattataggagtctttaactaatgtttaaactcactaccttacaatgtttgcgtaagtgatgttgttaaacaaagtccattttggtgacaaagacggtttcttgcttgcgattggatcctaaaccctctcgtcaacgatcattaaaatcattgatcacaaatcataattaatatcatgaaaatttcatattactatcagtgtcatacgtaaattattgtagtgatcgaagtttgcaaggaaatgatatatgcaatgaccaatattacttattagagaaaattcaatgtctaaataattgttagccttaatcaaaatatctggagaattacttaacacgtctgtctattaatatatggatatagacatttgacaaaatgcgaataataaataataaatcttcaataaaaaaaaacacacgagatgataagaacatgacaaacataaattattgaccatattaattaaagttgatttacatataaaccacacattagatatacgaaattaggaataatagcaaaataaaacaaggaaaaaaaacaaaacagcaaagtatttgtagttaaggaaccttaaatattcgaattaatcgtattcgggaagatgaatacataacacagctaagtacaaaagacgaagctgaggctgtacgttaagcttcttctttccctcaactctgtatcagaaaaagaaaaaacataaaaaaaggtacgaaaatttaaaaagaagaaaaagaaaagatttgatattaaaagtgtcaattaaaaaaagatattttgcaaaatcaaagttgggagatttccttgcaagctgtgccaccgccctctctctctctctctctcttagttttttttacagacatagaaataagaaaccctgaaacagagataaaacaaaacacaagttttgagtgtgttttttcaagtctctctcttctctctctgtccttgttaaacacagcaaccgcctttattacacaaaactctcttataataatctctctcaccatttcttctcttctcttcagaagaaagaaagaaactcataaaggagaagaaataagagtttctctgtcttaaactcattcattctttctctctctataaccagagttctgtctgtgaaaacacacaaatctaagagaagtt

SEQ ID NO: 10591 - DNA, 3000 bp, Unknown
  misc_feature (1)..( 3000): cDNA_ID_2716055_gDNA_ID_2213664_Annot_ID_182024 3000 nt of promoter + ATG
taaatattttagtgagtcctcatgttggccgatagccatatatataagagattctgataaaccgttgaaaactttaacccaaaaacaaaaagtcctttctgtgacatcgaagtgaaaacgataataaagaaatctagcatagttttggacccaagaaaacgttttactctctattttgacaccacacaaataaaaaaatatgtcccaaatgttagctaaacataattaactctcgttaaaacaaaaatgtgatggttacgcgtgaaaatggatgatttatgtatttgtgattatatttccaatattttgctagcctactgaaaagtttaacgaaagcaatggataatggaaagattacaaacttttatattcgacataattttaccaattaggcaacgactttcattacacaaaattgcggaaactatacaaaattagccatggataaaaatggaaaataacaaaccgaaacttggctgtaacaaaatctgttagggatgtttcataaaaatatacaccaaactaataaaattcgaaaccaaccaaatgataaaattttgcctatgaccaaaaaaacataaatgacacaatgtgaaaagaaaaacatatttgttgattggaggaaccttcctgttgccacgtggaacttgaagtttgacacaattgctgacaccactgtactacctatctcttctttatgaatcttcaaatgtctttttttacgctataaactcactttcttctcctccaagagccaaataaacacacaaaaaaaaactcaaaatcatgagaagctccgatcatatggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtttagttgacttttcttttctcatctttttcatttgtttttgtttgggattgttgataaatacgcaaatacattttcaattttttaattgaattatccttgttttgtttaaaattctctgtaacgtacatatgaagtcagatcgaaaacggattcacttttgaaaactaatgtataaaaaagcttataacaaaacaacggacaatgatgtgaggtgcgctgtggtgcaggtgggtttctcggtttttcaatattaaaaaagtcgtattcgtggacaaagaatatagctatccgatcccctgataaaatatatgctaatagaatatagttttgtgtttgtcgctaaaaatatgctaactgttcaattatgtgtttggtttataaccagagttttacttcctagtttatacacaatattacatgttctaaaaaacaccgactacgcttcacagaaagaaatccattttgcggatgcattttgagaaaaatctttagtcaaagtactactatttagaattattgcattttccaaaagaaataatataatttcatgcaaaattggttatatatgaaaattattgaccgccactaggtctccagtcaggtcacggatctcatcgtgtatgaattatcatgagtcaatttccatccagaaggattatcccttaaaataaatattagttaagggatatatgtaactctatgcatttatttcgctccgttatattacatgctgtgtaatcacatgtatgatgtaatctatgcatatatgtaactctagatactttagacaattggatgaagactgtcatagtgtgcaaaaatactggttttaatttgttttgtcgtctcgtctcgtctataatcttaagacacgtgttacgttgtatcaaatttacataattaatgggctttaggcttgaacaattaaggcccacaaaagcctgttaatcccatgggaagttgaggacgagaaacagagtccgggaaaagaaaaaagagctctcggagattcaatcactc

SEQ ID NO: 10592 - DNA, 3000 bp, Unknown
  misc_feature (1)..( 3000): cDNA_ID_3037408_gDNA_ID_2213664_Annot_ID_182022 3000 nt of promoter + ATG
tggaaaaatgcctttttttggaaatgaaacagttaagtttatggaaattattcatataatcataaataaaccagttaacatacaactaaatatatatgtaatccataaagaaagtgataatgtaactttctttgttacattgctaaagattcaaagatgacgccgtctcagagtatttaccggtgagaatgtgtagtgcaacaaaccgatttgcagcttcagtgtaatgaatgccgtcccagttaacatatttggaactatcataacaaggtttggcggttatgatcgtaccatttgatcttgctgtcttaccgcaaccaacctgatcatcgtagttcagtggtggtcctccggttccacaacataccattatcgaatgatcaaaacctattaccataccaaaaaaaagtttcaagcactgttaacttgcacataagtaagttttggcattccggttaaaatgccaccactaacacaaaagtaaaaaaatgctttctaatttgagtgaactgaacattattaatacttagttacttaccatatttggaatgattcaggatgaggtcggatttgatagagaagatatctacgtatgtgaaacgggaattgggatattgttgagggagttttttgaaaagaccatgaagctgcaaattgaaaagcttagcagcttggttatggtcactgacacaaccaaactcatcaagctttgatttgtcttccccaaaaattgacacaacttgtgctaaacacccaagtggtcctgtgttgtgtatccaatagtttcttgccccctctgcatataatctctagataaagaattacaaaatgaattaatagtatgatgatatcttatactcaaatcaaattcaaatatttcccccaaaaaatgattatccgtgtaacaattaacaaagtgtcatttatagttttatttaagattgaaaaaaaaacgaggattaagattcatgtaaatactaacctttattccatcttgaaatatatctaagattataggaaccagagcaagaacttgatctactgtcttggtgtaaaatgctccggcaatatcattttgtccgatatcaaacatatacaatccattactaaaaaaatattcggacggtaagtatctttggagctcttcatctgacaaacaaaagagaaaaaaaaaaggtacattggtcagtgactaaatgattcaactaagtctaaaatgttgatgaacttttggtatcatttgctatttagttaccttgttgtatcaattgaaggactttggacttaaaggtgatgaattgagagacttgaacaccaaaaccaaaggggctataggatgcagcatttgccttctgaatcgttgacgcagccgcagcaaaattgcagcctcttcggtaagtttgtcgacttatcgaatctaaataaggcctcaaatatggtcgatcaattgcttccactacaaaaacatatataaagcccactcaaaaacttatcatgtaacgagttttatggttcataagaatctttacacccacaacgaaaattacatgagcgtgaaaatcgcgttatatcaagatcaatcagatcatcttgtaacgttttaaaagtcatgttattaactcgactagtttgttatagttcatgcaatccaacgcttccagtaaaaacaggaaaacatgacaactttgccgttgaacaatttgtaaaataatataaaatcctattattattttgctacaaaaaaagtcatgaaaactgaaaaaatagaggaaagattttaaagaataaaggaattattagaaatgaagaatgattacttagaaaatcgacgataagacgtccattgcagaatcttccggaagttggagatctaaagaaggttatttcataggaaggttgtggaaggaatccaagacccgagctaagttctccggtgtcagagttagagtctccgaagttgaaaaccgccggaaagtcattagaaatccggaaagaaccggcgagaggggacagagtatgagagatggctacgaatagtaataatctaagaagagtgtggaaaagagtttccatggctcaaaacaatataatttcagccttatcatttcttacatactatatatacattatatattatggttttaacaaaaaaataaaataaaagataaaaaaaaatatacatccttatgtggatacaaatgtatgcgtgtatacataatgtaatgaaagtagaatgtgagtttgcttggaaatatagatagaaacaaatgatgaagtcctcctctcgtgacattttttttggttttatattcacggaaaccacatcaattgcactattgtgtcgactttacgatatccgaagataaaaaagctcagtatttgggtattaataattaacggtcgtgagaccccatttatattttgtatactgatggaactaaccttttcttttataattgcatgagatgcgtattttttaggataggcccaataagcctgataggcccaaatagttttttcgaggttctctagtaaaaacatcaatatagctggtaaaatataaaatggaagaaatcagaatctcgccggggctatagcttcaccgtgtcgtgtcctaatctattgtcgggaatttgaagctaaagtaacattacaatgaggaaaccacgaacggcagagatggtgatttccggttatttaaccacgattcgatactagtaaattgatatttctcttacattattttgaaggcttcttattttaatgaaagttattttttttttaaataggtaacacaaagttggcatcttttttttgcttactaaattccaagcaaaatagagaaagaattgatatgcgtgcaagtttctgtccaaattcttgtcttttttggaggtgtggtgttgttttatcgacactccactttacacttcacaagtcacaacacttataacaaaagtgatcacagaggccagagttgagagtttgacaccgtcatca

SEQ ID NO: 10593 - DNA, 3000 bp, Unknown
  misc_feature (1)..( 3000): cDNA_ID_3037338_gDNA_ID_2213664_Annot_ID_182021 3000 nt of promoter + ATG
gaagattgcttcttttacctgcatgttatgccacaataaaaagctatcgtggtaacgtcgttttaacagaacaaaacatagcactacgatcatcagatgcttacctcttcacgcgctggaacattatcgaaagccagagcctttgctgaatcaaacaacctaacccaagattccaacatataaaacaggattgcttagaaaactctgttatttgcttcttggtttctggatataactgttcttaccgatctagatgttcctcaagcttgaatatctttcccttgtaaatccgaagtccttcccatacagagtcaccgccttgaacaaccgagtcaaaaacagaaaccttacaaaaataagaagaaatagaacataatcagtgttcaaaatgcaaatcaacaaacagtgagctgttaagttttcttccacatttcaagcacacctttgccatttcacgaggcaaaatctcgtcaccgacccatgcaagaagttttgcattttcaggaactgggagactaggaggaggcaagggactactcaagagggaggaactgtgcttcacgtggctcctgagaatgttgtaaagcggtagacttcgctccagcaaatcgtaatgcgacaaagggaatgtctgaaggaaaagaacaataccaaacacatcttagactgaattcagaattattaaccacacaagaaacaagagccttacccgaggatacttctttggagatgagaaacccgttgattcgtgaacactcttgtaccaccatggtgcccatactccatcttctggtataggaccagccttccatcttcaagagaacataacaaacaaaagtgaaacttaatgctttgatataaaacaaactttaagtgtctcctaggagaggaccatacttaagcatagaggcttgaaatggaatctccaaatcatcacaaagaccgcgaagtgtagtctgcatggatatggttggaataatatgtaagagaaaaagacatctttgtgaaacttttactgttttaaatattacagaaacaaaacctcgggatctcgctgaagctcatccgcatcgatgactgctggtggtgttcccatctgacagagatcactgtatatcgacactaattcccccaagcctaattcgagaaatgatggagggtgtaccttctcaaaggaaggctgcaaaacgaataaacacagaagaactttagatgaaacattggctaaaaatctgcagagaaccagtctttgatgagaaagctaaccaatatgttaagaggatttcgtattaatatgaaatgctttcctctactcatcagttcacttggcaaaccgaaaagccgctgcttcgagatatgctgttcagagggaaaaacagaacaacacaacaaagaaagtttggtaatatgaactttgaagcgtccaaaacaaacaatcagagaggatttttaccttacaataccggtacttcttagatcctgatccatatatgacatctttcacaactttctctccattgcactcctatttaaattacaagagggaaaattaaactcgtgtactcgaagaaagactaactactgaagtgcaaatcagttacataccatcttggagagaacttcgtctctgtatggcctatcaaaacctgtagctttaagaaatgatgcatacaacggctcgtcgacaacttcagtgtcaagtctctgatatatagatacaacatcaatcacaaagaaaaagaacactaaatcatctccatagtgattcattctttctaggatctcatgttttttttgttcttccaaactttccaagttatttattagataaatcatagtctttactctttggagctaacacgtactcaattttttctcagtggagacaaaacgagcaaagcagaattgagatttggttttggatgatcataatctttagagttaacacttggaaaatttgtcaagaagataggaaaaagttgggtatagtacctgagcaaaggagtacatgaggctggtgctgagagatcttggtgcagaccatgagtgaatcacctccggttctgccattgatgacggtgtcaaactctcaactctggcctctgtgatcacttttgttataagtgttgtgacttgtgaagtgtaaagtggagtgtcgataaaacaacaccacacctccaaaaaagacaagaatttggacagaaacttgcacgcatatcaattctttctctattttgcttggaatttagtaagcaaaaaaaagatgccaactttgtgttacctatttaaaaaaaaaataactttcattaaaataagaagccttcaaaataatgtaagagaaatatcaatttactagtatcgaatcgtggttaaataaccggaaatcaccatctctgccgttcgtggtttcctcattgtaatgttactttagcttcaaattcccgacaatagattaggacacgacacggtgaagctatagccccggcgagattctgatttcttccattttatattttaccagctatattgatgtttttactagagaacctcgaaaaaactatttgggcctatcaggcttattgggcctatcctaaaaaatacgcatctcatgcaattataaaagaaaaggttagttccatcagtatacaaaatataaatggggtctcacgaccgttaattattaatacccaaatactgagcttttttatcttcggatatcgtaaagtcgacacaatagtgcaattgatgtggtttccgtgaatataaaaccaaaaaaaatgtcacgagaggaggacttcatcatttgtttctatctatatttccaagcaaactcacattctactttcattacattatgtatacacgcatacatttgtatccacataaggatgtatatttttttttatcttttattttatttttttgttaaaaccataatatataatgtatatatagtatgtaagaaatgataaggctgaaattatattgttttgagccatg

SEQ ID NO: 10594 - DNA, 3000 bp, Unknown
  misc_feature (1)..( 3000): cDNA_ID_2990920_gDNA_ID_2213664_Annot_ID_182018 3000 nt of promoter + ATG
gctattcaaacattacaaatttacaatatatatggactaattttacagaccaccacaatctcataatcagtaagtcatcacttatcaattactccattaaataattacagattaaattgttatatactgaaattttggtattattattttttttttttgaaagaccaaatgtacattttgggaaaaaaaaaaagaaaaaaaaaatctcggtctttttagacactaccatactcaaaatttaaactacataaatatacatatatatatatatatatatatatattcagtgtgtgatatatacaaataaagtctctaatgattttacaaaaagattttcaagaaacaagtgagatatttttcgattgattaattagtcaaagtaccgtttgtaagaaatatcattagacatgtcactactacgtacgtgctctagaaaagggatatattaggcttaccaaaatatcttacatgtcttgttccataaaaatatggtatatataaaaaaagttgcgtttgaaagaaatcaacaacctataacaagaaaaataataacaataaattttgataaccttcaagtttttagatagtggaaatgtctacgtttcttgtccttctcagtcttgattcctttcagaccattttctaatttcaaagaaatattacgttcatgaccaagcctaaagggttaaaccatatgcttaatattttctatttataaatttgtatatattcttcttaattatggaacgtaaatttattttttcagaagtggtcctgcaagagaagattcatagtggatacaacaaaacctagtttttctactgaattggacccgcttaacgatcatgaaaaaccgcaaaaggaaccaatattacaacgaaatgtgtatgggcggtacagaagaaatggacaatcccatcaacactatgcagtaataaggatagtgtctgatgaagatatcgattgccaattcgttatcatattgtattgacaaaaacttagctactgagaatgattaccaacgagaaaaaaaaaacgtgtgataagacatgggatgggcatccaaattgggtagattaaaatatgagaaggatggggtcttatttactcacttgtccaccatgctttaataattcagtaatcattcatgctaattaaccccaccccatctcccaaacaaatccatgtaattgtcaacgatcgtgacgatacaaaaccatatgacgcaaaataaattatcataaccatcatcattatgttggaaacacgttacactatgctatgcttgactttacttgttattaagtgagttagttaacacaactcccgtttaaaactttatagtcttcgattctcaacaaactcccatttatatagtcttcaccgataatataaacaaaacattaacatatattattcatttataaaccattctttgtttaaaaacagatgtaggtacagttttttcaatattcttttacaaaaaggtacaaatatcctttgttttacagactttaggtatgtataatactttacctcgtattacaaatgaaacgatgattatggttgaacgttagttttttttctttaaaatcagttgaacagtaataaaaaacaatattgagaccattaggtggccaatttctgtttttgtctagcattagttgcttagggtaaaaacaacttgatccacattttttccttaaagtatttccgtcttaattttagaaaataattgaatttgagaatcacctaattaaaatgtttatatacatgttttgtttttaaaataatacgacttttgaaataggatggagaaatttactcaatcttcccgagtcttcctgataattttttatttttggcaaaaatactatactttgattaagacttgcgtatgaccaaaatactatatcaaattgtcaaactttagtgaacaatacccgctaaaatattattaatttattatggcctttgtgaataaattttgttaaatgatttgagtaaaaagaaagtaaaaagagaactgtaaatttatttaacgaacggtagctaagtactccaacggtcattttggtcaaccataaatataaaattttgtaaacaaaattctcacagaggttttagataaaacacccattaaaaattaatttaggctttcttgatttgagtaaaaataatttataacagaactgtaaatttaataaattaaaacagctcgatcgaactgtaaaagatttaaaacagaattgtaaattcgttggtagatgcgcccaacgaatatgtaggtcaattattgaagcccatattttttaatttatttggtaaaacattataaaaacatggtgatgtagtttagtcatatttatgttggcaatatgtaacacgttggactagagttatttggatacgcttcaacggaatatttcctttgattttggtcaatttaattctgagtctggttaatcagttttttgtagaaaaattataaagtttctgtgatttttatcactggtaatgtttattttatgtttgatttttgtcttttatattttataaacacataatcttatctaaatattaatttttctctaacataagaactatttggaacaaaaagaaaagaacgtacaacttgtattgaggacagataatgagctatattcactaggatgcattcaaagttggcattattatcttaatgcaaagcgacaaacgaaactcgaaatgattaaatgataatatttgtttatttaaaataaaataaaaaaacgaaatcgtattctataacaaaccaacttgtggaaatgatgaagtgcttcaaccccacaagtaaactctctctgattctctctttctctctttctctcgctctctatctctctctcctctgtttgttatatcaattaatcaagaagatttcttgtgtttttttttttctgttaaagaagatttcttgggagaaaataaggtggattgaaggattagtctttaggaatg

SEQ ID NO: 10595 - DNA, 3000 bp, Unknown
  misc_feature (1)..( 3000): cDNA_ID_3037413_gDNA_ID_2213664_Annot_ID_182017 3000 nt of promoter + ATG
aagttaggaactaggaaggaatttagtgaaaaggctaattatttacttctgattttacagtgatgaaagtaatgatttgttttgaatttacaggttggaattggtttaatgttgatacaacaattatctggagctagcggtatcacatattattcaaatgccatatttagaaaagctggttaggatattcatagtcttactattattatttatgaatttattttgctttcatataaataatactcgtaggagttatttaatactacctattatttatgttatctgtattttcgtcgtttaaacaggcttttcagagagacttggatcaatgatatttggtgtgttcgtggtgcgtaccttaaactaattgattttttttttacgatattaaatttctcaaagctatttcgattataccattatgattattttttactctttgtagatcccaaaagctttggttggtctgattcttgtggatagatggggaagacgaccactcctattggttagaaaaatacagtttatatatagacataacaatataacagtataataattattaacattatcttgataaacattattctaggcttctgctgttggaatgtccatcggatccttgcttattggagttagcttcacgttacaggttactcttgtagaatttctatattggactaatatgagataactatcaatattacaatcctcgcctcttttttttttggacaaaacaatcctcgtcttataatatgtttttttttttgtttgtttctgagacagcaaatgaatgtgcttcctgaattgatcccaattttcgtcttcgtaaacattctggtaaaatctttcattttctttcaaggatttattcattttttcatgcaaatttttatttttattttaaatttttggtattaacttgttataagaaatcttaaattaaatttggttaggtctacttcggatgttttgcattcggtataggagggctaccttgggtcattatgtctgaggtaaataacatattttaatttatataaatcatatagttagacgttatgaaagaaaaaaaaaagtttactgtgttttttgctgttgttgttgttgttgttgcagatctttccgataaatataaaagtttcagcaggaacaattgtagcattaacatcatggactagtgggtggttcgtgagttacgctttcaactttatgtttgaatggagcgcacaaggtctttattttctctattacttttttattaatttggataaaacaatttaccaaaaaaagttaagagttatctttataaaaatacacaaatcaaacataaagttatttaaaaatcgtgttcgaattttgacatttgtatcaaacagttttagatgtgcaaaatgtgcggtcggaaaatatctcttagattcacgttttcttcaaatacttttagcttttgttttcttgtttagattggatgattgagtttttgtttatttattttttatttttaggtatatattgttaaatatacttttaaattcaagtaggtcatttacatattgtttatggtatatataataattaaataggaacattttacatatttgcggctgtcggaggaatgtcattcatttttatttggatgctcgtaccggaaaccaaaggacaatcattggaagaattacaagcttcgcttacggggacatcctaaatgcacatttatattgtaatatactattaattttgtttggtaaaaagataaaatttattttctgttgtcagtcgcattgcaaataataaatgtattttgtaacattatttgcatattgatattaataatattttacatttttttccttcgcaaatcagtggtttatttatcctagtttaagacaacaaatgaaggatagagcaacgatcagacgtatcggacaagtcaagcatgccaaacgatttcaaaacaaagctagcataatcataaaaggatatataatcaaactgatacaagtttgaattagcatcgaaagagatgtcgatgaaaacatacgactttgacatagtcaccttacattgtgacttttaccataatccaaaacctcaattctcattgagataagcttcgtcataacttccggtcttgtaaagacctttacacaaaattgtagaacagtacttaggatgatgaaatattcttcgaaattgaatccggaatgatacctctcatggagaaggagtttgaaggaagagttctctcctccaaagaagaggaagtgtacattgatcattcattgtcttgacaagaggaaaattggacaaacttctcacaaaaaccggaagttggacaaactaacccaaaagctaatgtatatgtcaaagaatttgaaaagcttgtttacctaatcggtttttgggtaatatttgaaccgaaccgatatccatgattcaaaaaagaatcccactcgattattttacttttgtaattaaactgatcgctctttagagtatttggtttgggtaatatgtgtagagtatagatatgtaaaggctaggactgtcatttaatctctcttgtaatctatattgtacttaacctatctaatagaatcattcagttccctattctacaatatgctcagaattaatggaaactcacatttaaattatgtgtagttttaaatttttggcactgaggattttgtcatatctggctaagtacattatgatggtttattcttatgattcaaatatttttataattgttaggaaaaaaagatctagagcaaggccactggccacttgtgcaagtcaataagtgcttgaaccccacgtgtaaactctgtttttctctatctattttctctctctattttatctatcttgtcctctcctctgtttataatcagcaagatttctttttgtttattagaagatttttggaaaattaatatataaagagaggagaaattaagcgtaagagtggtggcgggggaaaataaaagcatg

SEQ ID NO: 10596 - DNA, 3000 bp, Unknown
  misc_feature (1)..( 3000): cDNA_ID_3037421_gDNA_ID_2213664_Annot_ID_182015 3000 nt of promoter + ATG
ctgaaattgtcagttgcaatttcgatgtcagatattgagaagttttggagagatgattggaaatcgtagatatcgtgaaggaccatgccattcatgtttggatctgcacttttgttttgtttgatgatcggtggggcggcgccacttaatggaggaaaggaagagaggcgtttcatggatctgcgtttccatagcttgaagaattttccccaattagaagatgctctgtgattcttgcactgtacgtctgtgtctgcatctgcattgtcgatagcttctctgtttggaggaggatcgtcagatgaagatgaagcggaagagattgagcaacgagttaagcaggcttcgagggctcctcttggtgatttggggtcttgcttctctttatctacctctagtaatcttagatctgggaggagaagggagagaaaacgttggaagaagctaggttttttggtgtacaagcaatgaataagaatacagaggacaagagaaaacagagcaaacatagaaacagaggaaacagaggagctaggttttaccatgagctgaagcagaattcataagaaacgcgttggttcttttatgttttgacgtatgatttatgtcgtttggatcttcttcagtgacataacttgaatatttagagttgtacctgcctcgggagattcaaaagaaaagaacagactaaacatgtcgttcttatgtaaattttgcgggaaattaagagaaaatcggtgaaaattcagggaaagttcgttaattctgcttaaacgttcgttaagtatcaatgaaaatcataacagaacagaagataaacttctagacattaatatcatgtctaccaaaaaaaaactcaaatcaaatataagaacaaacagagaaaaaagtgatttgattgaatgattacattggaagagcacaacacacgggagaagcttctttgctttggtctaccgccatgaaagagtgttggtaggacacttttaagattttctcagaaacctgaaaacctaaaaatagagaagaggatcatagaaaggaaatagaaagaagttaacatttaaaccaaaaataaataaaaatagaaagaagttttgaagttggtgttcgtctcgagacacccgaaagaaaaggttttgtctgtgtgtttaaaatttgatttactaatttaattgttttccgttgaccaatggtatatctactagtagtttttttgttaagctaatagttagactctaaaatgactaaatcctatatttggcaatatgcttttgattttctctttttggattgaactcagaggcattctcttagcttcattcatttatggcagaaagggttaagggtccttaaaaatcgcttcatctgtcggtctcgttatccaaactcatattcctaatttaggtcttttaaggttttaaaaaactactttctttatcttgttgataaggaatttataaaagatcaaacttgagtaatctaagtagttttagttttactaatttcatttactgttactaatcaattgtagatattgacattcttgtatatattgcgacctgatagtaattatctttaattttctatatgtttttattcaagtagtactctgttttgtattttctttcttgtgaatagaatattttctgtgtgtatatgatgcagaaagcctgcattaaaacctgcattggctttattgctttgcaccgtttatttatttttatgattcttatttttgtgattaacaaatattatttcaagtgactcttatataagttttggatagttaaaccacggaccacaatcatgttggaagtgattgttcaatacttcattgttgtataagagaggggacatcgatcatttatgtaaatcttgttaggtactgttctgttctatcaatctatcaatagtccctacgctaactttctgtaccctcgattaaataggtttttgctcaatgacgctgggtccaaattgtaatgactcagttcaacttccgcgacaaaatcattttcatagattttgatgatttctatagtgggcggttttttctatacatcttacattcgcaagaatttgaatgatattagcccatatgacgagaagaagaataattcattacttatgtggttaatgcggagtggaaacgaatatctcatggccaactacaaatccaaatactgtcttttgaatccctgtagttttatactatatgatctagagttttttttggattttgtctcccaaattagaaattattatagtatcaactatccatcacatttatagaaaaaaaaaaaaaaaaaaactatccatcacagcttggatcttgcggtgggccaggaaaaaacacatgagcatcggatctgtggaaaacaactgtcttatcgggtcaaacctttgagtcaattacacgttactgtgcatgtcataaaccatcaccaaaaaggaaaacaaaataacaaaccatgcatcttacttacccagtaacacaatgcatccataatgtacatagtatttgtgaattttttgaggaaagtattagtgaatattattactatgaaataccatgtaattacttctgaattatcttacttaagaaaattcaagtttagtcaatcaacattaaaactatagagaacccccaacgtgtaataatgcattgggagttgggactttcataaaatctcgaataaattaattcaaattgtctaattcgtccaaaattatcctgcatgggttttagctaagccagcctagctacatgtactgatttatacagagataaatatagacatgatatatatcaataaattaggaacaaatcagagtttttagatctaaaaacacggtgccttctcatttcctccggtgagttatccaaatcttgtgtttcttatcatatatcctatattttatctacataaaaattgataagtattcgttgaattcaaagggcattttacgaagaaaatggagacaagaaaagacgac

SEQ ID NO: 10597 - DNA, 3000 bp, Unknown; identical to SEQ ID NO: 10582
  misc_feature (1)..( 3000): cDNA_ID_2716094_gDNA_ID_2213664_Annot_ID_182010 3000 nt of promoter + ATG

SEQ ID NO: 10598 - DNA, 3000 bp, Unknown; identical to SEQ ID NO: 10581
  misc_feature (1)..( 3000): cDNA_ID_3037433_gDNA_ID_2213664_Annot_ID_182009 3000 nt of promoter + ATG

SEQ ID NO: 10599 - DNA, 3000 bp, Unknown; identical to SEQ ID NO: 10580
  misc_feature (1)..( 3000): cDNA_ID_2685704_gDNA_ID_2213664_Annot_ID_182006 3000 nt of promoter + ATG

SEQ ID NO: 10600 - DNA, 3000 bp, Unknown; identical to SEQ ID NO: 10596
  misc_feature (1)..( 3000): cDNA_ID_2716076_gDNA_ID_2213664_Annot_ID_132634 3000 nt of promoter + ATG

SEQ ID NO: 10601 - DNA, 3000 bp, Unknown; identical to SEQ ID NO: 10594
  misc_feature (1)..( 3000): cDNA_ID_2716072_gDNA_ID_2213664_Annot_ID_132635 3000 nt of promoter + ATG

SEQ ID NO: 10602 - DNA, 3000 bp, Unknown; identical to SEQ ID NO: 10593
  misc_feature (1)..( 3000): cDNA_ID_3037338_gDNA_ID_2213664_Annot_ID_132637 3000 nt of promoter + ATG

SEQ ID NO: 10603 - DNA, 3000 bp, Unknown; identical to SEQ ID NO: 10592
  misc_feature (1)..( 3000): cDNA_ID_2716061_gDNA_ID_2213664_Annot_ID_132638 3000 nt of promoter + ATG

SEQ ID NO: 10604 - DNA, 3000 bp, Unknown; identical to SEQ ID NO: 10591
  misc_feature (1)..( 3000): cDNA_ID_2716055_gDNA_ID_2213664_Annot_ID_132640 3000 nt of promoter + ATG

SEQ ID NO: 10605 - DNA, 3000 bp, Unknown; identical to SEQ ID NO: 10590
  misc_feature (1)..( 3000): cDNA_ID_2716051_gDNA_ID_2213664_Annot_ID_132641 3000 nt of promoter + ATG

SEQ ID NO: 10606 - DNA, 3000 bp, Unknown; identical to SEQ ID NO: 10589
  misc_feature (1)..( 3000): cDNA_ID_1029967_gDNA_ID_2213664_Annot_ID_132642 3000 nt of promoter + ATG

SEQ ID NO: 10607 - DNA, 3000 bp, Unknown
  misc_feature (1)..( 3000): cDNA_ID_2716033_gDNA_ID_2213664_Annot_ID_132647 3000 nt of promoter + ATG
atggttatccgtttgggctgttattgttcataagaacgatattgtagtgagctgccacaacatggttttcaaatacaaagatccaacggcacatgcagaagtcatagccattagagaggtagtaatcttcttcaagtaacaaaacaaaaatgacatgtttctaattatggcgaacacacaggcatgcaagaaactgaatgaaattaagctatcggaatgcgagatttacgcatcatgcgagccttgtcccatgtgttttggagccatccatctctcaaggctcaaggtaataagaactttttgtttcttctttctgaaacctcgtcttgattactttgtaaacagagattggtgtacgaggcgaaagtcgaagcagctttagccattgggttcaataggatcttagcagatggtgtgagaggcgttgggtgctaccataactctaacctagagattacaaaactcgatctgagtatcgccgagcaagtgtttcagaatacaaaggggaagttcagtttatcgtaactcgtaagctctttttatcttctttcttttcttcatcagaaatgtatttgcttaaaccctctttatcagttactgttaatgttggcttgtgtttactttcgtccatttagaaattgtatgtatgtatgtaatatactttcttcttgcaatgccatatatatcaactttcttcttgtaattttatcattttatacggtttaaactttaaaccaatgtctgtgtaccaaatagagagagaagcatcaaatctcagcataacggcgatgttaacgccgtcaatattgacgtctttttaaactcccgaggcaaaatcatatgatcgctttacggatttcacctacccaaattgtcttcccagaggcgaggacacacaacctcaatctgttcgtcgctgtcgcagatcggagagatgggtgtcgatttggaatcggtgtcggaagcaacctcgggagctattgggtcgcttctgagtacaacgatcttgtatcctcttgatacatgtaaatcaaagttccaagccgaggttcgagctcgtggtcagcaaaaatacaggtttctttatcctttgatttgggtgcatcggtttctatagatagtgtcggtctcctctcgtgttttttttgtaatggtttttttttttgggtgatatttgcagatatctttccgatgttatgtgggaggcaatttctaaaggacaagtcttttcactgtatcaaggccttggaactaagaattttcagtctttcatttctcagttcatctacttttatagctatagctatttcaagagagttcatagtgaaaggactggttctaaatcaattggaactaaggctaatttgctcattgctgctgctgctggggcttgtacttctgtcttaattcaggtacgtttaccttgatgatctctgagattagctatgttatgttttggagttcttgttaaacaattgaagtcttggtgttggaatgaaaagttgaggtctagtttgctacataatgtgctatgatcgtcttgttgcagtatcgatgaattaaagcactgagtcttatctttgtgtagcctctagatacagcttcatcaaggatgcaaactagtgagtttggagaatcaaaagggttgtggaagaccttaacagagggttcatgggcagacgcatttgatggcctagggatctctcttttattgacttcaaatcctgcaattcaggtacatttctcatgtaaagccatgagctatcgactcgagtagctcacttcaatgtcacttgacaacatgactggctgaaatagttggttactctttgcagtatacagtgtttgatcagctgaaacagcaccttcttaagcagaaaaatgcaaaagccgagaatggttcttctccggtagtgctctctgcctttatggcgtttgtcttaggtgcggtctccaaaagtgttgccaccgtgctcacatatccagcaatcaggtattttacctgttggacaaagattactagtattcttgatttcaccctagtgaactttctggctcagatgaacttctcaagtcacataattttaagactttggctgagtcagacatcatattgggctcaattttgcaggtgcaaggtgatgattcaagctgcggatgagtcgaaggaaaacgaaacaaagaagccgagaagaagaacaaggaaaacaattccaggggttgtgtatgccatatggagaaaagaaggaatgttagggttctttaagggcttgcaggctcaaatcttgaagactgtcttgagctcagcattgctattgatgatcaaggagaaaatcacagcaacgacatggattctcattctagctatccgtagaaccctgtttctcacaaacacaaagggtaagttaagaagtccttagagactcccaccaccaagcttatttcacgtccttgtaagttgtattagatgatgaatgatctacatcagttatgtaaaattggttgtagccggattgtgttctaggtgggttattgtgtgtagttggggtgtaataaaagtaagaatctttgtgtagaagaatcaaagaaaatgatgtaatatgaacgtttcttaagaaactcaaatttataacattattgtatggattgttgagcttcattagtttttgatcattgtgagatatctcccaaatctttggaatcttcaactttaagcgtaacaataattagctggataaattttgcatatcaatttgttgttgtgtatcttttttgcaaacgttgaattttaacatattaccctattttaaaaataaaataagagaaaaataaaaaaataaaaacacatagtgggccgatgcttctaaatgaaaaagaaaaaagaaggttttgccatattggttcccgtcaaatctcattggaccggagtagtatagatttcttcaaggccaatatcgtttcttcagagagaatcgaacggaagatcggaacaagatgatg

SEQ ID NO: 10608 - DNA, 3000 bp, Unknown; identical to SEQ ID NO: 10588
  misc_feature (1)..( 3000): cDNA_ID_2716029_gDNA_ID_2213664_Annot_ID_132648 3000 nt of promoter + ATG

SEQ ID NO: 10609 - DNA, 3000 bp, Unknown; identical to SEQ ID NO: 10587
  misc_feature (1)..( 3000): cDNA_ID_3099721_gDNA_ID_2213664_Annot_ID_132654 3000 nt of promoter + ATG

SEQ ID NO: 10610 - DNA, 3000 bp, Unknown
  misc_feature (1)..( 3000): cDNA_ID_2716178_gDNA_ID_2213665_Annot_ID_132657 3000 nt of promoter + ATG
ttaaaaaggattatgtgttttatggagttatagaagaatatatggctttgactaaaaagaagaagaaattgagcttctttttgttattttccactttggttagttcttaattgcaacgtagaagccttgccctccccaagtttcgcaagtcttcaacaaaaatgttccgcaagtcttcgctattacacgtggcgttgctttcatgtcttgcccgtgactgtcctgttactctagtggtcagagaaagtttctttttcagttgtattttgactattcagattttggtggtaagttgagaaacgagaacttttagcggaataagcattatatgattaaaaaaactctataatcaaagaagaataattgtcttgtagagtttgctaatcctcttctccaagcaaggtgcaaagtctcctctgcatactaggcttagttcaatacatctttcaatctagttaggcccattagcccgttatgtttacaaagttaaaagcccacttacttgagaaaattcacagatgcacacatgcattagattatgtactgcaatctgaaaatgcatgatgagaggtctcatacacaaaacaaaatcaaaaacaatttagaaaaatattagagtaacttataaagactgttacagctgaaactaaaatactaataaattcgacttctggcaataattaaggattacatctcttttgtttagagtataattgaacttttggagctgtaatataatttgtatgtatgatttatgaaaagtgattgaacttatacatagatggaaaagttggcgtaacaacatgcatgatacatacagaacacatgcagccacagcatttgaatagaacacatcatcacaattcccaaacataatcattctcttcagcaaaaagacacactctttccaaatataattgtcacttttactgttttaaattttaagttatgccagctttaaagttgccgacgacaaaagcatgtccatcgtttctttcttcttcggaagattaatcagaggatttaaaataatctaaattcgagattatgttgtataaatatccattttgaaacttgaatgaacaaaaaaccgataaagttttccacgaataagttgttggtgtttttagtaggttcatagataggagggtggaaggtctctagttgggcaataaattgaaaccgcttttttctgacctaccaaatattaatttgatcgaatcattgaaaaaaatacatatataaaattatccatataaaaactatgtagtttgctttaaaatatttcatcgtatgcaatgatatatgcatacttaatccaccacatgtcccttgaaacaaaagcacttaagctctgtgtggttgacattaaatcacacatttcattttgttaaaattaaagtctaaaattttattcatggtagtacatccatcatcaaagaccattttcattgaacaaaataaagtttcaatctctaatcctttgtgaaaattcttactactatatattaattaggtcttttggaatatagacgcgcaacacacattttcttatatatggattgaatggtatccaaatccccaaggtaatgtaatgtaaaaccaagataaagaaaacgagtatgacattgacaattgaacttgtagcgaagtcaggataggacgacttgcggtttctactttctaagccaaagaaacatagttttcattgatttttagtgtttttaaatttgttgttgacttccattaatggaatatttcgtactttgcttcttcttttcgaattttatttacctatataactttgctttattttctacaacacaataagtattgctcataattgaggaagtctatacacacaatattttcctatcctttctttttttctgtcgggaatttcttcatatcctagcatctagattatgattgtacacatacaaaaacagaaaagaactagacttcaaaataatgcaaattagaaacaaaaaattgctccaaaaaaaatatattcaaaactataaataaaatattattatgatttttcttctattttacgtacattgtatatctctagagaagaaaataatttttaaaaaatagtttgggatcaacgtcgcacttattgttttgtcttacaatctcagagtctcaccgtatccaccacgctggtcaacaacttcaacaaaactctcttcctcgaacttcaatcttatcccttcatttcattaccattaattcacaccaacggctaacattgtcctcctcgctaaactgttaattatacgtttggccgtaatgttttgaagtctgcctatatttcttttcaataaatgctcttttaattaggttttaatttggtgaaatccaacctttaaattttctgatgctgttaaatctaagagtttgaattttctaaaatcattgttgtcggttatcatttgtacatcttgatagaactataatatgatcaatataaacttataataataataactgaaaatacaaatgattttgtttgtttgtttataaaaccactgaaaaatgcaagagttaatccactgagttcaaccaaaaaataaagaagtgaattctattagtcataagcttggaccaaaaaatccatctagaagaaaaaaaaaattgaaaaaaaattacaagtttctaagaagatggtgcaatggttagaaaaatctctcaagttattaaatgcatcataaactaatactgtatattactatacacaaaaatcaaagactcccttttttttaattgaatcaaacaaaatccgaaatttcgaaaggtccgacttttcctcacctgaacccgcgttttctctccccctcccaacccaactctccaattcgccggaaaatcaccgccaccgtcacttccggcgtccatatgaactaaagagataagcttttttcttctataatccttcttcttcttcttccttgatctcctttctctgagtttgctgagtttcttaactcagcc

SEQ ID NO: 10611 - DNA, 3000 bp, Unknown
  misc_feature (1)..( 3000): cDNA_ID_2716174_gDNA_ID_2213665_Annot_ID_132658 3000 nt of promoter + ATG
tccacagaaaacatctaggtgtctgcagtgaggctttggctgcaacaaggcctagaggtgattcaaaggttcgtgaaatggagatagagcgcgacttactaaccaggtcaactgtttgttttgtgctttgtacacttacaagatgcatgtttagaaacttccagatatgtgtactgatattatttgcaaatactactgtagtcccaaagacgatcttgagttttctattgtccgagagaatataagagaaaaacttaaagtaagttcaatatttttactcatcaacctcaattcctggcttcaagtagaagaacatttatttagcagaatctttgtgaatgctaaaacatatttatcttgaatgtcttttttatatataaccttctgattttatttttcttgtaatcctctcttctgctttgcagaccatatgtgacagggtagtagttaaaccccataaatcagtgagaaagcttgcaagagtacagcatctatattctcaattggcaggacagctaaaaagagaagatgatgaggttacatgacatttcttacatgattttaacctctcatgatcatctaaatcacttgacttgttctgcaggttatctaaaatagacagatatgagtttcctttaacttataatctgttgtagtctcatactacagtcctctttccattgagtgaaaaaagctacgttttctctcttacctcaaaatatgtttgtctatgtttcagtttaacatcttaactgctttgcatccgacgccagctgtttgcggatgtccagtagaagaagctaggcttttgattaaacaaattggtataacataatttgattccgatgcttttcaaattttctttcactgtcttttcggaaaaaagaatttctctgtagaagtagctatctactaatatatgcttataccgagatacatattcttcttctttttccagagtcatttgatagaggaatgtatgctggacctattgggttctttggtggtggggagagtgaattttctgtaggcatacgatctgctttagtcgaaaaggtgacaactccccttagtgtagcaaacgggtcattcactgttaaatacagtgcatttatcttggtccttttgtgtctcccagggtcttggagcattgatctatgcaggaacaggaatcgtttcaggaagcaatccttcctcggagtggaacgagcttgagcttaagatctctcaggtgaaaaagtcttcaagaatgttgttaaacactctcactgcaatttccatgtcttttatgaaatctcaaatcagattgatatgtgttttctgcagttcactaagtcacttgaacatgagtcagctttgcaaccaatcaactaaagaaaggcgggaattgagattgtttaataactaaattggtttgtatcatttgtgtgtttggtcattggtgtgtatattgtaaatagaagcaacactaatgatgatgctgcatggtacactttaaatcttcttttagctacttgttgtccaatttctgaccagactagaagcctttgaagcgactatgactctatgaggtccatcaaatgaaacacttacgcacgttgtgatccaaagctgacgtatatttccaccttcacgaaaaaatgacaaattatttaggaatattatgtgacaataacaaaacataataattaaggctccaaaaacaaatctttattactacttattaacgaacgaacgtaattagattaccgatagtgtgctaatggggtttcagaaaagtgatgggtggtttcttttggactaatccaatcaaaagggatttgatttttttgggttatatcatttaggaaaagatacttttttgttcccttgataatcaaaactgtcttctccatcactcatattctcttctaattgttctcacaatcatatctcactataaaattgaaatgctttatttctgtagcaataatttcaaagacaactttctatttattatgaaattaatataaatattcttttacccatcacttgaaaaagaagaagcaaatgtacatcttttttagataagacttttagttaacatatactcttgttctccaaattaaatcgtaattcggtgggtttctatttttgatagtatagaaaatttcgaaataaatgtctaattcattcattcattacttatatagatatattttaaaaaacctagaaatgtacatgaactataatcggtaaaataaaaaagaatatggatattagttgaccgccaataatacaatttacccctcttgagggtcatatttatcaaaacgaatcaacatgatttttgaatgcaatggtcgtctccttatttctcttttgcatgcttaaatgtttcttttacataattaaagttttgagaagaaaaaaagtaacggtagcgagaagattccttttgcatttttgaaagtttattgcattcaactaaaaagccaattgtcaacattacagaaatatgttcgtattggcacaatatatgattcttaaacaactcttcttagctttcttcttcttcttttatcattttttcatattgtttaagaatacctactagatgaaaagtaaaaggatagattcgttgtcgatattacagatattaaagatgaactcttgactgctacttaatgtttaaataacgagttaagaatattacataagtcatggcaacaaataaactaataagttatccgaacgttagtgtgttagttgacaaatcaaaacaatgaagtgaggaataccaactccagtcctctcctttcgataaagccgactctttttactcaaatctatattctaatccaacacttttgttttggtataatctccaaatagcttttttggtctcataatgagatccttctcacttcccactaatatatatatacacacacacatatactaacacattacacacacttagagaaagcagagcagagcatagagaaaaacataacaatg

SEQ ID NO: 10612 - DNA, 3000 bp, Unknown
  misc_feature (1)..( 3000): cDNA_ID_2716170_gDNA_ID_2213665_Annot_ID_132659 3000 nt of promoter + ATG
cctatacctttagccacagcaacctaaattcatccttaatgtacaaacaaatttctgaatagtagttgacctctgatttggtcacaggtcaccaaaaagagaaagaaattagaaatgaatgtttcctttctagataatacatgtttcatgtgaatcatttggattttctgacaagaagatatagaagattcccccacttctttgtgttcattaatccgacactcagttttgtttaaagtctcaaacaattgaatttttcttcgttcagtttacttttctgataatataacctttaaatcgtcggaaaaagaaaaaattaaccaactaaagaagaagaaaaacttttttaaaaaaacgaaaagagaaaaagaagacgaaaaacaaacttatgagtaacgtcaatgattagtggttgtgatcgaaacatcacaagccataccattaacacgatatactcgtgtttcaacaacacgatatacttgggttttcgtgttgaatgtcgtgtttcttccagctcacttgtttctttaacacaatattgtcttgttaacaaaaataaatcaaatcttctcttaactttatctttttttaaactggcaaacaaaaattcaaaatgaaatattgaacaaacctatacgaatctacgatacgcaattaataacatctccgtcaaatgttggtcatagacgtactctttctttttgctctgtatatagtaaagtagatgacaaagacaacagaactattaaaaaggaaaaaaagcagtgcaggctcatacgaattcagatacgaaacgcctctgtaacgtaaatgattaatttgatatggacgtatcgttacctccccacacgtggcctgaaggggattgatttgttatcaattgttttgtttgaccatcaaagcttcgacatttattgttattttcaatagttaatataacttgacttttaaaggtttatagaaactgaatatgtaaaagtttgtaagagacagatatttgtttaagaatatataagaagagtctaactctcttccaaatctcaagggtttttcttttcactaatctctagagtttggagcagattaattccacatttccactactaagtggctaagtgctaacagaaaatatattatttacaaagataggacaattttaccttaattgttacgagacgattagttttttatttatttatcccgagcatattttataccgtatatgtcgatctattttattaaataaagattagggtttaaatttagattttatggtttgttaaaaataataatatagatttatggtttagtttaattttgctgaacatccattagataaattaaaagctattttgattcattcatttgataaacgtctatttaaatgtccatagaaatctatgatacatggctaactgtgtttaacctaattaatcagatgtgccattatattaacgaagaacatgatctaaatgttaagaacggtattctataactacatatgatttgcccgctaaggctattttggtaacgaaatggtggtgtactgtagaggcgcaacgttcgaatggtacatgaacatgggacaagaatgctaaattttagataaatatttgaaaaattagtctgagattcgtttcatgatagatcctgattaccaaataaaatcttcattttgttaattattaaacaatcacacagtcgatattaaattacattacaaatctatctatatatacatttttgcagccattttagcaaataaatcttagagttgaacttatttacaatccaatgccattagcattaaatctttttttcaaaataattaattttactttaaattcttaatttaaattgtcaattacattatcaataaaatttaatccagacaaacttcacatcaatcccttaaaattagcataaacgtattttgttaacaatattttaaaataaagttttttgtttaaataaatattgttcttactaaacgttttttgtttaaataaacaaatcatgtatttgaacttatttacaatgtcatgctactgacattaattatttaggcatgaaaatatttaattaaagatttaaatcttctaaattcttgcttttagagttattatatcattatttaaagaggcaaaaaatattaattttttaaatattattatatatatatttaaacttcataaaacattattaatatttaaatttataaaaagtttattatatcaaaaaaattaacatcattatataacatatagagtttaaaaaatctcaaaacaatttcgtcctattttgtgattcgaaattttaagaatgaacatatattaaccaataggcgaaaaatgtgtgggttcaatgtcccgtaacgactaaaatattttgacaatgattcataaagatattataaataagatcaatattaataaaataaatagtttttattgtagacgggtttggcaggacgttacttagtaacaattgcaaactataaaataatttacaaatttttatatatattaattgttaaaaatgagttgtcgggttaaaatctagttatagaccgaatttcttgagcagttttcatgaaactcaaaacgaaatttaacataatgtgggaccaatttcaggatcacatctatatatatgtatatatattcaggcaagacatatcgtacaagttgaagtctcagtgccatacaataatatcaacatcttcgtagtctctctaatggcgtcgcttcagtgttcattccattttctgggcacaaaccctaaaaaatacaatcccagttcgatcttccaaagctactctcgaacctcattcaccaaattatcctctcgtgtctctcgccaggttttttttttttcgttttttgttttcaatcattttcaggtttcagcaaaaccactctgtttttctttgtcttttacgtcacagtatttgaaaccctctttgtgaaacagaggttcctacgctgtacactgtctatg

SEQ ID NO: 10613 - DNA, 3000 bp, Unknown
  misc_feature (1)..( 3000): cDNA_ID_2716166_gDNA_ID_2213665_Annot_ID_132660 3000 nt of promoter + ATG
aatatacccctgtattctcttacttattacggtgttatcggattttgggcatcgacgaatttagctgaattttttttttttctggccttttttttttcttttgctaattgtagaaaatgtttctaaacaattttaagagaaaagttaaagtagttaagacatgatgtgctataataaaacaccaagtcaacaagctgactatttattctaaaatgtcaatggcatatacataactctacgcaaccagcaaaaggccttagatcgtggtccatttaaatatgtacttgttaatatcaaattatcaatcacatgtgatatgtccatgataattcatcaaatatatcatgatatatggtcaattagtttctagtttaaaactcatataacgtaagattatgttggtaaatttaattacaactctagtgttatatttatgattaacacatatatcatatattactagtttgatgccaagtctacgtaccaagtaccattcatttggcaaaaaaaaaaaaaaagacttagttaaacaaagagacaaactgcgctaaacctaaataaaatatacaacttgaaattgattaaactttcctatggaattttgtttgtagggaagccacaaaaaatttaaaaattgtaagctgattgattagatatgaccatttattttgtgttctagatttatagttttgctcatacatcatggcatatatttgagtggtttgtgtaaatatttattacgttttgcactcaccaataattaaatctgcagaaatataaatcttcaacaaaaattgaccttttattaattataaagatattttatttgtgtaatgtcaccaatgtatgactttaagttcatatattggagtgctcgtttttgtaaacgcatgtatatcatagctggagtcatatatatttttcttggtaattagtattttcgatctatagtcaaggtcttttctaaccgctgattaataatatcaaaattccactgctccacaatacattaattatattgtataccaaactttattctgcgtttagattcagatccagtagtagataaaataataattccgatccaatacaattcatttgatgctttaattagaacgatcgatggagcaactaaaaccgaatttggtcattctttgccatttgaaaaacaaccagtcgtctcatttgttgttaataagttaacattgatacgtacgtcggtacgcgagtggcaaaacaaacacatcagctctaagacgaaacacgtttggttttccaaaaaaaaaacgatgtattgataagctatattgacttaaaaggtaatatagtaacagctatcgaaaaatactacgaataaattagctaaattataatattaattatattagactatttaaattagcaagaaatctcttggaatgatctttctattacctattttggttcattctcttgttaattaaccatagtaatccatttgcggattggcctgtatctagacatttgttctgtcgctaccactagaagtttatcattttgaaaatgaaaagataagagagataaaattgtaacgatgtgatcaagaaatttcaacgttgttctttagcagcaacgttggccggtgggtccataatttcggctccaaaccttataacagtgtttgttgttgagacatagctattttattataacattaagcgttgaagttcaatatttcttttccaattagtcgacactatcgatccacgaacaatattcttctttcttttttccgaataaatcggatgcacaatggttgtttttattatgtacgtgtgttggtattagtttaaagggcagaaaaaccaattaatagtatattataatatcccattcatatttggtcgtatacattgttatttttaacttatttgttttgttcaattggattggctgttgacctttcaagatttcattgttgcgtgcttgtttttctcatggtttgaaacattgctgcataaaatgagtaaatagaataattgtacaaccacttggttcaatgtttttacattttatagtctacaaaaactctttataaactagtatttaatttctgattttggaatttcaacctaccgtaaaacaaaacagcgagactatctaattacaagactataattgaattttaaatcttaatttaatattatatgtgcactatatgtttcattctatttaagatagatatttggtaattttgtaaattatagaaatatgtcatgttctctgaacattattaatataggagacttgcatgtttttgtgaattgtttaattggcatagtcaaaggatgtataggttgcatatatagaaatcaacagttcccaagagaaaacatgagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaaggtatcataaatttccttttgtatagttttcaaatatttagacgtcatttataaatcgcataaatcaatccttggaattacatacatgtatctttcataatcttatcacatagatggtttgttttatccaaaatccatttttattaattgattgattagtcttaatcaatgaatcttaatttgaattctaaaatcatactaaattagatcttcaaatctcttgtcagtttcataattttctgtctttgcggaggtttttacgaagaatttgctcatctatatatcacaagtacaataattatgagaaagaaagaaaaaaatatgtattggatttttgaggcatgcatatataatttgaggaaagatcaaccaaacgatagatatttgtatatttgttaagcatatcgtgattaaccatatcttataaacgtatgatgagatcagttggactcaactaaagtcgaaatg

SEQ ID NO: 10614 - DNA, 3000 bp, Unknown
  misc_feature (1)..( 3000): cDNA_ID_2716163_gDNA_ID_2213665_Annot_ID_132662 3000 nt of promoter + ATG
cgtagcgaatcaggacaaggtcgactcgcaatccgattatccaatccctcttagccacgatggtatctttgcgaatctgaaaccaaagctagaaaaccctaatcttggtacccttgtcaatccaatttccgggtggggaatctctgaaagtgatgttgaagtcatcgatttgggtaaaaagttttcatctaagctgaaaaggaagcttaaggatactaacgggtttgtcaaagatgagtttgtcaagatgttaaagcagtttcttgagaaaattggtgagaaagttgggatttcagaggctgagtctgagatggttttgggagatcaagctggttctgagatacagatactggtggagaaaaatgggtttttgatgggtagagatgtatctggtttagtgttgaaaggttgtattagtctagagatgtgggagctagtggaaattttgatttcaaactccttggttgatcattcttcatactcttatttagttagcaatcttgttgagaagcaaaggtcagatttgctttgcgtagtgatcaaagaagcttcagatcttggggcaactgagctactttcaatcttgaagtattttttatgcccatcaaaggaagcaattagcactatggctaaggtaagagaagaatgggagagtcaggctatgttggctattgaaaaggtgagcaacacagagctatcaaagaagtctaaagttgcagaagaggcttctatcttgttaatggttgctcatgacgggttttcaacctcagagctttgcctgcattacttgttagcttcacggaatgttgacgaagtcatgtttgcatctgcagtcagtaagttgaatggcaatgagatgggtagctttattcgatacctctctaaatggatgaagaagtatgagatgttcccacaagctggtccatgccctaaagccgcctccaagcttggtttgaaactatgcaactgggttcctgaactcacagacattaccaaatgtttgggacttcttatcgatgagaacttctccactctggttctgtactcggatttgcatgaagagctaaagtctattgcaagagtagccgatgggttagcttcagaatcaaaactttcctgttttgtggctaatgtggttgaaagtttgaagcttggagctgcccgaaactagattttcacaattgttggagcttaatgcaaccctgttttcactttttattatggtctccagtgacatttgtattttctagtttcagttcatctcttaactaaagtataattttgttcgctatctttgagagtttgtctccaacctctgcacattgccaatctcatttaggatgcaccacatggtttaaaattgttttcttttccaagaattctttatcagttacaacaggaagagtaaaaggtttatctttgcaatacaacagcttactttgttgaagaatgagcacaagttgttgctcaacgaagtgtctcacagagccggataataaaaaccgttcctttatgaacactcacgagaccttgccgcaaaatcaaacggctaatgtatcatcaccacgaaagtgaggtactctcgctgaggttgaagaagaagaaggggcaagaatgtaattacatccagaaatgcttcatagttacgcagctgagttattacacttgttcacaaagtaagctgcagtctggggactacccaactcctaactttcttcaccttcttaaattacctatctgtcaattatcatcatttcccaattgtgttgatacttaattggtagtagcaattttttccattaaagttttcatttttttggttttttgttgatggaaaaagtattgatccaacggctgtagaagaacggtgcaacaagattttgaattcggagatgcgtttgttttagttttaaaatagaaataaataaagttgttctctctctctcttcgtggacactggaactaacaccaccgatgcactacactctgtagagactgcaaatggaaagcatcttttggtaatcacgggtactgttgtcttcgtcttagtttttgtcggaaatcagacattagatccgaccagattctctatttggagacagacattactcggatctttatttcattttgtatgattctttattgtagattttgagatcaggtagtgtggatttgagatcaggtacatttacttgcaaggtgagttccagatctggttttggttatttcatttctggagttttatacgtttttgcaattttggagattttgttgattttagattaggatgatcattgcattttctttctctttcttgtttgatttcattggttaatgattgtggattactactatttaatctttttataaaaaaatccaaatccttagctcatgtacttataaaagaatgattttatgtttgatagtgatctatacatagttataaacaaatggctgatccattgaacttagtatgatgaatcctgttacaaagagcttatgtatctctttaatgtctaaaagctctagatagaaccaaaatatgaaaattgcaatctttagtaatgaaagtgttgtgttatagtcttgtgttattgcttgaccataatattttgtgattgttcggactaatgcaggtgttttgaattttggttgtggacataatgggaaagcctgcaaggtggttaaaaagtgtactacttggaaagaaaccatctaaatctagtggttctaaagataaggaggtaacacacttccgcacaatgttgtatgataaaacaaatgaatttcaagcttgcatagttaaatttctcaggttgattacagtagtggttctcgtagaggaccttgactgcttgacatctcttttactagttttttcactttagacattgcaaatttcccactaattttgtgtcgtctactattgtctatggtgtcactttctgatttcatttccctttgttgtctgtttctaattgttcctgacaacaattctct

SEQ ID NO: 10615 - DNA, 331 bp, Unknown
  misc_feature (1)..( 331): cDNA_ID_3037448_gDNA_ID_2213665_Annot_ID_182082 3000 nt of promoter + ATG
ttctggtgagctgaatttgtgtgttccgaccgaaaaatcaggaagaagaagaagaagattgacaaacaaaaaggattcacctttagtgactgagtgagagaaagagattgaaggaaaaaaaaaaaaaagggtgaagctttggagagaggataaccacgtagaggattctaatccgtggttgcaaacgaaggacccagaagtgaacacgatactctccctcccttcccttgttcaatttctttctttgttctcatcattaaatttctttgacccaaagtttcaatctttttcagtttctggaatctcttgcttcgatcgaatcactctcatg

SEQ ID NO: 10616 - DNA, 3000 bp, Unknown
  misc_feature (1)..( 3000): cDNA_ID_2716116_gDNA_ID_2213665_Annot_ID_182080 3000 nt of promoter + ATG
cgcccaatcctggatgatacttctctatcatctcttcatacctgtcaaccaaaccttcccaaaacccgtgcaagtagtattgattctccacataaaccttctctatccatttttccttctgcgaaagcaagagatatatcaacgccgattgatcatcggcctcaaatgctggcctgcctttcagataagctgtcagtatcttcccagtttcgtcacggatcttcccttttggtcccattggggcccaagcatctaataaatccaatgaccactgacaatttctcaacagaaagatacccgtgttcaatgcaacccatgatttttggttgaacagcaagtctggataaccgtgtatcaccagattatgattttcgtaccgaggcaacgggatctcaaacagtatatcagtgaacaaagcatcactatccatccaccaaatccattctacttctggatgagacagcattaatgtcctaatcataggtaatttcgtccaataccctgagagttcctcatccaaattcgccatgttatacacaatctctatcccgtggagtctacagtaatcaatcttgttcttcacagctttcaatagataatagtttccaattggtttatcacagggtccgggggaagaccctgtgagaagcaatattcgagctttgccattgacaatattaggaaactcagggttctgattcagccataccttgcgttgactatcccagttggtgattttgggccctagagtatatgtcgcattgggactaatatcagctttaggcggctcaagcaagtctgtcaaatgcgaatcagatgggatctccgcgattctggggcctagagtatacgttgcattgggactaatatcagctttaggcagctcaaccaagtccgttgaatgcacatcagatgggatctccgcgattcttggctctagagtatacgttgcattgggactaacatcagctttaggaggctcagccaagtccgtcgaatgcgaatcagaggggatctccgcgagaatcggaatggtttccttgatgaaactctgattaacagagtcggcgttggagcttccaaggttcccaacacggattgtgccaagtaggatgagaatggtcacgaagcagcagagaatcatgaacttgatgttgttaaataaggtattctggatctgccaaccgcgcaaaaacccacgggttctccatccaccatttgatacagccgttgtcgacagtcctctgccacttcctgaggatcttgacccatcctgaaacatttcacttgttgcctcctgtctctagatttcactcacaggggagagacctccagatggcacttgaatccagacacggtctaacttataactataatcggtgaagactgtctttttgttactcacagaatgtgtagatcccacactctctccctctctgaactacaccgctctgaaacttcagatttttggcaggatcctgatggaagactagtagatgatggacttggacaatctgaagagcctcttttaaaaatcattaaagaatattaaattggataatggagaaacctggttgtaattaaatatatttgatgcggagcaatatgttttatatgcatgccaacattaagcatcttattaaatgaaaaataaaaacctttcgcatcttcaacatatgaatattcatgccagattgcttggatattttgccagagaggtatcaaaagcatgatgcttgatatctctacaaacttaagtgactctatgcttacatatcaaagaagagccaaccatgtatacgcaactgtaaacaatctactcagaggcttattatacctatatcagccttggtttggaaatgaaatgcatagtcttacaacgtaaaatggcatcaaacttcacgttgaaacctctacgaaatattatatgtaataacaagttggatccaaaagaaatcatatacccaaattcaggaaatggaattggagatggtaaagagctcgtttagtcaactgaccataagaaacgacttcccagcaggcgaagttatatttgcaaaatcttccacaacattttcgttttcaagctcctctataacatgctgcaaacatggaaccattaaaccaagcaattcgttttcatataaacagaataaatgttcattctttttcagtatgctgcagtaacaacttactgctgtttcatcattgccaggtgtcacagtcccttctctatatacgagatttcttaacagcttaaaggcgtagtctatctgcaaaacatttagtagcactgatgatattaacaacataaagctaacagatttagcacacaacaaactgacagacctctataaaatctgatgagcaagtatatcctgaaacagatagaaattgagagaaacagtatgaagaatgatggtgaagaagaagcatcatggaacgaattcatgtcatggtcgattttgaaaaacgttcttcaagtttgtctgcaatgtacttgaactaagaccacctaaagtatagttctaaaattcaattagcctacttatactaacagaaatagagtacgctgagtttatccaagactcttcacgaaacaccacacacagacgcacacactcacccaacagtagatactaatttcaggactatctatggagtataagttactcgaaggtggaatcatgcgattgaaacaagactcaaatgaaaacagaaagaaattcaaccgaaaatgacaaacccgcagaagagtatatacacggaggtcatggacgaagacgacggagtttctttcgccgtctgatttagcaatctccgatcaaaagatttttcaggcgtcaagagttgccaaaaagagaaggaaaatgcaaaattccggtctaatttaacaagaagccaaaattacccggttcggtctatgtttacttgaaccgaatttaatttaccttcccggttcaaaaacccaaaattctagagagagaggacggcaatgcg

SEQ ID NO: 10617 - DNA, 3000 bp, Unknown
  misc_feature (1)..( 3000): cDNA_ID_3037460_gDNA_ID_2213665_Annot_ID_182078 3000 nt of promoter + ATG
ataggtataataagcctctgagtagattgtttacagttgcgtatacatggttggctcttctttgatatgtaagcatagagtcacttaagtttgtagagatatcaagcatcatgcttttgatacctctctggcaaaatatccaagcaatctggcatgaatattcatatgttgaagatgcgaaaggtttttatttttcatttaataagatgcttaatgttggcatgcatataaaacatattgctccgcatcaaatatatttaattacaaccaggtttctccattatccaatttaatattctttaatgatttttaaaagaggctcttcagattgtccaagtccatcatctactagtcttccatcaggatcctgccaaaaatctgaagtttcagagcggtgtagttcagagagggagagagtgtgggatctacacattctgtgagtaacaaaaagacagtcttcaccgattatagttataagttagaccgtgtctggattcaagtgccatctggaggtctctcccctgtgagtgaaatctagagacaggaggcaacaagtgaaatgtttcaggatgggtcaagatcctcaggaagtggcagaggactgtcgacaacggctgtatcaaatggtggatggagaacccgtgggtttttgcgcggttggcagatccagaataccttatttaacaacatcaagttcatgattctctgctgcttcgtgaccattctcatcctacttggcacaatccgtgttgggaaccttggaagctccaacgccgactctgttaatcagagtttcatcaaggaaaccattccgattctcgcggagatcccctctgattcgcattcgacggacttggctgagcctcctaaagctgatgttagtcccaatgcaacgtatactctagagccaagaatcgcggagatcccatctgatgtgcattcaacggacttggttgagctgcctaaagctgatattagtcccaatgcaacgtatactctaggccccagaatcgcggagatcccatctgattcgcatttgacagacttgcttgagccgcctaaagctgatattagtcccaatgcgacatatactctagggcccaaaatcaccaactgggatagtcaacgcaaggtatggctgaatcagaaccctgagtttcctaatattgtcaatggcaaagctcgaatattgcttctcacagggtcttcccccggaccctgtgataaaccaattggaaactattatctattgaaagctgtgaagaacaagattgattactgtagactccacgggatagagattgtgtataacatggcgaatttggatgaggaactctcagggtattggacgaaattacctatgattaggacattaatgctgtctcatccagaagtagaatggatttggtggatggatagtgatgctttgttcactgatatactgtttgagatcccgttgcctcggtacgaaaatcataatctggtgatacacggttatccagacttgctgttcaaccaaaaatcatgggttgcattgaacacgggtatctttctgttgagaaattgtcagtggtcattggatttattagatgcttgggccccaatgggaccaaaagggaagatccgtgacgaaactgggaagatactgacagcttatctgaaaggcaggccagcatttgaggccgatgatcaatcggcgttgatatatctcttgctttcgcagaaggaaaaatggatagagaaggtttatgtggagaatcaatactacttgcacgggttttgggaaggtttggttgacaggtatgaagagatgatagagaagtatcatccaggattgggcgatgagagatggccctttgtgacacattttgtagggtgcaaaccgtgtggcagctatgctgattacgcagtcgatagatgcttcaagagcatggagagggcttttaattttgcagataatcaagtgctgaagctgtatgggtttagccacaggggactgttgagtcccaagattaaaaggatcagaaatgagacagtctctcctctggagtcagtagacaagtttgatattcgaagaatgcacatggaaaccaaaccatagagctaggaaaatcaatgagtgaacggaatcacagtttggcaagattacaggaaacatatagatgatatacaaatactctcacaaacacaatgcaatttgtttaccctgcacttgttccttgtgcttcattgtttggtctcatgaagataagttttaactgtcaaattcttattccatagatgtttcttgtcattgttggtcaatatatggagaaatttgatactgcaattttgcttgttactcgtcttttggtatcttccttttagacaaccagctttggagaaaaggttagacaaaatatccagaggttgcatgtgtctttggttattcattccaggaacgtaatgtgtccagttgaggtattggcatgaccaggtttggagtcgtgtcttgtatgtaaagtatatagagagaggtaaagagaaatgatgagagttttattttgtttatttcacaatatgtgttccattcaggtattaaataaacttttgcacaaaacaaaatggtagtaataatgtatttaccatggaaatagatagttgatcatttgtattttatttaaaaattataaaggttttggcaattttatctgtaaattcgtaatactatctaatattgtttggtagtcgtcacatattaatctttttttttgtttttgttaaaaataacatattaatcttaaaccataattatatttaattttagaaaaagagagatttagtatgctgtgatctgataagatacgattttaaccataataaaagagtataattacttacttaatgctaagagtcgatccctttttttatttattaagaaaaacgcggaaaaataaccgaaggagatttacacttatcacatcgagactctttgatcggagtttcccaaaatccccgatg

SEQ ID NO: 10618 - DNA, 3000 bp, Unknown
  misc_feature (1)..( 3000): cDNA_ID_2716126_gDNA_ID_2213665_Annot_ID_182077 3000 nt of promoter + ATG
aaaaactcatatgtgatactttcaaaaaaacttttattttcgtcaatattctacctactcgtaataagaattgggttattgatcaaatttttgtcgaccgaattgattaaaaataaataaatatatatatatatatatatatatatatatataaaccggagatcaaattaatagttcggatatacttccatggatgcaaaaataaagtatcaaacttcatttatcatgtagaatatatattaaaggatatgtaagatacaatcatttataatttgtttcggtttcacacttaatatagttgagccgcgttaatcattgttctcacttctcactgtttttttgtttcccccaaagaaaacttctcactgatttacacgtacgctatgtataaatccacgaatttgttttttttttatttaactataccaattattgacacgtgcttaaattcggtaaaagtcgcatactttaaaatatttttctttccttttacattttaaaatatttgaggcgaagttttcacacttatatattatggtgacatgttggcttgtatagtaattgtatggttctatacagatgctgagcacatgtcaaaaacaatataaatacaagtacaaaattttgatagaagcaattcgaaagatagcaatacaaataaaaatgctactagataaaagtaggacagtttaaagaaataaaaatttatcaaaaattttgatatagagtaagtatcaataatttgggaaaaaaaaatctagctccacttcaccacctttgtatagccacttcactttgtacaacccaatattaggtatttgtactactcttttaatataaactatgcaatgcttctatttgcacacttttgtataattcctatgattggttacatacaaggccttacaatcattaccactactagtttatatatgtaactaatcaaaaccataatcattatatttgattgtctatttgttttgtttggcacaactatttactaacaaattaaaccaaatcttattatatttaatctccatgtggtcgaaaaattaaatatagttttttatattatcaattgtgatgagacccctctatcacatttttcttgatttgtttgtagctattgtagaagaagaaaacaactacttaaaaaaaaaaaaaaaaaaaaactttcagaagtgataatctttgtccgaaagagattgatagatgactttgataatgagaaacaaatacacaaaaaaaagcatttacaaaaagtacaaaaacgagaatcatatatatatatatatatatatatatactgaaaagaaaaagagaattacatatttaatcatacaaaaagaaattaaaaacaagaaaaagtgaatgattgttgggattatttctcgttaatatgaaaatgtctaccatgaaatgatatgtgaactaacgactttaattcactaaagaagagggtatcccacatcaatgataagtttggcatcaacaatcatgcacaattgcacatcacgcctctgagtaggcgcatgagtgtgtgaatgaggaaatatgaaaaggatgagagagcaaaaagatttcacacagatcacagatggaattcgaatcattcgaccaagaaatatgtgaggaattcgaatcacaggtcttacgcagtcaacggaccatccttttttctatattaatttctaacttctaactataacattcaaaaagtccaaaatatgtgaggaatgattaatgtgaacactggtaggtttatttactgtttttccatttatttacattgacctagtgtaatggtatcatactatcatctgcaatctgtagtgccacgtcgccccaaaaataatgattaccacatccacatgctcttctactaattaaccgttccaaaaaattatctagtatcgtcactaattaatagtataaagtaagattatcatatacgtttatcaaaaaaagaggtgtgagactatcatacttttattaatagccaggaagagaaagaagaaaacgttcaacgtactaacactattcagtatccacacatgtgcgggaatatatgaataaataatagtatcatttaccattttttataacaagatcatcttactttagctctaacccctttttgtttctagattgtctacgaatataaaataaaaatatagtattaaaattttatacgtggctaaacttacattttattgtattatatcacgttaaagctaagtgactaacgaattatatatacgatataataataataatttgtggttaattttaaaattttgttaataaatgttctataaaaattaatatatattgataaatatgaaatttattaaaacaaatttatcaaaaatttcatggttacgtacaaaaaatatataatcaccaattcaccattttgtttatatatgttcttattagattttgatattttgataggtaaaaaataaataaatactggggtaataatttacgaaaagtttttaagtgttagatagtacaccttccatttaaaattaattgtcgtttaaagttttttcacgagtataactaatacgaaacaaaaaaagtaatagatactatcttttcttttcttcttttacctctttacacataaattttggcaagatttgggtatttggtatggtaatagactaatagtagaaatttgtgctcgataaaactttcgatatctaacggcaggaattcgaagtaaaatccaacggcggaaatataataataccaaaacaggggggggctatataattgtataaccctaattagaataacgcatcccactactcattctctcgagagcatcctacagagtaaaacgtgtagagagagactcacttttttttctggagagagagacacactttcaaataaataattgaacttgtttaaaatttgtcttctcgtgaggtggtgaaacgtggcaatattagattggttttttagtttggttggctggagaaaatg

SEQ ID NO: 10619 - DNA, 3000 bp, Unknown
  misc_feature (1)..( 3000): cDNA_ID_1663143_gDNA_ID_2213665_Annot_ID_182076 3000 nt of promoter + ATG
ggtttacaattacaagctcgaagaggctttgaaacatggaagcacgaaggttactgacaaagacatgacaagctctccttcttcacctctgctaacttattttttgtttttaaagattgattagttttggtttttgtcaggtagaatcgtgcagaagcgtatttcccgctaattgttcctcatcagactcactttccagtctatacgaccaattaatttagccccaattgactaaattttttatacttaaaaataataaatattcactctgaccaacttgcgaccgaagaaatcaagaaaagcaaattaagatagtttaccaaacataattatttatatttttaagacatcggatgtcgtcaacaataaatttctgaaggagacaattgctcctaacatgatcgttcaatgattcagaacacaagacaacaaagaagtacataacatatattatatatatggaagctagagagtatatataatgttgcatgactgatataagaaaatatataatgtgtatgtaaagtggtttatgattcacaagttagttttctacttagtaacagcttcttcaagctctcttaagccaccaaccttctgttcaatttcttcgataagttcttcacgccatagctccgctcttgctttctcttctatgtcttcttgctgcatcatataacccaaaacacaataacaactctatccaatcttataatagttgtacacattgtgaatctgtgatgatataccaaaggtcaatggcccgagcaagcccagcccgacccaacttaggatcaatgttacctaccatcagatctgttaacgtttgaattattatatcaagcccaacccggctcaaacttactaagcatgattgatctatcaataggatggatcaatgttacctaccatctatcagattgtgactttcgtttagatgatcaaggttgtggattcatatttttgggtgcatatataccaacggtaaacgctaacctaaaagcacctatttttctttgtttagggaggtttatcgcatgctgagacacatggaggagtactcaaaaccggctctgaacaggtctacatggcctactaagaccaaggtgggatagtctgaggtcaaactagatctgaactggtccacagggtctagtaagaccacagcgggttggtcggtccattgcaacatccctagttataatttgtatgcatttctaagtttttttctttctttcctaatagtattagaaagggagagatacatacagtttcatagacccaatatccagttccatcccctccatctccacggtactcctctgagtcgtagaatggatcctgtattgatccaatatcacaaagtactattaagatcccaatgcagcaaatgtatcaaaagattcagtttgagttgttgttttcatacttttgctgaaccgaagtacaaacatccccaacaagtgaacatgatgtagaacatatctgccatatcaagatcaatatcaaaacataagaaaaagaagaaaaaaaagtctaagaaagaaaataaaatctctcaagaaaccccaagtgtttaacttacaaacattcttgatagctttatcacttagatgccacacgtgtttctctgtaatgatatcacgcattccttctatttgttgaaccatcacagccattaatggcaaatcatgtggcaatgcctttcttacacataagcttcctctcatcaaattcctttccctcttctcattaacattcttctaatttttcaaattctaagacgtaaattcacaagaatatggagattttttttctaattttagtcttagttagagaaaattacttacagatagccaatatccatgattcggtcctgaattctgcttcggctacaacacaatacacaattcttaaactttttttcgtaatgaaatatttttggtaagaatataaaataatatgtaccgagtgattgtaggaagaaggaatatgaagatttgtgaaggtgaaacttgtgaaagcttcagccattgttacttcttgatggtggcaatggagaagaaaaaaaaaaaatgttggtgtaatcttttttattttttcatttattttaatctttaagattagattttttgaggcagaaaatgtgtggataagggaattggtatcgtccactcttcacttttgtgataaacaaaataaaaaaataacgtacgttagcaatcacatcgcataacactttttttgtcttttaaaagcccaatttagacaatcacagtacacattttagccttctaaaacgctcaggttgggaacaactatttgccttaaagagtggtaaagatatttccagcaaaattcaactacaaactttcgtattttacccgtccaacaaactttccattcgcgcaggttagcaatcactaaacacgttcactcctctagacgtgcaagttagtaaccacactaaaattgctaataaatctttggttggtgaaattcaaactttccgcttatgtctcttcccaaatacatcatttgttgaatagcgtacgttggcaactattgccaaacttttaatgatatttccatctaattcaacttcctatgcgcgcatgttagcaatcatcccaaatacatcattcgttgaatagtgtatgttctatttgccaaactttcaatgatgtatatccatctaaaccagcttttattcgcgcatgttagcaatcacaataacacgtctactcttcttagcgactagtattttgtcaaaagtcggaagaaaatctccggccaagtcaacttctatcgctttaaaaagcgcatgttagctattaaaaagcgcacgttagcatcattttcgggaaattgctaatcaaactttccactttcgtcttcttcccgtgtatatctttaatctcctctgtttggtgactattatccaatttccaccgatcttctcctcataaaaacacctcttcctcaacgaattttttatcc

SEQ ID NO: 10620 - DNA, 3000 bp, Unknown
  misc_feature (1)..( 3000): cDNA_ID_3037464_gDNA_ID_2213665_Annot_ID_182075 3000 nt of promoter + ATG
ataaaacactaagctacatatttaatcaatatgaatttaatttaggtgatactgtattagtgtttttatgattacataaagaatcataaaagtttatatttaagctaccagttttactcattagttaaacacaaagaattgattggttcaaaacggactaaaacaagtcgagcggaacaacaattgacctgtgaatatgtgattgtaatacatgcaacgcattttgtttatttttcttgaaacatgagtgactgaaacatattatattcaatatattgaaacatagtttacacacaaatacatcaatccatggatcatggtggtcttattatcatttcggttatagaaacacgacaatgggttcaagttcttcagttatatataatccaagcttatgtgatcttattcttcttctgcttctttgccctatattccttgatgtcactttctaccttggcattcacacgcgcttgaaaaccgggatatggttcatacccgaaaaccgattgaagaacctgtattcattcaaacatttccacattagcttttcatgtattctggttacagtttccacagagcagtataataaggtagcaggagataacaaacaaatcacaacataacataacaccaacaacttttacctcgagcaacacgaagaaaggagccatgagaaaagcttggagtaaattgtctaacagcgcaggtgcccgtttctgtgagtagacaagaatcaataacatatgtgttaggactcatgtatacggatgacaagacacaaaggagaatcaaaacaatgatttctaaaagccagagaacttacctcgaatactccatggccaacgaactgcccggtccaacataacagctgagatgctaacccaacctgagtaaaaagacaattaaattgttacagtatctacataacagagagagttggcgtcttggtgagtattaactgttttccccttgctgttgaatacatataacaaactaatcaaatgattcagactgaagatacatataaactaatcaaatgattcacaacacagaagatacataaaaaagctcctaagttacagatgtctcaaatactatggaagaaaaaccaaactttagttaaacaagtgatgtagattctaattatctgagaccatccaaatgttggtggtcaagaacaacacttgtttccgtccaagcacacatcaaatcctcttaaccaatgagtcaacaacactaaaaacatgacaagtctccggaccaaagaatcagaaccgtgcaaaggtggacaattgcagaacaaactgcaataactactaatcatgaatgttcaaagctagagacatgatattagtactgctgtctcaacgttaacagctaatgaagggacccatagacaacagatagagaggactaatgatataaataaatctatttcttcttccccgagcataaccaatgatataaacgaactttcaagtcaaagcatagaaaacaatgaacaataaatgcatgaaccacactcacatcatataaatatacacatagagcaacacatggatacacatagtcatataccctcataaacatgcttctacgcaattattttctccaaaaatgaagttttttcaaaaaccctaaattgaaattagagaaaaaaaatctaacctttaaggcaagagaagatcctagtcgaacagcaagaaaactggaaccaacccagcaagagaaacacataagagcagctacaaatccagatttcttatccaaaccgatatagaacagagcataaatcaaggcgaatataaacccaacgttaaatcgcaaaacgccgtcgagggtcaacgattgagaaaaccctaattgagaggggtcgaaaattggggtcgacgagtggaggagaagtaaaactgagaagaagattggccaaacgaagatgatgtggattagaatgttgatcggattgctatggtaagcaccgtagaaggcgaagtgtttctcgagatcgaacaatcccattatgcgactcatggataaaaaattcgttgaggaagaggtgtttttatgaggagaagatcggtggaaattggataatagtcaccaaacagaggagattaaagatatacacgggaagaagacgaaagtggaaagtttgattagcaatttcccgaaaatgatgctaacgtgcgctttttaatagctaacatgcgctttttaaagcgatagaagttgacttggccggagattttcttccgacttttgacaaaatactagtcgctaagaagagtagacgtgttattgtgattgctaacatgcgcgaataaaagctggtttagatggatatacatcattgaaagtttggcaaatagaacatacactattcaacgaatgatgtatttgggatgattgctaacatgcgcgcataggaagttgaattagatggaaatatcattaaaagtttggcaatagttgccaacgtacgctattcaacaaatgatgtatttgggaagagacataagcggaaagtttgaatttcaccaaccaaagatttattagcaattttagtgtggttactaacttgcacgtctagaggagtgaacgtgtttagtgattgctaacctgcgcgaatggaaagtttgttggacgggtaaaatacgaaagtttgtagttgaattttgctggaaatatctttaccactctttaaggcaaatagttgttcccaacctgagcgttttagaaggctaaaatgtgtactgtgattgtctaaattgggcttttaaaagacaaaaaaagtgttatgcgatgtgattgctaacgtacgttatttttttattttgtttatcacaaaagtgaagagtggacgataccaattcccttatccacacattttctgcctcaaaaaatctaatcttaaagattaaaataaatgaaaaaataaaaaagattacaccaacattttttttttttcttctccattgccaccatcaagaagtaacaatg

SEQ ID NO: 10621 - DNA, 3000 bp, Unknown
  misc_feature (1)..( 3000): cDNA_ID_3037483_gDNA_ID_2213665_Annot_ID_182069 3000 nt of promoter + ATG
ttttttgatggggtcggcaacatatttattattttccatttttaaatactagaaatctgatttaacttttaattaaataattatactaactaacggcgttactacgcttgtttgacacatacaattgttgacaaaaccggaaaaaggtgttttgcatcggcaaatacaaaacggaaaaagaccccggcgacaacaccacgcactagttcattgatcttcacatggcaacttgaaacgacacaggggacaatcgtgattggtctcaaaccagtttaggacacattcatcgtcaaagtcatgtctaccatatattacgacgttacaagaatgataaatatatcaatatgttaatgtttttataggtgttggccaaaatattgtttgagccaaaagaattgaattttaagattaaaaaagagtttatatgatactgtctaacaaagattcctccatcgtgatggtggtaaacacatgaaccattgatcgattcatctcggtgatgattttttcaccagaatcgacgctcaaacggttattgacatgtggctaagatggagtccgacgaaaatttcttcaacaacaagcggtgatatattgagctctttttgggcctttaatgtttctggggctttatgtatagcccatgtaagatttggttgtggttaataatttctacttttgtgacaaaccctaaatccaatttacagtctttttgtttttgtttttaaatatgtacatagattttttttaatctaatcttaaattacacattatgatcaaactatcagatttaactatacgcaactcatgcgattatgatgtacgaatccacaaacaactccacgatgtgcaactctctctctaacatagtgatctcctacctaacgattctttatggtggatcatacctacgatgaacgatcttattcttacctaagacggacgattctgcttgcaacattatgagacttccgattagtatgccaaaatagttaattagaaaaagttaattaattatattaatcaatttataaaggtattcctaactcatttgacccatttttgggtttttgaccaaaaaatccttaagagcgttacgaacaaggttacatcggtaaatacgcaatacaaaatgagaaacgaatatgttgtagttttccaaaatttaagaaaaaaggaaagtaatagtatagaaaatccgaaaattagaataattgacctaaatccaatctacagattttgttgctaaactaatttattttttctaaaatttaattaattatattaattaactttaaaaaagcattacaaagaaggtttgacccgatattgttaacaaagagcgttaggaacgaggttacatcggaaaatacacggatacaaaacggaaaaagactcatgcgacggcatcaaactagttcattgatatggcaacttgaaacgacagagggggcaactgtgattggtctcaaaccactttaggacacactcatcgtcaaagtcatgtccacaaggtaaagtaacaactcttcttccttcactaaactcttccaaacaaattatgcacatttcaccagtagaactagtggtcatcttgtatatcttcctggctaaagacttgaccacgagcttgcttgcgggcctcaaactaatattattggtctcctccaacgaggctcgaaccgcttcttccatctgatactcttctccaattggaatcgcgtctccaatctgaaaggtaggaataagacgcaaggacactagcaactcatctcccgtagaatagttactacgatcacatactgcaatagcatattcacttagcattattagtgcaaatatggtatcgtcgtcgccgattcctgaactttattagtgcaaatatggtatcgtcgtcgccgattcctgattccattaagaagtaattgaagtattctttgcatcgacactcatcgttatcttcgtcaaggaattgttcggcaaaagatgaaccagtaaacgtgggattgtaaccgtcgatctttgcatttactgtgattgtgccctcgttttctggttgaggattgcgtatgatactgtggctaaaatatattttcatgattgattgaagaatgaagatgatgatgaaaaaagaagaagtaagaactcaaacttctaaaatggttcttgtgtgtttatgttgttgtcacagacgttatttgtagaggattctactacgtttgttatattggtgggatttggaatcatattatttattatagggtcttttgcaaaagtaaccattgtggaaaaagttattaaatttttaacatcataatctgacaaaagaaataagtacaataaagttattaaatttttaacatcataatctgacaaaagaagtaagtaacaccagtggtatctaaaaagactattttgtccttagtgtctaatacttcaatttctatactatttggaaggttttatgaataggcacatttttgctcttgctttattaatatagactcatttctctgatctctgtaaacgtttcttccactaacattctccaatgatcccaataaatcaaattaaatgagaattttgatggaagaaatttaaatgagaagattttcttttggaaagattccatttttttttgttattatcttatttatttttcatttttaaaatacataaatctgatttgcctttctttttttttaatcacaatattggattgggaaagaaaaactctgggtagaataaaattaaataaaaaagcattgacgtgggttgcaaccagagaaaagtgatgacgtgtcatgtcgtgattggctgaatattattgacgaaagaagaaaaaaacgctgtgtctatctctcgactctctctctctctggcgatggctatcaaaccggagatttctgtctccacagccgctccatcgtgcgaaccgaggttaacctactcggagatttacgactccgagtcggagagtaatcgttgaagagagcaatg

SEQ ID NO: 10622 - DNA, 3000 bp, Unknown
  misc_feature (1)..( 3000): cDNA_ID_3037503_gDNA_ID_2213665_Annot_ID_182062 3000 nt of promoter + ATG
tctcgccttcttttagcttttcatctttacctgtctctgcccttaacctcacacagatatcgagtctcggcgattgaagtgaactctcatccttataatttcatccgaaaggtaaaattttgacagctctagtcgctaaaccattgttgtttaggtctccttggaactcttctgaatttgcttttagattagtttactctttttgagcctttgtttgtgtaatcttcgaatggattcatggttttgcgttaatgggttctgtttgttattacagattttggataaagttttgatttttttggttcgcaatgacgctgctcgaagctatctccaacgccgtagcgaatcaggacaaggtcgactcgcaatccgattatccaatccctcttagccacgatggtatctttgcgaatctgaaaccaaagctagaaaaccctaatcttggtacccttgtcaatccaatttccgggtggggaatctctgaaagtgatgttgaagtcatcgatttgggtaaaaagttttcatctaagctgaaaaggaagcttaaggatactaacgggtttgtcaaagatgagtttgtcaagatgttaaagcagtttcttgagaaaattggtgagaaagttgggatttcagaggctgagtctgagatggttttgggagatcaagctggttctgagatacagatactggtggagaaaaatgggtttttgatgggtagagatgtatctggtttagtgttgaaaggttgtattagtctagagatgtgggagctagtggaaattttgatttcaaactccttggttgatcattcttcatactcttatttagttagcaatcttgttgagaagcaaaggtcagatttgctttgcgtagtgatcaaagaagcttcagatcttggggcaactgagctactttcaatcttgaagtattttttatgcccatcaaaggaagcaattagcactatggctaaggtaagagaagaatgggagagtcaggctatgttggctattgaaaaggtgagcaacacagagctatcaaagaagtctaaagttgcagaagaggcttctatcttgttaatggttgctcatgacgggttttcaacctcagagctttgcctgcattacttgttagcttcacggaatgttgacgaagtcatgtttgcatctgcagtcagtaagttgaatggcaatgagatgggtagctttattcgatacctctctaaatggatgaagaagtatgagatgttcccacaagctggtccatgccctaaagccgcctccaagcttggtttgaaactatgcaactgggttcctgaactcacagacattaccaaatgtttgggacttcttatcgatgagaacttctccactctggttctgtactcggatttgcatgaagagctaaagtctattgcaagagtagccgatgggttagcttcagaatcaaaactttcctgttttgtggctaatgtggttgaaagtttgaagcttggagctgcccgaaactagattttcacaattgttggagcttaatgcaaccctgttttcactttttattatggtctccagtgacatttgtattttctagtttcagttcatctcttaactaaagtataattttgttcgctatctttgagagtttgtctccaacctctgcacattgccaatctcatttaggatgcaccacatggtttaaaattgttttcttttccaagaattctttatcagttacaacaggaagagtaaaaggtttatctttgcaatacaacagcttactttgttgaagaatgagcacaagttgttgctcaacgaagtgtctcacagagccggataataaaaaccgttcctttatgaacactcacgagaccttgccgcaaaatcaaacggctaatgtatcatcaccacgaaagtgaggtactctcgctgaggttgaagaagaagaaggggcaagaatgtaattacatccagaaatgcttcatagttacgcagctgagttattacacttgttcacaaagtaagctgcagtctggggactacccaactcctaactttcttcaccttcttaaattacctatctgtcaattatcatcatttcccaattgtgttgatacttaattggtagtagcaattttttccattaaagttttcatttttttggttttttgttgatggaaaaagtattgatccaacggctgtagaagaacggtgcaacaagattttgaattcggagatgcgtttgttttagttttaaaatagaaataaataaagttgttctctctctctcttcgtggacactggaactaacaccaccgatgcactacactctgtagagactgcaaatggaaagcatcttttggtaatcacgggtactgttgtcttcgtcttagtttttgtcggaaatcagacattagatccgaccagattctctatttggagacagacattactcggatctttatttcattttgtatgattctttattgtagattttgagatcaggtagtgtggatttgagatcaggtacatttacttgcaaggtgagttccagatctggttttggttatttcatttctggagttttatacgtttttgcaattttggagattttgttgattttagattaggatgatcattgcattttctttctctttcttgtttgatttcattggttaatgattgtggattactactatttaatctttttataaaaaaatccaaatccttagctcatgtacttataaaagaatgattttatgtttgatagtgatctatacatagttataaacaaatggctgatccattgaacttagtatgatgaatcctgttacaaagagcttatgtatctctttaatgtctaaaagctctagatagaaccaaaatatgaaaattgcaatctttagtaatgaaagtgttgtgttatagtcttgtgttattgcttgaccataatattttgtgattgttcggactaatgcaggtgttttgaattttggttgtggacata

SEQ ID NO: 10623 - DNA, 3000 bp, Unknown
  misc_feature (1)..( 3000): cDNA_ID_3037507_gDNA_ID_2213665_Annot_ID_182060 3000 nt of promoter + ATG
gatgaaaactttttacccaaatcgatgacttcaacatcactttcagagattccccacccggaaattggattgacaagggtaccaagattagggttttctagctttggtttcagattcgcaaagataccatcgtggctaagagggattggataatcggattgcgagtcgaccttgtcctgattcgctacggcgttggagatagcttcgagcagcgtcattgcgaaccaaaaaaatcaaaactttatccaaaatctgtaataacaaacagaacccattaacgcaaaaccatgaatccattcgaagattacacaaacaaaggctcaaaaagagtaaactaatctaaaagcaaattcagaagagttccaaggagacctaaacaacaatggtttagcgactagagctgtcaaaattttacctttcggatgaaattataaggatgagagttcacttcaatcgccgagactcgatatctgtgtgaggttaagggcagagacaggtaaagatgaaaagctaaaagaaggcgagagcaattagggtttagggttttgtaaatggaacactactttctgcgttttaatctgtttccaaatatacccctgtattctcttacttattacggtgttatcggattttgggcatcgacgaatttagctgaattttttttttttctggccttttttttttcttttgctaattgtagaaaatgtttctaaacaattttaagagaaaagttaaagtagttaagacatgatgtgctataataaaacaccaagtcaacaagctgactatttattctaaaatgtcaatggcatatacataactctacgcaaccagcaaaaggccttagatcgtggtccatttaaatatgtacttgttaatatcaaattatcaatcacatgtgatatgtccatgataattcatcaaatatatcatgatatatggtcaattagtttctagtttaaaactcatataacgtaagattatgttggtaaatttaattacaactctagtgttatatttatgattaacacatatatcatatattactagtttgatgccaagtctacgtaccaagtaccattcatttggcaaaaaaaaaaaaaaagacttagttaaacaaagagacaaactgcgctaaacctaaataaaatatacaacttgaaattgattaaactttcctatggaattttgtttgtagggaagccacaaaaaatttaaaaattgtaagctgattgattagatatgaccatttattttgtgttctagatttatagttttgctcatacatcatggcatatatttgagtggtttgtgtaaatatttattacgttttgcactcaccaataattaaatctgcagaaatataaatcttcaacaaaaattgaccttttattaattataaagatattttatttgtgtaatgtcaccaatgtatgactttaagttcatatattggagtgctcgtttttgtaaacgcatgtatatcatagctggagtcatatatatttttcttggtaattagtattttcgatctatagtcaaggtcttttctaaccgctgattaataatatcaaaattccactgctccacaatacattaattatattgtataccaaactttattctgcgtttagattcagatccagtagtagataaaataataattccgatccaatacaattcatttgatgctttaattagaacgatcgatggagcaactaaaaccgaatttggtcattctttgccatttgaaaaacaaccagtcgtctcatttgttgttaataagttaacattgatacgtacgtcggtacgcgagtggcaaaacaaacacatcagctctaagacgaaacacgtttggttttccaaaaaaaaaacgatgtattgataagctatattgacttaaaaggtaatatagtaacagctatcgaaaaatactacgaataaattagctaaattataatattaattatattagactatttaaattagcaagaaatctcttggaatgatctttctattacctattttggttcattctcttgttaattaaccatagtaatccatttgcggattggcctgtatctagacatttgttctgtcgctaccactagaagtttatcattttgaaaatgaaaagataagagagataaaattgtaacgatgtgatcaagaaatttcaacgttgttctttagcagcaacgttggccggtgggtccataatttcggctccaaaccttataacagtgtttgttgttgagacatagctattttattataacattaagcgttgaagttcaatatttcttttccaattagtcgacactatcgatccacgaacaatattcttctttcttttttccgaataaatcggatgcacaatggttgtttttattatgtacgtgtgttggtattagtttaaagggcagaaaaaccaattaatagtatattataatatcccattcatatttggtcgtatacattgttatttttaacttatttgttttgttcaattggattggctgttgacctttcaagatttcattgttgcgtgcttgtttttctcatggtttgaaacattgctgcataaaatgagtaaatagaataattgtacaaccacttggttcaatgtttttacattttatagtctacaaaaactctttataaactagtatttaatttctgattttggaatttcaacctaccgtaaaacaaaacagcgagactatctaattacaagactataattgaattttaaatcttaatttaatattatatgtgcactatatgtttcattctatttaagatagatatttggtaattttgtaaattatagaaatatgtcatgttctctgaacattattaatataggagacttgcatgtttttgtgaattgtttaattggcatagtcaaaggatgtataggttgcatatatagaaatcaacagttcccaagagaaaacatgagagctaataaaaaatttatcaaagaagactaatatg

SEQ ID NO: 10624 - DNA, 3000 bp, Unknown; identical to SEQ ID NO: 10611
  misc_feature (1)..( 3000): cDNA_ID_2716174_gDNA_ID_2213665_Annot_ID_182058 3000 nt of promoter + ATG

SEQ ID NO: 10625 - DNA, 3000 bp, Unknown; identical to SEQ ID NO: 10610
  misc_feature (1)..( 3000): cDNA_ID_2716178_gDNA_ID_2213665_Annot_ID_182057 3000 nt of promoter + ATG

SEQ ID NO: 10626 - DNA, 3000 bp, Unknown
  misc_feature (1)..( 3000): cDNA_ID_2716159_gDNA_ID_2213665_Annot_ID_132663 3000 nt of promoter + ATG
gtaagcaacaaaatcccgatcggaatttctacttttacaggagttttttgggtcggtatggacggttttgaccccagagcagggaccgtaacatctaaacccaccaaaagagatgctcgtatcgttcattttccgttgcttattttcattgtggttgttaatcctcatgagaaaggtttgactgttgcaacttgactcggatcttacacttggcgttccatgtcggcttgtttttgatcttgacgacgtcgttttcgtcaactggggatgaggatgaggatgaggattaggattaggattaggattagcattaggatgatcatgtgtgttttccttttcatgttgcttggtgatatccgccgtggaatcaacatgatctagcttcatgctgaagtacttttctgctccgaaaactccaatctcggcgtcattgtcagctttgatattggctttttctgagatttttgaagaagggttttcttggattgaggagaggacaagtaattgtggtttataagatgagatttggcgaaaatgggcactcttcttttcagcatccatctctttgtatgtgtatatatgttgtttagtgatgactactttatgaagtgttaaaatacaaaatatccaaccaaaaagatttaaaggaaatgacaagaagaagaaagctatggaaatgatggaagatttgcagagagaaagagctttgaatggtggatatgttcatgaggaggaaatttcactattatatagagaaaatgaatcttggtggaggaaatggtgacaagtcatagttagctacacagtttgcaaacccctcaatttttaaaaattgattacggcttttgtattttgtcaaattgatttatggttttccttcaaaagaaatattaggataagtacattatatgtgtgtatatatctatgtaatttcaattactatttgaggcatgtacaaaaaaaaattgctatttaaaatatattcaccgatccaaattacagctgaaaaacttgaaccctaatctctcaatttccataatcaaacacaatacgttgattcaaaaatatatagattttaattttgtttggtctcgaaaacaaaaagtgagtaaagttattattaccgtttgataaaggaagaatctagcttaactttatatagatattttggttcattcgcgttacaaaacatcagttgaaaaatggattccggcttagaaattgtattttagttataagctataaaatattagtatatatttgactattcaaaaaatttgcaacaactttttcttaatatatcaactcatatttactctctgttacatgtaagttctaaagcaatcaatagaatatgccaatatggtgatgaatagtaaattaataatatatgttttgaaaatgtgattctgttttttttctatatacatttcacaacattcatcaatttttatattttcacattttttaaagtgatacagttttgaattataactgaaagtagtcaatatgtatttacgaaggctaaaatttctagtgtcttgagattttttagtgtaaatattttgtttttgtttgctaacttaggtatccccactaatctattcatctcacttaaacactgtagtatcaccatattattcctgatggtacagtaattttacatgcaagccaaatgaacattatgagttggacctttcaacgttatacagtatcttttttccttatcaaagattgattcgaattatctcaatcatcaaattattattttcctttttctcgttagtttgtggatttattatccatgataaaaaaataacatgtggacaatgttacgacaagtggtatgtggaaattgaacaacaaagagaagagagaaatcgaactggcttggtatttattgttggtatgcctattgttcagtacttcataaatagctaggtagaaagattggtgcgtaatggattttgcatttccaacaaatacatatccacacacatttaagtataaattgccttgacgtctgctgaaaagtttggcagtggcaacgtcaaatatcttttcagtatcattattgtccctttagaataataaaactccaaatatataactgtggaaattttctttttttgttttttcatcaaagtacatgtggatcaaaatgattagattttaaatcgctatgcagggttctggttgtttcaagttcacattgtctcttaaacttgtttgatcagcaaagaactgaataggttctgaactagggggatccatgggttttggcaaaacatttaaaaattagcaaaggataatataatatttgggtatgttataaatcaaaaagtcaagatggccgagttggtctaaggcgccagtttcaggtactggtccgaaagggcgtgggttcaaatcccactcttgacactattgattttctgattttttttttgacatcaatagtttgacacaaaactgaaaaaaggacttgtagatataaggcctagatgccctagacgatccactgggctctacaaaccgttcttttccaatatcaaattttgtgaactagcccaaattgtttttaatttttcttttcaaatttaaaaatatgagtttacatattaacttaaaaaatatgagtatatcatacgtctaaatttgataactagcccaatgtattaattttaaacaatcattcaatttaataaaaatgaaaaaatatattttagttgtcacctttataataaagcttttgtgctattatccaaatggaaataatggatattttggtctttgggacaacacacaaatgacgtgtcggattgtgaatggtagtgatcacggaccaccaaagtccaacattacgaaactacccttactcgtttactatatatatacacctaagtttttgtctacaacattcgaaaactcattacaaaattctctctgtttccctccgcactcttgagaaatcgctttcttcgagtcactctcacaatg

SEQ ID NO: 10627 - DNA, 3000 bp, Unknown
  misc_feature (1)..( 3000): cDNA_ID_2716138_gDNA_ID_2213665_Annot_ID_132669 3000 nt of promoter + ATG
agacaagtcgctgagaaattcatcgatctcaacgcttcttcaaacgaccttctctctctcgaatggatcggaaagcttcttgattctttcctctgttgtcaagaagagtttcgagctatcgtattcaaccaccgatctcagatctctaaatctccgatggaccgtttgatttcagattacttcgaacggagcatcaaagctctagatgtctgtaacgccatccgcgacggtatcgaacagatccgtcaatgggagaaacttgccgatattgtgatctctgctttagatagtcaccgtccgatcggagaaggtcagctccggcgagctaagaaagctctgattgatttagcaatcggaatgcttgacgagaaagatcatccttctggaaccaatctagctcatcgtaaccgttcattcggaagagtcaaagacagtcaccaccgttcgattggtcatttcagatctctttcttggagtgtttcaagatcatggtcagcttctaagcagttacaagctttagcgagtaacttggcaacgcctcgaccaaacgatgtcgttgctagcaatggtttagctgtaccggtttacacaatgacttcggttttgctttttgtgatgtgggttttggtagctgcgattccttgtcaagaccgtggattgcaagttaacttctttgtgcctaggcatttccaatgggcagctccggttatgtcgttgcacgataagattgttgaggaatctaagagaagagataggaagaattgttgtggtttgcttaaggagattgataggattgagaagagttcgaggttgatgaatgaattgatcgattcgattcatttcccgttgaatgatgacaaggaagttgaggtgaaacagagagttgatgagcttgttcaagttcgtgaagctttgagaaatggtttggatccgtttgagaggaaagtaagagaagttttccatcggattgtgagaagcagaactgagagtcttgattctctttgatcttgcacatgtttgtctgaatatgatgaatgattcatgtttggattttttgttttgtttttgtttttctctatttatcctttttgatcacttgtaaaaaagaaactcaaagagtgtagaagtgtcatcttctctttgtgatgctgatagtgattctgttcttctttgtgtagctacttgcttagattgaagttattttttcaatgaacagttgtatcaaatacttcattgaatttgaaagattacattcaagaaacaaatgaatctttatttagagaagaggttcaactaaagggtctgttttacaattcaaatgaagcacatacaaaatctagacataaccttaaatttctcatctaatcttcacaatcttctgctggcttgagtccagcttcatgtttgtgacgtcctactttatttcttgcaagtgattcttcctgcaaatagagctcaaatgaaatccaaataaatgattagggattagaacagaacaaacatttgttgtagacagtattcacggtttgcctcagacataagtgatattcatcactgaaaaatctgataatacgtgcaattgtttaggcacatcattggcaaaaccaactaaatacccaagcaaaaaaatgttaaataatgagcaaaggattcttagttatgtgcatcagagagattcccatctagacattagtcatcattatagaacttctgatgtccctgtctattcatcgtcacttgcactagtcaaaagacaccaaaagagtatcaaaacgaagcaaaacagaaaatactagatcaaagttgataaacagtctgtgagatatgcatcagagagattcccatctagacattagtcatcattctcatctcctaacaaggagattctgatgtccctgtcttttcatcatcacttgcataaatcaggcaaccaaatcaaatcagaagctagaagagctaccaaaaccaaatcattaataagctcaaagatcacagtaaaataagagaaaccagatgtgtaaagagagagaaaaaatgcctcagagttgatttttttttcgtagagacgcatctctcaaagtatatttaacaccatcacaggcatcaaaatcaaaatatacataacaaaaacaaccaaaaaacttgcaaaaagatcaaatctcaaaacattaacatgggtcaattctagggtttatcaagaagtgataaatagacgtatttaagaagagaggcggagctaattagggcagagacaagtcaaagatattaatgggctttctactttggcccaacgaatacacatgttaatcaattaacaaaaaacggtttggttttgtcggtttttaaggcaattgaattaacaaaaccggtttggttaaacctttgtctctctctagcacagaagcacacaattccgttggtcgacgtcttaagtttcccagcgaaataaaaggttgtcccttcgtctgcttctgtgagctttctctctgttccaccattaatctttcccctttttctcttattcaaacttttcttcctccttcttcttcctcgggacaaatctttttggtgcctttttttctttctttcctcctccatgatctttctcttctttgtgactttcgcctcctctgtgctcattttcatgaattcttctcttgtttcgacgcaaacacccatttttgtttcctctgtttctgctgcgaaagacccctttttaaaaaaaaaacatcttccgttacagtgaattttgttgtctagagatagactctgtgtccgaatttagacgtcccccatcttcaaagattggtgctcttcttcttcttttaaaacaagtttcatcattttctcaatagggagaaatatacaatcaattccttccaataagtagaattttatcaggtgattgaagtgagtattcgaagaaaatgtttagtctttagaatattttcattgttggttatgggattttgatgctgtattggttttgaacaggggatg

SEQ ID NO: 10628 - DNA, 3000 bp, Unknown
  misc_feature (1)..( 3000): cDNA_ID_3037464_gDNA_ID_2213665_Annot_ID_132671 3000 nt of promoter + ATG
aagttcttcagttatatataatccaagcttatgtgatcttattcttcttctgcttctttgccctatattccttgatgtcactttctaccttggcattcacacgcgcttgaaaaccgggatatggttcatacccgaaaaccgattgaagaacctgtattcattcaaacatttccacattagcttttcatgtattctggttacagtttccacagagcagtataataaggtagcaggagataacaaacaaatcacaacataacataacaccaacaacttttacctcgagcaacacgaagaaaggagccatgagaaaagcttggagtaaattgtctaacagcgcaggtgcccgtttctgtgagtagacaagaatcaataacatatgtgttaggactcatgtatacggatgacaagacacaaaggagaatcaaaacaatgatttctaaaagccagagaacttacctcgaatactccatggccaacgaactgcccggtccaacataacagctgagatgctaacccaacctgagtaaaaagacaattaaattgttacagtatctacataacagagagagttggcgtcttggtgagtattaactgttttccccttgctgttgaatacatataacaaactaatcaaatgattcagactgaagatacatataaactaatcaaatgattcacaacacagaagatacataaaaaagctcctaagttacagatgtctcaaatactatggaagaaaaaccaaactttagttaaacaagtgatgtagattctaattatctgagaccatccaaatgttggtggtcaagaacaacacttgtttccgtccaagcacacatcaaatcctcttaaccaatgagtcaacaacactaaaaacatgacaagtctccggaccaaagaatcagaaccgtgcaaaggtggacaattgcagaacaaactgcaataactactaatcatgaatgttcaaagctagagacatgatattagtactgctgtctcaacgttaacagctaatgaagggacccatagacaacagatagagaggactaatgatataaataaatctatttcttcttccccgagcataaccaatgatataaacgaactttcaagtcaaagcatagaaaacaatgaacaataaatgcatgaaccacactcacatcatataaatatacacatagagcaacacatggatacacatagtcatataccctcataaacatgcttctacgcaattattttctccaaaaatgaagttttttcaaaaaccctaaattgaaattagagaaaaaaaatctaacctttaaggcaagagaagatcctagtcgaacagcaagaaaactggaaccaacccagcaagagaaacacataagagcagctacaaatccagatttcttatccaaaccgatatagaacagagcataaatcaaggcgaatataaacccaacgttaaatcgcaaaacgccgtcgagggtcaacgattgagaaaaccctaattgagaggggtcgaaaattggggtcgacgagtggaggagaagtaaaactgagaagaagattggccaaacgaagatgatgtggattagaatgttgatcggattgctatggtaagcaccgtagaaggcgaagtgtttctcgagatcgaacaatcccattatgcgactcatggataaaaaattcgttgaggaagaggtgtttttatgaggagaagatcggtggaaattggataatagtcaccaaacagaggagattaaagatatacacgggaagaagacgaaagtggaaagtttgattagcaatttcccgaaaatgatgctaacgtgcgctttttaatagctaacatgcgctttttaaagcgatagaagttgacttggccggagattttcttccgacttttgacaaaatactagtcgctaagaagagtagacgtgttattgtgattgctaacatgcgcgaataaaagctggtttagatggatatacatcattgaaagtttggcaaatagaacatacactattcaacgaatgatgtatttgggatgattgctaacatgcgcgcataggaagttgaattagatggaaatatcattaaaagtttggcaatagttgccaacgtacgctattcaacaaatgatgtatttgggaagagacataagcggaaagtttgaatttcaccaaccaaagatttattagcaattttagtgtggttactaacttgcacgtctagaggagtgaacgtgtttagtgattgctaacctgcgcgaatggaaagtttgttggacgggtaaaatacgaaagtttgtagttgaattttgctggaaatatctttaccactctttaaggcaaatagttgttcccaacctgagcgttttagaaggctaaaatgtgtactgtgattgtctaaattgggcttttaaaagacaaaaaaagtgttatgcgatgtgattgctaacgtacgttatttttttattttgtttatcacaaaagtgaagagtggacgataccaattcccttatccacacattttctgcctcaaaaaatctaatcttaaagattaaaataaatgaaaaaataaaaaagattacaccaacattttttttttttcttctccattgccaccatcaagaagtaacaatggctgaagctttcacaagtttcaccttcacaaatcttcatattccttcttcctacaatcactcggtacatattattttatattcttaccaaaaatatttcattacgaaaaaaagtttaagaattgtgtattgtgttgtagccgaagcagaattcaggaccgaatcatggatattggctatctgtaagtaattttctctaactaagactaaaattagaaaaaaaatctccatattcttgtgaatttacgtcttagaatttgaaaaattagaagaatgttaatgagaagagggaaaggaatttgatgagaggaagcttatgtgtaagaaaggcattgccacatgatttgccattaatggctgtgatg

SEQ ID NO: 10629 - DNA, 3000 bp, Unknown; identical to SEQ ID NO: 10619
  misc_feature (1)..( 3000): cDNA_ID_1663143_gDNA_ID_2213665_Annot_ID_132672 3000 nt of promoter + ATG

SEQ ID NO: 10630 - DNA, 3000 bp, Unknown; identical to SEQ ID NO: 10618
  misc_feature (1)..( 3000): cDNA_ID_2716126_gDNA_ID_2213665_Annot_ID_132673 3000 nt of promoter + ATG

SEQ ID NO: 10631 - DNA, 3000 bp, Unknown
  misc_feature (1)..( 3000): cDNA_ID_2716122_gDNA_ID_2213665_Annot_ID_132674 3000 nt of promoter + ATG
gctgtatgggtttagccacaggggactgttgagtcccaagattaaaaggatcagaaatgagacagtctctcctctggagtcagtagacaagtttgatattcgaagaatgcacatggaaaccaaaccatagagctaggaaaatcaatgagtgaacggaatcacagtttggcaagattacaggaaacatatagatgatatacaaatactctcacaaacacaatgcaatttgtttaccctgcacttgttccttgtgcttcattgtttggtctcatgaagataagttttaactgtcaaattcttattccatagatgtttcttgtcattgttggtcaatatatggagaaatttgatactgcaattttgcttgttactcgtcttttggtatcttccttttagacaaccagctttggagaaaaggttagacaaaatatccagaggttgcatgtgtctttggttattcattccaggaacgtaatgtgtccagttgaggtattggcatgaccaggtttggagtcgtgtcttgtatgtaaagtatatagagagaggtaaagagaaatgatgagagttttattttgtttatttcacaatatgtgttccattcaggtattaaataaacttttgcacaaaacaaaatggtagtaataatgtatttaccatggaaatagatagttgatcatttgtattttatttaaaaattataaaggttttggcaattttatctgtaaattcgtaatactatctaatattgtttggtagtcgtcacatattaatctttttttttgtttttgttaaaaataacatattaatcttaaaccataattatatttaattttagaaaaagagagatttagtatgctgtgatctgataagatacgattttaaccataataaaagagtataattacttacttaatgctaagagtcgatccctttttttatttattaagaaaaacgcggaaaaataaccgaaggagatttacacttatcacatcgagactctttgatcggagtttcccaaaatccccgatggcgaaggaaactccggcgtcgtcgtcgatgccttctggtctcaaagcctacacggttcctatcttcctcttcgtcctcgctatgttcttccagcttttccttcttcctcgttcctttcctccttctcattacgacggtacacaattctctaagctcgctttctctctcgactatgtactgtgctacacaattaccttccggttttgattcttttgatttgatttcttatttttcctttttgagttcttagttttgggtgtaaagatgtacagctcagtggatgacgtgaaagatgcgtatcagactgttgcttctaagtggtaactttctcgatctggggaattttcttaaccttgaatttggatttagtccccatgattctacctccacaatcaatcacgagtattgtatgaattgtttttttctatataactaattgctagatgatagtatatgtaggcttggcattgtaaagaatggaatgtaattctaattgaagttgataactagactttaggtgttctaagtagaaactgtgtggctgacacattgtaacaactggtcgtgacagggattcgggttcaggagtttctcttccagctgattttgttaaggttggccgtcgacttcttattagtgctaaatcattcagcctttttatgtgcgtaacgtttcttctaattccatcattgctactatgcagatacaatacgcctatgagctgttaacaaatctagtatggaaaagggactatgacttatacgccattgatgaatcagtagtaagttgttagttctgtatcttcactctttttgttgcagcaaactgaaaaagaaggaagatttactctcttttttccttttcaaatataaccccttgttttaatggttgcagcatattatagaggaacttgaaaaacaatatgctgtggaagattttgcaaaaataaaacttcccctactggaagttgtttcttatggtcagttaaccaacatacctctttgacattttcagttctgtttcttgtattcgtttttatatttcttccgatgccaacttattggtgtataaaacctgtttagagcctgaacgtgaaggttttatgtcaataacatctcaagactttgcgtccaagttccaagattctaagccatggctcattcaggtataaactctgtctagactgtttacacagagatatgtaaatttgtggagacacatttctgcagaactgatactggattatcaagtatagaatatctagtgtacgtttaaaacctctcctacaaaagatacaagcaatctaacatgttgaagatgcgaattgtttcctattaaattaataaatgttggcatacgtttaaccatatttctcttggaatctctttatgctacaaagtgagggagtgcatgttgtgcttcacgttaacgatagaagattttccttttggactgtactgaaatattaatttattggtataattcaatgctacttcttaattaacgtctaaatacctttaggtgtattcttctggtagcaacagctctgcccagttcgctacggtttggagaaggattggtatgatttgctttctgtagcatgtttaaagtgtaaaactcttgccagcctttgttaaagtatgagacaatggaatgattaattgaagagctagaacagtgcatttggcaaggggaaactgaagtatctgaaatagacagagttagttttcaggaaataaatatgttgtctatgatgtaaaaagcaagtgtaacaatatgatcgtaagttcgcaacttgatgtcaatagatatgttttaacaaaaattaggagggaacactaacttaatagttaataatagtatagacatattttgctgtgtatgaaatcattttaccaattatcttgctatgcttaactttcttttataattgcagttgctttgttggatggggttgctaaccatgcgatg

SEQ ID NO: 10632 - DNA, 3000 bp, Unknown; identical to SEQ ID NO: 10616
  misc_feature (1)..( 3000): cDNA_ID_2716116_gDNA_ID_2213665_Annot_ID_132676 3000 nt of promoter + ATG

SEQ ID NO: 10633 - DNA, 3000 bp, Unknown
  misc_feature (1)..( 3000): cDNA_ID_2716112_gDNA_ID_2213665_Annot_ID_132677 3000 nt of promoter + ATG
tgacaaacccgcagaagagtatatacacggaggtcatggacgaagacgacggagtttctttcgccgtctgatttagcaatctccgatcaaaagatttttcaggcgtcaagagttgccaaaaagagaaggaaaatgcaaaattccggtctaatttaacaagaagccaaaattacccggttcggtctatgtttacttgaaccgaatttaatttaccttcccggttcaaaaacccaaaattctagagagagaggacggcaatgcgatggggtcatctttctccgcctcctttactaactccaccaccgccgccgccgttcctcctccgtcgccaccttcatcgccgtcacgttccaatgtaaaatctaacggagaagagagacctcgtttcttcgatggaaaggcgaagaacaagtgctgggctaatgctgacatcgtacctggtcgacatcccgagaggtggcgtaaagacgtcgccggtaacatagtctgcaaacgcttcggaaattgcaatggttgtctctgtttcgagtatgatcacattgttccttattccaaaggtttgatttttcttatcactgcttccccaaatgtgacattttgaatttaggttttgagtagttaaaattaggatcttgatatttgtttctgtgtatataggtggagagtcgatagcggagaattgtcagattcttcaaacaagagttaacagattcaaatcagctcaagaaaatgttgatgccaccactcttaagagctattcttgtggtctgcaatttacgggtatgttgccaaatgttagcttcttcttcttctaattacatgtgatgatggatcatagatttgctcatctgctataagattcaatctttccttgttgggtttgtttttcagtgttcatttctatgttattatgtagataagatgggacaatcttgattgtgatttgtagtatgttccatattctgtagagattaagatcattaatcgtatagatatagtctttcttacctctgttatgctttcgtaaagtgctgtgttgaatagcatgttcgtttagaagtaatgccaatctcatacatgtgggagatgcttttgctttagatcttctttctcttttctctgttggtttgatcatatcaagaattgctattgagccactaggaatctaaatcttctttaaacccaaaagccatgctgtgagttgtttttaggtgttgctagtttacgttttatataggagtgaagcaaagtgttaaatgctcttgggaaatgcattttcttttcaaaaagactcaaaagattatagagctcttggtacttgcaatgattatacacaagtgaactcaagtgtgtgttgtgtgtctattctctgcatatttgctttgactttcttaagatttcttctattgtaaacattgcagacaaggagttagatgttatcgagatggcggtttatggagacgtgttacgacctggaaaagaatgtcgctgcaaaaccgtagctgagctgcttggtcagtccaagtccaaagatggtaaagccgcatgcgagttaccatcatagaaagtagtaatcaaccatgtctttgtaaagctttgattcatgctcatacattggcagattcatcagaatcttttacatatactggaaaccattgtttgtaagagtagtgatgattctatatctctatatacaaatggaaataaaattcagcttacactgatacctaacttttgaagtcaacaaattgtttgttaatatatcgaccacctaattcactattatatagtcgagaaataaaagttactgttacgatagagattttatggttggtcatggagacatgaaatatcaaaaaacgggaaaggtgcgcaattatgtgtgagctattaaagaaagatgtctgccaaaaagttaaagtcaacataaatttcctttggcttttttttttaaaaaattctctctgatatttaaatgtattttttcccatctatatataaaaaaaatatagtagctttcattcattaatacctaaataaaaatttaaaaattggtagttgtatcaatgggtgttcgaatttcggctttgaacaataaatgtagctcccacgtatacacatatcggctggttgaaaaactttatctatggagagagtcacatgatatatggtatccaacaataattcaacaatttaatgtggaatatgtattgattgccgtaaggttcgaaagctcaaatcccaaagaatttatcttactctaaaaaggggctattctatttaaatctcaatatgcattttgataccactacttcggttattattaaacaaagaatttcgaatcgatcccatattatacgaataagaaaactacaacaatgtttgtgattgtatataaagtacacaaatgacaagtgtgaggttaaaaaatgttggaaacaaacaagtcaacaacaacccaccaccgtttttggccgtattagctcactctcacactggtcgccgctagtcaaactctcgttccattgcataattttttaatcctattaatttcgattttctcaacaatgttactcacttaattagaaaaaaaacactactatatcaaattgaactatacaaagaaaaaaagctgtagaaatacttaacacagaaagtaaaagagagtgatcaatcaagtcatcattattcactgtcgatccaaaaaatcttgccgtagatttcgccttaaacatttctatttttgattacacgacatttacttttgatctatctctgtttaatttttgatttcgtcttccgcaattcacgcagaaatcaaaaactctaaaagaaaaaaacaacattctctaaacttttctctctgtatatatctaacgaaaaccgcaacagcaatagtttcatcattcaccggagatccgaatcacaataaccggcgccggtttaagagatagttccggtacacatgtgttgttgacgcggaggagcgaaattctggga

SEQ ID NO: 10634 - DNA, 3000 bp, Unknown
  misc_feature (1)..( 3000): cDNA_ID_2716266_gDNA_ID_2213666_Annot_ID_132679 3000 nt of promoter + ATG
agaaagaagttcttgagtgctttagttggagaaaacccacatggcggtacgattttcctaagagatggatttgcaaaaaccatccaagtgtacattttcttatcagcttcacaatacttgaggttaatctctcttaaacgtatgcagctctgcacaacttccttcacccctcttgaactcacattcaagcatccttgcagatcaagatgcaacaaccctcgacactttttgctgatcatatctaaggcttcatcgtcgatccaagttccacatgctcgcaaagactccaactttggaagctcaaagtctactacaccaagactctttatgcccgtacatctgctgatgtccaaagatcttagcttgccacaattcctccaaacttcaagaatcccatctctcgtgatgccaggacactgagctacgtcaagactttctataaaagggcaatgccgtgatatcttttcgagacactcatcgagcaaattgtggtttctagataagtacaaaaacttgacccctgacttgaaatccttcgtatccttggtatattcttccactccaaagttcgtccctaccattatcatgcacctcagggaaacacatctttcaataatactaaagaatgctagaccagttaacttggaacagaaactcagattcaaaaaggttaaacgccgaaagaacatccctaatttcataaccatctcatcagagaggaaatttgctcctttgaggttcaagtgaactagtgattggtacttgtccagcagatacaagatcccatcaaaagtaaaaccgtggcaatcggagagaagaagcttctttagaggtaacttagcactagcaatcaaacagagcaagtcatcagacaaaaacgaatccgaaagatcaagctcagtcaaacaacgagcaaacaagaacgcatcggttaacaaagactccctcggtctcaatccgattccgttgatcgcaagagactccaagttacgggaattgcgaagaacgaatttgatgcaatccgacgaaatgaaatcacagtcacggaagattatctctctcaagagaagacaattctgcgagagagcaatcaaagatttatctgtgatgaaactattaccagaaatgttaatcttcaacaaacctttgagattcgaggaaagctcgataacaccagaatcagagactcgactcggacttgaattaggatagctaatgtccagcttctctagcaacggaaaattcactccgatggaaaccagatcgctatcactaaaacctccaactccataacatttcaattccttgacattcttcatctcaaaatctgggaaatagcgcgtttgcgagacatctaccgattcgaaatccaaaccggaacgagaaacctggagaagaatcgaattgagatcctgagtgaaatcagagaacctgattcgcttcaagttgcggaatcgaaggagatgacgattgagtaaaggaacagctcgatcggtgacgacgaaagtagagcgaacgcgattggtgattgagaggaacaaggttgatacgagtgaaacagattccaggaatcgataatcgtcttcatcgatagctttgcagattaattcccaacattcttcaggtaaatccatggatgatggatttgatgaagattagctcaaatcaaactaacaacaaacacagtatgtaactaactatatatcatccttcaatttcgctggcagctggcttttaaccttatccaattttaaaatttcgaaactgggcttgttgtggctttttattccttaatggcccaataactatatttgtttttccaacagatattgggcctaacgactgattcatttcaaaatttcaaaactgggcttgtattgacccaataagatataaaaggctcattattcttgtaaggccctcaataagtctagttgttattcaactgtacagttgtgactagtcagtgaccacttgtgtcggtaattaaagtttgaagaggacagacatagagagttcacatgaataatgctcaaacttttggacctttgtcgtctgtatttttttaaaataaaaagaataaaattcttggatgcactctattaaaccatgacttgtcgttttgttcactaaatccgcatgaattgaatttggggagtgacccaatcgaatcatttggattactgtgcctcgatgcaaacaactctatcgagagattacacaatccattctcaatccatattctttccatatatcacaccattttattaatctgattaaaaataataatttcttttacgacaagatgtattttttttttcttggaaattaaaagactaaacttatgaatatgaaggaacattaaaaacaccatttatgtaattggattgtactttgattgctttatgtactttctttgtattcttgatttttctaatttaataaagatatagtataactatacgttaaagaaaaaggaacaaggctttaattaatagataaaaatctgttagctttacgtataaaaggtttaattctatttgtcaactagtagtatcagcatcatctctaacattgggatgttaaattgttgtaatggtagagagaaaatcaaaattttaaagattggctaatgggaagaaactgttttgctaactacacatcctcctcctcactctctccacaactccacgtcttatcaccacgtctgggattaggcactctttgctgctttattagcctttttgtccaccttttcataactgccacatgaagaccaaacacctaaaacctttgtccttctctctctctgtttcccaactccaacagtgtctcttgtctacatctcctccagacaaagataatctctagcatttttcaccatctccataaaagaattagatagaacacgaagcagcttcgtactctttatctctctctctctctctttttgtcttttctctgcatatttgttgataccagacaacaaaattaaatatg

SEQ ID NO: 10635 - DNA, 3000 bp, Unknown
  misc_feature (1)..( 3000): cDNA_ID_2716259_gDNA_ID_2213666_Annot_ID_132681 3000 nt of promoter + ATG
acacgtcatgcttttccttgtcctccaaccccaaactagtgtcacgtattctccacaccaccacttgtccttattatctatcatctttctatttttattttattctacccaaaaattccatttcctttagtttgacgactttactttggttttcaaattataacccaccgatcaaagtcaacttcaaatcagacaacaatcttaactaaactttgtaaaaaaaaaagtaaaacaggctaactcaacaagactgtcaccaagaaaatctgacggacgaatcacaggacctaatccgttgcaacaactgaggactttgaccactactactagagaacgagtacatactacttattgtccactgcgccacatctgataactgctctccccactaaaccctaccacacacgtacctaatccactcatactctaatcttaaattcaattccacgaaaacgcctcccaaattataaataacgccagcgataatctctggcattgactaatataccctctatcgtgagaagcagctaacctggtgacaagggttaatttagtcattagcttggtaatgataatgaatgtgtttattttttctctttagcattgaagtctacaacgctgatttgacccagaagacctctcccctctcccttgatgtgagggctttgtggtctttccgcaaagcagcatagagagagagagagaaagatgactgagatgcacaaaagtgggaaaacgtgactcttttgttgccaaaagaaaagagcaaaaagcagagatcaccgaatttatcacctgtttgtttgaaactcaaaaacaatctaacaagtgtttccaagaagacaacaaaagaaatcgagaaagatagattgagtttcttggaaaagaaaagactaaaaacatcattgcctaaattggagttgtgtccacgctgggggtatttcggtcaacgaaaagtcggtgtacctacatgatcagcttaagaacacgatcgtggatcctaaaatgaccaaaatacccacaagctaccaactgaaatgtcaagggcgtactcggtagtagatcagcccaaaccacaacaaagacgcttaaaattacgtttttaaaaactaaaatcatgacagtgcaaaacgccgcatcacgagggctatagcagaaaacaagacctacgagatatgaccgtcgcggagtttcaaatcggataaacaaaaaaatgagtgaaatgatcggacaaaccttagatctaaatggctcagagggttttacggcggcgctagactcctcgaggccttccatggtggtagcaccggcgccgcttccaccgctgccgcctccgccgctaagagacgtggcaccgctccaggaaagcggtgtggtggggcttgctcgcgtctggtctcctttcttcgatctccgttgacgcacgctccatttcagcttgagaggggacgcgtcgactctattcttcggttcggagtggcggagccgaagaagcgcctccgccaccatggaatcgtcagacatggccactcgaatccagttttcgccggacatagtcgcaactcaaagagagagaggagagatgggagagatggtggcgaaaaagtagagaggaagatatctctgtggcatagttaatgggtggatttgtatatatatattgagttttattgcacagttagatatattggaattaacttatttttcttctcttgataagtgtaggaccctctttaagacatacgtggcatagatcattttgtggcttgtgttggaatagtagcagtaggagaatgaaggtgatacacgcgcgacaatcgactgatgatgagtgtaccacctccgtccatattcaaactttgggaattccactatttagatgctacggtatcatgagttggaaaaataaaaaatgtcatgctagactaatcaactacattacattagatttatacatggcctatgttatattttagagactacatattagtattttcatgttaatttgtgattggatacaaatacgatcaggtatctttttgatgtttgttgcctcgcattcgtgaccattcaatttcttggtcacgtcaactccttacttgtgatcttcgagtatggtaattaataattataagactcatactagaataatacagttcaaaattaaataacgaaactaacaaagaattcctttcagacaagaaaaaacaaacaaccaaacttagatcatattcatatcaaatagaatatcaaagctttttataatagaataatgatgggatataaattgcatagttaaaatgggatggtatgggttgaaacacaaatagaaccatacaaaaatagggttttgaataagtttttgtagacacgtatcagttgctagttgtactttgttagaacaccaaattgtaaacaacacatgtcgtgacataaacgtgttcgtgcaatacacattcttatgttaatcgtatcagtcgaatacatacgtctctctctcgaaaagtagttatcggttccgattgtacgaaagcagtcagcaaactaccattttcgtttcgtcaacacggtaacatattattcattaatatgaaggcgatgttaacatttataaaataaaatgctactttccttatttcttaaccaaaaaatcttaatcagtcgtatgatattgttgttatctaatttaatcgtagctacaaagattttaaagtgcctcataagaacctagcgaatcaaacctcatgagctcactaacgtaacatttactcatctcaagtctcagtagtgatgatgatgatggtcagatggttttaaatttgactttcacttttaccgaaagcacataaaaccgtcccttctggtttactttatcgcgtgatcaattccggtttactagagaaccggactgagaccattttcatttggttccatctatgatcaacatgtacccaccaaaaaccctaaaagctcccggagccgccaagatcagtttccatg

SEQ ID NO: 10636 - DNA, 3000 bp, Unknown
  misc_feature (1)..( 3000): cDNA_ID_2716236_gDNA_ID_2213666_Annot_ID_132687 3000 nt of promoter + ATG
acgtcatgtctgcataatctttacaaaagtaagctaagattaaaagtcgtattctttagttgaatttttttcaaattacaataataacgccatattctccaatggttttaagaatgtgatccatgatggatcatccatcgtttctgtagggtgttttattgagcttaacgatcttacaaaatagccacaaaatgcctgtggttgtcacagagtggaacaacaacaaaaaaaaattaagttagagagtgaattacaaatggtacgtatatgtagtagaacacatataggaggcgacaaaccatctttcaaaaccaaatcttcggaatttggcttaagacacacaactcaaccagatttctcaatgaacctcagtgttttctcctcggttttgagttgaaacaaagccactttatggcaaagatgatataccttggggagatttctccatccaaaaggacgcttctctattgcttcatgtctgttttgaacacataaccaaagagtttcttcatatctagttatctattctctacagacaagcgtttcgtccaaggacttttctaccaactcaggccttctccttggagatagccctctttcgatcatttcctcctcatattccctagccatatccaacattcctttctgaatcaacgcatcaatcacagcattatacgccgctgaatcaggagtatccccagactctttcattgtcttccacacatataataccggctgaagaaatccccatctctcaaacttcctcattagcatcacataagtatccatctttggcctcactccactccttatcatcctaccaaacagacttaggatctcactcggtttctccaaacgggaaaagagacacatgtaagtaatcgaatcgggttgacaacctctcttaggcatctcatcaagcatccgatacgcgtctctcatcctcccgtcttcacatagaagcttaatgattgtgttatgagtcgcaacattaggttcacaacctctttccctcatctcccgaaataccctgataccgaattcaacaccttgcgacgctccaatggctcgaatcacagtgttataagcaaccacatcgagtttcatccttctactcttcatttccttatacaacttcacagctttccacggtttcccgctcttgcacatgatatccatgtaaatggaatacgaaaaaagatccttagtaacaccttcagtatccatcttcttccaatactccttgcatttaccccaccatcccaatttcgaccacccacgaagaatcagattatgaatcttagtattactcacactaaaaccattaccaatgacattcttcccaaaacaaagctcttcagcttcaaccacatgtttatgctcgcaaagcgcatcgaccagattataaaatgatgtttcatctctcaaattgaaatcatccaatttatcatacgcatcaatagcctcctgaacaagatgagccgtcacataacgcttaaagactatacgaaacgtgacgtgattcggcacagattccgtgtttccgatcatgcggttaatcaaagcccaagaaatttcaaactcgaaatacttacccagaatatcgatcacccgattgaatgtctcggtggtatgtctgaatccggattctctctcgacccagttgaaaaactccaacgccttttgccaatcgttgctgtaacatgtgagagcttcgcatactgttttctgatcgtaactggactgatcttcttcttcctgagatcgaaacttcgcatcatcgacatttgaaataggttttactgacagaagccgaacggagtaaggggaagcaatccgaactcgattgagtcgccgcaacaagagcattctcttgtttcccctctccgctccctgtacacacgaaattagggttcatcatctaacgggcgaattttgacccgaatacccattttaaaatctgacccgaataccatttatgggcccaaagcccgctggacttgtgttaatatttggaacatttgggccgatctatcttctacgaatctttcttaggcccatcataattgagccatccagaggtgaaaataaataatcgaacggttaatattggtttgattataaacacaaaagttctttccaggtctccttgtagtctttgttgtagtaaatggcgggagtcatccacgtcagcagtacccagattccggttgcgtttatgtccgcaaccaaacagagctttaggagagcttctgtgatcagatgtgccgccaacactccaaagaaacggtacaccatcgcggttcttcccggcgatggcgtcggtaacgaagtgatcccagtcgctgttgacgttctttgtttagctgggtctcttgaaggttccttctttctcatcctgttgcctaatttaatttgattttcccaactgaaatcgtgtttttggatatcagggatagattttagcttcgaggagttgcctataggaggtgttgctttagatcttgtcggagttccactgcctaaggaaacattgatcagggcaaagcaatcagacgctcttcttctcggagctgttggatggtatggtattattaccataactttcgttcatctcaagtttggattcatctaaagtttggatttttgaattgaaggccgaaatgggataacaatcccaagcatttgaagccgataacggccttgttgcagcttcgtgcggctcttcaagtatttgatgagccctccttcttctgtgaggtgctgctaataaatggatatatatatatatatatatatatatatatatatgttgtatgtggtaatgtaaggtgtccatttacaaaattaaaaactttggggtcaattctgaaaataaaacaatgtgcaaaaaaggacccataaatgcaaagaagtaaagtctgagtgtactagtagtatccatttgacttgcggtttcaaaatccgaaaaagaccaatcaatcctttctccctgaaatg

SEQ ID NO: 10637 - DNA, 3000 bp, Unknown
  misc_feature (1)..( 3000): cDNA_ID_2716228_gDNA_ID_2213666_Annot_ID_132689 3000 nt of promoter + ATG
aaaatcaaattaaattaggcaacaggatgagaaagaaggaaccttcaagagacccagctaaacaaagaacgtcaacagcgactgggatcacttcgttaccgacgccatcgccgggaagaaccgcgatggtgtaccgtttctttggagtgttggcggcacatctgatcacagaagctctcctaaagctctgtttggttgcggacataaacgcaaccggaatctgggtactgctgacgtggatgactcccgccatttactacaacaaagactacaaggagacctggaaagaacttttgtgtttataatcaaaccaatattaaccgttcgattatttattttcacctctggatggctcaattatgatgggcctaagaaagattcgtagaagatagatcggcccaaatgttccaaatattaacacaagtccagcgggctttgggcccataaatggtattcgggtcagattttaaaatgggtattcgggtcaaaattcgcccgttagatgatgaaccctaatttcgtgtgtacagggagcggagaggggaaacaagagaatgctcttgttgcggcgactcaatcgagttcggattgcttccccttactccgttcggcttctgtcagtaaaacctatttcaaatgtcgatgatgcgaagtttcgatctcaggaagaagaagatcagtccagttacgatcagaaaacagtatgcgaagctctcacatgttacagcaacgattggcaaaaggcgttggagtttttcaactgggtcgagagagaatccggattcagacataccaccgagacattcaatcgggtgatcgatattctgggtaagtatttcgagtttgaaatttcttgggctttgattaaccgcatgatcggaaacacggaatctgtgccgaatcacgtcacgtttcgtatagtctttaagcgttatgtgacggctcatcttgttcaggaggctattgatgcgtatgataaattggatgatttcaatttgagagatgaaacatcattttataatctggtcgatgcgctttgcgagcataaacatgtggttgaagctgaagagctttgttttgggaagaatgtcattggtaatggttttagtgtgagtaatactaagattcataatctgattcttcgtgggtggtcgaaattgggatggtggggtaaatgcaaggagtattggaagaagatggatactgaaggtgttactaaggatcttttttcgtattccatttacatggatatcatgtgcaagagcgggaaaccgtggaaagctgtgaagttgtataaggaaatgaagagtagaaggatgaaactcgatgtggttgcttataacactgtgattcgagccattggagcgtcgcaaggtgttgaattcggtatcagggtatttcgggagatgagggaaagaggttgtgaacctaatgttgcgactcataacacaatcattaagcttctatgtgaagacgggaggatgagagacgcgtatcggatgcttgatgagatgcctaagagaggttgtcaacccgattcgattacttacatgtgtctcttttcccgtttggagaaaccgagtgagatcctaagtctgtttggtaggatgataaggagtggagtgaggccaaagatggatacttatgtgatgctaatgaggaagtttgagagatggggatttcttcagccggtattatatgtgtggaagacaatgaaagagtctggggatactcctgattcagcggcgtataatgctgtgattgatgcgttgattcagaaaggaatgttggatatggctagggaatatgaggaggaaatgatcgaaagagggctatctccaaggagaaggcctgagttggtagaaaagtccttggacgaaacgcttgtctgtagagaatagataactagatatgaagaaactctttggttatgtgttcaaaacagacatgaagcaatagagaagcgtccttttggatggagaaatctccccaaggtatatcatctttgccataaagtggctttgtttcaactcaaaaccgaggagaaaacactgaggttcattgagaaatctggttgagttgtgtgtcttaagccaaattccgaagatttggttttgaaagatggtttgtcgcctcctatatgtgttctactacatatacgtaccatttgtaattcactctctaacttaatttttttttgttgttgttccactctgtgacaaccacaggcattttgtggctattttgtaagatcgttaagctcaataaaacaccctacagaaacgatggatgatccatcatggatcacattcttaaaaccattggagaatatggcgttattattgtaatttgaaaaaaattcaactaaagaatacgacttttaatcttagcttacttttgtaaagattatgcagacatgacgtaacaattttctaaaaaaaatcttagttacaacatttttctttagaaaatgccatgacagagcaaaagcaggaaaagttggtaccagatgatcataaatgcaattttccgttacaaaattagagtagctctcatgtcagtattggtggtaattaatgccattctccgtttctttttctaatctccgagtcgaccctgagtataaagtatttttaccaatttcatttcaattttattgtataatcggttttatagaaaaaaatgtgattcattaatttaagttttaggtcacacagccaataagagttaaaagagtaattaattaaggattttaaaaactaagaaaatgaggtgaaaacttaaaacaaaacagaataacaacaatggatggtgaaaatctaaataaagggaacagtttcgtttcatcttctttgtccttgatttcctgaagaagtaaaagattcttattcatacgtttgattgataaacccttttttagagtttcagaaattagaaaccaaacctcccccaaaaaaacaaaaaaagagagagaattagacaagaaaaatagggagaata

SEQ ID NO: 10638 - DNA, 3000 bp, Unknown
  misc_feature (1)..( 3000): cDNA_ID_2716224_gDNA_ID_2213666_Annot_ID_132690 3000 nt of promoter + ATG
attactaatttgtgacgcgatgtcgtttatcttcaggattgggtctgcaatgctgtacacggggcaaaacgagttctacggtagcgtggagaggacgtttatgtacattgtgaaacaagcaactggagttttgactaagctaacgagcttatgggactcgattcaatctgctaaagacattcagctcgatggacacaacctgtttcctcccgagtttagaggcaacatcgatcatttcaacaacatgatcaagatgtctaacatcacttaccccgaccgtgtcgctaaccagacaatccgttatctcaccggagcactaaaccctgtgtaagtaataagtattcgcttgatatgtttcttgcctcacaagctaaatatatatagaagctctgtttgagtatttgactcaaatgcgttttcctcaggagatatgtgttaaatgtgatcgctggtgtaatgctcgcagtcgcattcctcggcctttgtaagtcacaaatcaaaacatatctattttgatctgaagatacagaataatctcattatttttgtttctgtttttcttcttctttcgaaacagtgttttcgttctgtggattgcgagttcttgtctacctgtgagttacacttagactacgttgttatattatcatatcatatccaaatcaaatgtttataatcagtgtttcaattatatcagattggtaattcttggttggattctcgtcacagccactatcctcctcagcgccgttttccttgtattccacaagtaaatgatatttcgtcgtcacttgatctaattcaagattcaatttgtttttatcaaactaatgatgttacttaataaacagtgtggttgcggacacgtgtatggctatggaccaatgggtgcatgacccagcggcagactcagcattgagtcaacttcttccgtgtttagatcctaaaaccattggagagacattggatataacgaagacgatgactgcgacggccgttgacatgaccaatgcgtacacggtcaatgtcagtaaccatgatcagttcccacctaatgcccctttctaccacaaccagtctggtccgctcgttcctcttctctgtaacccactcgaccaaaatcacaaaccgcggccttgtgctcccgacgaagtcctcttagccaatgcttctcaggtacatacattttctcataagtgatacatatgtcaaatgttaatgttaattcaatttgtatatgtttttgtaattaggtttataaaggctatatttgccaagtgaacgcagaaggaatctgcacaacgcaggggaggttaacacaaggttcgtacgaccagatgatgggtgcgatcaacgtggcgttcacgttggaccattatggtcccttcttagctagtattgcggactgtacattcgttagagacaccttcagagacataaccaccaagaactgccctggacttagcattacaagtcagtggatctacgcaggactcgcgtcgctctctggtgcagtcatgttctcactcatcttctggttgattttcgtcagggaaagacgtcaccgatctcaaaccaaaaagtctatgatccagatgaatagattttaattagtggagccagcccattatggactcggcccatattatcacccctttttttttttttttggaaacgttaatgatatatggttttaaaaataaagtcgtacgtgcaaaggaattcgtcaatttttttttatttgttgttttttttgtgcaaacgctcttttattgttttactcggtttattaacttttagaaagtggatagtctgtaaatcaacaacttatttagactattaacttcactagatagctataatagtattgatgtttttttcctggtctaaaaatataaattataaacttttcttttagataatattctacttgtataattatttactaatttcattctatgagaataagaggtgagaaaaaatgttgaacattctaagatacatgacatgagtaggtttttcaataaagcaaagccattgaatttgtcaacgaacgtcgccgttggacccccaaactaaatgtacttagtaattgcgacgactagttggggctagctaggcaccatacctaattgctatttgtgaaattctgacgtgtcggattgctatttgtgcctcgaggccggtgcagaaccaggtgtcctgccgtttcaacttgcaaattattgttttttttccgtcctcagtaggtaagatttttgagtattttagttaaggtccatatgtagcagtcaaaacaaaacaaacaaaaagttaggccccctctttaatttatttttatgcaacgataatcctgtaattgtcggtttttgactctataatgttttttaaatatgccatgggaacgttaagatctatgccaataccaaagtgatgtatcgggcggtccacgcgggacgaagtcacagtcaaatgacctcacgtgtttcaagcacaaaaatcttaacaagacaacaatttcctctcttacatatttgtaccataaaataaattttcaaattaagccaaaaaaataacggaaagtgtttgattggttagtgcttcttataactgtcgaatttcagacaaaaaataaaatagaataggaacaaaaataaaaaacgtaggatttttgtcattagttgtgaataatactaagaatctaactgagacccacttgcaattcttcaagaatttaatatgattagtttcaaaagtaatgctaaacctcttgcgaatcacgctttttatcctcttgagtttttttttaaaaaatagtatgaaactactataacgtatgctttaaatatgttaaaaaatatgacgtcattttgaagatgtttaatgctttaaatagaaacacaccaaacaataaagtgagagtgagtgagtctgattcatctcctctgtttaagcaaagcacttttctaaaatcccacaggagaagagagatcggaagag

SEQ ID NO: 10639 - DNA, 3000 bp, Unknown
  misc_feature (1)..( 3000): cDNA_ID_2716210_gDNA_ID_2213666_Annot_ID_132694 3000 nt of promoter + ATG
acaattattagaaaaatcaatgccttctttggaaaaaaaaaatcggtatgtggctctattaattgaaaacatattttatatttgactttgttttttttattgaaagtgatttgatagcatcgttgaatgatttagtaatatctcccgtaagaatttaattatcccgttagactttttaacagaccagccagatgggaccaacgtgcactgttttttggccggagaatgtataaaaaatattgaagatgcagtgaacactgaccaccattcacttctccacaacttttaatgaccggtttacaaaataaaacatagtactatataattttcaacgtgttagtctgatttttatatttctaaagagaagtactcatctatttttgagctattaatctattacaatttgtgttctgatctggagagtggagagttatttcaaagtaaagtatgtagattgtagaggatctatcgagaatctactcatttaaaatagtttgacgttgtagcaaacaatttttttgtcattgatgatttgtattgtttgtaaatattatttagaaaccaaatcgaatttttagttgaaaattataatctgtttaataagtgataattacatcatgcacatgtacctagtgactcataatgaaacgtatcataatggattgacgagtagttgtctgatattgacatcttaatttataacttcccttttcattgttaatgttccttactgtcttctgattgataataaagacgttgacatgtcaaaccacataattatttgaaaaatatatattatttcttcagattttcatcatttgttataagtctcgataagacagtttttgtttttttaacaattttttacaaaaaacttacgaccataatttagttcaggcgaaaatcagtgaatcattaatcatatttattagtttggatttttatgtgtttttctttttatgtatttgaggatttttcagtttgtgaaaacaaatctaatatgcttatttgatttcttctttatttgctgtattcttaatatatcttgcagagctaaggtaatactcaaattttttttttccacacgtaaaaactcatatttatcagtttggaattactgtattctttttagtagtcctctcactcgccatggcaagaagaaggtttttttttcctttttcttgcattccatgttaatcagtatttgaataaaaaagcaagctaaatcggcaaatgaacttatatccaaataatcaagatatcaatctgtgtaagcattactagaaaagtagagatactcgtgttaccgtgtaaattaaaagaataaaaatgtgcttttcaaaagttatatacttttcttgtgcacccataactttagcaaaagcaaccatcatcattcttgagcaattaaaacaaataatattgatcttcatttggtgccaaaatactttacggtaatgacgtcaaactcgatgtttcttgtcaaagtctgaaagaccaatataaaataacactagacacattataaaattaacatattggttcattgtaattaaaccgtcgaatatatataacgaaaataccaattacgctgtgaataaacaaacaaaatcattttattagtcatcgagtaaataaattcgattataatcctcaatagtcaatatatatatagctcacatcacattatgcgattaacaaaaacaatccaaaacagttaaatgattagaaattaaacgagtctcactaaattattaacgactccaaatcacgagaaggcttaagagttatcatgtcgggagaatttaactgataacctcttccattatctctcaatcacgtgatttttgttcaacgagtaccgcatctcaagaataaaaatggcaatttaggtaaatatttgtcattttcaagggcaatggaacttaaagatgcatttcagaaggaaaagctttgtcgtgttatgagggaaatgtggggacgcagctacttcgctttcaaaccgttggatgaatatcctttaaggttcatcgtacaagatcgacggcactcaccgagggtgtactcatgttgtgacacagaggatcatgtctacttggagtacagctagcagctagagattctgagccgataacgtcgagaattgtagccggctaagtcgtatatgctggtttaaactttaatctgtacttatatataagtcaacgtgcttatcaaaatcagctcccttatcgtgtgataggtgcattgtcttattagactccgttatccgtcaccttcgcatattaaaatcactttttattttttggttttaaattaaagtctccatttctgcaagattttaatgttcgtataaataagcctgaagagagagagagagagagagagaaaacttgttttttttttttccattagtttttttcttactttctggtcgagagaggagagtccaaaaaacccaaatccttggcctctttcaatatcaggagagagaaactgaagctctggcctttgtttctgaaatcgatcgtcttcttcttcttcatggcaagtaacgtatctaggtctttcatttttggtttaatatctaaatcgtagcttttctgggtttttgatttttgtttttgtctcatggaagtgaaaaagatggccattttaagctttatatttaattcggtggacaataataatactaggaagacctaatttttgtgtagcccaattaaacactaattaaatccgccggaatagagacttttggagaattttccggaggatagttgtaaagatctagttatatactgtgtaattaagaggctgtgtctattttcattttttaaaaataataattaaatggaggaatatctgaaacccagtaaattgggatgatttgatggttttgtaaggttatcatcgtcgccattatattgatatgcagatctggtgggtttttctgcatctgacttgatagctttatcggactgagtggcaaaatcaatc

SEQ ID NO: 10640 - DNA, 3000 bp, Unknown
  misc_feature (1)..( 3000): cDNA_ID_2716206_gDNA_ID_2213666_Annot_ID_132695 3000 nt of promoter + ATG
tcgtcatgaagtgataataaatttaaaatctattttttattatattcacatggataggctattttcttgtgggacgagtaaagatggggaatcgttcatagttgagtggaatgaaagcgaaggagctgtgaagagaacttatcaaggattccacaagcgttcccttggtgttgtccagtttgatactactaaaaaccgttatctcgctgcgggtgacgacttctccattaagttctgggatatggacaccatacagcttttgactgccattgatgctgatggaggtctccaggtatgcaaacaaatacctcgattctccctgggaaccgaatgttttcatttgcagccatcatggctctctatgttttgtaggcaagtccacggatcagatttaacaaggaaggctctctcttggctgtttccgcaaatgacaatatgattaaggttatggcaaactcagatggtctaaggctattgcacacagtcgagaacttatcttctgaatcctccaaggtactgaattttgtgctcactggatcttcaacaagcaaattactaacccccaatttgaaatttcttcaacactttatttttcatgtacatttgcagcctgcaatcaacagcattccgatggtagagagacctgcctctgtcgtttccatccctggaatggtacgaaaatcgatactttttccgtcagtttctctatctcttggtctgggtccaatcatcgttgttgatcacttacctttccaacagaatggagattcgcggaatatggtggatgtgaagccagtgattaccgaagaatcaaatgataagtctaaggtatggaagcttactgaagtcggcgaaccctctcagtgccgttcattgagactccctgagaatatgagagtcaccaaggtactaacacatagactgacataactgtacttatatggcttgattctaatgactcaaaacttgagcagatatcgagattgattttcacaaattcgggaaatgcaattttggcattggcatcaaatgctattcatctgctatggaagtggcagcgaaatgaccgtaatgcaactgggaaggtacttatggtctaaaatcttcctttaagatcgccaaaagagttgaaatcatgatgaaattcaatttgagattttgtgtaggcaacggcttctttacctcctcagcagtggcaaccagcgagcgggatcttaatgacaaacgatgtggctgaaactaatccagaagaagccgtaccctgttttgctttatcgaaaaatgattcctacgtgatgtcagcatcgggaggaaagatctctttgtttaatatgatgacgtttaaggtaaaatcccagctacagacagcactatgtctaatgtatgcaaacaatgcttcatctgttacatttaattgtgttgttggctaagcgcagacaatggctactttcatgccgcctcctcctgccgcaacgtttcttgcttttcaccctcaagataacaatatcattgcgatcgggatggatgacagtacaatacagatttacaatgttcgtgttgatgaggttaagagcaagcttaaaggacattctaagagaataaccggcctcgctttctccaatgtattaaacgttctggtttcgtctggagcagacgctcaggtgctgattcatctcatgttttgtaataaagaatccaaatccttagaagtcttagtgtgaatcttttggtttttgtatgcagctttgcgtatggaacacggatggatgggagaagcagaaaagcaaggttctgcaaattccacagggaagatccacgtcttctttgtcagacacgcgtgttcagtttcatcaagatcaagtacacttccttgtggtccatgaaactcagctcgctatatacgaaacaaccaagcttgaatgcatgaaacaggttttagtctttatatatgttcattctctctccttgcatctgagtaacccttatagaagaaagaaatgtctttattttgattccagtggcctgtgcgtgaatcagcagctccaataacacatgccacattctcatgtgatagccaattgatatacacaagtttcatggacgctacaatatgcgtcttcagctctgcaaaccttcgattgcgttgcagagtcaatccctctgcatatttgccagcttctctcaggtgagttaatgaaatgaatataaactagtgcaatgttggatcatgaatcttgagtcttcatgttgatgttttgtgcagcaactcgaatgtccatccactggtgatagcggctcatccgcaagaatccaacatgtttgcagtgggtctgtcagacggaggggtccatatattcgagccgcttgagtcagaaggtaaatggggagtagctccaccgcctgaaaatggctcagccagcgctgtcacggctacaccttccgttggagcttctgcctctgaccagcctcagagatgatctgcttcagtttcttactctgttttttttgtgggggttttagatcttttccgatttattattgttttgtttgtgtggggggaagaaagcattctaacaaggtaaatgaattaatagcttacaagttcttcttaattggttaattcgatgttgcttgcctctgatattttggtcttgagaaatatcagttttgcaaaaggacgaatttgcaattttgcactccgaatctaagcacgaactaaggattgaatgccacgtgcagcttcgagataggtttggatattcgttttgagatacgaaggaagaattactaaggcctatgcggcccacggcccacagacttatatatctacaatgataaatatcttcaaaaatagtaattttgagaaaatattgagaagagacagagaaaaaaaatcgagtgaaaattatctggtgtgtgtatctagaagaagctacagagtgggacgaggtttaaactcgccaatcgccattgacctctcgcttgctttctttaactaaa

SEQ ID NO: 10641 - DNA, 3000 bp, Unknown
  misc_feature (1)..( 3000): cDNA_ID_4266572_gDNA_ID_2213666_Annot_ID_182114 3000 nt of promoter + ATG
tcgtaaaacaatttaatattttatatacaaaatcaactaaatcttaatcacataaaattagcacaaaaaaaagtattcaacaattaaaaaattatcaaatctctatataagttttgatactatattcgaataaagtgtaatattccttttcaatttgtattctttaactaatttaagcgaactaatatatttgctaatcttatacctatcaaaaccgactatcgtttcttatctttatagtatatttgcaagatcttttttggtggatttggataaaagtgcatatcgtcctactatattatttgggaagtacattttaaatgtaaccttaatttttgtaattaattacatgacaatgccattagaaaaatttaatcaaaaacaaaatcttttaatgacatcattaagattaccaaaatcatttaacgacaatattcatctcttaattatagggtttattggatttaaagacgggtcatcaaagatttcctaaactgaagcaaaatatattgaatattaaaatatctatctgttaccaaattataaacaaataagttcgtaaaacaatttaatattttatatacgaaatcaattaaatcttaatcacataaaaattagcacaaaaaaatgtggtacattcgggtctatagtagttttgcaagacttttttggtggatttgggtaaaagtgcattcgggtcatgtagtacattcccctattaaataaatatggtgcactcctatgttattagctaaaatatttagattataatttagagtcatatcataaataaaattaatattaataaaataaatggctttttggcaagacggatttggagggacgtgtttttgaatcaacattaataaaaagtaaaatataattaatccactgtttcaatacgggttaaattattaatttattattttttaataacaattaatatatataaatacttaataataattataaactgtaaaaatataaatattttataaaaataaaatttacaagttttaatatatattacttttaaaaaataaatcatcccgcggtataccgcgggttaaaatctagtttcatttaaacttgttaagatttaaaagtatttgattatttattttgaaatatatgaaaagaaaataaaatataattccttacagtccagacatggaaacaaataaactttgataatctcttcaaattataaattataaatagaaacgttttcatcataactcattcagaaaataaaaaataaaaaataaagaaaagataggggtgaaggaattagcatgattttgattatgatgatacattaagttaattacccaattagatttgaaagtataattttcttgaagcttcaaaatgggtgagtaatataataaaattatgaagcctcgggaaaatgtaaatgaaattaagtagatatgggccagaccaacgatattaactgaataataattgtggactaaatattggactccgtaaaagcccaaaacaaaatataaaacgaacccacacgacacgagttattatcagaaacattactgttacaatgcaaacgcgcaccagtagagcgtatagcgcgtgtgtcgaaaatgcctagtctatatacccaccaaaaacgctgtttttagcctaaatactttattttaaaagaaatcagcgcgtgggagaacccatgaacatttgggtttgtttatccattgttttgatatttatttatttcggttaattccaaaacaaaggattgcttcttcttggtatttttgactaacaaatacttttttttggcgacacacttatgtatagcaaaactaaaaagtatgaattcaaacaaacaaacaccggtataatatgtttacactaaactaaactaggagaagatgtttaatttatgaatgaaaccaaaattggaattattcactaaatgacgatttcgtaaactcagcttaacatttattgacgataacatcataaagagctcaaaatgatattgtactacataaaagaaaattctcttccatactagctataaaagatatttcaaatgaaacaatagtattattggttacaagtaaatcatagtgtacctcttaacaagtcaaataacttaaaaagatcaaaatatgcacaatcattttattaacaatccatatatataactgggaaaattaaagtggcgtaaatttgatcaatttatgtagctagccggtgattataattgaatatacgatgatgttccgagacaagttagttgatcaaaatattaattcatacatatccatccaacatatgttgctattacaatttacatatgataatcttagggcaggcctcataatatatacattaattggtaaaatctggtcaccaaatttacgagcagtagtaatcaatattagtagtagataacccagtttttgtttttttggtctgaagtagataaccccatttctatccataatatctttgtatttaagatacgttttcacgagggccagccgtaaaattgaattaaaatcccatttgtttataagtttatagtaaaatatagtagcttcagacaagtagtactaggaaaataaatcaacttaatagaagaaccagatctgtgaacggagaaagggacatatgagtttgtcaaagtcaacgatagaaacggttacaagaatatccaatgaaagagagccacgtgggagatgcagctgaatttaagtaagaatgatctcataatcttgaccatccaccaataaaaagcttaattaatacatcatcatccaatccggtggagtaaatgcgtagatggatagagaacggtgaagtttccaacaaaatctctgactctgattcagctttctatattcaatcgttcccattatctcattttgtagtttagttttatcctcaacaaccatcttcttcgttatattccttgagataacaacaaagcatcgttcttcacctttaccaaaaagataaaaaaaaagaaaa

SEQ ID NO: 10642 - DNA, 3000 bp, Unknown; identical to SEQ ID NO: 10640
  misc_feature (1)..( 3000): cDNA_ID_2716206_gDNA_ID_2213666_Annot_ID_182112 3000 nt of promoter + ATG

SEQ ID NO: 10643 - DNA, 3000 bp, Unknown
  misc_feature (1)..( 3000): cDNA_ID_3037769_gDNA_ID_2213666_Annot_ID_182109 3000 nt of promoter + ATG
ttggatataagttcatttgccgatttagcttgcttttttattcaaatactgattaacatggaatgcaagaaaaaggaaaaaaaaaccttcttcttgccatggcgagtgagaggactactaaaaagaatacagtaattccaaactgataaatatgagtttttacgtgtggaaaaaaaaaatttgagtattaccttagctctgcaagatatattaagaatacagcaaataaagaagaaatcaaataagcatattagatttgttttcacaaactgaaaaatcctcaaatacataaaaagaaaaacacataaaaatccaaactaataaatatgattaatgattcactgattttcgcctgaactaaattatggtcgtaagttttttgtaaaaaattgttaaaaaaacaaaaactgtcttatcgagacttataacaaatgatgaaaatctgaagaaataatatatatttttcaaataattatgtggtttgacatgtcaacgtctttattatcaatcagaagacagtaaggaacattaacaatgaaaagggaagttataaattaagatgtcaatatcagacaactactcgtcaatccattatgatacgtttcattatgagtcactaggtacatgtgcatgatgtaattatcacttattaaacagattataattttcaactaaaaattcgatttggtttctaaataatatttacaaacaatacaaatcatcaatgacaaaaaaattgtttgctacaacgtcaaactattttaaatgagtagattctcgatagatcctctacaatctacatactttactttgaaataactctccactctccagatcagaacacaaattgtaatagattaatagctcaaaaatagatgagtacttctctttagaaatataaaaatcagactaacacgttgaaaattatatagtactatgttttattttgtaaaccggtcattaaaagttgtggagaagtgaatggtggtcagtgttcactgcatcttcaatattttttatacattctccggccaaaaaacagtgcacgttggtcccatctggctggtctgttaaaaagtctaacgggataattaaattcttacgggagatattactaaatcattcaacgatgctatcaaatcactttcaataaaaaaaacaaagtcaaatataaaatatgttttcaattaatagagccacataccgattttttttttccaaagaaggcattgatttttctaataattgtatttattttaaatattggaatctacaaaacattattttaggtcagttggtcaatgcaattggttagaaaatctgtaaccaatgaaaggaaaatagtgtcaaattatactagtgagtatgttcataagttactaaagtccactaagtattaataaagcgcactatgtgaaactactacaattattattggctatttttgtttgtactacttgttttgtttaatcatggttagttttttaaattttaaaaccaaactttaagttgattaataaataaataaaaacgtagatgagaagggtgttggctaatggctattggttactttccacttatgtatgtcctctcttcttctcttaaaaagcttaattgctttgctattttgatactagtacagtctattcttcaatttatcagcttcttctcttctctcatatcgcggtaattaaaggcgatatactgattgctttctggggagaagttgtcggttgtcttttgccattataattataatgtgaatttttgtaagccataattatttgcactatttatttatttagcccaaataagcacgtatgtatatatagatagactaatttccacgtatccaagacattgccgctaactattttttgttgggaaaatttgatttttgttatatgacgacgacagcgacaccatcaaatttgtttatttatttcggttctcttgttatcccaacgccgcttggattgatatttgtctactatcaaacttcattatacttttgagcgaattaaccaaaagatttgtaatgacacctttttatttcaaaacgtacggataatattttgtcatagaccaaactatttttttcataaaaattagtctatgtactacatatcaaacttgttggtaattcgttggggttggtttctagtcgtcttcccatctcgttgggactaaaacaacattcttttagccactttcactattatataatggaacgaaatgacaagcccgttaaagacccaatagcccaatattgaatcaaaccgcagatcccctttcttcctccaaaattcaggtcacaaacccaaacttctcacccgtatctaaaaagttctcgtggtgtatagtcctaaactagtacacgacagaatcaaacctgtttgaagtatttagcacggatccaaacacgagagacatcccaaggaatctgattctccaatgtttgtctagacataagatgcgttgatggtaaagaagaaacgatacgcacatcagattcacagggttttacttctttttttggtaagattggatttttctctcacccccatttcttattccatgcttcttagatcgttaattgaatctgcatcccgcagtgatcattctttaatttacgaatttgtttttgttgtcttgttgtcgatttttgtcaattttattgtgtaatttaccaagtgtaaattgtgattgaatcgattgggagggcattgcgaggtaaatccatattgtgattttttgtttagtgtctaactagctgtatcgtactccgcataaatcacaggatttttttggtgagaatttggtaacaagaggaaattgttccattgatgacgaagctcctagtgttccattgagaatttttggtttccgattggattattaaagaatagaagaaaaatgttgaaatctggggtttgattttggtatttcaggagacacaagatctaggatttcctttatttagagacgagggattctatg

SEQ ID NO: 10644 - DNA, 3000 bp, Unknown; identical to SEQ ID NO: 10638
  misc_feature (1)..( 3000): cDNA_ID_2716224_gDNA_ID_2213666_Annot_ID_182107 3000 nt of promoter + ATG

SEQ ID NO: 10645 - DNA, 3000 bp, Unknown; identical to SEQ ID NO: 10636
  misc_feature (1)..( 3000): cDNA_ID_2716236_gDNA_ID_2213666_Annot_ID_182103 3000 nt of promoter + ATG

SEQ ID NO: 10646 - DNA, 3000 bp, Unknown
  misc_feature (1)..( 3000): cDNA_ID_3037547_gDNA_ID_2213666_Annot_ID_182102 3000 nt of promoter + ATG
aaatggcggcggctctgcagacgaatatccggacggtcaaggttccggctacgttcagagctgtaagtaaacagtcattggcaccctttagagtaagatgtgctgttgcttcccctggtaaaaaacgatacaccatcactctccttcccggagacggcatcggtccggaggttgtctccattgccaaaaatgtgcttcagcaagctggatctttggaaggttctctctctctctcttgttccctttcttatttaatttagttgctgtttcatttcaattggggactactgttttctgcttggaattgaaagatgtgagcattagaaattggcgagattttgaatgggatttacaatcgtgggttgggctcaaaggccacggagattgcctaatacattgcgtctgtgctctgtatcaggagtggaatttaacttccgtgagatgcccattggaggagctgctttggatttggtcggagtgcccttgccggaggagactatctcagctgcaaaagaatcagatgcagtgcttcttggagccattggagggtctgtcttctctcttttcccactaatcttgttggctcttaattattgttttgggaaatacagtttctcatttagtcattttctcatgttggtataataataacttaaggtacaaatgggataacaatgaaaaacatctgaggcctgagaaggggttacttcagattcgtgcagctctcaaagtctttgcaaatctgagacctgctacagtcctcccacaggtgaccatcctcagagatttcttggttgcctgaactttgtttcttgtgtgaaactctaattttgttgtttttatacagttagtggatgcttccaccttaaagagagaggtagcagaaggtgttgatctaatggttgtaagggagcttacaggaggtcagttttattacttattaaaaattgatcgtaattcttgtctttctcgtgtgacaatatcttataaaatgtcatgtctcatggtaacaggtatttactttggagagccaaggggcataaagaccaatgaaaatggcgaggaagttgggtttaatactgaggtttatgctgctcacgaggtactctattgaaaatctcagatgcagatttccgtggactgattgttaagtactagggtcaaatctaataaagcattttgtatgttcgtcagattgatagaattgctcgtgttgccttcgagactgctcggaaacggcgtggcaagctgtgttctgttgacaaagctaatgttttggaagtgcggttgataattatgttttctttgacttgttttcctctctcttgtttcctgtggaacgaacataacactgaatttttttatatgcaggcctcaatcttatggaggaaacgagtaacagcattagcctctgaatatcctgatgttgagctgtcacatatgtatgttgacaatgccgcgatgcagcttgttcgtgacccaaaacaggtacgtgtactttgtatttgccaaactagtcagctttgatgtgcgacaggtgtaaatccttgcaattatttgattgtttgataaatgcagtttgacaccatcgtcacaaacaacatttttggtgatatattatccgatgaagcttcaatgatcacaggaagcataggaatgctgccatctgctagtctcagtgattcggtatgatataaaataatatgatcttttagtatgcaagcagtatgatctagtctgaacataaacccgccatgtgtaatacagggacctggactctttgaacctatacatggttctgcacctgatattgctggacaggttctaactctatccttcaaacaaacacggtttttgttccctgatatcaaaactagtttaatgccaaaatcaaagagcacaacttgttgattctttgaattttcaggataaggcaaacccattggcaaccattctaagcgctgcaatgcttctgaaatacggacttggagaagaaaaggcagccaagagaattgaagacgcagtgttggttgctctgaacaacggattcagaactggagacatatactccgcgggaacagtatgtttcttgaaccactcttataacatgtttccttttccttaaaaacgtcccgagttagtgtttgagaaacgtttaaacaagcaggcaacaacaaacagtagtaatatttttttgtctttttgtatggggtatgatcagaaactggtgggctgcaaggagatgggagaggaggttctgaagtcagtggactcccaagttccagcttctgtttaatatttgtagaaactttgaagagttcatttccaacaacaaatgttgtaccttgtactcaaagagtctcggttttattagcgatttttataatgtgagattattagagggacttatttgatcgaactgaaacgttgatgtttttttctgagaaataaatatccttgtggagataatgacgtgtcagagtatcactcaaaaagccaaaaattagagagacaaaaaagattcaatctcccccgtagtccttatccggcgccgagtgtggtcaaacgtcgcaagagttttcgctctttccggtgagatctttttcctctgatttctgtttcatggcaagcctacttttagagctgagtttaatcgatgaatcaaggatgtgaatttttgttatttcttgattattcattattatgttcaagaaatctaaatctctgcttgggaactaattcacaatttagacatctctgatgagtttttcctctgttttttatttctatcttatcaattttgtttctggaaattttcatggctttttgaatgttcattgggattgcgtatcttggtggtggtaagtaaaaagtcaaacgccttcgtttttctgcataatctctgagttccatcaaagctctgttttgtgttttcaaggtggacttttcacttgacatgttaggctttgatccttttttgttcacacagatagacaaatg

SEQ ID NO: 10647 - DNA, 3000 bp, Unknown; identical to SEQ ID NO: 10635
  misc_feature (1)..( 3000): cDNA_ID_2716259_gDNA_ID_2213666_Annot_ID_182097 3000 nt of promoter + ATG

SEQ ID NO: 10648 - DNA, 3000 bp, Unknown; identical to SEQ ID NO: 10634
  misc_feature (1)..( 3000): cDNA_ID_2123533_gDNA_ID_2213666_Annot_ID_182094 3000 nt of promoter + ATG

SEQ ID NO: 10649 - DNA, 3000 bp, Unknown
  misc_feature (1)..( 3000): cDNA_ID_3037528_gDNA_ID_2213666_Annot_ID_182117 3000 nt of promoter + ATG
tgtatattttatagtttaaatcaaataaaatgaagataacggaatttgagttagtatgggcaaaaacggttaatggttgtgtcttgtatttaaagatggagactttggaccaattgggacaagttgatggatgtcatatccaagttcattttctcctgatatttttctggtcaggtttagtaatttagcattcgaattccagtcaacaacagattatatatctaaacatagacggtaaaatatactaccgaatatcgaattaggcctttcgactaatactgattttagattttggatgttgttttgacatgttactctgttttctatctaatgctatagagtatacacttactagtgcgcacaacaaaaaacagaataaaattaatctatcatttgttcgtttaagaataatgaaaaaacttaaaacctacacataaaagactgtactttttgaatggaccttctgaatctataatttagatcacaccctttctttttctcatatactaaaatattaatcggaccacacacacccttttgctttgtaaaaatttaaatcgatctcctaattccaaacaacagaacttgttttttttttttttggttttattataaacaacagaacttgttctttttttttggttttattataaacaacagaactttgtggcaacttgtatactaaagtgatgaatatatgtatactacacatacacgacggcaaaatattattatatgaagaacgcaaaactacaaagatgtttccttcgcattatgtggtacataatccaagcacataatagcgtttaaagattaatttatgttttattaaaatgaaatccaaatccagctcaaagactaatgccttggagtctttcctctaaaatccttctagataatttctctaatttcacttgtagaatttcccttttttttgacaaaaatttatttgattcttatttggcttgttgttgtctgtatgtgtgtgtctatctttggtcggccatatttaaatctgtattgatactcgacatctttaaactattaccgatgaccaaagttatatgtttttataaatatagctacaatatatacagatatttgtcgtaattatatatgatctttattaaacttcttaacgcgtgtgacataaagaaacgaaatgttgtctccgtactcaaaagcgtatactcgttaatcaaagcatttttgcttactaatttaatctgtaacgtatggacatttatgtacaatactctatttttcgtagctgtacaaaattgaatacggaataatacaatatttagggaattagtagcatgttccatgcaggttggactagttctagtgtccgccatatgtataaagctgtaaacatctttaacgcatatatttggtttattaaaacaatagttttgtgattactatgacccattcatgtatttgcatataaatgtagtaacttggagttttggttaattagacaaaagatactccgatctaatattttttaaaataagctaattgaaacttcaacgtgggataaaacgggctgacaaaaaaaggttcaacatgaagaaaataactctaactgataaaacggcacggcgtctgaatgactataactctataaggtgacaaaacgacacggtgtcaacatccttaaaggggggaagaagagtcgtcgtgattcgtcgggtggctggctctttgataaatctaaacaataaacgacggaagcaatccgattcttcgtagataggaatagcccgaatagactggtactgggagtgttggacccacttcatcaatgttcgtgtcgatattttcaattctcatactcttctttggtcgcgttcaattattcaaatctcttaacaagtattttcttcacaagaaaattcgccaagcaaattggaaaaaaacgaagaacacacgaaataactagccaaaagagtttaattacttctttatatatgtgatcgttatttatttgcattttactcgtttttttttccaattatgtcgacacttgattaaattagaagcacaaagcctcgaagcaaaccggcaaagataataacatctgccagagctaagtaataaggtttacagttagatgatcgagagaatatgagctttggcaccgcagaaaacgctggccaattacataggaaaatgttcatttgaaaagatatatagctaaacagtatatatgtctcaaaagatagtttgactcgccgcatctttctattaggcactcgacgtcttcatcatatatgcattattattttgcatattaattaatggtagggatcaaattgttacgaagacatgcaatagatcatttggatattcatgcggtcgacatcaaataaaacagctctcgtacatacagacaggataagctcatgaagtttcctttggtatttatttttacgtccttttccatatccattatgatagttatccggtagctgatgtggacttcgtatcttctactgccagtaattgtatttctttttttataagtgcgcggaatatctattttcattcatcctcatcatcatatactaacatcaacttatctacctttttttttttaagggtttgctcgaggtttcatgtcattttttggaaataaattttgacaacatgatttaatgttgaatggtaatgaaataagaaaatcaagatgattcaatactcttcgatatatataaagtgagcgagagggaaagcacagagtatgataaatcaactgaatttagctaataaaacacatttttttatattgatagcgtcgaacagaccaacgacaacacaacggtcaaattaacatggcttaagtcaagcgaggacagaacgtgccaaagccattgaatatattgaatccttttataagcatatcttatttagtaaccacgtgagtcgtgacgatggcttattattagtacgtactacgtaactttgaagaaaagaagccctgaaatttcggaa

SEQ ID NO: 10650 - DNA, 3 bp, Unknown
  misc_feature (1)..( 3): cDNA_ID_3041335_gDNA_ID_2213666_Annot_ID_182092 3000 nt of promoter + ATG
aag

SEQ ID NO: 10651 - DNA, 3000 bp, Unknown; identical to SEQ ID NO: 10641
  misc_feature (1)..( 3000): cDNA_ID_4266572_gDNA_ID_2213666_Annot_ID_132697 3000 nt of promoter + ATG

SEQ ID NO: 10652 - DNA, 3000 bp, Unknown
  misc_feature (1)..( 3000): cDNA_ID_2716186_gDNA_ID_2213666_Annot_ID_132700 3000 nt of promoter + ATG
gactagttctagtgtccgccatatgtataaagctgtaaacatctttaacgcatatatttggtttattaaaacaatagttttgtgattactatgacccattcatgtatttgcatataaatgtagtaacttggagttttggttaattagacaaaagatactccgatctaatattttttaaaataagctaattgaaacttcaacgtgggataaaacgggctgacaaaaaaaggttcaacatgaagaaaataactctaactgataaaacggcacggcgtctgaatgactataactctataaggtgacaaaacgacacggtgtcaacatccttaaaggggggaagaagagtcgtcgtgattcgtcgggtggctggctctttgataaatctaaacaataaacgacggaagcaatccgattcttcgtagataggaatagcccgaatagactggtactgggagtgttggacccacttcatcaatgttcgtgtcgatattttcaattctcatactcttctttggtcgcgttcaattattcaaatctcttaacaagtattttcttcacaagaaaattcgccaagcaaattggaaaaaaacgaagaacacacgaaataactagccaaaagagtttaattacttctttatatatgtgatcgttatttatttgcattttactcgtttttttttccaattatgtcgacacttgattaaattagaagcacaaagcctcgaagcaaaccggcaaagataataacatctgccagagctaagtaataaggtttacagttagatgatcgagagaatatgagctttggcaccgcagaaaacgctggccaattacataggaaaatgttcatttgaaaagatatatagctaaacagtatatatgtctcaaaagatagtttgactcgccgcatctttctattaggcactcgacgtcttcatcatatatgcattattattttgcatattaattaatggtagggatcaaattgttacgaagacatgcaatagatcatttggatattcatgcggtcgacatcaaataaaacagctctcgtacatacagacaggataagctcatgaagtttcctttggtatttatttttacgtccttttccatatccattatgatagttatccggtagctgatgtggacttcgtatcttctactgccagtaattgtatttctttttttataagtgcgcggaatatctattttcattcatcctcatcatcatatactaacatcaacttatctacctttttttttttaagggtttgctcgaggtttcatgtcattttttggaaataaattttgacaacatgatttaatgttgaatggtaatgaaataagaaaatcaagatgattcaatactcttcgatatatataaagtgagcgagagggaaagcacagagtatgataaatcaactgaatttagctaataaaacacatttttttatattgatagcgtcgaacagaccaacgacaacacaacggtcaaattaacatggcttaagtcaagcgaggacagaacgtgccaaagccattgaatatattgaatccttttataagcatatcttatttagtaaccacgtgagtcgtgacgatggcttattattagtacgtactacgtaactttgaagaaaagaagccctgaaatttcggaaatgggttcaaaagtccaaaaacagtttgcggttaaagaagggtacgttattttttttataacttttttttcattttttcatcaaagaaaggtacgttaaagacaaagtgaagacgtagtttaattttgacatgtttagactcattgatattcagaaacttagtcctggaattgtgttgtagcaaaaacaacaacacaacgagagaaagataagataaaagcatatatgatgggtttgtgttgcggatgttacgagaatatgagacatgacacatcatgacatcaatgatatggacaagcatacgatatatttcagaagaaataggatgtttcctccccttgcaagctttagcttctccagtgcattaagtctaattcatcgagctcattgtaggtatacgaaggatttgactgagctaacttaggaaaaaaagattgaaacgaggaatgatttagtaatggtaatttgaccttggttttgtacttcttttaattcataaaccccctccaccgtaaaaatgaaacattagaaatcctaaaagggcagacaagttgatgtccaaaaaaaaagaaaaaagggcagaagagtaaaaacgcgaatgaaagagtcaaagcaaaaaattggtaaaaaaaagcgtgaacggcaggattcgaacctgcgcgggcaaagcccacatgatttctagtcatgcccgataaccactccggcacgtccacctttgctagttgaatcatttgttaaattgaaaacccgtcattttgatctgattttgtactgtatgttgacaaattgaatagtctctgatgatttcgatcaaagagaagccacggggggagcgctagcacttaaaggttcctcgctttcttctcaagtttatagtcttctcctctgtgttggctcatttacatgggtagatttagttttcgagggttttatggcgaagttcgcgatgttctgttaattgcaatgtctttcttctttttttttttttttttttttttggtattcaattccaattttccagtgtgatttgatctgaactcgaattcaaattcagtgctactgagttatgttaaaaccattgtccattgatttttttatgttgaaattgaaaaaaggttataccattcgtttgtattaagatttgtctttcttagggaatgttttacattttttgcagatttgcaccgttttctctctggctttgtgttgtgctagatgcgatgcaatagcaatattttcctggagtttcaagtaactagtggcttaggttcataatagtgtttctttgtaggacgaaagctgtgttagtattctctccactgtaaaggacaag

SEQ ID NO: 10653 - DNA, 3000 bp, Unknown
  misc_feature (1)..( 3000): cDNA_ID_2716182_gDNA_ID_2213666_Annot_ID_132701 3000 nt of promoter + ATG
tggctttgtgttgtgctagatgcgatgcaatagcaatattttcctggagtttcaagtaactagtggcttaggttcataatagtgtttctttgtaggacgaaagctgtgttagtattctctccactgtaaaggacaagatgtctcagaagcgaaatcttccttcttggatgagttctagggatcccgagattactccgagtaagtctcattgtaagaagcctaaggatgaaggaccaaccgaagagcacaacagtagaaatgccccttccaacaagtcagaacacgccgagccaagttcaaataccactgaattctctaaacttatggtttgtgtgtgtcttcatggtcttgttgagactcaattatcttaagctgtcatgttagtttatatgcttttgtgattgagttgaaggttaaactatgcaggaaggcgttgtttttgtactttcgggctttgttaatcctgagaggagtacactgaggtcacaagccttgacaatgggagccacctatcaacctgactggaacgctggctctaccttgttgatttgtgcttttcctaacactccaaagttccgtcaagttgaaacaaatggtggaacaattatctcaaaggttacctctttgactcttcttataagggattgtgtgcggatttgaatttctcctttttgctgatattttatatgatttcactgtctccaggagtggataactgagtgttatgcgcagaagaagttggtagatatcgagcaataccttatgcatgctggaaaaccatggaggaaaagcagtagtccccaagatgctaatcgaggtaaaaagaattatattggaaaggctttagatagaatctccgttttaaccatcctgaggttcatcaaatcaccttgtttttacgtttatgacaagagaaaagcttttcttattgcactgcttcactccgatgtttagttgactctgtgaaccttaattgattgtattcagaaaagagagaacacctgtctaaaaaaccagagaagcaagtagagaaaaaaacagaaacaaggggaacaccatctacctcatccaaggcatgtttaaatctgatgatttggttaaccaaaacgaaccgtattttgctccaatcaatggtctatgactgtttatttccatatgttcacagaatagatcagcttgcaatcttgtgaaagagccattttttgttacagaggtgaagaaatgggccagggatgacctaagtcaaaccatctcatggcttgagagtcaggaggaaaaagtaagggaattaatatgctctttcaaaagacatgttttcttgattgtatgtttccgttattctaaagccattgtaacagccagaaccaggcgaaatcaagcgaatagctgcggaaggagtcttaacctgcttacaagacgccatagattctcttgaacagaagcaggttaatatctctgaagtctgaacaataatagttgccgcctgtgtacatttttggatttgttaaactttgatcagtttctttgagaagatcattggttgaatttattctcgaatgttcttaattttaggacattggatcagttacagagctatggagctttgtccctcgtgtagtgaaggagcttggaaagatggaatcgtcttctaaaaaggaaaattcaacagcatcaaaggaagaagtttgcaaacaagcaaagtcgtggaaaaagatctacgaagctgagctagcaaaaccgggcgaagatgaatcgacctctcgggttgcttgtggctatgacagtgatatgaccgttgagatgactgaagaagagatcgaacttgcttataggaacgtttctttagagtgtctttagatcaaacttgtttcattttgcatatgatctcttaaggaattccaagaattcttgttatactcggtttgttcggtttgagtaggatgttattactgataaaaatttgaaataatccggtctgcttggttcggaaagaatgtttctaattagaatttatttatgctggtttggattcgattgagagatgtaatcggttgcaattaataagtcggtttgatttgatactttttagtgtcgattgacgatgaatttgatcggttaatacaaatttgatttggtcaattaggttcagatgtctccagttttgaaccggtttggttctatccaatttaataaccgttttgtaatatcagacaaacgaattgaaaccggaaacatgtaccgatatggttaggatcgaagaagattgattgaagacaagaccctaatttatttatacccttattgggttttgtcttgtgagagttgtgcctttctttgtttcgcagtagggttgaagcggatagtacgccacctctatctctctctcaccctatcgaactcgcgaagaacatcttcttcttcttcttctccgtcttcgtcttcgcgagctctctcagtagcgcaataaaatgggggcttcgcttcctcctaaggaggccaacctcttcaagctcatcgtcgtatgttccgattccctctctttctttctcagtttttactttgtcttaaacatgcgatgtgatgttcctggtcagcagaaattggaatacgatgagttttatctgctctattaaaccctaaattaagttaatcgtcaatgtgttgggtcaatagaaaaattcgttgacatatgaagtaaactgtgcggagttgtggttccttaatgtgttaatttgatgtaccaagttcttagcttcagttacttttgactatcggctattattagacctcgattgcttctgggcttttttagtcgctcagggattcgtagtttactttgaagaacttgaaaaccaagctttatcaatatatatatggtttcagcatagattttgggtttaaccattatattgttcaacctgctttgaatagttgacctttttctttatgtaattttcgcaagtaagtacatcatatatagttattctgagtaatcttata

SEQ ID NO: 10654 - DNA, 3000 bp, Unknown
  misc_feature (1)..( 3000): cDNA_ID_2716338_gDNA_ID_2213667_Annot_ID_132702 3000 nt of promoter + ATG
acttatagacatggttttcacttatcataattaattgtaactttatattattctggtatgtgtgtttgatgtaacttggagctagtacctaggaggattaagagctgagtgcacaagtgtataaacaaagtgattcagtcgttggaataggtatgccaaatgttaaagatgagcacataggttaatctgatagagagggcaaaatttaggatcaataataaagaagagaggccaaggacactaggaaatgagcttgagctcagcaagctctttcatggatgccatctttggtggcaaagcaacagggatcatatcaagacggtttacaaggatcgttggcttatcaaactcttttctaaatcaagccaaaccaagaatttaccaaatttgacattctttaataatttcttttaatttttaactgattgattctattaaattttcacattagtaattataatagatattaagtatttttgtaattttaggccattacaacgcatactttgcagtttgcaaataatttgacttactaaacgttcttcaaatttgatttagccagttgcatacatactttgctatttctttcctattttaaattgtgatagaaaaatattgaaaacgtcccatgggctctggacttatatcatacattcatagtctaaattttttaagacacaaacaaagcccaagggcccgaacataatacacagtaaacaacactatacacagtacaacgttcacgaatcaaatttgtgcttacaatcatatttacatcatatatcattatcaacatcaaaagtacttgctttttttgtgttttaaattaatttgaaagtagtacaacatcaaaattgaataccaatggtctttgccgttgaaaattttaggtgtatgaacttcatactatgaagagttcaaatgaaaatttattcaaacgtgtcttgatatagtattcaaaaaatcaaaggtaaccggtacgttgagtttgacaacgtacgtattgtaaccaataaaaatattggtatacagcttttttgtgtggtcaacttacatttttcatatttttgtatatgtttgactttgtggctatttgcgagttgtaatttcgctgaagtcaaatcgactgagtagcatggcgtttgttcatgaagccggagacaaaaccctgagacttaaccaatataatacgaccatgctcccgctacatctaacaaaacaactggtcaatataattatagaaataaaaaaattaataactagtaattaaaagtctaaaaactttaacgaatttcataaagtaggaataacataaagcgactaatcggcctaaccgaagaggcggcgggtgagcatgcaacttgttgtaccaaaatggtggctctaacgacttagggatactcgttcttgcttggaagctctacaaagaaaaaattatgccttctcaaaagtgtgaagattgattaaacctttaatttgtgaattaagttatgcatagatacagaacattgcatatttgatttgcatacttgatatggaagaatttcttacaagaatcagataccttgataacttttaaaataagacgaaatattaatcagagaaaaaacgagatatatatgaaaacaaactgaaaggtttttggacatttgaaacgtcatcttgtatgcatgaatgtatatcatcttagttttatgatttatgacgatgggtacatcacgaatataactttgggttctgattagtgtttgcattatataacatcttaatacaatttttttgttttaaacttgaaagggataatatattaaataaaaggggatctagatattattgattcggagaaaattataaagtaaaatggattaataacacaatttacaaaaacattaattgtatatacttaaccaaacggtaaatctaccgtataattgatctgattgatgatatcatctcataaatcaacccacatgttatgtgtaaatataacttattgatttctacaagaaaaaaaaaacaataatcgatttcgaaacaagctttttcttatgaaaaaattcatgtgatttaactgattatactgatagcactatccgacatgatcatctttctttgacgatcacaagatataatcaccatttccggttacttttaaaattattttaaagttttattcgtagatatcaaatggactgttttattaaactatcacacaaaccgatcttcaatatccgatgttcgaattatagatttacttcacttgtggtgttttttttatatatattataaagtaaaaggcaatgtcaactttattagacgataacgggatatgatcaccatttccggaaagatcaggggtaatatttgtcattcaacaatcaaacgagaatccgcgagtccattatttaacactttctcgtttgcttccttaacgtttttagacgcgttcgtgtctgactcggaactcagtttgactcaaactagaagatttttttttcttttttttcgtaaagacctttttttattttattttggtttgaaaaaaactctaaatcttttgctaaagcaaaatatatggtgatgcaagtctttcttttttagaaggtagcaatatttcttttgttttgagtaaaagtgttggaaagttaccttacgtagttacgttgaacattaaagtgtccgtattattcagaaaatctaacaacaagttttgaaaaattcgcgttttaatttttttgttagcaaagttataaaaatatgattgacgaaagaaaaacaagtaacaacgaatattccaattaaaaaaacgtgtggacggcgaaaagctctctttcggtcttcccttttgctctctctttctcaaggcatataaatagctgtcacctgccgattattatttgtaatcagaacgcaaccaaataaagaaagctctcaaactcagtcttgaagcttcaactttatatctaccatatcatcaactaactaattctttttaaaatg

SEQ ID NO: 10655 - DNA, 3000 bp, Unknown
  misc_feature (1)..( 3000): cDNA_ID_2716330_gDNA_ID_2213667_Annot_ID_132704 3000 nt of promoter + ATG
ttttttaatattttttttgtgcaccggaaagtaagaatgatatttaagaaaatataacttgggaattgcatggattaagtctgggggagccggtttagtgtaatttaatataggtcaactcataaactggatgcatatatatacagtatccaaaaaaaaaaagatattacgtaatatacacataattcacatctaaaagtaagacattgacgtgacttgacttatgatgcataaaaaatctgcctggagacaaaaaaacaaaacaaaacattggtctcttgagtgctaaaatctaaaatgtatttatttagttcactagttctatgcgctaaatgggcgcaacaccgaagggtccaattgatattgtattaagccacgggcctcagtttgatttgatctgttgatcatttaaacaatgataatgggcctgggcctctgagagccagatcgagtattttatgtatatgtatcacatgttttagttattttgttgatatcatatgttagctttatcatctacttataagtgttggtaaataattaacgacatacgagtaaattataacacatctataggagaaatataatatacggatataaactagaaacatggcaaaaaaagacatacttatataagcataaaacaatttaattagtttgattcataagcaactttagaggaaatataaacttgagattattataataaccttgatcacgctttcgagatacttacaagcataaataatataaaactagttaaaagttttctcaaaattattatattaaacaaaatgagttggtcatgacacgcacattcatgtcgtttctcaaatgattgtactgagcttgtcagttgatgatacatatagttgaaaataaaatgttattataacttatgagtgtattgacttgaatcatcagaagataacaaaataattaattaattatatcataacgtagaaaaataaataaaattgagatgccagcagcaagcagtgttgtggttggcccgacgccgaatagttagtggttacaacttcattttataaataaggtaggaccgactcaaatcttagtggacctaaacctaaattcagtaattaaacaaaaactttgcccaattttcattaatccgcattactaatggaaagcatggcagacaacacaatccgttaaatcagctttttccctcaaccattaattaaaaaagctaaccctatattttaattttagtttactttgaatgaatctatttttgtgaaatactttggccaaattatgcaaaccaaatttgaaaccagtatgtgaaattgaatgatcaccgatccagagagctagaaatcagaatatacgaataatcgattaaagttgtttgtttttgtatgcgataaatgtgatttattgtacatggcctacatgtccaatgattttgttcgacgaatttatattgagcagtcgatcgtggtccgatgtcgacgtggagagattctgtagagtttttacattatttatttattgaaataaagtgataaatagtagtcaaatgatatttatactttactttcttacacataaaagtatatatattgaggtggtagccgaaatatccaaatccaagtccacactaatttatagaagctacatttgtcatgtaaattctaacattggaagaaaattaaatagtggtatagttggacatttttccctttttaggagtgaatgtaaatatacatggacattaaaactaacgtgcaaaacgtttttttggataaacttcaactcgtaatattttaaaacaaaatgatggagttattaagcaaaattacagaactaaactgtggaatgtaagaggttcttattttatgatcaaaacaacataataattgaacatcaatcatactgtttgtgaaaaaatctttagtttgttcatctcttgaagaataaatacattgcgagtaaaaacagagatgtggacgttttggaacgccatggttataaatatgaagaatttatgaattatgatgcttcagtgaatattcaaaccacttgatttgatcgatagaacttgaaaaatagaaaaataaaagtgggtgatttaaaggaagcataaccaatggagagaaaatgatagaactattcatcaaactgtcgaatttttgggttgatttgagagtgtgaattctaaaacaagaaaatgcgtgaaatattatgtctcccgaaaattctgaagtcttcaaaacattcaaaaaaaaaggtaaaacaaaaaaaaacaaaaacaaagcagttataagttctaacaatataaaaaagatgactagatttctattagatttcgacaaaaaaaaaaaaaaaaaaaaaagatttctattagattcataatttgtagtgttaagagattcgtctaaacagactaaatctaataacacatccactaacaaattcgcgtatgaccgtaggataatttgagccgaagcacatttgcttagtaaaaattgaatgaaccacaacctaatttatgtatttttaatgtcgttttcgtttgtagaaaaaataattttgacccccaaaaattatattctttatcaattgcaaatttcaactcaaaatgatacaaaacttccacacaaaaaaaatgttagttatttacttttccaccaaactattattgtgtttaaagtagaaacattatttagcttaaagttgaaactatttatactacccttgaaaagacaagaagaaatctactattccataaaaaccaataaaaaaattatctataaacaaatccgtgactgttgtggcggcagggatgctttccacgtgtacataaaccattggctacactatcccacttattaaaatctttatctcgccgttcctttcaccggccgattttaaaatccccctttaaatacggacctgataaatctctctttcactttcttcattttcgctctcaccatcgccggtaaaatctcgccggagaaaacaaaaaga

SEQ ID NO: 10656 - DNA, 3000 bp, Unknown
  misc_feature (1)..( 3000): cDNA_ID_2716328_gDNA_ID_2213667_Annot_ID_132705 3000 nt of promoter + ATG
ggggaccaataagatatgcatgtttcctccaatgatgttagttcatttggtaacatgaatcgctattggactttcataactcccttagattatcttaattgatatattttatatgttgtataattgttttagaaccaacattaatggatgcatatactagaatgtatttattctaattatattaatatatcacacctatatatctaattatatatctatctatctataaatattataataataatatatttgattaacatacgttgttttttaaagtattttatacgtatagcttgtgcataaactatgatatgtacctagacggctagacccgttcagcaccgcgtccattcgaatttggactagacaatcgacccaccctatacataataatttgttggttcaaaaaatctcttggattttggtgcttaatttgctcaaaatagtactttggctacactggctagtgcatgtggaaactgatagtagccgttgaaagtcaacctgacccctttgggaaaaggattacaaacttagacccaccaaacctaacctttttaccttagaatacgtgtctttctcaccataattagtttgtttatctctagtaagaattggaactacaaaagtagtttatgtaattaacaaaaacaatgctcgtttgtttaagcaaagcgggggatgggaaaaatgacgtggagaatgtcgattggacctgagttcacgtgattgggagtggtgcggtgggctcaactctccgatgataaagcgaaactgctttttgttgctttccttttgtctcctttttttttcttccagttctctcaccctattttgttcctcatccttatttatgaattttaagataaaaaaatatatatttaagtaattaaaatgtcgattttttttataagttcatttgaattttttaggtttataagtaaaaatcaattggtcatgaatagattgatttaaaacgaaaagaaaagaaactaaaacgtattaacccttgtttaaatacctagttatatacaagcaaatcttcaaacgatattattaaagggatgatgcattagataaaacaaattactagcactctagcagtatcatcaatagtttatggtaataacccaaaccgttcaaccattaaaaaacgatattggtatatagatgtgcacaaacttggtcaacaaaagttcatgtagtcaattataaatcggggattagtataaattttcatacggctttgtattctatcgtggcaccgtggtgtgtaatgtaaagatgattagataagaaatgtgttacacgcccacaacatatgattcaattatttgatggaaaatatagataaaatgtatagagaaaaagtactagaagatgcgaaatccagaaggtaaggggacaatggcatgagttccttcgtgggatttgctttcttaatttcactctttctttctgtctctttccctcttagatttttctgaaattctctagaattttatattagctttagtgctttacataatttacatattatttagttcttttgtcaattagaattacttgtggatcaaactttaatgagcaaatatttctggtcaataaaacgcttcgcagtaagaggtcacaaattaaacccattttttcatatttatattttttgacgtttgatgtgtacggtaagttgaaacttgaaagctatattacaaacttgatttcccatattccttttcatgcatctactattactaacctagctagcaaataaaatgacatgtagcatattggttggtttataatgcatttgttgttactctcgagatttaaactcatatatacatttgttgacaaaaaagtaactttaaatagattttttagattagcgcttctaagttataactatacactgatttctagtgtaatttatgcattctagttctatatacttaatagtaacttttatacagtatttgtgtaagtagttttcaagtgaatttttttctcaacatatacaatgtatattacatataatttacgtgcaccttttaaaaatgaaaaattcgacgaaaatcacacacaacaaaatgtgtggaagcctctatatcttcgtgtcagcatagtaaccattcaaggacgatacaatttttctagggattcaatataatttccctctcctcttatagatagtcgaaaaatggtagaaaaaggaatatttgagactgtttgatgaaacgaagtgccaatatatgaattgtgatcaaagccgtgacgttatctccaatacaaaaactaatattcttattgtactccattaattaattgagctataatacaaattaaatacgtacagaagaatgtttctttgggcctcgatcgtttgcatggggataggtgcgttaatatgagtgctacgttgtgagctgtataaaagaagagtgtgggaataggttttatctgaacagaacttaaccaaaacccaaacaaattgaaagaaaaaaaaaacttttttccttcttccttgatcctttatctttttcgaagaagtgaatctggacgaagaactaaggccgccaattttggaatttgaaccatcaaattcatcaacaacaaaaaataaagatcttaatctttgaatttctacttgtatttaagcttcttgattcaccttaaacccgagttatttcatttctttttccacctctttctttgtcttcttcttcttcttcttccgggtcactaagacatgaaggttcgtttaatcactcatacgctctggttcattgatttctgatcacataatgtgttacattacttattcataaatgtttttttttcttttcagtttttcgggtggatgcagaacaagctacatgggaaacaagagattactcatagaccaagcatatcctctgcttcttctcgtaagttcaagattacgtattcgttgaaaacaaaaaatttgattaccaaaactgttgtccacagtccacttgagac

SEQ ID NO: 10657 - DNA, 3000 bp, Unknown
  misc_feature (1)..( 3000): cDNA_ID_2716324_gDNA_ID_2213667_Annot_ID_132706 3000 nt of promoter + ATG
atacaatttttctagggattcaatataatttccctctcctcttatagatagtcgaaaaatggtagaaaaaggaatatttgagactgtttgatgaaacgaagtgccaatatatgaattgtgatcaaagccgtgacgttatctccaatacaaaaactaatattcttattgtactccattaattaattgagctataatacaaattaaatacgtacagaagaatgtttctttgggcctcgatcgtttgcatggggataggtgcgttaatatgagtgctacgttgtgagctgtataaaagaagagtgtgggaataggttttatctgaacagaacttaaccaaaacccaaacaaattgaaagaaaaaaaaaacttttttccttcttccttgatcctttatctttttcgaagaagtgaatctggacgaagaactaaggccgccaattttggaatttgaaccatcaaattcatcaacaacaaaaaataaagatcttaatctttgaatttctacttgtatttaagcttcttgattcaccttaaacccgagttatttcatttctttttccacctctttctttgtcttcttcttcttcttcttccgggtcactaagacatgaaggttcgtttaatcactcatacgctctggttcattgatttctgatcacataatgtgttacattacttattcataaatgtttttttttcttttcagtttttcgggtggatgcagaacaagctacatgggaaacaagagattactcatagaccaagcatatcctctgcttcttctcgtaagttcaagattacgtattcgttgaaaacaaaaaatttgattaccaaaactgttgtccacagtccacttgagacatgtgcaaaattgcaaatatcattcctaacattcttctttccattgattggctctctgatatttttgttttttcctatttaaaacaagatcatccgagagaggagtttaacgattggcctcacggattactcgcgattggtacattcggtaacaaaaagcagacaccacaaacacttgatcaagaagtgattcaagaagagacagtgtctaacttacacgtggaaggtcgtcaagcacaagatacagatcaagagctttcttcctccgatgatctagaagaagatttcactcccgaagaagttgggaaactacagaaggagctgacgaaactcttgacgagaaggagtaagaaaaggaagtctgatgtgaatcgagaattagcgaatcttcctttggatagattcttgaattgtccttcgagtcttgaggtcgatagaagaatcagtaacgcgctttgtgatgagaaggaggaagacattgagcgtacaatcagtgttatcctagggagatgcaaagctatttctacagagagcaagaacaagacgaagaagaataaaagagatttgagcaaaacctctgtttctcatcttctcaagaagatgtttgtctgtacagaaggtttttctcccgttcctcgccctatcttgagagacacgtttcaagaaacaagaatggagaaggtactactactaaataaagttcacaaccacgattttgatatcaattattttttctatgtctctaaccatttacactgtatatacagttgctgagaatgatgctacacaagaaagttaacactcaagcttcatcaaagcaaacatcgacaaaaaaatacttgcaagacaagcaacagctctcgttgaagaacgaggaagaagaaggacgaagcagtaacgatggggggaaatgggtcaaaacagattctgattgtgagtttctgatctttggatttcttaaaaagattaaactagaaaaattaatacatcaactgattccatttgcttcttctttaatttgcagtcattgttcttgagatctgaatatatggtccacttttcctttttcatgttctttcaagaaaatacaggtaaaataattgacctgatcagtgaatctttgttatattagctttgctcatagtactgaatcttatactaaatattctatgttttggcagatagagaatcttcacaatatcaagacaatttctttttctctctgatgaaaagtttttgggtctctctatctatctgcagagagcccatgagtccctttttttgcatggttgggtccataaaaccaaaacatgttttgggaactaaacatcagacatcgtacatgagatatgtatatgcatacatacatgtgtgtatatgtaaagatagatatatatgcgtacatgtatgtagttttgtattttcaggtggataacctttggtttctagaattcctgtctctgtctctttttttttttaaaactcttttttgtatctttcatttttacatggttttgtttcttcatgtatcacagaagagaactattcagattaataaatacttttatcgtagccttgtaaattattgttatcaatttatcattttgtaatctttgataggaatatcactaaaaccaaataatatccgtaaattaatttagaaactatgagtgtaactatttaatatatagaagtaaaataaacactaaatgagaatataacatttaaaaaaaaaacaaatttatataaattaaagctataactattaactataaacccattcttcaaatataactattaactatatttggtactacgtacttcataaaatgaaagtaaaatccagttttgatggaccatatttcacaaagcaattattggacacacgaacgaaggcccatcctaaaatcgaaatatataaaagttttgttacttactaaagtgtaaccctctaattaggctagaggcttcacttggaacacatgaacatctggagaatgatcaaggagcaatctttaacagccgtccgatcaaaccgacccatttgacacatctcagctctcactgacttcttcttcagtcatcagctctctttctcctctctttcttcagatctctctgcaacgaattgggtttaca

SEQ ID NO: 10658 - DNA, 3000 bp, Unknown
  misc_feature (1)..( 3000): cDNA_ID_2716274_gDNA_ID_2213667_Annot_ID_182150 3000 nt of promoter + ATG
cattttcttggtagacttcatcagctaaaagaaccaaaccctcttgcttgcagaaattaacaatgtcacgctggttttcttccgcaagaacctaaccagaataagaacgcaagattagaagaatgttacattttgttaggctagtcttgaaaatctgtttgtacctgcccagttgggttaccggggtttatgacaaccaaggcccttacagagatgcccttggacctagcttcctctagttgcttcttaaggtcagatatttccagtccccatcctgttgcttcatcaagatagtacggaacctaagaagtacaaatttcaaaaacttgtaccaaaaaacaacattactccatgatgattatatgaacataccaaagatccaccatgaagggcaattgaagccgagtacaatggatactgaggaatcggggaaagaataccatctttctctgagctcaagagaagttgcatcatcatgtgaacctatagagtaaaaaacaccaaaaacacttagcatgaatcctttaaaagaacttactctaactctatgagataacgttttcgttttgattgttaccgctggacttgcaccatcagtcaagaaaatatcatttggatcagcagggaaaccatcacgtgcttcgattccagctgcaattacatcacgtaaacccttgataccctgaggcagaacaaaaaatgaaacattcagcaacataagaaccatctcaagaaagggtttaggacttttaactagactctaataacaaacctggctatgactgtaagccccagttgctcttccgggaatatggtccaaaatcctccatgctcggtcaattgaatcggtactgatagcagagtagaaatcaaatgttaagcaatcttaaaccgtgagcatacatgtcctaaagctgaaatatagcaaggaaaacctcacctgaacaaaccatgggtttcagactcatccaaaagacttgcgtggtcacacaatgcgagaacctgaggcatatagatgatagacgttatatctctgtggctgatatgacaaccaaactagtaccaaaaacattcacttacctcacggaagaactttataggcagctgaccaagagattgaggattcccaatgttgcaatagattatctgccaaaagtaatgaagaattctaagttccttgcacaaagagtttgagaacaggtaacatcaacactaaactaatcataaatccgtcaaaactgccgataaagaaagagattttacctcatcaaagggataagcatccttattagtcttcaagtcttcttgtaacttctgtaagatggaagcaaaaagcaaacaaaaatcaattagcattaaaaacaattttacagattttgttcttggttttacaagacaaagcacatgcatctctgacctgagcaatgttgacaatttctcctcgaacagcatactcacatttcagaacctgttccccggaaaagaaaaaaaactcttagttaacaataaaaccaacttctctgtaatataaagtacaaagaagttatgcaaagcttgtcgatttcatcgttgggaatcacaacgagaagcaaaggataaacctttggcgttaaatcagacaaccacagtaaaaaattgaaacttttttactaaattagaaacaaatccagatcaaccctgaaacccacaattcaaaaacgcaataaaccagctagagaattagaaaccgaccttgggattgatggagtcaagagtaacgggaagagaagaagtggaatcagaagcagacatctccgaagtagaagagaagaaacgagacagagcaggaggagaagaagcaaggggacgaggttgaggagagagaaagcttggacttttgtggtgatgttgacgacgagaatggtcgacgagacctttagcttggttaatcaagaatctccgcatctgtgaatcagctttatactaggaacgtgctctttaagccctaggattgaaaattctctcacgaggaaacaagggtcccaatatccagtgccttgcacaccgaattttgccttgtcctccacgctcagaaattgctttttcgttttttcttttcgaaaatctaattgatgaagatatttgtaggggttttttttaggcggctaattttgttgatttatctgttaaacacacgactaatcccaaaaaaagacatgtcttttatcaaaaaaagatgtctgaagtctatcttccgttgacttaattatccaaaaggaccaaaattgaataatccaatcacagtcgtaatctaatttggggataaatagatacttataaaacctacagctaatttgaaagttataaatttttagaaatctctaaatttaaataaatcacaacaacatgtagcagcacattgctaacgatgaggttttttttgggctacataattgggccctaaaaaggtcggtaaaatcgtgatttaaagcccattatttgtttatatccacgtcaacaaaacgatatcgtattaggttggacgagaataaaaccctaggaattagaaaatttgtacaacgtcaaaacatcgaagattttgatccaacgtataccaagagtttcggagacgacgtcgttttgtctctgcgccgcgttcttagtctgagctcacgcttgttcgtttctcctctaacgtcaactgtgtttttgcatcctcaaaggtttgtgatacaccttattgtttctgttcttttgtacaagcttcacatggattagtgtaaagtcttagaattgggactcggaatttattgttatgttttaggttattcaacccagttatggtatcgttttgaagtagaggtagaaaccctaatttttggggtctgtaaatttggagaaaaaattgaacctttcccttttttgttatattgtgtaatttgggactaatagttcttcgaagctgagtttttttgtgtgtaaattttgtagggtttaacatagttggggctaggaattttc

SEQ ID NO: 10659 - DNA, 3000 bp, Unknown
  misc_feature (1)..( 3000): cDNA_ID_4268705_gDNA_ID_2213667_Annot_ID_182147 3000 nt of promoter + ATG
cagggttgatctggatttgtttctaatttagtaaaaaagtttcaattttttactgtggttgtctgatttaacgccaaaggtttatcctttgcttctcgttgtgattcccaacgatgaaatcgacaagctttgcataacttctttgtactttatattacagagaagttggttttattgttaactaagagttttttttcttttccggggaacaggttctgaaatgtgagtatgctgttcgaggagaaattgtcaacattgctcaggtcagagatgcatgtgctttgtcttgtaaaaccaagaacaaaatctgtaaaattgtttttaatgctaattgatttttgtttgctttttgcttccatcttacagaagttacaagaagacttgaagactaataaggatgcttatccctttgatgaggtaaaatctctttctttatcggcagttttgacggatttatgattagtttagtgttgatgttacctgttctcaaactctttgtgcaaggaacttagaattcttcattacttttggcagataatctattgcaacattgggaatcctcaatctcttggtcagctgcctataaagttcttccgtgaggtaagtgaatgtttttggtactagtttggttgtcatatcagccacagagatataacgtctatcatctatatgcctcaggttctcgcattgtgtgaccacgcaagtcttttggatgagtctgaaacccatggtttgttcaggtgaggttttccttgctatatttcagctttaggacatgtatgctcacggtttaagattgcttaacatttgatttctactctgctatcagtaccgattcaattgaccgagcatggaggattttggaccatattcccggaagagcaactggggcttacagtcatagccaggtttgttattagagtctagttaaaagtcctaaaccctttcttgagatggttcttatgttgctgaatgtttcattttttgttctgcctcagggtatcaagggtttacgtgatgtaattgcagctggaatcgaagcacgtgatggtttccctgctgatccaaatgatattttcttgactgatggtgcaagtccagcggtaacaatcaaaacgaaaacgttatctcatagagttagagtaagttcttttaaaggattcatgctaagtgtttttggtgttttttactctataggttcacatgatgatgcaacttctcttgagctcagagaaagatggtattctttccccgattcctcagtatccattgtactcggcttcaattgcccttcatggtggatctttggtatgttcatataatcatcatggagtaatgttgttttttggtacaagtttttgaaatttgtacttcttaggttccgtactatcttgatgaagcaacaggatggggactggaaatatctgaccttaagaagcaactagaggaagctaggtccaagggcatctctgtaagggccttggttgtcataaaccccggtaacccaactgggcaggtacaaacagattttcaagactagcctaacaaaatgtaacattcttctaatcttgcgttcttattctggttaggttcttgcggaagaaaaccagcgtgacattgttaatttctgcaagcaagagggtttggttcttttagctgatgaagtctaccaagaaaatgtttacgtccctgacaaaaagttccattctttcaagaaagtggctcggtctttgggctatggagaaaaagatatctcgttagtctcgttccaatcagtctccaaaggtaaaagaacaacttttactgtccaatgcttgtcatctaaaaaatggggtttttgtttttaatattcttctgttgataggatattatggagaatgtggaaaaagaggaggttacatggaggttactggattcacttctgatgtaagagaacagatatacaaaatggcttctgtgaatctttgttctaacatctctggtcaaattcttgctagccttgtcatgagcccacccaaggtaacaccctagttctctctaatcggttttcgctaagttcttgcaacagattatgactaaaaagtctaatattgtatttgatcagcctggtgatgactcatatgactcatacatggcagaaagagatggaattctctcatccatggctaaacgtgcaaaggttagtcgaagattacaataccctctaacgacatttttcagtctctttgtatataatgtcacaagcttgaaaatgaacttgcagactttggaagacgctctcaacagtttagaaggtgttacatgtaacagagccgaaggagcaatgtatctcttcccgcgaattaaccttcctcaaaaggctatcgaagctgctgaggctgaaaaaactgcaccagatgcgttctactgcaaacgccttctcaatgctactggtgtagttgtagtccctggttctggctttggacaggtaaaatataaccaaatcttcataactttaaatgtcttacaaaaggatcgaacttgaataatgggttttggattcattgtggtttaggttcctggaacatggcactttagatgcacaatacttccacaagaagacaagattccagcgatagtgaatcgtctgacagagttccacaagagcttcatggacgagttccgcaactaaaaggacctgaccatgaagatgaacttaaagacccttttgaagaaaagtgtgatcagtttgagttattaaaaaaaagaaaacttgtgttttgaatttgatcaggcaattgtgatcagctaatttaattttagaatattttgtacttccattccatggcatgtcatatgaagatatgaaaattagtaaatttattgggcttataaatgggccttatattattaatgggccttatatttatttttcatatgatatttctggagaaagcgacagtatattatcttcaatttttccattttgaagaattttctcaagaaaaaaaaaaatcaatg

SEQ ID NO: 10660 - DNA, 3000 bp, Unknown
  misc_feature (1)..( 3000): cDNA_ID_1461791_gDNA_ID_2213667_Annot_ID_182144 3000 nt of promoter + ATG
attcataaccccttccatttggtgtggtgaaaacctctgaatacttgtatttggatactgaatacttctgcctagcatgtcttggtgttgtagaagcgtatttttccaatttgtatcggatccatgaaggccatccatacgttgccctaactgttgctgcggaaccccatcaggacccatatgtgaaacccttgttcgcttattcaagccaggcatagaagacatttgtccttcttgactttctctctttctatgaaaagatgtaccagggttcatactatcagagccataaggcagcatcgcatctagtccaccaggcgaagcgccagagacactgacagaatttgatccttgatcctgcgtgtttcttgtacttccaattcccatgtacctttgttgctgaggtggtaccaaggccagagaggaatttggtgcatcttgcaacggctgacttcttaatcccgccagcatattagtaccaaggttttgaatagcctggttgttattggtttgctgcattatcaaatgccctggcaaatttcctcgctctgaactttcaggaagccgatcaatgcacacctttttcccctgaatcttattctgagacatgactgtcacttctgccatttgccttaatctctttctccgcaaagtagaaagcgacaaatcgagctatcgagtagagaaaaaaaaacattttagacactataataaacaactgagaacagaaagcacaaggagtctttttaatgagatattaccttagcagtcaaaggatttttactcagcctatcaagtctgggtaaaggatccagacagagttcaggttgtaaggcttttaatatcctggactccacttcctgcagttgatgtaaggatcagtacagaagataatagtttcagtgctcagatatacgacctataagccacgagctaccatgattaccatgagatcaccgtacgtccatgagttgtctgacattgatggaatatcttttaccacattctcgagtgacatcttaaggcgcaatttatttatcacaggagagacttgagatgaggtatgtttccgatagtcatgcacctacaatagtatgtgccaaaaattaaagaaaacatgatgatgtaagatggtacacagcagtcaattaaaaattagtataactaggttttttatgtttacttctggtcccagttactccattatgtttcagaaacaatcaaatacatgtacaattgagtttggaagataaacttccatgtacttataattacgacatttttttaatcttgattaagtgtagataatttctgttgagctctttttaaatatatttatatacgtttggactgtttccaagaacttatggaaggctttatcccaaaaaataattgcagataactcacctcacatataaccaccccatccacaaatttgcaaggtatatcttccaaaatgtccccaggaagcctgccagcctcaatagcctataaagcgtacaaagggattaaaaacatttactcagtagaatgaaactcagaaagtgtatttaacaaaacgcgagtaagtagtgcagtgaaatgcattattcgggtagaacaagtggggaaaaaaaacatcatcttcacatttactaaatctaagtactttgaattcattcaccaaaactttgattacatgttcaaatcaagtctataataacatagttcgaaagatttaccgaaaggagaccctctgctgccctatcatacggatgtaagacctttggaacatctcgaaacgatatctgttgcatagcctggtattcaaaaactcaaatttgtgaaaacgtgaaggttttaaaactcaaatacaagaaatcacaagataaataaattcatatagactctcagtacatacctcagaggtttttcctatagagtacccatttggatagaggctcaatatgaaggaaacttcatgatctgcagagaaaccaaaatgcactcaattcaacatagctagaatttagcaaaacattatgtgtcaaagtggttcgttgagatccaaacctggagatatatcgggtaaagatggcttcgaaaacccggaaacatcgccaatattgctatcatcagtggcctgaaccaaacgtaataaattttctatataactttccaaaataagcgaatttagttggaacacaatacaactaaaattctaagttaaattacctttggtttcccagatagaacgattgcttttggggaatcaggagtagccaattcagtagaaatcttaggtcgaaactttctaccaaccttcgatatcttaaacgagacacccatggattctctccagagagatgaagctcaaacctgtctaggtactgtcaataaacgatacagaaataaaaaagacacgagaattgaagaaatcgaagaatgaattttaagaaagctagagaaattgaaaccttatgagcttgttacagagaagatcatcaaacaattggatcggatagaaagcgagagaaatcaaaggtgactaagaatagagcaatgaagaattcataaacatggaatttgtgaaacacaggtgggaaatttttgaagaagatgcgatcggaagagaaaggaagagagattattgttagggttcttcttctaacttcaaagtagcagaaaaagaaattatcttttgtgtctctgtgcacacttggatttcggtttaagacaaaacggaagttgaaccagttattaattttggttagcttcgattaaaatttgggtaaccgagtttgggggtagaatagacattttgcaaattagggttttgcttgatatataaaatccttcacccttataagcctttcgtcgcctcttcgtgtgatttactgagtgaaaaaagcttatcgcggcgattagttcccggcgaagaagaagaagagagataagaaaatggcgactaatggatctgctagctcagcgcagctctctcagaaggaagctgatgtcagg

SEQ ID NO: 10661 - DNA, 3000 bp, Unknown
  misc_feature (1)..( 3000): cDNA_ID_3037589_gDNA_ID_2213667_Annot_ID_182143 3000 nt of promoter + ATG
ttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcctgaacggttctattgtacaaatgacatgagtgttttaaatgagttcttcttcgacttgtctgtttgctatttattcttcaaaccttagccagtgtcaaacaaaaacggccactacgactattgttttgaagattgcgatattttaagttgtaagaatgtagagaataatgtttgggaagaacaaagctcgattcatatttgtgataaacgcaaaatatagattcgattcaaacaaaaaggtgcaaaacatctaagggtcttaagagaaacaagtgagaagaaaaaacagttacggttcgataactcttcaatcccaaaagtaacaaaaaagcatgtctataaccattaaaccattgagtaaaggctatcaactttactcccaaccagcagctggtgcccctgagggtggcgcggcagcttcccatccaccatctgccggtgcagctagaacagcaaaataaacataacattagaatcaagatctgttagaatagggttcaaatggttatcaaaaactcaccagcggaatcactccaagaagcagcagcaggtgcagcagagattggtgcctgaccttctcctggccatgcagcatcagggatctgagcggtggtccattggtctccacctaccattccatattctggagcaggaagtgcaccatattctgcctgagggccagcttcatcttcatcctctggcttagtctcctcaggttccctgtaaaagaacaggtcaacctgcacaacaccataccatatgaaaaattcagtcaataaacagggaaagtttttaatgaacagatgcctttctaatctaagagctccaagaatgatattcttaccatgacatcccacttctgtccagcagcaatggttccacgcatctgaaggaccatgcgagccagaagccagaaaaggcacccaatgctgtgctttcccttgttgttggctgggataccaatgtcaacaaatctcattggagagtctgtgtcacagaaagcaatgattggaatgtttcccaaagcaccttccttgataggctgcaacacacacaagacatttatcaataacaaaaatcattaatcaatcactagtatatgaatcatatgaagagtttacctggtggtcagttcttgggtcagtaagaatcaacagccttggttcactgaaggatgtctgcatctgattggtgaaggtaccaggagtgtgtcttccagcaatggcattggctccagtgtactgagcaaacttcaacacagctctctgtccatagggcctagctgactggacgatgatgtcctgtgggttctcaatggcaacaataactctagcagccatctggagcttttcccatgttttgccaaggttgaagatgtaaatacctgagaatgacgaaaacttcaaaaactaagttccatactcaccacttacaattgtaaattacaataaaagagcaacaataacacacactagcacaaatacaatctcaaacatcagtcaaaactaaaatctcaatttttttttttttacaaacacacagagagagatagaaatgaaacttgagcctttgatcatttgttcatacatttctgtaaacaagaacactagagaagacacagaaacaaaagccttttcttagatacgaacgcagagaagtgagcgtgctgacaaaaacggctagttgcaacattttatcttttctcagtcagcgacatatttagatccgtcgtgagtaaaatctactctcgatacaataaaacaacctataaatccaaaaaccatctaaaacaaagcagcataaaccaaataaacagatcatcaacatttatacaaatccgaaatatcaacacagaatctcaacactataaccatcaacatacatacatacagatagtttatcaaaaaatatacgagaaattaccatcgttgcgtctcttgaagacgtaacgctccatctggtaattgcaattcttggttccaagatgaacctcagcggcacacatcatcctgacatcagcttccttctgagagagctgcgctgagctagcagatccattagtcgccattttcttatctctcttcttcttcttcgccgggaactaatcgccgcgataagcttttttcactcagtaaatcacacgaagaggcgacgaaaggcttataagggtgaaggattttatatatcaagcaaaaccctaatttgcaaaatgtctattctacccccaaactcggttacccaaattttaatcgaagctaaccaaaattaataactggttcaacttccgttttgtcttaaaccgaaatccaagtgtgcacagagacacaaaagataatttctttttctgctactttgaagttagaagaagaaccctaacaataatctctcttcctttctcttccgatcgcatcttcttcaaaaatttcccacctgtgtttcacaaattccatgtttatgaattcttcattgctctattcttagtcacctttgatttctctcgctttctatccgatccaattgtttgatgatcttctctgtaacaagctcataaggtttcaatttctctagctttcttaaaattcattcttcgatttcttcaattctcgtgtcttttttatttctgtatcgtttattgacagtacctagacaggtttgagcttcatctctctggagagaatccatg

SEQ ID NO: 10662 - DNA, 3000 bp, Unknown
  misc_feature (1)..( 3000): cDNA_ID_2716316_gDNA_ID_2213667_Annot_ID_132708 3000 nt of promoter + ATG
aagaagaagaaattctttttatggtcaaacatattataggctattaatttcctatatcctcaaatgttttgtcacgaatagaaatagggaaataaattatatgcggaaaaaatgatttattcctatggttgattacaaaaatcaaactacaatgttcgttacaagttccggcacgttttcattgcacaagccgtgaagaaactgttgtaagttgacggcgacattacataaaggcgttaacccatttaattcattcgggtcccaagagtttctgttaaatactaatttacccttctgaggtaattcgtttagtggtggttaggatattcgttattaaagggcgtaaatgagggcatttgcaaacgctatagtctaacggagttctgacggagttaagtctcgcgtcggctgcgatggctaatacgaatttaatatgtgggatccattagcaacagtacgacttgtgagtggatatttatcgatgaatggtgtcaattacttatccccgacaaagtttaaggacacgtgaagtattgttatgtgcgtttaggatgtcaacacgtgtcggaatcttggcggtaccaaccttatttcatgcatgatttgcgttttttttccctctttgctaaaggatattatagcgttcatacttcataggcctaattttcttttctgtttttaattacaaaaactgagtgtaattaatattagaatttgtggttttgtatgttggtaaaaggttaacgatttctgtttagtcctaatatgaattttgttacttgctcagttaaatattatttctataacaataataataataaaatcttttaatcgttttgttcaatgaagtcgagcgttgaattttatttgaataagaggcaatgccaaagagtaccaaaaaagaatttaaaacaaaatgtcgtagacgatcgcgccaagggaaaaaatcatttttattgaattatttatcgcaacttgcaaaatgagaacataatactttgaactttgaagactcttcaatatcatatgatttcaagagttgaacaacaacttgagtctaatatatacacatgtatgtgtgtatttaattacacaatatagatccattgtcattttctaatacatacaaaagaccaaataatattcgctatttcacatgaagattatctacattgttggaagcgcaagttgggtttcgatcacatatttgatcatgtccaaaataagggaatgtcatattctaacagatttgatatgcaaaaatcaagattgtgagaagattctactaagactaccaaaccaacgttaacggcaaaaaagaaaaggcaacggcgaaaccttccggtcaccactcgaagttggactctcctttaagcaatagagtatatcaacatttatcaaataaatagttgttgttttgagacctaagttcatatatggacataatcaagatggtgtcaacagttttgggttaggtgtgcttcagacttaatctttgagctgggtaagatttcctttctatctagtgttacgagctagcgtgtctctgtaacaggttgtcttcgggtaagtttggtcttgcagcttgagcttgtggtgggaattctctgtacagtcgttatcttcataaataaaatggtacttatcagaaaataaaataaaattagaagacaatattgaaagattatacaactcatttgcattgacgtatgacaatactaaacataaaatttgtttaaaatttaggggtaacgactacgaatgtaggtccgttttacaacaatgactaaaacaaattggttctttgacaccgacagatactttggatgtgaacaccaaaatgttgcagcttcttcacatgctcctcttgtactatgacaataacatatgtgcctaaagattatcgcatattaataagtatccattacatgcggaacaggaataacattttttcaacaattgcataattgaaaccggatagaaatacaacaaggacactaagtcaaatcattagaatacatgtcatggtctacagaaaattaatagattagacaaatattttgtttagttgcatataatatcatgagtaattgagtattagagtattttactcatgatacataagaaacttataactattctttcgatattctcatatttggaaatagttaggaactgtaaaagctaaaactgattgatgattacatttggtggcgtcaatttgttttacatttatcaaatttctttcttttttcggcatagggatacattttttgtcatgctatagtgagtaaattagaaatccgacataactaagcatcaggaggaaaatccaaatgatgaagtggtccacttaaaaggtcacgttagctagaactgaaccaaatgttgtacgagttttaagattatatgctcttggtcctaatgccaaaaccatttgtttttcccataaaatttatttacatgcgttatcttgtagtatggcaaaatttggagtatcacttaatagttttcacacgtaacacgtaaaaaatatagttttgatagttggttttacaacacttttacttgatagttgttcttacaacacttatacttgtaattaagtcacttctacggtttaaaaattatttatagaaacgataatcaactttgtccaagtttgggcttggaaactaaaatcaacattattcatatgggccaaccaaaaatgcatatctttagcttattttttattcgctcttgcttttctcaatcttcttgactctttcaacgaacattcgcgccataagctcctaagttcctctcatccaatggatcacaaatgacaaagaaaaacaaaagacagagaaaacagagacaaagcgagaaacaagacaaggaatacagaaaaattagtaaatcgaatcaccaaaaaaaaaaaaaaaactactttgattaatcaaaaaaaaaaaagagttgcttgaaactcccggcggcctagctccggttaagtaaatg

SEQ ID NO: 10663 - DNA, 3000 bp, Unknown
  misc_feature (1)..( 3000): cDNA_ID_4268709_gDNA_ID_2213667_Annot_ID_132709 3000 nt of promoter + ATG
ttaaaccgtagaagtgacttaattacaagtataagtgttgtaagaacaactatcaagtaaaagtgttgtaaaaccaactatcaaaactatattttttacgtgttacgtgtgaaaactattaagtgatactccaaattttgccatactacaagataacgcatgtaaataaattttatgggaaaaacaaatggttttggcattaggaccaagagcatataatcttaaaactcgtacaacatttggttcagttctagctaacgtgaccttttaagtggaccacttcatcatttggattttcctcctgatgcttagttatgtcggatttctaatttactcactatagcatgacaaaaaatgtatccctatgccgaaaaaagaaagaaatttgataaatgtaaaacaaattgacgccaccaaatgtaatcatcaatcagttttagcttttacagttcctaactatttccaaatatgagaatatcgaaagaatagttataagtttcttatgtatcatgagtaaaatactctaatactcaattactcatgatattatatgcaactaaacaaaatatttgtctaatctattaattttctgtagaccatgacatgtattctaatgatttgacttagtgtccttgttgtatttctatccggtttcaattatgcaattgttgaaaaaatgttattcctgttccgcatgtaatggatacttattaatatgcgataatctttaggcacatatgttattgtcatagtacaagaggagcatgtgaagaagctgcaacattttggtgttcacatccaaagtatctgtcggtgtcaaagaaccaatttgttttagtcattgttgtaaaacggacctacattcgtagtcgttacccctaaattttaaacaaattttatgtttagtattgtcatacgtcaatgcaaatgagttgtataatctttcaatattgtcttctaattttattttattttctgataagtaccattttatttatgaagataacgactgtacagagaattcccaccacaagctcaagctgcaagaccaaacttacccgaagacaacctgttacagagacacgctagctcgtaacactagatagaaaggaaatcttacccagctcaaagattaagtctgaagcacacctaacccaaaactgttgacaccatcttgattatgtccatatatgaacttaggtctcaaaacaacaactatttatttgataaatgttgatatactctattgcttaaaggagagtccaacttcgagtggtgaccggaaggtttcgccgttgccttttcttttttgccgttaacgttggtttggtagtcttagtagaatcttctcacaatcttgatttttgcatatcaaatctgttagaatatgacattcccttattttggacatgatcaaatatgtgatcgaaacccaacttgcgcttccaacaatgtagataatcttcatgtgaaatagcgaatattatttggtcttttgtatgtattagaaaatgacaatggatctatattgtgtaattaaatacacacatacatgtgtatatattagactcaagttgttgttcaactcttgaaatcatatgatattgaagagtcttcaaagttcaaagtattatgttctcattttgcaagttgcgataaataattcaataaaaatgattttttcccttggcgcgatcgtctacgacattttgttttaaattcttttttggtactctttggcattgcctcttattcaaataaaattcaacgctcgacttcattgaacaaaacgattaaaagattttattattattattgttatagaaataatatttaactgagcaagtaacaaaattcatattaggactaaacagaaatcgttaaccttttaccaacatacaaaaccacaaattctaatattaattacactcagtttttgtaattaaaaacagaaaagaaaattaggcctatgaagtatgaacgctataatatcctttagcaaagagggaaaaaaaacgcaaatcatgcatgaaataaggttggtaccgccaagattccgacacgtgttgacatcctaaacgcacataacaatacttcacgtgtccttaaactttgtcggggataagtaattgacaccattcatcgataaatatccactcacaagtcgtactgttgctaatggatcccacatattaaattcgtattagccatcgcagccgacgcgagacttaactccgtcagaactccgttagactatagcgtttgcaaatgccctcatttacgccctttaataacgaatatcctaaccaccactaaacgaattacctcagaagggtaaattagtatttaacagaaactcttgggacccgaatgaattaaatgggttaacgcctttatgtaatgtcgccgtcaacttacaacagtttcttcacggcttgtgcaatgaaaacgtgccggaacttgtaacgaacattgtagtttgatttttgtaatcaaccataggaataaatcattttttccgcatataatttatttccctatttctattcgtgacaaaacatttgaggatataggaaattaatagcctataatatgtttgaccataaaaagaatttcttcttcttgaaccatcataagaaaaatgtgtgtttagtctattgatcagttttgtgttcaaaaaaaaaaaaaaaatgtctatcgatcagttaggtgtaaaaaaaaaagttacaaaactcgtgacaaaaacattctatattggacacacatcactgtcacttcagactaaataaaaaaaaagaacacgttatttcgttttctttatttattcgggagaggttaaaagccacagaaacttattggctagaattggttatttataacaacaacacatgagcaaaaagctcaaaacatctacatactctttggaatcctcgattttttgtacgtgtaaagaagtcacacaagaaaatcttgggttgttgtaatcttcatcacactagt

SEQ ID NO: 10664 - DNA, 3000 bp, Unknown
  misc_feature (1)..( 3000): cDNA_ID_2716308_gDNA_ID_2213667_Annot_ID_132710 3000 nt of promoter + ATG
tttctattcgtgacaaaacatttgaggatataggaaattaatagcctataatatgtttgaccataaaaagaatttcttcttcttgaaccatcataagaaaaatgtgtgtttagtctattgatcagttttgtgttcaaaaaaaaaaaaaaaatgtctatcgatcagttaggtgtaaaaaaaaaagttacaaaactcgtgacaaaaacattctatattggacacacatcactgtcacttcagactaaataaaaaaaaagaacacgttatttcgttttctttatttattcgggagaggttaaaagccacagaaacttattggctagaattggttatttataacaacaacacatgagcaaaaagctcaaaacatctacatactctttggaatcctcgattttttgtacgtgtaaagaagtcacacaagaaaatcttgggttgttgtaatcttcatcacactagtatgtcaacgggacaagcgccggagaagtccaatttttctcagagatgtagtctgctcagccggtacttgaaggagaagggaagttttgggaatattaatatggggttggctcgaaaatccgatcttgaactcgccggaaaattcgatctcaaaggtatttatttatttttccctatctattccgacggccgccgcctataaagaccaaagtttatatcatatacttttagtatcctgcttcgttgattattagcataaagtttaactatatattttttttgttgaaatgcaaaattttaaatcatttttttcttttcttttctttaaacttaagcatggtattattttggacagcttaagtatattaaagttagagattctgtgaagttttttaaaaaacgtaataaacatgtaatttgattttgataaattttaatcggtttgcaatttctgttctaatttgttttaggacaacaaaatgtgattaagaaggtagagacctcagaaactagaccgttcaagttgattcagaagttttctattggtgaggcctctacttctaccgaagacaaagccatatatattgatctcaggtactgtacacacaaacttcatatgtattcgaactcctaaagtgtttgttttcacattttgtagcaattgaattagagaaagaactaccggttatagatgtatggactatggagtttgactaattgtaaaaatgggtttgatttgattttagtgaaccggcaaaagtagcaccggagtctggaaattcacagttgaccatattctttggaggaaaagttatggttttcaacgagtttcctgaagacaaagctaaggagataatggaagtagctaaagaagcgaatcatgttgctgttgattctaagaacagtcagagtcacatgaatcttgacaaaagcaacgtggtgattcccgatcttaacgagccaacgagttccgggaacaatgaagatcaagaaactgggcagcaacatcaggttgtggaacgcattgcaagaagagcttctcttcatcgattctttgctaaacgaaaagacaggtaaactaaactccgaaactgttttgtgcttggttatgctttttctaggccgctcgtcaaaatgtatgcatagattaggatcaaagtttcttaaaaaagttatatgtaaaaatagctaataattaccatattaagacttattcgagttattctaggaatcccacatcggattagaagcgtattaccaatcaagtttaagttgaacattcatgaaattgaacatagggtggtcctagtatgtttatgaattatgattcctagagtaagatttcgagatgtgactcaagtgtcatcatttataaagaacatgtaaaaaatcttacaagttacaatgaaattcgagatgggacctagagtagtatataagagatatgagtccatcatctatgtgtccttgatctaggaaaattattagtaaaatgtcgagaaatttctagttaaaaaacactaactaagagttctttgtaaatcaaaacttcaatatctactttgtcttaaatgttgattaattgttttgatttcagggctgtggctagagctccatatcaagtgaaccaacacggtagtcatcttcctcccaagccagagatggttgctccatcgataaagtcaggccaatcgtcgcaacacattgcaactcctccaaaaccaaaggcccataaccatatgccgatggaggtggacaagaaagaaggacaatcttccaaaaaccttgaactcaagctttagggcgtataaaatgcacgatcgagttcacgtttctagttttcacttatttaggatttgaacccaaatacccttttatattttcttccattacttttgaccaatttaagttatttatagtactgtattacgtagctagtatttatatttcaaaacatacatattttgatacttgttttttagattctttaattaaaattgtcatctggattaccctttatcgaaattttttaatcacctgatataatctcaccagtgatggatttgcgttgttagtaatttttctaagtggcaaaagtatattaacctataataggtttcaaagatatacatataatgtttctatcaaagatattagtataatattttaccacatgatcgaaatctcaccagttatggatttgcattgaatgttctagcgattgggctggaccgtctcaggaacccaaccttaatgaaaaaacatcgtctcattgattttaggtcgttaagtctgttttgcccttgtcttatcccgtaattacgaaattagccttctaccatttcctctgtctgcttctctcttgccgttttctaaaaccctaaaaatttctgttgaaccccaaacattgaagtttatctttctttttcattgttcgatctcaaagcacagagattgcttaaacctaactgtctcagttcttttaaaaacagtcatctctcacaaaactctcttaaccctcttcatatgctttgagaaaaa

SEQ ID NO: 10665 - DNA, 3000 bp, Unknown
  misc_feature (1)..( 3000): cDNA_ID_2716298_gDNA_ID_2213667_Annot_ID_132714 3000 nt of promoter + ATG
gttttttcttaaactattaaagcattaattatgctgggaattagtgatacacatatatacagaaaaaaaaaatccgtggaagaaaaaataaataaattacgttcttcgttatgaacattttttgtgtgcgaccgaaaagaaaaaacatttttgtagattaagaaaaatataggctaaattgagggcgggaggtctaatatgtccaatctaaagtgggccgttaaggcccattagtgtttctcatgttttatcttcttaaattctttattgctcaatggctgctgattaccggttcgaatcgtacggaatctagttttagttaagaagatgtgctgatctaattactctatgatcaaaatcataaaattggagccaacaaaaatatcataccaaacacatgacgtggccatgtggaattgttggcaaccccaaaacatccaaacattggtttgttgcaaaactaatcagataattaatgagattaggtacagtatttcatatacatttaaggacatttaatgaaaattaatgctacattagaatgttagggttgtttgattggtgaaaattacaattgccagcaattatgttactgtaaaattgccattcacattttcacccaattgatcaataaaacttttcatcgtcattcttttttttttccatttgaaaatctgttttttttttctgtgttggatgtaattttttttctttgaaatatttttattacaaatatttaaccgtaataaaataaaatacagtctactatttttagaacgtttattgcaaagttctaaaattgctaataaagtcttccaagtgaaaaatattttaccgttgaaattatgtttatttattactactagctagagagcctaggcttcgaccaatttttagttacgatattaccctcatcgttataggctttattaggaaagtaaaccggtgttgttaaaaggttttgagggtattatggtaaaacgtagtactgcggctgtatcttttttttctttcctaatcgaagacgacattcgtcggaaaagaagttgtctgaataaggaaactctctctctctctaaacagtctccgcatattttctctctctaaagactctgtcttttttactacggagagagagagagagagagagagtgtgcgtgtgctggtttcgagcgtggatattaagggacagagcaaaatcttctttggtgggagaaataaagaaagattttgcattttgagcaaaaccagtagtgaagtgacaacattaactcctgacattgttagggtttcatcttcttttctctctttctcaacctctcttgccgattgagaacttggattaagtttggaaatactgagaattggaaagttcccagctcaatgctggatcggcaacaggaggatcttggtatgttctttatggattttgcatgattttgagttctgagctttggttttttttttccggattatattaaagttgggatttttatggttgggtctttacttagagtagtggaatcagatctgagaagcatcgtgttccgatgaattagatcctcgatttctatgtctggccatttatatggttcatgacctgtttttgtcttccttttcatttcccgagattctttgtttctcatcaaagttatattccgtgattgtcctacttatttcgtgagaatgactctggtttcattcatcttttgctttcaacattgttagcaagttggcttttttttttgtaatctctgagtaacagtttctattattgttttctcaggtttcttggcattaatttgagtttgttcagttgaattctgttaatctcagtgatacttctgctggttggttagcattagcaatctggtcttgtgagaatgaggtcagatacggttcttgactacgtggtattcgaattatcgccaaagcattcaaagtgagtatatgttccacttcaagatttcatgatttctagtttgttctgtataaacaagtgtgtgtttttcctttgatagatgcgaattgtttgtatcaagcaatgaacagacagagaagctagcttcagggttgattcaaccctttgtgaatcatttaaaagttcttgaagcaaaagcgtcgcctgttgctcaatcctctattagattggaggtggagaaaagcaacacttggttcactaaaagaacattagagaggtttataacaaagaattcaatatcattttggtttcttttcacatagccttttttcgatatagtaatagtttcttccaccatttgtcctttcagatttgttcaatttgttaatagtccagaaactctcgaaaaggtcaatacatattattccgagatgttgcagttggaagcagctcgaacattatattcgcaggttgtaaccactattttgaaacttgacttctaattgtgattcttgaccgatcgatctttcctaaagttttgttgtcatttttttggttcttaaagcggagtgaagactcaaagtttggtgcatcaggtgtgtttgattttactgttgttactttgctcgtacattgatctttaacatcaatttgaatcctatttccttccgtttcagatgatggagctgcagcagatgccacaaagtaaagcttctctgcgtttatgtttgttctgtgtttaaagagttttatattgattactttttcttctctatattcaggaaggagctcttaaaggctatagacttaagacttgaagctattaaaaaggacttgacaacgtccatttctcatgcatcagctagcggtttcgaccctcatactgtttccgaactcaaacaatttgctgatagatttagtgcacatcatttggagtaagccttttattgttttgctacttttcatttgatgaaacctatctttcatgctttgttgtttgattgaattggaatggttccatcagtgaagcatgcagtaaatatatctcactatggaagcaaaggccagacttgatcgac

SEQ ID NO: 10666 - DNA, 3000 bp, Unknown
  misc_feature (1)..( 3000): cDNA_ID_2716294_gDNA_ID_2213667_Annot_ID_132715 3000 nt of promoter + ATG
ctgagaatgacgaaaacttcaaaaactaagttccatactcaccacttacaattgtaaattacaataaaagagcaacaataacacacactagcacaaatacaatctcaaacatcagtcaaaactaaaatctcaatttttttttttttacaaacacacagagagagatagaaatgaaacttgagcctttgatcatttgttcatacatttctgtaaacaagaacactagagaagacacagaaacaaaagccttttcttagatacgaacgcagagaagtgagcgtgctgacaaaaacggctagttgcaacattttatcttttctcagtcagcgacatatttagatccgtcgtgagtaaaatctactctcgatacaataaaacaacctataaatccaaaaaccatctaaaacaaagcagcataaaccaaataaacagatcatcaacatttatacaaatccgaaatatcaacacagaatctcaacactataaccatcaacatacatacatacagatagtttatcaaaaaatatacgagaaattaccatcgttgcgtctcttgaagacgtaacgctccatctggtaattgcaattcttggttccaagatgaacctcagcggcacacatcatcctgacatcagcttccttctgagagagctgcgctgagctagcagatccattagtcgccattttcttatctctcttcttcttcttcgccgggaactaatcgccgcgataagcttttttcactcagtaaatcacacgaagaggcgacgaaaggcttataagggtgaaggattttatatatcaagcaaaaccctaatttgcaaaatgtctattctacccccaaactcggttacccaaattttaatcgaagctaaccaaaattaataactggttcaacttccgttttgtcttaaaccgaaatccaagtgtgcacagagacacaaaagataatttctttttctgctactttgaagttagaagaagaaccctaacaataatctctcttcctttctcttccgatcgcatcttcttcaaaaatttcccacctgtgtttcacaaattccatgtttatgaattcttcattgctctattcttagtcacctttgatttctctcgctttctatccgatccaattgtttgatgatcttctctgtaacaagctcataaggtttcaatttctctagctttcttaaaattcattcttcgatttcttcaattctcgtgtcttttttatttctgtatcgtttattgacagtacctagacaggtttgagcttcatctctctggagagaatccatgggtgtctcgtttaagatatcgaaggttggtagaaagtttcgacctaagatttctactgaattggctactcctgattccccaaaagcaatcgttctatctgggaaaccaaaggtaatttaacttagaattttagttgtattgtgttccaactaaattcgcttattttggaaagttatatagaaaatttattacgtttggttcaggccactgatgatagcaatattggcgatgtttccgggttttcgaagccatctttacccgatatatctccaggtttggatctcaacgaaccactttgacacataatgttttgctaaattctagctatgttgaattgagtgcattttggtttctctgcagatcatgaagtttccttcatattgagcctctatccaaatgggtactctataggaaaaacctctgaggtatgtactgagagtctatatgaatttatttatcttgtgatttcttgtatttgagttttaaaaccttcacgttttcacaaatttgagtttttgaataccaggctatgcaacagatatcgtttcgagatgttccaaaggtcttacatccgtatgatagggcagcagagggtctcctttcggtaaatctttcgaactatgttattatagacttgatttgaacatgtaatcaaagttttggtgaatgaattcaaagtacttagatttagtaaatgtgaagatgatgttttttttccccacttgttctacccgaataatgcatttcactgcactacttactcgcgttttgttaaatacactttctgagtttcattctactgagtaaatgtttttaatccctttgtacgctttataggctattgaggctggcaggcttcctggggacattttggaagatataccttgcaaatttgtggatggggtggttatatgtgaggtgagttatctgcaattattttttgggataaagccttccataagttcttggaaacagtccaaacgtatataaatatatttaaaaagagctcaacagaaattatctacacttaatcaagattaaaaaaatgtcgtaattataagtacatggaagtttatcttccaaactcaattgtacatgtatttgattgtttctgaaacataatggagtaactgggaccagaagtaaacataaaaaacctagttatactaatttttaattgactgctgtgtaccatcttacatcatcatgttttctttaatttttggcacatactattgtaggtgcatgactatcggaaacatacctcatctcaagtctctcctgtgataaataaattgcgccttaagatgtcactcgagaatgtggtaaaagatattccatcaatgtcagacaactcatggacgtacggtgatctcatggtaatcatggtagctcgtggcttataggtcgtatatctgagcactgaaactattatcttctgtactgatccttacatcaactgcaggaagtggagtccaggatattaaaagccttacaacctgaactctgtctggatcctttacccagacttgataggctgagtaaaaatcctttgactgctaaggtaatatctcattaaaaagactccttgtgctttctgttctcagttgtttattatagtgtctaaaatgtttttttttctctactcgatagctcgatttgtcgctttctactttgcggagaaagagattaaggcaaatg

SEQ ID NO: 10667 - DNA, 3000 bp, Unknown; identical to SEQ ID NO: 10661
  misc_feature (1)..( 3000): cDNA_ID_2716291_gDNA_ID_2213667_Annot_ID_132716 3000 nt of promoter + ATG

SEQ ID NO: 10668 - DNA, 3000 bp, Unknown
  misc_feature (1)..( 3000): cDNA_ID_2716287_gDNA_ID_2213667_Annot_ID_132717 3000 nt of promoter + ATG
tgaagtgtatttcattcccccctgttgtgaagctggaaattgcatgggaccaccttcctgattcataaccccttccatttggtgtggtgaaaacctctgaatacttgtatttggatactgaatacttctgcctagcatgtcttggtgttgtagaagcgtatttttccaatttgtatcggatccatgaaggccatccatacgttgccctaactgttgctgcggaaccccatcaggacccatatgtgaaacccttgttcgcttattcaagccaggcatagaagacatttgtccttcttgactttctctctttctatgaaaagatgtaccagggttcatactatcagagccataaggcagcatcgcatctagtccaccaggcgaagcgccagagacactgacagaatttgatccttgatcctgcgtgtttcttgtacttccaattcccatgtacctttgttgctgaggtggtaccaaggccagagaggaatttggtgcatcttgcaacggctgacttcttaatcccgccagcatattagtaccaaggttttgaatagcctggttgttattggtttgctgcattatcaaatgccctggcaaatttcctcgctctgaactttcaggaagccgatcaatgcacacctttttcccctgaatcttattctgagacatgactgtcacttctgccatttgccttaatctctttctccgcaaagtagaaagcgacaaatcgagctatcgagtagagaaaaaaaaacattttagacactataataaacaactgagaacagaaagcacaaggagtctttttaatgagatattaccttagcagtcaaaggatttttactcagcctatcaagtctgggtaaaggatccagacagagttcaggttgtaaggcttttaatatcctggactccacttcctgcagttgatgtaaggatcagtacagaagataatagtttcagtgctcagatatacgacctataagccacgagctaccatgattaccatgagatcaccgtacgtccatgagttgtctgacattgatggaatatcttttaccacattctcgagtgacatcttaaggcgcaatttatttatcacaggagagacttgagatgaggtatgtttccgatagtcatgcacctacaatagtatgtgccaaaaattaaagaaaacatgatgatgtaagatggtacacagcagtcaattaaaaattagtataactaggttttttatgtttacttctggtcccagttactccattatgtttcagaaacaatcaaatacatgtacaattgagtttggaagataaacttccatgtacttataattacgacatttttttaatcttgattaagtgtagataatttctgttgagctctttttaaatatatttatatacgtttggactgtttccaagaacttatggaaggctttatcccaaaaaataattgcagataactcacctcacatataaccaccccatccacaaatttgcaaggtatatcttccaaaatgtccccaggaagcctgccagcctcaatagcctataaagcgtacaaagggattaaaaacatttactcagtagaatgaaactcagaaagtgtatttaacaaaacgcgagtaagtagtgcagtgaaatgcattattcgggtagaacaagtggggaaaaaaaacatcatcttcacatttactaaatctaagtactttgaattcattcaccaaaactttgattacatgttcaaatcaagtctataataacatagttcgaaagatttaccgaaaggagaccctctgctgccctatcatacggatgtaagacctttggaacatctcgaaacgatatctgttgcatagcctggtattcaaaaactcaaatttgtgaaaacgtgaaggttttaaaactcaaatacaagaaatcacaagataaataaattcatatagactctcagtacatacctcagaggtttttcctatagagtacccatttggatagaggctcaatatgaaggaaacttcatgatctgcagagaaaccaaaatgcactcaattcaacatagctagaatttagcaaaacattatgtgtcaaagtggttcgttgagatccaaacctggagatatatcgggtaaagatggcttcgaaaacccggaaacatcgccaatattgctatcatcagtggcctgaaccaaacgtaataaattttctatataactttccaaaataagcgaatttagttggaacacaatacaactaaaattctaagttaaattacctttggtttcccagatagaacgattgcttttggggaatcaggagtagccaattcagtagaaatcttaggtcgaaactttctaccaaccttcgatatcttaaacgagacacccatggattctctccagagagatgaagctcaaacctgtctaggtactgtcaataaacgatacagaaataaaaaagacacgagaattgaagaaatcgaagaatgaattttaagaaagctagagaaattgaaaccttatgagcttgttacagagaagatcatcaaacaattggatcggatagaaagcgagagaaatcaaaggtgactaagaatagagcaatgaagaattcataaacatggaatttgtgaaacacaggtgggaaatttttgaagaagatgcgatcggaagagaaaggaagagagattattgttagggttcttcttctaacttcaaagtagcagaaaaagaaattatcttttgtgtctctgtgcacacttggatttcggtttaagacaaaacggaagttgaaccagttattaattttggttagcttcgattaaaatttgggtaaccgagtttgggggtagaatagacattttgcaaattagggttttgcttgatatataaaatccttcacccttataagcctttcgtcgcctcttcgtgtgatttactgagtgaaaaaagcttatcgcggcgattagttcccggcgaagaagaagaagagagataagaaa

SEQ ID NO: 10669 - DNA, 3000 bp, Unknown
  misc_feature (1)..( 3000): cDNA_ID_4268705_gDNA_ID_2213667_Annot_ID_132720 3000 nt of promoter + ATG
gtctgatttaacgccaaaggtttatcctttgcttctcgttgtgattcccaacgatgaaatcgacaagctttgcataacttctttgtactttatattacagagaagttggttttattgttaactaagagttttttttcttttccggggaacaggttctgaaatgtgagtatgctgttcgaggagaaattgtcaacattgctcaggtcagagatgcatgtgctttgtcttgtaaaaccaagaacaaaatctgtaaaattgtttttaatgctaattgatttttgtttgctttttgcttccatcttacagaagttacaagaagacttgaagactaataaggatgcttatccctttgatgaggtaaaatctctttctttatcggcagttttgacggatttatgattagtttagtgttgatgttacctgttctcaaactctttgtgcaaggaacttagaattcttcattacttttggcagataatctattgcaacattgggaatcctcaatctcttggtcagctgcctataaagttcttccgtgaggtaagtgaatgtttttggtactagtttggttgtcatatcagccacagagatataacgtctatcatctatatgcctcaggttctcgcattgtgtgaccacgcaagtcttttggatgagtctgaaacccatggtttgttcaggtgaggttttccttgctatatttcagctttaggacatgtatgctcacggtttaagattgcttaacatttgatttctactctgctatcagtaccgattcaattgaccgagcatggaggattttggaccatattcccggaagagcaactggggcttacagtcatagccaggtttgttattagagtctagttaaaagtcctaaaccctttcttgagatggttcttatgttgctgaatgtttcattttttgttctgcctcagggtatcaagggtttacgtgatgtaattgcagctggaatcgaagcacgtgatggtttccctgctgatccaaatgatattttcttgactgatggtgcaagtccagcggtaacaatcaaaacgaaaacgttatctcatagagttagagtaagttcttttaaaggattcatgctaagtgtttttggtgttttttactctataggttcacatgatgatgcaacttctcttgagctcagagaaagatggtattctttccccgattcctcagtatccattgtactcggcttcaattgcccttcatggtggatctttggtatgttcatataatcatcatggagtaatgttgttttttggtacaagtttttgaaatttgtacttcttaggttccgtactatcttgatgaagcaacaggatggggactggaaatatctgaccttaagaagcaactagaggaagctaggtccaagggcatctctgtaagggccttggttgtcataaaccccggtaacccaactgggcaggtacaaacagattttcaagactagcctaacaaaatgtaacattcttctaatcttgcgttcttattctggttaggttcttgcggaagaaaaccagcgtgacattgttaatttctgcaagcaagagggtttggttcttttagctgatgaagtctaccaagaaaatgtttacgtccctgacaaaaagttccattctttcaagaaagtggctcggtctttgggctatggagaaaaagatatctcgttagtctcgttccaatcagtctccaaaggtaaaagaacaacttttactgtccaatgcttgtcatctaaaaaatggggtttttgtttttaatattcttctgttgataggatattatggagaatgtggaaaaagaggaggttacatggaggttactggattcacttctgatgtaagagaacagatatacaaaatggcttctgtgaatctttgttctaacatctctggtcaaattcttgctagccttgtcatgagcccacccaaggtaacaccctagttctctctaatcggttttcgctaagttcttgcaacagattatgactaaaaagtctaatattgtatttgatcagcctggtgatgactcatatgactcatacatggcagaaagagatggaattctctcatccatggctaaacgtgcaaaggttagtcgaagattacaataccctctaacgacatttttcagtctctttgtatataatgtcacaagcttgaaaatgaacttgcagactttggaagacgctctcaacagtttagaaggtgttacatgtaacagagccgaaggagcaatgtatctcttcccgcgaattaaccttcctcaaaaggctatcgaagctgctgaggctgaaaaaactgcaccagatgcgttctactgcaaacgccttctcaatgctactggtgtagttgtagtccctggttctggctttggacaggtaaaatataaccaaatcttcataactttaaatgtcttacaaaaggatcgaacttgaataatgggttttggattcattgtggtttaggttcctggaacatggcactttagatgcacaatacttccacaagaagacaagattccagcgatagtgaatcgtctgacagagttccacaagagcttcatggacgagttccgcaactaaaaggacctgaccatgaagatgaacttaaagacccttttgaagaaaagtgtgatcagtttgagttattaaaaaaaagaaaacttgtgttttgaatttgatcaggcaattgtgatcagctaatttaattttagaatattttgtacttccattccatggcatgtcatatgaagatatgaaaattagtaaatttattgggcttataaatgggccttatattattaatgggccttatatttatttttcatatgatatttctggagaaagcgacagtatattatcttcaatttttccattttgaagaattttctcaagaaaaaaaaaaatcaatgtggagaagatcaccgtcgtttattctcgacgagcgacgaagctcgaattcacctccaatg

SEQ ID NO: 10670 - DNA, 3000 bp, Unknown
  misc_feature (1)..( 3000): cDNA_ID_3037593_gDNA_ID_2213667_Annot_ID_182142 3000 nt of promoter + ATG
actattgttgtataagttctagtaaggtatttagttttatactctttctgcttgattttttttccttttcttataacttctttgtggttctatatatgtatataacaaaaataaacttttgaaatgaaaatgtatgttgtagaatttaattcagaattatcatgaaaccgatgttgaccattgatgttttaataaaaggtaggtggtccatcgacgagattccaagctggcaatagaagatctaagaagtagagcttaaaaagtttttaacattttttgtattttttttttttgtggaacttcatgttgtaaaagttgtcgtggtgaagaaaatatggtggtatgtactattttgtatacaatgtgatcaaacgtctaggtcatttgaatctcatttttgagttatgcacattcttgttaaagtacaaatgcacacaaaaaattagaatattgatattgtatcttccaaataatatatttactattcatatttgacatgatgatcaaatgaaacttcacaaattctcgtatttgattcagttttacataaatatttaatactccacaaatatcaaatgaaactccacaaattctagtatatatatattcctctgtcgtgcaaaaataggatattttggaaacgctgggaagtaggagtagccgagtaggaccaaagagacaaagctagtcacaagttgtcatattttttagttcgtgaagtccaaatcaccactattttcgcagacctgcgacttcgagacttttcttcctttttttaatatatatatatatatatatatatttcctttgacaaaatataatattgttaacttatacaaaataaaataaaatcatgttatccactacatttacttgatatggtaaacaaaattagaagttggatgaaatcagaaataaatgtgtatgtatcaccaagttgataataattagtggcctttacaccgaatctggtccattacttttttttctaatttgacatatagtaggtttctccaacttgtataaacgccgcttattttcaatttaattcgtaattaaacaaatatgttcagtatataattatgataacatttttctatcattcttttctgattctgttttttcttaaactattaaagcattaattatgctgggaattagtgatacacatatatacagaaaaaaaaaatccgtggaagaaaaaataaataaattacgttcttcgttatgaacattttttgtgtgcgaccgaaaagaaaaaacatttttgtagattaagaaaaatataggctaaattgagggcgggaggtctaatatgtccaatctaaagtgggccgttaaggcccattagtgtttctcatgttttatcttcttaaattctttattgctcaatggctgctgattaccggttcgaatcgtacggaatctagttttagttaagaagatgtgctgatctaattactctatgatcaaaatcataaaattggagccaacaaaaatatcataccaaacacatgacgtggccatgtggaattgttggcaaccccaaaacatccaaacattggtttgttgcaaaactaatcagataattaatgagattaggtacagtatttcatatacatttaaggacatttaatgaaaattaatgctacattagaatgttagggttgtttgattggtgaaaattacaattgccagcaattatgttactgtaaaattgccattcacattttcacccaattgatcaataaaacttttcatcgtcattcttttttttttccatttgaaaatctgttttttttttctgtgttggatgtaattttttttctttgaaatatttttattacaaatatttaaccgtaataaaataaaatacagtctactatttttagaacgtttattgcaaagttctaaaattgctaataaagtcttccaagtgaaaaatattttaccgttgaaattatgtttatttattactactagctagagagcctaggcttcgaccaatttttagttacgatattaccctcatcgttataggctttattaggaaagtaaaccggtgttgttaaaaggttttgagggtattatggtaaaacgtagtactgcggctgtatcttttttttctttcctaatcgaagacgacattcgtcggaaaagaagttgtctgaataaggaaactctctctctctctaaacagtctccgcatattttctctctctaaagactctgtcttttttactacggagagagagagagagagagagagtgtgcgtgtgctggtttcgagcgtggatattaagggacagagcaaaatcttctttggtgggagaaataaagaaagattttgcattttgagcaaaaccagtagtgaagtgacaacattaactcctgacattgttagggtttcatcttcttttctctctttctcaacctctcttgccgattgagaacttggattaagtttggaaatactgagaattggaaagttcccagctcaatgctggatcggcaacaggaggatcttggtatgttctttatggattttgcatgattttgagttctgagctttggttttttttttccggattatattaaagttgggatttttatggttgggtctttacttagagtagtggaatcagatctgagaagcatcgtgttccgatgaattagatcctcgatttctatgtctggccatttatatggttcatgacctgtttttgtcttccttttcatttcccgagattctttgtttctcatcaaagttatattccgtgattgtcctacttatttcgtgagaatgactctggtttcattcatcttttgctttcaacattgttagcaagttggcttttttttttgtaatctctgagtaacagtttctattattgttttctcaggtttcttggcattaatttgagtttgttcagttgaattctgttaatctcagtgatacttctgctggttggttagcattagcaatctggtcttgtgaga

SEQ ID NO: 10671 - DNA, 3000 bp, Unknown
  misc_feature (1)..( 3000): cDNA_ID_2990839_gDNA_ID_2213667_Annot_ID_182140 3000 nt of promoter + ATG
aaatatatataaaaaggaaaaaaaattgtatcaaataatttaatagttttgttatgttaaattagataaaatgttatttattatgtattttttattgatatatatatatatatatatttagccaaataaattaatggtgtaatgatcacttgttatatctgttttttttaatagaacgtatttatcagttttttcgtagaccgtatcattccctcatccatctatcataattttacaatatttttcttatcagcaagtgtaatttgtaacatgaaaataaatgaatgaatatggcaaaatttattacaaaattaaaattattacgaatctcaatatataattacaagatacaacaaaaaagaaagaaaaaacaatgggcaaaaaacgatactagttttgccatttatgtcctcatctctcttagctgttatgcatcaatcggtgggtcatgcacctatacgttctctctctatctcactcaatatatatacacgaaccttcctcgttatttcctcccaagaacatctctcaaacattcctctcttcttcttccaatattttgatccccacacacactcacatcaacacatataaatctcctcgtaaaccctaaaccctagctagtttcaacaactctcttgttccaaccccaagaaaaaagttcaatttcgttagcaatggccaaagttgggaagctgacaaagcttaagtcggctatgaagaaatggccttctttcgccaagaaccaccaccactcaacctcctcagccgctgtttccgacgaactctcagaagacaacaatctccatgtggtttacgttggtcaaactcgaagaccttacatgcttagaccagacatcatctctcacccactctttcaagaactcgtggatcggtcttcttctagatccatcgaacaagatcgtgagattgttgtagcttgtgaagtcgttttgttcgagcacttgctgtggatgctcaagtctggtcaagaaggaggatccgttgaagaattggctgagttctatacttattgacatcgaccgattgattttatacatttatttcgtataatatataccttttttgttgttgtttgttgttgctgatttgtattttcattcgatgcggtgtgtgatcaaaacgtgatctcgtaaaccatgtcatttgcttccgtttttctgagcaattttatgatgatgatgagcatatgtagttttcttactttgttaagaccaaccaagaataaatttctactaacaacaatctttatatatattttccttcaaaatgtatttcagtacctatattaattgtaatatacataaaaaaagaatgcaatgatttcaagaaaacaaactaagttttctggtaggttttgtttctatatttattttattatggcggttttgtaaacttttgtttctattttcgtaacgtatctttctcatatgagtcatgagtctcatgacataataaagaaggcctttgatgatgttcgataaacaaaagttggttgaatatgatgagtccaattcatttattttgctttatataaacaaaatatgactagcaatgatttctatcatcgatattcatttttttttttttttgcgtatcatttgtatggtgtcagtttcaaatctatttttgtgtgtgtataaaatagaaaatacgtatgcaatttcttttaaggaaataataatggtcgctctcatgacgcgttggtgacctggtcccaatttcatgtccctactctcctttctagttgcagacattatatatttatcttttaatattcttgaactttcagccatacaaaataaattaaagcttacaggttaattagtcgatatactaataaatttgtagtttgttgtactaattggcattacttacaccaacatatgtgcattaatatacgtttatagacataaattggtagataaaataactgacattaattttccgaggtgggtacgaaaaggacgcgcagaataattattgaagataagtataattagtaagaccaaaataaattaatttcctacgtaggacgaagttctaatcattataatcaaagaaaagaagtttctttgctaagtttaattaagcttgttaattgattccgacacgctaatgattgacaagtcactcggtgtgtcttttcagcaaacttcatgggacttcttcttctacttctgtcttgttccttacattacatcaatcctatgatattatagtgtttatataaactcggttggtagctaaattgttatgggttgctgcttgttttaacgttgattatagaagaaattaataattacatttgattcgaactcaggttagttactagaagaaattgtaacgaccaaaagacagtgttgggccttagtgggccgtgcaaagagatgggagttatgaaacgacaccgtttagttttaacttagtgtcaaacactctaacctgaacagaaggtctcaacaataagagggggactagcaagaagactctcaagggaaggacaacttcatgaaagctcaggtgaagtgaaaccaaactcatcctttgtcttgacgatttgatttctcttgtttttgtttgtgcaattccctatggattcttctttggtcgttggtcttttttgtttttgtctgtgggtcgatgtgattttatcaattcttgtctttcaagtgtttgttgaaatgcctcaatgggaaaatgtaaggtttttcagggaatccattaatgggttctgctcaacccaaggattcaagtaaccctataacttcagctccgaatagggctgcagtaaaattgcttaagtctctcttcattgggttatgcgttgtgctagagtttccaaagagatgatctttcatttctcttttgcaacctcttgttatcaatctatgggatattaaggttattctccattttcattccggaaagaaattaaccagttagtgttgttcccattgatccagcaacttcagaact

SEQ ID NO: 10672 - DNA, 3000 bp, Unknown; identical to SEQ ID NO: 10664
  misc_feature (1)..( 3000): cDNA_ID_3037601_gDNA_ID_2213667_Annot_ID_182138 3000 nt of promoter + ATG

SEQ ID NO: 10673 - DNA, 3000 bp, Unknown; identical to SEQ ID NO: 10663
  misc_feature (1)..( 3000): cDNA_ID_4268709_gDNA_ID_2213667_Annot_ID_182137 3000 nt of promoter + ATG

SEQ ID NO: 10674 - DNA, 3000 bp, Unknown; identical to SEQ ID NO: 10662
  misc_feature (1)..( 3000): cDNA_ID_2716316_gDNA_ID_2213667_Annot_ID_182136 3000 nt of promoter + ATG

SEQ ID NO: 10675 - DNA, 3000 bp, Unknown; identical to SEQ ID NO: 10657
  misc_feature (1)..( 3000): cDNA_ID_2716324_gDNA_ID_2213667_Annot_ID_182134 3000 nt of promoter + ATG

SEQ ID NO: 10676 - DNA, 3000 bp, Unknown
  misc_feature (1)..( 3000): cDNA_ID_3037605_gDNA_ID_2213667_Annot_ID_182133 3000 nt of promoter + ATG
atgactggttaagtggtccataatccatctcttgtccttattttcctccctttttataccaaccatttatgtatatcttaattacgctgaaagcatgcgtcttagagtcaagtcgccacgaacactctgatatattaatgcttaaaactaattaatctcgattttgccatagatactgttgataactaattcaatcaaaggagatcaacgaaaggaaggcgatagaagaagttaacgtaagaacaaagttccatggggaccaataagatatgcatgtttcctccaatgatgttagttcatttggtaacatgaatcgctattggactttcataactcccttagattatcttaattgatatattttatatgttgtataattgttttagaaccaacattaatggatgcatatactagaatgtatttattctaattatattaatatatcacacctatatatctaattatatatctatctatctataaatattataataataatatatttgattaacatacgttgttttttaaagtattttatacgtatagcttgtgcataaactatgatatgtacctagacggctagacccgttcagcaccgcgtccattcgaatttggactagacaatcgacccaccctatacataataatttgttggttcaaaaaatctcttggattttggtgcttaatttgctcaaaatagtactttggctacactggctagtgcatgtggaaactgatagtagccgttgaaagtcaacctgacccctttgggaaaaggattacaaacttagacccaccaaacctaacctttttaccttagaatacgtgtctttctcaccataattagtttgtttatctctagtaagaattggaactacaaaagtagtttatgtaattaacaaaaacaatgctcgtttgtttaagcaaagcgggggatgggaaaaatgacgtggagaatgtcgattggacctgagttcacgtgattgggagtggtgcggtgggctcaactctccgatgataaagcgaaactgctttttgttgctttccttttgtctcctttttttttcttccagttctctcaccctattttgttcctcatccttatttatgaattttaagataaaaaaatatatatttaagtaattaaaatgtcgattttttttataagttcatttgaattttttaggtttataagtaaaaatcaattggtcatgaatagattgatttaaaacgaaaagaaaagaaactaaaacgtattaacccttgtttaaatacctagttatatacaagcaaatcttcaaacgatattattaaagggatgatgcattagataaaacaaattactagcactctagcagtatcatcaatagtttatggtaataacccaaaccgttcaaccattaaaaaacgatattggtatatagatgtgcacaaacttggtcaacaaaagttcatgtagtcaattataaatcggggattagtataaattttcatacggctttgtattctatcgtggcaccgtggtgtgtaatgtaaagatgattagataagaaatgtgttacacgcccacaacatatgattcaattatttgatggaaaatatagataaaatgtatagagaaaaagtactagaagatgcgaaatccagaaggtaaggggacaatggcatgagttccttcgtgggatttgctttcttaatttcactctttctttctgtctctttccctcttagatttttctgaaattctctagaattttatattagctttagtgctttacataatttacatattatttagttcttttgtcaattagaattacttgtggatcaaactttaatgagcaaatatttctggtcaataaaacgcttcgcagtaagaggtcacaaattaaacccattttttcatatttatattttttgacgtttgatgtgtacggtaagttgaaacttgaaagctatattacaaacttgatttcccatattccttttcatgcatctactattactaacctagctagcaaataaaatgacatgtagcatattggttggtttataatgcatttgttgttactctcgagatttaaactcatatatacatttgttgacaaaaaagtaactttaaatagattttttagattagcgcttctaagttataactatacactgatttctagtgtaatttatgcattctagttctatatacttaatagtaacttttatacagtatttgtgtaagtagttttcaagtgaatttttttctcaacatatacaatgtatattacatataatttacgtgcaccttttaaaaatgaaaaattcgacgaaaatcacacacaacaaaatgtgtggaagcctctatatcttcgtgtcagcatagtaaccattcaaggacgatacaatttttctagggattcaatataatttccctctcctcttatagatagtcgaaaaatggtagaaaaaggaatatttgagactgtttgatgaaacgaagtgccaatatatgaattgtgatcaaagccgtgacgttatctccaatacaaaaactaatattcttattgtactccattaattaattgagctataatacaaattaaatacgtacagaagaatgtttctttgggcctcgatcgtttgcatggggataggtgcgttaatatgagtgctacgttgtgagctgtataaaagaagagtgtgggaataggttttatctgaacagaacttaaccaaaacccaaacaaattgaaagaaaaaaaaaacttttttccttcttccttgatcctttatctttttcgaagaagtgaatctggacgaagaactaaggccgccaattttggaatttgaaccatcaaattcatcaacaacaaaaaataaagatcttaatctttgaatttctacttgtatttaagcttcttgattcaccttaaacccgagttatttcatttctttttccacctctttctttgtcttcttcttcttcttcttccgggtcactaagac

SEQ ID NO: 10677 - DNA, 3000 bp, Unknown; identical to SEQ ID NO: 10655
  misc_feature (1)..( 3000): cDNA_ID_3037608_gDNA_ID_2213667_Annot_ID_182132 3000 nt of promoter + ATG

SEQ ID NO: 10678 - DNA, 3000 bp, Unknown; identical to SEQ ID NO: 10654
  misc_feature (1)..( 3000): cDNA_ID_2716338_gDNA_ID_2213667_Annot_ID_182130 3000 nt of promoter + ATG

SEQ ID NO: 10679 - DNA, 3000 bp, Unknown; identical to SEQ ID NO: 10658
  misc_feature (1)..( 3000): cDNA_ID_2716274_gDNA_ID_2213667_Annot_ID_132722 3000 nt of promoter + ATG

SEQ ID NO: 10680 - DNA, 3000 bp, Unknown
  misc_feature (1)..( 3000): cDNA_ID_4265991_gDNA_ID_2213668_Annot_ID_132724 3000 nt of promoter + ATG
agtgtaacccagacctccaacaacgtttacttagctaaaaccaggcgtcaataaaatgccttgctttaaaagttcagtaaattagtggatgagaatcccaaaaggagaaacagcaaaaccaccactacttgcatagatcagtactttataattaactggtgagctaaaggaatgcatcatagtatatttatatcaaccaaagagcccacaatctcctctgtggagaatgtatcaaagttcatagcacctaaactaagtaatcaactaataagagtgggcaaattaaattgaaagtgaataaacaacctccaattgaaacactgactggatcatcatgtccagcaccaaactcttcaagagaatctgcaaaggcactaactccagtagatgcctctcctaaagctcccctataacaaaaaataatgcaattcctaagtttcagaaaagacaactgaagagaaagatacaacaaggagacagaaaaaatgaaggtgagaacgagaatgctaaatctaattcattgaaaaattccttcccattgagtcttaaatggtacaaagtttaaaactttcagctttcaatggtcaaacagttcaagagaatgacttatgaataagacaaagccttatataatagagaaccagagaaagatgattaagatattacgacaaaaaacggaaacaaccaaaaaaagtaggtagagatactcttcttacatgaacttcttaacacctttgtataacttctgacaacgatctttaagctcatcacttgtcccttccaaggagaagacctgatccagtcaataaatcaatcaagtttcaaaactttattggagaaaacttgaatatatcactaatgaggtaaaaaggtagtgtacctgtttttgaaacattggggaatcctcaagattgataaaacccgccattgttaagataaaacacgaagaagcttcagaccaaaagtctacgaatcgagtcaacaagacaagacaagtaaaccctcgaattgctgtcttcttcgatttgaaaatagatctcgcgagtttcagaggcgttttcagctgtctgatgatgttttcatttgcttcgagaagagagacacagaaaaatctgggaactaaagttgtttacaaataaacccctcattttattatttattacagaaacagaggaaaataatatcagataacaaaaccatcctcatgtcacatgtcttacgaaatttaagtaagccactttaataagttcaaaatgttgttgtaacaacactcaaaaagtagaatttatccatcttgctcagcttttaggctctccaaattttccatttgaaacaacaaagttacaaaaaattctttgtctttgttcgtatgctctctaatttctctgttaaagattttgtcctcatagttgcgatcgtcatctctctgttttttttcgataacggtttttgacatgtacacccacacacaccccaaagaaatggatcgaactcattaattttaggatgtaagcaaataccccaaaccattagattgcacggtcttgctcttgttatctctcgtttgatttattctagtttctttcttctgtccaaaaacacttttatatcttcttcacggcttgtttccaaaacctatcattataatttatttccattaaaattttactccattgtgttggtttgaaacctatgtatatgatgacttagaaaaatgtgtatgtatttttagtatgagtttttaagttttacttttgatttattttggagaaaaaaataactaagattataaagtttgaggttctctattaaaaatgataatgaaaattatgttaataatgtttttacttataacaaataaagaatatgttcaaaaaccaaattaaagctagagaaaaaccatatacattcaacatctaaagaaaactaatatggtagtgcaattaaacctgactaatctcgaaagaaaaatcaaaccgaaaaaaataaaaataaaaaaataaacttctgagcttatcctatgagaaagttaactcaaagtaagattttaaaaaaatatcaaaacggaaatctgttgagcaaattaataaatagaagattaaaaatttgtacttgttgttcaagcttctttaatggagaccccagttctttatatttttttgaagaacacatcttgagaagacatctctcatcatccatgtcatacacctcgtacagcatccgatgatttaggttttgtggtgaatatatcttagctagcatcaacatattctatcaaacagttttaagattgaaggaaaaagagataaaaaagaagaggttttcatcgtattctttacatgtacattcaacatcttatcaggatatgcgccatgagcacttgttagcttgtcaagttcgaactttaaacaactagttctttacatgtacattcatcaactagttttttaccatttgagatgaaagagttgaaaaaattattcaacccattcaattttaaaaaattgaaaaaaatgagcaagttataacaacaaaatgttcaacttgttcagctacaattttggagatgaataagttgaatgatattcgatccaaaacttttcgactcaatacttttaatccattcaattttaggcaaccatccgtagccatacatgtaggattaaattccaacgaaaatcctaaagcaaatgacttaattacttttttcataatgcttatttactttcatttttagaaaaaaactaaagtaacggtcttcatagaaaccataggttaaaataaaataaaataaaaggtttttaggttccaactttactttttaccacacaccaatcatttcaacttttgacaattgcgtcaaatacatatccccaacggtaaactttactctctgccttacattattgtcatccacttgttgcaaagttccacattacaagaatcattcgattctcttctatcatcatcttcttcttctccatcaaaattcaccaaaac

SEQ ID NO: 10681 - DNA, 3000 bp, Unknown
  misc_feature (1)..( 3000): cDNA_ID_2716402_gDNA_ID_2213668_Annot_ID_132727 3000 nt of promoter + ATG
gaattcaagatcttaccttctttaattatctttttaaactactattaacctaattttcgttttaatttttgattagttaattctctaaatgtatctgattcgttctccatccaccacacgaaggattgatcctatccacgatggccattttctttgtaaaaaaccagcacctaattacatctaactattgtttttatttagagagattgtataagttatccgaatattattgttgttgtgtgttgactgttggtataatattaaaattgagctcggtttaaattaggttcgcgtgtgtggagttcatccataagagcaatcttactttaagagaagttttgatttaaggctaagggttcaaaagattggagagatgataacaatttagagttcgagttgattaaccagtgttgtattcattttaattaattgatttgttgttatgttaatatatatattgtgtgttatgattgatgaattgttttgtaatctcttaagatcataatgaattgttagcgtatggttgtggccgaattgtgatttttttttttttttgctaatcgaaatataatgtcacatattcatagatcataaaatctcttgttcaaacattctttggtgatcaaagtaacgtgaaatttaaggattccgcaattcaagatagtgaatagtggatgttgtcaagatactgaatagtggatgttgtcagtacaacaattgtgaacgattagaacgtccatctatctaccaagctatcgacatttaagtggctatagtgctagctatttaagtagttatgctatatgttggcttcaatttatagaattaagcttgttatgagttattattggaattaggattgtgattataattgtttttatatttgtgcaattataagatataccaatatattttaacaaaaagtaaaagaaaagaaataggagtataaatataaacgaaacacaaaatagaactgtttaggagaatataaaacttttacgttgtctctacctcttcaaattcaccaaatttattttttaaatagtttccatcacttgtcaatgtcacatcacctatcatctatctctctttttctccctctcgtcctttttcatcactttcatcattcatgcatctctgcccccattctctattttcttctatatttctctagtcaaccaaaaattttgccttaaggaaaccaaaagagaaatccaattgaaaaggatattaaaattaagggtaatattaaaaagaaaattttgggcccaacatcagaacaccattttatgactgtttctattgtcgactgtttgacaaactgaacaaacaatggctttgattggtgaacaaaatcaaagcactacaatttctacaatttataaatttatcaatcaaatatcaaaattgttacactgtttttttacagtttttctgtactatttttctttttcttttttatacatcattatgtaccatcttaccattataactaccaggtaaaaaacttgtaaatttttatattattaataagacccaatatatatatatatatatatatatatatatatatatataagttagcaatccaatggtcttgcagtctttcattattgtaatgatgcttattaggttttgtactaaaattaatgctaatcaatttagaatttacataataatatttagaatcatctgtttttgtaactatcttagttttagaactaaaaataaaataacccaaaaaaaactggtaagtactagtctctaatagctatgctttctttctacaatattatggtagtcaaattataaaaatatggggatgtttcgaatctttctaccgtaaaactggttgtgtccaaacgtatatatttgggatacaataaaataaaaaataagactattaagccaatgaatcataatgaggccataattttaaacgattaatgggctcctaaatatctatcttcataattcacactccacatgaatctattcctagtaaccctaagtgttttaataataggatctagagatgttcgaagatataattgcattttacttttcgtcgtacttatgacgaagcaagccttggacatctccgttttaaaacagggatctcatgatcttgaaaaggattcttcaagaagcacagaaaaagacaaattcgtatgaattattgactcatatcaaagttatttcatataaacaaaatcctatgaattattgacactagtcaaaactcaatgaacagattgattggccgtgaatgctacggtccatgaagggatcgagtgtggaccagtctctgcaatatatgttgttaggttgacttgttttcactagaatcgtatgtttttccaatccatcagtacgtttaacttcaaaccaccgtcaaatgaaagctaatttaaacttcttctttttttgtaatattttgtgtcaacaattgaatttgatccatggtgagagaaacctctaaacgccggagatatttgtgatgttttaacgtggtctttcatcttcaattgctagttacgcctagaaacatatgtgactttaaactatcagataaagacttataaaacacacttttaaaaagtcataaacaaagacatctaataataatcaacccttaattacacaaaaaataataatgtaaaacaatattagaatgatcaatttttaaaatatttagtttttttttttttttggtgatagaaactaaaaatttagactataagccgataaagctgataagcccattaagtataatgagaccctagttttcaaatttggactagacaagcccatttacggttttggtgtaacaccaaaaaatactgttcaatttacaataatacccatatatcacttcatcttcctcgaagaatcttcataatttttaattcatcctccattagaatccctagggttttcttccatacacaatcagactcaacgataagtaccaatcggagaagagatcacaagtggatg

SEQ ID NO: 10682 - DNA, 3000 bp, Unknown
  misc_feature (1)..( 3000): cDNA_ID_2716395_gDNA_ID_2213668_Annot_ID_132729 3000 nt of promoter + ATG
cggtatcagtcctttacttgcattagttccttattgtcacagcaaatatgccacagagatctgaagcttgaaaataccctcttagatggaagtcctgctccacgcctgaagatctgtgattttggttattccaaggtctgccatatatctccagcatgcacttgaatgtgctagtgatttcttaatttatcctgttgtaacaagctcctctttcttctttttccctccatttgcgaggccccttgtcacttccatgtgagctatttttcttcttttgtagtcctcactgttgcactctatgcccaaatcaactgttggaactccagcatatattgcacctgaggttctttctcgcggagagtatgatggcaaggtaatcttattggtttgcaagtattagtatatcaagtatgcttagcatcttgatagagacatcatagtttgaaaaaatttcctgcgtagtaatgtagctctttcaactttttctcatgcataatatgtttatacatcaagaaggtatcgcccatattggcagatatctgctgtggccttgatagatttgggcagtaaacatgtctttttaattatccaggaccagaatgtgttatttttccattttttatcatttaatcgccattccttttttgcatttctcgactctttaagtgcgtttgttcattgataattataagctttctagccttgagccatgcataaagaattttttagaaacgcaatggatcccaaatacttatcttgacccatatgctctatgaaattgttatgatcttattgtttggatttggaaacatcaacttcacagaaatcatcagagttttggtacttatattcttccttctcactcagatggctgatgtatggtcttgtggtgtgactctttatgtcatgctggtgggagcatacccatttgaagaccaagaggatcccaaaaacttcaaaaaaacaatacaagtaggtttctttgtttttgcattctttgcttaagagttgacacgacaccaccactgatcgttgtgccacattgttacagagaataatggctgtcaagtacaagatcccggactatgtccatatctcacaagattgcaaacatctcctctcccgtatatttgtcaccaactcgaataaggtatcatcactctgtcgaaaagcttgtccatcctttttgagataattacttgtataacttatcatttttcttgtcagaggattacgataggtgacatcaagaaacatccatggttcctaaagaacctgccaagggaacttacagaaatagctcaagctgcatacttcaggaaagagaacccgacattctcactccaaagcgtcgaagagataatgaagattgtggaagaggcaaaaactccagctcgtgtttctcggtcgattggagcatttgggtggggaggaggagaagatgccgagggcaaggaggaagatgcagaggaagaagttgaggaagtagaagaagaagaagacgaagaagatgagtatgataagacggtgaagcaagtgcatgctagcatgggagaagtccgagtcagttaaaaaaaaagattgattttcttttcacgaaagtattctaaaaccaaaaaaaaaagaaaaaaaagttttcgttggtctgtcgaatttgtctcttgctctgtgttgagttcttattttcttttcttggtcataatttttaaggttagtctcataaatgctttggaattttgcttctgaaaatcttgtaaaatctgcagtagaagaaagaacaaactggtttgatgataagttcggtttgggcgaataaaatattttgtatattatatggtctattttgcaaattacctcagatttcaccttgtttattttgctaattaattttcatatacaaacagagcttaaaaattacaatttacaacatttttatacttgtgaaattgaaatctcgtgtaatactattttgtcatgttataatttttcaaaaatttatcgttgctgtttttaaaatatggatttaaaaccgatacatggaattattttcctttgaaatcaaaatatatttgtttttgatgtctgtgaaagtgagggagagagagagtgaacctttttaactatcccgccatacgaaaatcgcagaaagctgtaattggagacgcgctctttcttctctctcgcctcgtgatcttaccggaaaagtttcgtcgccggagtttcactatttcgccgcagaagcactagagtttcatctgtttgaaaatgtaatctcgatcttcccgtttcccagtcatttctaggggtttttgttcgctttttctcacaccgattcatttgcgaataatttttgagtgtattgttcggtgttcgtctgtgtgtaaagaggaattttcgttagttatagcagaatcgcttcatcttctagttggagaacttattagcttctggatttggttagttcttcgttttcctatgcatagattttgaaattaatcgtcaaattcgttgtggtgtattgtaattgtcatagcgatcatgattacagctcaaaatcggcacaattgtatcttccagctggtacagtatgcaatttctgcagtttatgttacaatttcatcagattcaactaatcgcaatgccacttgttttgtttttgtacagtaaatggtggtgacaagaggagataaatttgctggaagctctttggcatgtaaatctatgatcggtgctaataaaatgaggcaaaattgatcatatccctgtccattttggttttataaagaacttttcacggatcttttgttttattcttcctgattgtgtaaatgcagtgggagtcatctccatgaagttaataattccagaagtcactttcctcaaacaaattggttgaaagttgccaaggcgtttgagtgtataccatccttaaataagtttatgggctccaatttcctttactctctagaaagtcaaaagctgggaagagatagagaaatg

SEQ ID NO: 10683 - DNA, 3000 bp, Unknown
  misc_feature (1)..( 3000): cDNA_ID_3037642_gDNA_ID_2213668_Annot_ID_132732 3000 nt of promoter + ATG
cagagtaatgacatctggaaactctggattcttcgcttccaatgtcaagttgactgatgtcacaagaaaaacaaatcaaagttgaccagaaaaagaaaaagcaactaattaattacataattaagagagaaaaaaaagagagagtgttttagtaaaagaaaattaatattcctgaaaatatgaatttgccaatttgtaacgttttctgaaaatttcctctgccaaagtccaaaggagagtttttctttattactagggcattctctgcagatttcttctccttaagccatggtatgaatctatttttctaaacttcttttatttcagagatttcttctctgtttctattgcaccgatcattcctatgttttattatctgcgatattgtaatactttacatgcatgtgagaagtgacaaatttcagattttgtaattgttttcatctatagatacgatcgtcttaaatctttagtcatataaaaaatttgattgaagttacgcatgattttcagataatcactcattaggtgttagacaattgtggatagctaattgtactatatacagaaaagagattgttactgttcactgattcatgttctgttacatcttttggttggtgattttcaatatctcttaatctttattctattctgtgttttcattacttacatttaggaattgcccccaaaagtgaaaaacatcttgcttttggattctgaaggaaagcgtgtagcggttaagtattactcagatgactggccaacaaattcagctcaggaagcgttcgaaaaatccgtgtttacaaagactcagaaaacaaatgctaggaccgaaggtagatttcgacatcaaccatgttttagatacttcatagtgtacttgttgagtatcttttatcaaatcttttccgtcattacaattgctagttcttgatatgtagtggaagtgacagcactggagaacaacattgttgtgtacaaatttgtgcaagatctccatttctttgttacgggcggtgaagaggaaaacgagcttatcttagccagtgtgcttgagggactctttgatgcagtgacccttctccttaggtttgtctaatcatagcttcaaatttttgttatattatttctacattcccaacttcgctcaaattttcgatcttcctctcttctgaacccaaattacagaagcaatgttgataagagagaggcactagacaaccttgatctcatctttctaagctttgatgaaattatcgatggcgggtataaaaaaaaatcttcttttcgacattactaaaaccattagatcataaatggactgtttcataggttacatagtcaaataaaactatcttatatttcagtattgttctggagacggatgcaaatgtaatagcaggtaaagcagggatcaatagcactgaccctaacgctcctctatccgagcaggtacagtggttttgaaattgtgatcatatttttcttgataattacatcatcttgatacaaactttgaaatagttacattgatccgaactctcaagtaacaccatcactaatgaacttgatacatttctctgcggtgttttttttttccttcagacgataagtcaagcactcgcgactgcaagagaacatttgacaaggtcacttatgaaatgatgtgtgttttgctcttcggtaataatggttgtttttgtcatggtgaatgtgtgttttgtctcttgtagttgagtgactatactcttaaatataaaagttactttgcacttgggagatagttaccgttcttaaggtcaaacaattctctggtgatttcttcactctttttcatgttccatacacaattaaattacaacatacagtatatacctaagattaaaatataattcaacatctacctgttcgagatgctcataagctaaaagtatgatgtattattgcaaatttgcaataggccaaatgggtttaggtagggatactttttttttactatttcaagttttcaactgtgagatatactttactagtaccgtaaccattacattttttaatcaaataatggatctgattggtaaccaaaagttgtataaatattttagatgttagctttatcggaacagtgcaaaacttttagaacgagctctacaaaaaaagctgagagtaaaactttttgtaacgtttttgataaagtttttatgattgataactatcaaaactgtacaaaagtgtattgtgttaccattcaaacccaatatgttttacaatccaaaaagtattgatgaagggtaatattgtatttaacccaaaaaaaaaagatgaataaaaaatgaaattacaacaaaatgtcgacatttagttggcgtgtggctacaatattcggaagaattgtatcttctatgccaagactctaacccgtttctcaactgcaaacttcctcacgatgtcgacattacttgtatctttctccaacttgcttttgtctgatttcatcatcagatggatctgtctgattctcatatttaattcccattcgtgttttttcggattgcgagaatcctacgttatttcttcacttttcatgatcccgaggacatcttagaccccaaatgttcttcgtcgatgttcgtaatcaatcagaattttgattgtttcgattgaagtttgttgttttgattaccgaaactgattctgggttttcttatttaggttctttggaaactggttcctctatacttgttcggatcagaaacaaagtctctctcaggtatttcatcgaacacttcgtcaactatttcatttgacttaaaggttcatattttgatgtctttacatgtgatttgattcaaagtctcgcaatttcttatccattgctaggtttatttactaatgtaatattgaatttgctctgatatgcttgatttgttaaatggtcctctgttttttttaaaaacagcaacagagtccattttgcagatagttcctgaggcaatg

SEQ ID NO: 10684 - DNA, 3000 bp, Unknown
  misc_feature (1)..( 3000): cDNA_ID_2716381_gDNA_ID_2213668_Annot_ID_132734 3000 nt of promoter + ATG
tgctttttctttttctggtcaactttgatttgtttttcttgtgacatcagtcaacttgacattggaagcgaagaatccagagtttccagatgtcattactctgtctggttttctctaaaccggttcctgattcagtccggaccgagatttgggtaatatttggtacactcttctcttgggccgtgtggatcttgggaacattaaaacgggtcttactcgacccggcttaatcatccgaaactctgtcagcccaagcatgtgcctccacaggcccgcctaagttatttatgataaattagttcttttttggtaattaagaaaaatcaagcaattacaaacggacctgtgaccacttctaatcctactatattatttggaaaatacattttaaatgtaaccttaatttttgtaagtaattatataggtatgccattagaaataaaattttaaaaagtaaattaatttatctctttaaggattaaaaagtcaaatactaatttaattaattaaattaattaaaaaacgaaatatattatcaatttccaaaaataatagccaattaaaatcaacatataagatttgatatctaaattttaattaatttaatttaattagaaaaacgaaatacattattaatttctaaaaaaagtaaccaattaaaatcaacaaactatatttggtatctaaattatcatattaattttttattaattattattgttcacttctcatctttatatgattctatttttacggaaaaataatatcatcattataaaaaaataattagagttttttcgcatatgccataatttgaatttttaaaaacgaatataaactgttcaatacatgaaataatattgtaacgggtgaaaaatagatttaagaaaactttctactgagtaacgggacataaatttgaaatatttatattcaatttcatacatattatattgaaaatttataatcttatatactacaatagttaataacatatcagatgtgattcaatttttaatacaagctggaaaatcctagaattgacgggtttagatcgatattaatacaagatgatatactacatgtgaaactcttaaattaacaatcaaactacaagtgtataatctataatcttaaacactaaacaatatagataatatcaacaaaacatatacaactcatatttactatacatttaaaatcaaataaaataatatcatatatttttaaatcatctttacaataaaagtttttagtttaactaaaatataagcctacctgcggtatactgcagattaatctctagattataggacttattggatctaaagacgggtcatcaaagattttctaaactgaagcaaaatatactgaatattcaaatatctatctgttaccaaattataaacaaataagtcaatttaatattttatatatgaaatcaattaaatcttaatcacataaaattagcacaaaaaaaagtattcaacaattaaaaaattaccaaatctctgtgttatataagttttgatactatatttgaataaagtgtaatatacctttttaatttgtattctttaactaatttaagctaactaatatatttgctaatcttattatcaaaaccgactatcgtttcttatctctatagtatttttacaagacttttttggtggatttgggtaaaaatgcattcgggtcatatggtacattcccctattaaataaatatggtgcactcctatgttattagctaaaatgtttagattataatttagagtcatatcattaataaaactaatattaataaaataaatgactttttggcaagacggatttggagggacaggtttttgaatcaacattaataaaaaaataaaatataattaatccaccgtttcaatatgggtttaatctttaatttatgattttttaagaccactaatattaaacatatcaaatcatcctaatttagaaaaaattatataaaaccaaaaatgttatgtggtatgtataatgttactatatataaaattaaactataaaatataaatgtattagagaatgatacaatttgcaaaacttttatatataaaaaataattctaaaattttaaaaattactacttttaaaaaaaatcatgggacgggtaaagaaattacagaacgtgttttattttggaattgagttatatggtggatgtatttgaatcaatatttataaaattttaaaatattattaatatgctgttttaataggggtcaaaacttcagttttttaccaattgtctcatgaattcgtggtatagcgttacttaataacaattataaactgtaaaatataaatattttgtaaaaataaaatttacaagttttaatatatattacttttaaaactaaatcgtcccgcggtataccgcgggttaaaatctagttgctagtttattgttgattacaacgacattgagaaaataatcactcaccagctaatcaacaataaatgtaacaacatcaaaaagattgtaattcaagataatgattttttttcgtcagcaaatgaagattatacgttttgatgttatcataataataatagttatcactaataaaaaatttagatatgtaaaagctttagagaaacaagtatcataatcctaaattggatcctaaattaatatttcttatcttaatagagccaaagagtatttgatccatttggtagaaaataaatataactaaaaacgaataatctaaagacttaagtctttgtaagatccaaataatctatacgtggtagtagttatcctcacttaaatttttacagatcatgattcctattccatcattttatgtatatatatccgtgataggtttcatgatctgtaaatgtcactacagcccctataaatgtcactcttcacctgtccatttttttacacgacaacacttgcaaaagaaaagagcgataaatttgatgaaacatcttttagtctctacctaaa

SEQ ID NO: 10685 - DNA, 3000 bp, Unknown
  misc_feature (1)..( 3000): cDNA_ID_2716377_gDNA_ID_2213668_Annot_ID_132735 3000 nt of promoter + ATG
ttcagtggcttgagagtaaaactcaagagtttgagccaacatatctatataccatggaaaaggtaaacgttattctctctcaagaatgtaaagctcactagtggaaaatgctggagcatcttatcaaagaaagatgtgaaatgaggaattcttcggttgaacttctggttcggtctcacaattgtgttgttctttttccatatagggttacttcttgctgcctgatgaagcaaaatcacggcataacattcgcactgcaaatgtcagcatatcggcacggcatccctgctttggcaacaggtaatattcacgttattggccctcaatttggaaacagtgattttaattgctagagctgtatccttatgataagcttctaaaattggattactttttcaggtggcagcaacttcttataaacagagttgttggatatgatactattataatgaatagcttacagaactctgctggtcaaggtaggcagtaggtctttgtcttgttcataatgtccatgcaagttttgctatttgtgggtctcatcctttgaagcctgtaattcctcaactatgggtttgtcttttcttttgtattttgtgcggaaactgtttctttctgaaatgttaggctaccactaaaaagaggttgtctatttagcttattgtaactttaaactaagttatcctcggggaattctagtcgaatttcagtgtgcagcaatatattggttcatgcaagactttgcaaaatgtaaaataaccaatgtcgttgttggtagctgttacatgatatttccatctgtcgttgtcgctgctcatgtccctttgattgtttcttactttctatatgctattgtgaaagcgtcagtttgcactccatatgactgccaacttcctccattacaggttatctatacaactaccagacaagagaattttacaatctcagttactcccaagaacttcctgacggttctgcgcatttcggaggtttgtcattttctgtcacggaaacagcatatgttgaaaactttcccttgaatctcgcaagtctatcgattatgagcgttacgttggattggaagatcttaccttggctgctttattagctcttgcaacttttatctgtagtttggtgtaagcatttactttaagagtaatattttaatgccggtgtatgcagattacttggtgacgaaatgtggtgtcctaatgatgtcactttttgtgtttttcacaaccacaatgtctgtatcattcacattgcgagagacacaaactcgcatgttgaagtttacaggttagaatttcttctattccaatagcttatggtttccaatctttgcttctcaacaatcatctttgtttcgatatcactttgttgcagtgcagcttcaacaccatgcccagcatcggttaccaacatttcagttgatctttgtacacgtgatcgaatcgcttgtctttgtaccggtatgcatacataaccctggttcttttttattccaagatttcagaggattctcttaagcgacatgatataactatttgaaattgcagattatgattgggattttgttcttcctgtttgagttttacgacgatcagctattggcttttatggttctagttcttgtctggctttgcgaattattcaccctgataaggttttggtctcctcttttgcctcagtcacctgtatttccactatgaagctcttttgctcgtgataatctcactgccaagttaaagttttttttgtagctgttcaatggaataataacaaactcttatcctccatatattgcagtgtcaggacaccaatatcgatgaagttcttcccgcgtttcttcttgctgtacttcttggtgttccatatttatttcttctcatatgcatatggtaagagatgtggttttacgttatatttgtctcattaactactgaaactgcagacgcgttcacttactgcataactctccacaggtttttcttatctcgccctaatgacaaccgctgcattcatgcaacacttaattttatacttctggaaccgttttgaggtacgcgtttgattccaacaactcgaagattggccaaatccagagaagctaagcttcaattcaaagtttttatcacaaaattacaggtaccagctcttcagaggttccttcaaagccgacagtcacaccttcagcaacacccagactttcacatcacttcctcaacaatcctagcatcaactcttcacatcacaaggctgaacagaacaacaagaaaccgaactccgtctggtcctaaccacacaaccccaaaccaaaacacggaaacaagatcttttacagcggatggaggaggtgtcgggaatccggcacaatatcaagagcagcaagaagagaatgaagcaaacaccgttcctgcagagcctaacccacaacaagcaggcgcaatgagctcgttcagctcgatgcttctatggattttaggcggggcttcgtcagaaggacttaactcgtttctttcgatgtttagagatgtgagagatgaagatgaagcacaagtgtttgcagatactagtccacctcaaaacccgcatcatgatcctctttcagttgattaaagttttttttttctttgtttgctgtatattttgtatttttggcctctggtttttgttccttgtttgcttgtatagtcactggccaaaaacagactagcttttgaaatattaaggtgatcaaaaattggtaaagaagggagaaaaaaaaatgattctgaaaagcttttgagaaaatgtggtaaagtcataattttcgcaaaatactttttatcatttctatgtttttatatgttcctaaaatattaataaaaaaaaagaacaacaaatgtgatcagtagagtaagtagtaattacccaatcagagatacgagttatatatatgaggaggataaataaacttgtcaattttatatgaaccttctccagagttgtaaggacatg

SEQ ID NO: 10686 - DNA, 3000 bp, Unknown
  misc_feature (1)..( 3000): cDNA_ID_3037671_gDNA_ID_2213668_Annot_ID_182189 3000 nt of promoter + ATG
aaaggtcaacacaactaggaaacctttatagaatccttaaagggaaagtagaagggcgtgatcctaacgcaaaaaccggcagcggaagcggaagaaaagctggagccggaagcgctccagctggtggaaagcaaggaatggctgatgctcttgctgagatcacaaagaaatctgcatattttttgcaaatacaagccgatattgcaaagtacatgacgtcaataaatgagctgaagattgagatcactaagttccagactaaagacatgactgagcttcttagcttccaccgtcgcgtcgaatcagttcttgaaaacctaacagacgagtcacaggtctgcaacatttaaacatctttttaccatcactttcatatctaatatcctctgtttttgtgattcttgattgtgaaagtgttctaaaatttttaggttcttgcccgatgcgaagggtttccgcagaagaaactcgaagcaatgagaatggctgttgcattgtacacgaaactacacggtatgatcaccgagctacagaacatgaaaatagaacctcctttgaaccagcttcttgataaagtagaacgttacttcaccaaggtaactacaatactttatttaatatcttcactaagatcctaatttcaactacattttgtaacttaaatatccaaaactcaatgattaatcaaacagatcaaaggagacattgacactttggatcgaaccaaagatgaagaatcaaagaagttccagagccacaacatccactttgatttcaatatacttattcagatcaaagaaacaatggttgatatctcatcaaattgcatggaacttgcattgaaggtaactaactgctaatactattaaaacaactttccttttaactctttttgttgtacgaaatcttatcgtatcaacaatggattcacaggaaaagagagacgaaaagctcgtgtcccccgatgcaaagccgagtttgaagaagacagtaggatctgctaaaatgctttggcgggcatttcagtttgcattcaaagtctacacatttgcaggaggacacgacgatcgtgctgattctctaaccagagagttggctcatgagatccaaactgattctgatccgaacccatgatgattacatcattcagatcatcttcacaagttcccaactactactcctttttgctattttcaacagcgtaaaatattttcctaaaatgttcgatatcgaacaataaaagagtttatgtatatgtataagctttaacctattgtttttgacttttgaatgtgtataatttttgagtctccctcaaaaaaataggatttagaagtttcatgggagctcggagatacagaatcttttgagtgaaaaggctttaagaaccttttaagtcaagcaagaccttttgtgttgccacaatatgtaatattgttttgctgttatatattaaagtttttctttcttttaacttttatttgtaaactaaaatgtcttcatttagcaccttcaatgccacatcgaaatacacagatactattgtgtcactaaataatttcacatttttaataatcttcattcacatgtacatatataattatattctgccaaaatttaatttcataaaccaaattttatatttgtttacaaccaaagaaacgtgaatagagcaagaaccaaagaaacggcgatattgtggtcaaacaaccactctatctgataacaaaaacacgtccaacatgaattaataaatagtctcttatcatatcaattttcagttcctatataattaagtttcactttcttccttaatagctcttcaaaacactttttgtccaaactctctcttaaaaaatgaaggtctctcctcgtttgaactcagcccttctcctattgttcatgatccttgccacaggttcttaattcataccatcatgatacatctaaataaaaactcatgtcaacatgtaatcatctacataatatatttgcaagtctacataatatgatacatatggtatccgtcattgtattttggttaacatatttgatgtatgattatgcagaagcttgtggataagcccatattaattacatgttcgaataatctataacgtttaattaatgtcttgtagtgatgggtctggtcacggtagaggcacggacgtgtgaaacaagtagcaacttgttcaacggaccatgtctgagctcaagcaattgcgctaatgtttgccacaatgaaggtttttcagatggtgactgccgtggattccgtcgtcgctgtttgtgcaccagaccttgttgatagatgatctatttatatataatgaatatatattatcaaaaacttaataatcttttctatgttttctatctctttgatcattttctgacttttatcctagatatcgtttgcccttgaaacaacaataaggagatctaaaatctttaagcccttttggcttgagctttcgattatctaccaaggttaaacaatagtgccttttagttaccattttcaaatcttatgactttttatgtatccaattagattggacttacgcatccaatataaataaaacatgattatgtataatatcgcatttttctttgaataaccaatggtccatgagattttatcccgatattattgttagctaaaaaagtttatagtgaatttttcttaccactagagcacaaaaaagttgatttaccaactaaataaaattatctcttataatttcatttagcaataatcaaaataatattcgaaaagacaaaagagcatgtaaaaagcgtgcgaatggaaaacaaaaaattaataacacgtgtcctcttcgttcacaagtttcctctttccttagcacagtatgttttttgacttcttcgcgtcggcgatattatccagaaacagtagtgtcgaagaagaagaagaagaagaaggagagattctgagtttagggttttgtttgtgttgcttcgaattgagcagctatg

SEQ ID NO: 10687 - DNA, 3000 bp, Unknown
  misc_feature (1)..( 3000): cDNA_ID_2716365_gDNA_ID_2213668_Annot_ID_182185 3000 nt of promoter + ATG
attcttcaagatccactttttcggataatgatttttctgagaagaggaacaagagacccagaaacggtggtggagggtttggttcgaattcgactttgatggaggctcaagagttcggcgagttaattgagaatgaggacgaagttaacttcgctcttgatgggttgaagaaaggacataaagttaggatcagaagagctgctttgtcctctctactctcgatttgtgaatctcagtatcagcgacgctctttgagagctttagggtatgtttatttacttaagattttcagtatcttcctttctagactttctagggtttgtttgaagtcgagttcttttaaaagtttctgaattttgttatttcaggatctcacagtccataattgatgcgattttgggtctttgccttgatgacataccaagcaatcttgctgcagctacccttttctttgtgctaactactgatgtaagtaacttatttgcattgtgaaatctgcttgtgatgctcttttctcttgctccattggcatttttctcttgtttactagttttatgttcatgattctagggtcaagatgatcactttatggagtcacccaactccatcaagtttttggttaagctgttgagacctgtggtttctgccagtactaaagtaaagccgcggaatataggatctaggctcttatcaataatcaaggatgttgatgcagcacgtgatgcagccagtatgcatgatttaagctcctgtgatataattgacagagctcaggaaattcttgttaattgcaaggagttgagattgattgatagctataaaatcgagaggatgaggcctgagctaagtacgaaatgggtagctttgttggtgatggagaaggcgtgcttgtccaaaatctcttttgatggtactttaacttcctgtctgttttgctggaacaatgactagctaactatttaagacgcatctggtatattatattgagttatagaattggaaagttatgttatctgcttcagtgaatcagtttaacaaatgtgtcagcggtaatagaatcctacgaccagattataattgatttataaatttctaattattgatattatcattccccatccagatacctctggtactgtgaaaaaatctggaggaatgttcaaggagaaactgagagaacttggaggacttgatgctgtctttgatgttgttatggattgccacactgtaatggaggtgtgaacctgtatgttatagggatcttgctatatatgtctttatttggctaggacgtcaataacttgtgtaaagtgtcgtagattggtagctttataattgtttgctatcttcaggttcatgttttatttcaatctaatttattgctgaaaatcgttgcaagtcaaggttcttttcttgtccttgggcaagagaattctcttgtttgtgtaacacagtttaatgttattgtgactgcgtttgttgtggacaagttggatgtctgtcttagtggtggcaaagactctgtacttaagttgtcaatagttactggacctttgcaactgtatttaataagagtctctattgcatattttgtttgcagagctgggtgactcatgacacactctctgtcgaggatataaaagatgacttgaataagcagagtctgatgttacttctgaaatgtctaaaaatcatggagaatgctacattcctcagcacagaaaaccaggtaacttttatttattttggattcccagcctcatgatagcttgtattgaatagctctgcagtttgcacctaaaaaataactgtacataatatatctttcagattcatttgctcagacttaataaaagcatgggttctcatgaatcccgactgtctttcacagagctcatgataagtgtcatcaaaatactttcaggtacccattcctatatttggattttaccaccatgacttgcttcgtatgttatcatctcttatgctgatggctggttggaatgattacaccaggtcttcagttacgtgctcacaggaacgaaaagcatcctcaccctcagccacatctagcttctgctgttaagaagggctttgtgacaattattagttcagatacttgctctaccactggctttagctccataaaaagtttgagcgtatccaagagaaatcagtctgcattcctggtaggttgctcaacgacaccaaagccggggtctcaatcaagtgtaatgtcgacaattgatcactgcacgctgacgactacagctggttccaacactgggtcgtttgcaggcagattagcctcattgggtagtggcatttccagaagtaaaacaaggactagccaaactagagaatccagttgtaaaaaagttgaaaactttgcatccttcgaggatagtcaagatcctttttcatttgatttagaagattcaggaccttccagatgggcagtaggaaagcaaaagaaatctaaaggtcaaaagaggaagggaagctacagagataagaaagatgaacgctcgcttcagctcttctcgagccaggaggaatcaaaccatggtttaaattctcaggaggaatcaagtgatagagatcaccatgtaacagagcaaccttctttaacatatgacattgataaaggatgtctctgtcttttatctgattgccttttaacagccgtgaaggtaatgtacagtctttttaacaattacttttctgttatgtaacaaatttctgcagctggaatgaaaatatgtttggaccagaatggaatgtcaccttttatgctaatctgtttagatatgtgaggatatcatgtgatcttttgctacgttctgattctgttgaacatattttcaggtattaatgaacctaacaaatggtaattctgttggttgtcgggaagttgctgcctgcggaggactggagagcatggctgaattagttgttggacactttccttccttcaccagatctccgctttacagtcag

SEQ ID NO: 10688 - DNA, 3000 bp, Unknown
  misc_feature (1)..( 3000): cDNA_ID_3037686_gDNA_ID_2213668_Annot_ID_182181 3000 nt of promoter + ATG
atcatgccacttcaatgcaagctatgaagctttattgcaaagtgaaagatatgttagaaatgcttgattgtccattaccaattagtttcaaggatctcttacgccctgaatcatcccgaaccgagtttttcatcagcgcacttttgaactatggtctatacaagtatgtccttcatgctcttagttcttctctgtagtatctatttcgatgcaccaagaagttaaaatagagagttcttatttgtcccacttgatcttctttaatctttttttcgtaccagagactcgaaaatggatcttataagaccaaaggcagaagagttgggtctccttgatgagcagcgaaagcagtgtgaggcaaaggttgctcaggtaatgcaagaaaaatatgtatcccatagataagtcatttatctttttctaaaagctgtacatgcagttgaatgcagagattggagaatttgatgaagccgttgagagggacttaccttttgtccaagagctagaagcgaacattgaacaactgaataaaaaaatattggaactaaataatcagcagatgtcactgcgagctaccttccagaaaatgagagagaagagtacacagatggataacgaggtacgtaaccgcaggatatggtgtcgagctccttcctcaaactaaattgggttatttgtaatttattatgaagttggtgaagaaacaaattttgtttgtcaattaggtgatttgcatatgcttgaacttgagaggcgttttctgctcctgacatgtgtatttctctctacagatttccaaagcagagtttgatcttgtggaaactgtccaagaaaatgcaaacctccgctcacaaattgttcaatcaccggacaaattgcaggtatatttttattccaactagtactagtcctaagataaacttttggtatacactagtataaacgtttgttgtggagacagggagctttagaagagaagaaactagtacttggggaaacaaagaaagctgaacaatcagcaatggtaactttccaggaaaaggctgccattcttgaggtttttgaaaaggtatctaatgaaaactctagattgttactaaatcctgtcgcttagcaagtagctaaatgcatttacgacatttgcaacttaatggtcactgcggatactgctctcaaaccagtttttagagaaggatatttcaagtcattattcttctaagtttggtgtgtttattgctctatcacttttgttcatacttcatgaaattctgtccagaagctttaggaagaacttcttttattttgttgtatagtggatgagaatgatcccaagatggaaaatattagattgagaccttattctgtgttgttacttcaaaattttcttatgttttgtcttgcaacagttttatgctttatttttgagtcgaataagttttgctttaatattgaggtaataaagtttattcaactatggttgccttttgcaggccttgaagaaaattttaaagtcatcttcgcaactgcagttaataaacgaacaggtgaccaagcaaaaaaactcctttcctctttcattgcttatagattgtgaaccatgtattgtatctctagcatgtggcaacacacagatccttccaattattggaatgagatctaatgtgtctttagatttatctttcatttttatgtatatttgatgatgttacaggtaaccaatgcgaaaacggttgagaaagaattcaaagctcttaaagataagctgagtgaggatggggtagcatacaaatcacttgaggcgaaagtggttgagcgggaaagaataggcaagtgttggtttatttcttccttcttcagatattgtttctgaattttgttttgggacggagactgtaatcatctcttctgtcaacagtggaacagttgaacgaatcattgaaacaactagagaaagaaaaagcagtcatgtttgatgattggacgaaacagttgaatgaattaaaagtggaggttgaatccagaagacgtgaacttgaaaccaggcaaacgaatgttgaatcagtagtagctatggtattgcttcctttctatcgaacatctaacaacgtgaatctgttgtgcacgatgctttatcatctccgtaagttttatttgtttatatatcaacaggttgatgacaatactgcgaagactaaccaggtgagacagtcaggagaagctaaagttaaaaaactagccgctaaatatgaagagatcgtgaagcaggtttatttcgtttccattatttttatctgctaatatattgaaccatggaaacaaaagctttgtggtgcatcaagttaaagaggtttccaaagttaaaaagctactagggttcttccagattctctgtaagacatattagtgagccttgcttttgatatttgcagtttcatgaatacacggtgtcgtttgatgcgtttctaccaagcctctaaaggacaaggaaggtctgattcatctaaattaaggtagacgagagattgtaatgagcacattttctctgcaaatggttaagaatttgactactaaattcctcttgtgattgtattaaagttggaaaatgttatgaatttctcttcatggaaatggcatgtattgaagtagtttataaaagaatgttaacagaaaaaaaatgaagagaaaatgagagctttatggttgtgttgaaggaatcgaactcttgtcctggaagcaaaagaatcctatcgctttcccaattgcgccactctcactagggatttttgaagaaaaataaaaacaatttaacagcaaacaaagtgtaaaatttgcttcgcggtgcttttcttttcaatcatcttcactcttcaatttctgtggattcgacaatctcccagaacgagaagaaatctacgatcctcgcaacggagcaattcaaattcgatgactacgtagtgttaacgaagaagacgaaaaagtgcatcggagatccgaaatatg

SEQ ID NO: 10689 - DNA, 3000 bp, Unknown; identical to SEQ ID NO: 10684
  misc_feature (1)..( 3000): cDNA_ID_2716381_gDNA_ID_2213668_Annot_ID_182174 3000 nt of promoter + ATG

SEQ ID NO: 10690 - DNA, 3000 bp, Unknown
  misc_feature (1)..( 3000): cDNA_ID_3037708_gDNA_ID_2213668_Annot_ID_182173 3000 nt of promoter + ATG
ttaagtgaggataactactaccacgtatagattatttggatcttacaaagacttaagtctttagattattcgtttttagttatatttattttctaccaaatggatcaaatactctttggctctattaagataagaaatattaatttaggatccaatttaggattatgatacttgtttctctaaagcttttacatatctaaattttttattagtgataactattattattatgataacatcaaaacgtataatcttcatttgctgacgaaaaaaaatcattatcttgaattacaatctttttgatgttgttacatttattgttgattagctggtgagtgattattttctcaatgtcgttgtaatcaacaataaactagcaactagattttaacccgcggtataccgcgggacgatttagttttaaaagtaatatatattaaaacttgtaaattttatttttacaaaatatttatattttacagtttataattgttattaagtaacgctataccacgaattcatgagacaattggtaaaaaactgaagttttgacccctattaaaacagcatattaataatattttaaaattttataaatattgattcaaatacatccaccatataactcaattccaaaataaaacacgttctgtaatttctttacccgtcccatgattttttttaaaagtagtaatttttaaaattttagaattattttttatatataaaagttttgcaaattgtatcattctctaatacatttatattttatagtttaattttatatatagtaacattatacataccacataacatttttggttttatataattttttctaaattaggatgatttgatatgtttaatattagtggtcttaaaaaatcataaattaaagattaaacccatattgaaacggtggattaattatattttatttttttattaatgttgattcaaaaacctgtccctccaaatccgtcttgccaaaaagtcatttattttattaatattagttttattaatgatatgactctaaattataatctaaacattttagctaataacataggagtgcaccatatttatttaataggggaatgtaccatatgacccgaatgcatttttacccaaatccaccaaaaaagtcttgtaaaaatactatagagataagaaacgatagtcggttttgataataagattagcaaatatattagttagcttaaattagttaaagaatacaaattaaaaaggtatattacactttattcaaatatagtatcaaaacttatataacacagagatttggtaattttttaattgttgaatacttttttttgtgctaattttatgtgattaagatttaattgatttcatatataaaatattaaattgacttatttgtttataatttggtaacagatagatatttgaatattcagtatattttgcttcagtttagaaaatctttgatgacccgtctttagatccaataagtcctataatctagagattaatctgcagtataccgcaggtaggcttatattttagttaaactaaaaacttttattgtaaagatgatttaaaaatatatgatattattttatttgattttaaatgtatagtaaatatgagttgtatatgttttgttgatattatctatattgtttagtgtttaagattatagattatacacttgtagtttgattgttaatttaagagtttcacatgtagtatatcatcttgtattaatatcgatctaaacccgtcaattctaggattttccagcttgtattaaaaattgaatcacatctgatatgttattaactattgtagtatataagattataaattttcaatataatatgtatgaaattgaatataaatatttcaaatttatgtcccgttactcagtagaaagttttcttaaatctatttttcacccgttacaatattatttcatgtattgaacagtttatattcgtttttaaaaattcaaattatggcatatgcgaaaaaactctaattatttttttataatgatgatattatttttccgtaaaaatagaatcatataaagatgagaagtgaacaataataattaataaaaaattaatatgataatttagataccaaatatagtttgttgattttaattggttactttttttagaaattaataatgtatttcgtttttctaattaaattaaattaattaaaatttagatatcaaatcttatatgttgattttaattggctattatttttggaaattgataatatatttcgttttttaattaatttaattaattaaattagtatttgactttttaatccttaaagagataaattaatttactttttaaaattttatttctaatggcatacctatataattacttacaaaaattaaggttacatttaaaatgtattttccaaataatatagtaggattagaagtggtcacaggtccgtttgtaattgcttgatttttcttaattaccaaaaaagaactaatttatcataaataacttaggcgggcctgtggaggcacatgcttgggctgacagagtttcggatgattaagccgggtcgagtaagacccgttttaatgttcccaagatccacacggcccaagagaagagtgtaccaaatattacccaaatctcggtccggactgaatcaggaaccggtttagagaaaaccagacagagtaatgacatctggaaactctggattcttcgcttccaatgtcaagttgactgatgtcacaagaaaaacaaatcaaagttgaccagaaaaagaaaaagcaactaattaattacataattaagagagaaaaaaaagagagagtgttttagtaaaagaaaattaatattcctgaaaatatgaatttgccaatttgtaacgttttctgaaaatttcctctgccaaagtccaaaggagagtttttctttattactagggcattctctgcagatttcttctccttaagccatg

SEQ ID NO: 10691 - DNA, 3000 bp, Unknown; identical to SEQ ID NO: 10681
  misc_feature (1)..( 3000): cDNA_ID_3438598_gDNA_ID_2213668_Annot_ID_182167 3000 nt of promoter + ATG

SEQ ID NO: 10692 - DNA, 3000 bp, Unknown; identical to SEQ ID NO: 10680
  misc_feature (1)..( 3000): cDNA_ID_4265991_gDNA_ID_2213668_Annot_ID_182163 3000 nt of promoter + ATG

SEQ ID NO: 10693 - DNA, 3000 bp, Unknown
  misc_feature (1)..( 3000): cDNA_ID_2716373_gDNA_ID_2213668_Annot_ID_132736 3000 nt of promoter + ATG
atgtgttgatgcttttggttgcagctttcatatagatcatgcagcatctctaccttattttctggagaaggtttgtttctcttttcaaaatgattttgttttttgggatgtgttaaaacatagctgagaactaattcaggttattgatgttttgatcagacgacattcaatgggcgggttttcatgacacatgcaacaaaggccatctacaagctgttgcttacagattatgtaaaagtgagcaaagtgtctgtggaagatatgttgttcgatgaacaagacatcaacaagtctatggacaaaattgaggttagtactgcattatattctatgactatgtttatactttgactgctccactaggtttgggataagttcaaaagaaattaaatctgcttcaaaactgtgattgttgagttaaggtttatatttgatttcctctataggtaattgacttccatcaaacagttgaagtgaatggcataaagttctggtgttacacggcaggccatgttttgggtgcagccatgtttatggtggatatagctggtgtccgaatcctctatacaggcgactattcccgtgaggaagaccgacatctgagagcagctgagcttcctcaattctcccctgacatatgcatcattgaatccacttctggtgtccagcttcatcaatctcgtcatattcgtgagaaacgcttcactgatgtaatccattcaacggttgctcagggtggacgtgtgctgatcccggcttttgcactgggccgtgctcaggaacttctcttgattcttgatgaatactgggcgaaccacccagatctacacaatatcccaatctactatgcatcaccactcgccaaaaagtgtatggcggtttaccaaacctacatattatctatgaacgacagaatccgcaaccagtttgcaaattctaatccgtttgtgttcaagcacatttctccattaaacagcatcgatgattttaatgatgtcggtccatctgtggtaatggctactcctggaggtcttcaaagcggtctctcaaggcaactctttgacagctggtgttcagataagaagaatgcttgtatcataccaggttatatggtggaaggtacactggccaagacgataattaatgaaccaaaggaggtgactcttatgaatggtcttactgctccgctcaacatgcaagtgcactatatatcgttctctgctcatgcagattacgcgcagacgagcacgttcttgaaagagctcatgcctcctaacatcatccttgttcacggtgaagctaacgagatgatgaggctcaaacagaagctcttaacagagtttcctgatggaaacacaaagatcatgaccccgaagaactgtgagtcagtggaaatgtattttaattctgagaaattggcgaaaaccattgggagattggcggaaaagacacctgatgttggcgatacagtaagcgggattctggtgaagaaagggttcacttatcagataatggcacctgacgaactccatgttttctcacagctatcaacagcaactgtaactcagcgaattacaatcccgtttgtaggagcttttggtgtgataaaacatcgcctggagaagattttcgagagcgtggaattttcaacagatgaggaatcggggcttccagcactgaaagttcatgaaagagtaacggtgaaacaagagtcagagaagcacatctcacttcagtggtcatcagatccaataagtgacatggtttcagactccattgtagctctgattctcaacatcagccgagaagtccccaagatcgttatggaagaagaagatgctgtgaaatccgaggaagagaacgggaagaaagttgagaaagtgatatacgcacttcttgtttcgcttttcggggatgtgaaactaggagaaaacgggaaactggtgattagggtcgatggcaatgtcgctcagctggataaagagagtggagaggtagagagtgagcattcaggtcttaaggaaagagtgagagtagcttttgagcggattcagagcgctgtgaaaccaatccctctctcagcttcttagtagctttttaaagtcatcgttgaggtatcttaaatcatcatagagttttatccatctgatgatgtttctgttcccatgtttagtaatagtgaatgatcaagtctaatggatgttatttaagaaggtgtttattgagaaactttgctactaccctactgtgataatgatcaagtcttatggatgttatcaactatgagtttttaacttttttaggttttttcataaatcattttgctgattcgtgcttttcccatatgcatttttctatcattatgctgatctaggatatggaagcaaaagctttgtggtgcatcaagttaagaggtttctaaagttaaaaaagtactaggcttcttccagattctttgtaagacatattagtgagccttgcttttgatatttgcagtttcatgaatacacggtgtcgtttgatgcgtttctaccaagcctctaaagtacaaggcaggtctgattgagctaaagtaaggtagaagagagattgtaatgagcacattttctattatttttccacgtacaaagtatacattattcacatcagtgaatgtctcttgacctctatgttttggcaagatgtctagtgcatcaagatattaagaccaaatctctacaatattaaaatgcttaatttttttttttgtagattaaagtttcttttttaattttatttataaaagcttctacgttctaccgtatccaaatatgcatcaatatctgcagagactgcagtttcatataggcgggaaaagcaaatgcaaaaaacaaatcgaacctgacccaactaaaatcaaaggctctcttttttttttttcatttctttccaaattgtcattttcagtttcttcgaatccagacacaacaaatccgaacctgaccaaaactgaaaactatg

SEQ ID NO: 10694 - DNA, 3000 bp, Unknown
  misc_feature (1)..( 3000): cDNA_ID_2716365_gDNA_ID_2213668_Annot_ID_132738 3000 nt of promoter + ATG
agggattggtttcacagcgctctgaatccgctcaaaagctactctcactctttccttaagacctgaatgctcactctctacctctccactctctttatccagctgagcgacattgccatcgaccctaatcaccagtttcccgttttctcctagtttcacatccccgaaaagcgaaacaagaagtgcgtatatcactttctcaactttcttcccgttctcttcctcggatttcacagcatcttcttcttccataacgatcttggggacttctcggctgatgttgagaatcagagctacaatggagtctgaaaccatgtcacttattggatctgatgaccactgaagtgagatgtgcttctctgactcttgtttcaccgttactctttcatgaactttcagtgctggaagccccgattcctcatctgttgaaaattccacgctctcgaaaatcttctccaggcgatgttttatcacaccaaaagctcctacaaacgggattgtaattcgctgagttacagttgctgttgatagctgtgagaaaacatggagttcgtcaggtgccattatctgataagtgaaccctttcttcaccagaatcccgcttactgtatcgccaacatcaggtgtcttttccgccaatctcccaatggttttcgccaatttctcagaattaaaatacatttccactgactcacagttcttcggggtcatgatctttgtgtttccatcaggaaactctgttaagagcttctgtttgagcctcatcatctcgttagcttcaccgtgaacaaggatgatgttaggaggcatgagctctttcaagaacgtgctcgtctgcgcgtaatctgcatgagcagagaacgatatatagtgcacttgcatgttgagcggagcagtaagaccattcataagagtcacctcctttggttcattaattatcgtcttggccagtgtaccttccaccatataacctggtatgatacaagcattcttcttatctgaacaccagctgtcaaagagttgccttgagagaccgctttgaagacctccaggagtagccattaccacagatggaccgacatcattaaaatcatcgatgctgtttaatggagaaatgtgcttgaacacaaacggattagaatttgcaaactggttgcggattctgtcgttcatagataatatgtaggtttggtaaaccgccatacactttttggcgagtggtgatgcatagtagattgggatattgtgtagatctgggtggttcgcccagtattcatcaagaatcaagagaagttcctgagcacggcccagtgcaaaagccgggatcagcacacgtccaccctgagcaaccgttgaatggattacatcagtgaagcgtttctcacgaatatgacgagattgatgaagctggacaccagaagtggattcaatgatgcatatgtcaggggagaattgaggaagctcagctgctctcagatgtcggtcttcctcacgggaatagtcgcctgtatagaggattcggacaccagctatatccaccataaacatggctgcacccaaaacatggcctgccgtgtaacaccagaactttatgccattcacttcaactgtttgatggaagtcaattacctatagaggaaatcaaatataaaccttaactcaacaatcacagttttgaagcagatttaatttcttttgaacttatcccaaacctagtggagcagtcaaagtataaacatagtcatagaatataatgcagtactaacctcaattttgtccatagacttgttgatgtcttgttcatcgaacaacatatcttccacagacactttgctcacttttacataatctgtaagcaacagcttgtagatggcctttgttgcatgtgtcatgaaaacccgcccattgaatgtcgtctgatcaaaacatcaataacctgaattagttctcagctatgttttaacacatcccaaaaaacaaaatcattttgaaaagagaaacaaaccttctccagaaaataaggtagagatgctgcatgatctatatgaaagctgcaaccaaaagcatcaacacattatatgttatcttaacccaataaacctcttacacaaaacacaaactctttcaagtagacaaacagagacagaacaaactctagcctcctacaagcttgaactaattaatccaagaaggtctctctactacacatcatccttctgtttttgtataaacaaacttaaacttcgaagattttgctcaaattatcattctattcaaatcaagactatcattttctcttcaaagtttcaatttttcttaatgggtattagccaaaagaggaagaagaaggaaacatactgagtaatcaagaggacatcaatggaagaaggatcaatctcatcgaagtaaggcaacgcagccatgcccgagtacgcaggatgaatcccacaatcaaactgcacaacacaaccaaaatcaactataagacatgccccaacaacaaaatcaaaacacatttgcttgattagaacaaaacggagaagctgaccagaatatttttgcctcggaaggacatgtaaacacaggaacgacccacttcacttccggctcctaacggagtaacgataagttgatctccatctcgcgaaattggttgctctcttcttttcagagaagtagaagaagaagccatgtttcgtctttctcgattttcctccaagagaagaagaaactcaaagaactgagtacagcaatttcagttagtgtatatcttcaaaccctaaaagcctttaaaaaaaaaaaaacgaccacagtgggagtcgaacccacgaccttctgatccgaagtcagacgcgctaatccactgcgctatgcggtcaatacatagcaattgaaaatattatatttatatagaaagtcatattatataccgaaaatacccttgtcttattttgtcactcaaatctgcgaacgaagagaaaattcgaagctttctcggcg

SEQ ID NO: 10695 - DNA, 3000 bp, Unknown
  misc_feature (1)..( 3000): cDNA_ID_2716346_gDNA_ID_2213668_Annot_ID_132743 3000 nt of promoter + ATG
ttgtgatctgcggatgatctgtctgagggcatttgtgatattatctgaaatcttgaaagtggatagacttttgttgactctctatagtgttacttagaataaatccattttttgttggtgtgattgtagatgagaccagaaactcgcgagatcattgagatgcagctgctcccggctatgaagttggttaaggaaaggctcgagagggaagtagagaaacaaagcatggatgagtttatgttctgcttcgaaaactgctacactgagaaggaaactgagatgcacgtgacccgcaagttcccttctttaaaacaatcggatgtgggaattggctttcagacgtttataggcttgatcgataaagagtcctcaagagaggcgtatctcaaggatgctgaagattgtgctaatgtaagaaggatagaggcacgtcaaggtgaggccagtacatctcacaaatgtgaacctaactgcaacaaacattaaattaatactatgatcaaaggatacgttttctagatctatatacaacaaataagagtgggtattgtgttccttatacaacaaaaaccacgtttatgttttccctttgtttataggagttgtactccctttaagttccctttgtttaggaactggtctttgtgattccaaaataaaaaatagtattatgaaaaacaataaataaattttatctatttgatgcatattgttgaatttgcaattttattgagcctgttttctggaaatgtatggaattcttgttttgaatgttatgtaaatgttatggttgatcattttattcggaaattaattgattacaacatcaagagacccacttgaggtgcctgtgttttcttttcgtcaagttcttatggaaccattcctgtgtgttttgtttatgtaaaagtcctaaaactaaattgaatcctaatctcagcgaataacacaaaagaccaagatatgatttctcacctcattacatgacacctatgttgtgaagccaattttctcagaaacaattccttgctagaaaagcaaaacaaatcttaccattgtccattggtactgaaataaataagcagtaacctggaccattggaacaacaaagagtgcttgaaaatcacaaccatgcatgcatatcggatttaaaagcctgttcaaccggttttctcttcggatttgggttagtttctccgttttcttaaacttagtattagtggttttttttgggcctattacaaagattaagtgtactccatctcttagccggaagttgattttatctcgtgttgtaaaagtctaatccacaccgcgtttaactatatttgaattgttcacctaatgaaacttatgccatttatattttgatgcatgaattttatatatgccatttatatagaaattggatgcatgaatcatatagataatatcccgtatctacttgtaaagtttgactagcattaagcaaaaaagcttataatatattaccatgtaataccatattaaaaagattattaaaaaccacaactggactgttttttcacaaaacatatgtcatgaattgatgcaaccaacatagactatgtcttagcacatttaacaaaaagaatcgtatactattgggtcgaacaaaagtaaaactataaaaaaaacatagtagaactattacagcatttatttttctttctttattgcatcatttaatcatcagtagaaccataattcattaatttaacaaaaaatatttccgtcgaaacaatatatattctacaagatttgaatgtgaatagtgtcacacaatgacaacattaagattccttttgaatttttcttgttaagaaactttgtaatttcctgtatatataaataaaatttattttccaaaaatatgaaatttttgaggtagtcattagttgtgtttaaaccaactttaccacttatatagtagttatatatattttaacataaaaacaaactaattcaaagaaatgtttacaattgtgcatgtaagattatgtatatgagttattggtagattagtatcctttattgcacattcatactgtatataattcgtgaaaagaagagtttgatcatgtatttatatcacggattatggccagtgtataaaaagagtttgattattgacttattgtgtgactattcaagaaaattttatttacttaaaggcactggtctgtttttgtctgtaaacaagaatttcactgtctcaccacagctacgtacaaaatcttcgaaagaggtatgtgatattgtatacaatttaatttctctggttaaagtttattttgaatgttgttttctatttttctcaaaaaaatatctcaaaaatattactcatatggcatatatatttttagtatatatattttattactaacacccgcagattgtgcataagatggcatcatatattttctgtgtattaccaagaaagataatatgtttttttttctgttatgatttaatcgaaatagaaaaaggtttaatctttcaagtaaaaggtgtaacaataaaacaagatatgagagaaaaagaattatatcgttttaaactactttcccaaaaaattataattagtaattacacaggtgagaaaaaaataacagaaaaaagtttaactaaaaaaaggacagataggttttagtaaggggttagagaaatttgcccataaaaaagacagattcaacattagttttcctttggctctctctttcttgagaaagttccataagtcctgaatctcaaaaccctaataagatttgctctgcacgattctgaattctacgattgtgatgttattctttattaatttcttcagctgtaaggctttgaacaagtctgtaaatattcattttttattttgaatttttcaacagaaataccaaaaaaatagtttattttttgacattataaagccggagtcgccggcaattaatgacagccggaggctgttttggtattcaaacaacaatg

SEQ ID NO: 10696 - DNA, 3000 bp, Unknown
  misc_feature (1)..( 3000): cDNA_ID_3037797_gDNA_ID_2213669_Annot_ID_132745 3000 nt of promoter + ATG
gctccatctgtcagaattcttacctttccaaaagaatagtacacttccttcaagagttctcagctggttgctaaaggcagagccaatggatactcgacttcccgttgtaattatgcaggaatgcttcacaatttacataaggaggcaggtagggtgatgtaatcttcaacattgctgcttgtgcctatggcatgcatactcttgttaccttctgaaagttgtgtatgttttaggtggactacattggcaaagtgattttgtcaaaactaatgaatgactggaaattgatgcacgaacttgctgtattgcgcgccatttacttgctaggttcaggtgcgttttatgtgctcaactgttttggcaatatggttgtatctgaaatcttaataaccccttaaaactttcaggggacctgctgcagcattttctgactgtcattttcgataggctgggcaagggagagtcatcaaatgatgattttgagttgaacataatacttcaggtaaccaggtttggtgtatttttaagagacactgctctcatctttatagttgttatcacttctaaaatgattccgcttgttaattgtttgcttatgtatccgtgttctgttgccgtatatgtgttcatacaccaaacttatttctaaagtgtaatggtcttctacaggaatcaattagaaattcagctgatgccatgctgttaagcagtcctgattcattggtggtatctatttccagagaagacagagacaaagatgataagggtgacataatacccctttcttcaactcgtaaaagccgcgttaacagctttggaatagattgtctcgagtctctcaaattcacatacaaggtctagagaaacaacttagtcttccatccaatccgtactggtatatctcataggccacatctatgtgtatttgaagagctgaactgttttcttttttaaggtgccatggccacttgagcttattgccaatagtgaggccattaagaagtataaccaggtaaccctttctcatccagctatttttgtggtaaacagtttgttgttcctctatgtggtaattatttaattgaaaacaggtgatgggatttttgttgaaggtcaagcgagcaaaatatgtgcttgataaagcacgaaggtggatgtggaaggtctttgatatctctcaaactcatttctttcttcttagactgtatcccgtgacttccaaatccagtttgaaagagcctaatcagtcttttgatctatacatataaatataaagggaatcataagaatgtggttcagtttgataaacttgatgactttggtgtttgtgtatgatagggtaaaggctctgcaacaaaaatccgcaagcaccactggttactagaacaaaagctcctcaactttgtggatgcttttcatcaatacgtaatggacagggtattgtccaatgctaaatgattggttataattacagtatcatttttcgttggagtaatataagtttgtgctagagttgtggcaaaatcgaaagctgatcacatggcttgagtaagatgaaaagcttgccatgcttaactgtattttgtaagcaggtatatcacactgcgtggcgtgaactgtgtgaagcgatggtaaaagcagggtctctggatgaggtcatatatgtacatgaaacctacttgttatcgattcagcggcaatgctttgtggttcaagaaaagctggtaatggaccatgaaggcattaagcgacctcttaaaatgcatagtatatatttgaagttgtaggcttctaaaaacctagtgtttggtggtttttgtatagtgggcaatcatcgcaagtcggatcaacatgattctcggtttagctctagaattctactcaatacaacagacactgagcagcggtggagcagtttcagccatcaaggctagatgcgaaatggaaatagaccgtatagagaaacaatttgaggactgtattgctttccttctcagagtaagtaaatcgaaaactgtgtacttgttgtattgtgaagctatatataattgattaatgcttaatgggggatggaacttgcaggtattatcttcgaagctgaatgtgggacacttccctcatttggctgatttggtgaccagaatcaattacaattatcactacatgtcagatactggaagcttgatgactacttctggagcagagaccaactcatccagaccttggactgccaaatctgatgtatgaatggaccgggaaattatcgcaatgttggattgtcgcaacactatcacacgtaattgttcaagcctcatgcttttcttgtgtctggtatctaatttcctgattatgtattttctgtttataaaagttcactgttttgaattagacattgtacaaaactgctatcaaggtttaaaaaaaaaaaaacattgttaacattcttaacaagaaatcatcaaagtttaaaatctaatcgtgaccctactatgcatagtacatatattaagcattaaccaatacgacaaaagaaaaaaaaaagcattaaccaaaaacaaaaagacgataattaaggttataggttatgagtttattacgaaaagcccatttatggatgcaattaagcaaaccttgttggaggacaaaatggtcaaaagaaagaaaacgtaaaaccctaaaacatttctttaacactcgacttgtctcataaaccctttgtgtttgtagtctctctactctctagatcccatcccatttcttgatcagcctcgcgcattgtgtgcttacacgtaatcctctagcttctttcctcggtattccttgtctaattcgaacttctctctttttttttctgggtccgatcgtttcagtgaaaggcgtaacctttccttcgaatctgatagcattgcaaaatgataatgttagtctgatttttgttgggtgtgtgtcttttgattgaaagagcaggtaatttccagagagattttcaacagaggaagc

SEQ ID NO: 10697 - DNA, 3000 bp, Unknown
  misc_feature (1)..( 3000): cDNA_ID_4268500_gDNA_ID_2213669_Annot_ID_132746 3000 nt of promoter + ATG
tgaacagtgtatatccactctttcccctgcaaatcgaaaccgtgtgacctcacaaacgttcctacaaggcgatcaggattcgacttccacactgaaaacgcaaactccaacgatctctggtcaatctcgacgtcatcatcacatatcaaaacagcacgagtgtctacagaggaacgagggaggaatctagcgttgaggctgctcgaagattgctgaattagagagatggaagcagaaccaggcgaatactgagtcagattctgatacaactggtcaagtagttgatcaggtgtgctagggttaccccataggactaagatggaggatacgatcgaggatgaagaataagaggccacgatggtttgcagaagaggaatccggtattctgagtaaccattgattagaacggtgatctgatccgatctgagtttttgaaattctctctggttcgttgcatcacatggatctggatcccctgagagcgtgcgacaaaacacgagatccgtaacaacgaaaaggaaccagatagagaacctcaccgatttgactcccatatcagcctaactatcctatcagttagttccgatttgatcgataaaacagagaagagcgatggatgtagcattcgaggatggatcgcaatttcgtttcctataagcgtgcgtgtgtctatgtcaacaaacaggcaaagagaaaattacctcggaagctgatggcattccggcatcagaatctccgtctagagatttggaattccgattgactagttggagttgaccatcatcttcggcggttagaggctaattaacggctcacatagtcacatgaagctaaagtgaatcataaatgcaagtgggtgggttttcactaataaagccctataagaattatgtaactaagcccaatatagtttgaaatacaagcaaagcccaatagagtttgaaaaacaaacgtagcccatacatctttcttggtatgttacggcttatggcgtaaaagaaaaacatttaactaacaaaacgggtgagataggtgagaggctactactatatacgtagtgtctagtttagttataaggccagcacagcacaacacacttataccgacaaaacatgtgtgtcatttaactcgatgacaaagcacagaaacaagttggtcgtttattttaagcaaagtcataggtacactgtctaattaataaactaatctttgagatttcaagcacaaaacaaatattcaatatcaacaagtcatgacagaatcctctgcctaggattccattgtagatagaaacggagacaaaaaacaaacgaatgaatattgagatctagttaataaccttttgccccaaggaaaaaaagatctaaaataaaaacatagataggtaaaagagggagtgagagatgcatgaaagtgagtaaatggtggggaatcgaagaggggcttgtacatcggggcagctttagatgcggcagcaggtaaggtcccatgtgagctgctcaaaccgtgaaagtgcagagagtggaattgggacccatgcacgtgatctttgctctttttcagttggtagtttgccttttatatatgcaatctctctctctctatatatatatatatatctataagtgtgttgtgtttcatgcatttggtttgcctctagggtcaacaaaactaaagcacctatatcatcaacccttcttcaatcaactagctaggcatgtgatttgattattagatcacactgatctttgtgacttgaatcaagtgacattttggtcggataacataaaattggtttctagttacaacaagatagtttggtgatacttattaagttgtttttgcaaataattaacatgtgaaaagcgataaaattaatggatggcccatattgttaatttaagatatagacagtgattggggaaaagatgaggaatgtagggactgctgtgtaaataaaaatggtcccgacaagaatcttcaagaaaaaacctcacgaaatccaagtttgaaagttaacggtcacaaaataattaaaaaaaagaaaaggaaagaaacagcctcgttcgtcccgctatccgttgtcactgttacagtacttctctataggggtataaccgtcatctcggttgtttctttctttatttttcttatactcagatacaaaaattgctgaaattacttttatagaggaaaaaatgcatgtcttattatagggtaaaaacaagcctgtcatgaacgtattatttctgtttataactttatagaaaatatttttactctttaaagaaacattatttccatgaatgtaagcaaaactactaattttaatagataatacagctaagtaatagtcgcatttcccttttttcttctaatataaagggtatatatatattaggccaattaagacttttctggtaaatggtaactgataggcccaagcagaatcgtgcaaaaaatattcgtaaaaaaagaatttaataaataaatattcgtaataatactacatatgattattataatttatgtactactactgtatgtgtttgaaagagagaaaagaaacgttgtagagaaaaaaaggagcagaagaaaacggaggtttttgtttaatttccggatcgtccaaaagtttctcttttttttctcttccttcattgtttcgctgttcctgcgattctgaaactcctcaagctttccattcagaatcgtagcaatggcttttcctctttgattttgtttttgatccgtctctctctctctctctcattgcgtttaaggggtcgctttttttcctcttcatcctcgccgccggcttatggccaactcgccaccaccttcgtcgcgaaatcctccgaagttgttggtggattgttggtcgtttccgtttcttctctctatggttcctactccctcataatttaaggatctgtatcggaataaccgaaacgatctccggtttcggatttgaatattttgggggaaattaaaagaatg

SEQ ID NO: 10698 - DNA, 3000 bp, Unknown
  misc_feature (1)..( 3000): cDNA_ID_2716442_gDNA_ID_2213669_Annot_ID_132748 3000 nt of promoter + ATG
ttcctccctcgttcctctgtagacactcgtgctgttttgatatgtgatgatgacgtcgagattgaccagagatcgttggagtttgcgttttcagtgtggaagtcgaatcctgatcgccttgtaggaacgtttgtgaggtcacacggtttcgatttgcaggggaaagagtggatatacactgttcatccagataaatactcgattgtgttgaccaagttcatgatgatgaaacaggattatctgtttgagtatagctgcaagggaggtgtggagatggaggagatgaggatgattgtggaccaaatgcgtaactgcgaggatatactgatgaattttgtagctgcagataggttaagggcagggccaatcatggttggagctgagagagttagggattggggagatgcgcgtaacgaagaagtagaagagagagtaagagacgtgggattgagcagtagaagagtggaacataggaagagaagagggaattgcattagggagtttcatagagttatggggaagatgccattgatgtatagttatggtaaagttgtcaactctgttggggaacaaggattgtgtcgtaaagccggcaaacttgtcttttgtgatcgagattgaccgttttttttttgtgtgtgtgtcaaaatatcgacactaataggatgtgtaagctcatcatcgtgtaatagaaattggcaactagcagcaagttaacaacatggaaaccaagttttgaaccaagcagtaaaaagtgtaaatttgagtttcgctaaaagaagaagctgggcttcgagaatattgtccgtttgtattgtaaatgggccttacaaactatacaggccgcattaacaaaatggaatttcaaattatgaaccaaactcaaattacgaaaatcgtaactaggattttgtttttttttaatataaacatagattgaaaagagatgtattagtctttttcgaaatggtaaatttgtagcgtgtgggcgttactcactatgtgatcatttttgtataaaaggaaacaggaagcttaataataagttcaaaaatggcgtggcaaaggcggagccgtcggaggatttttagtttacgagaaaaaaagaaaaagagagaaatatctgaaaaatacgggaaagatgcaggcagctgtcacagccgcaggtaaagagaaggtgtgtgacgtgtctcaataaaacaccgtttctctctataacacgattctgtcattatgtgtctgagcaaaagtgcctccttatttacatctctagaaccgtttactattggccacgtggaagatatcggtaccgttgcgttgttaaaaagggttactagtactcctcgtgaaatgatttggtcccacttcacaagtgttaatgtttctataagaaaaaaaagagaataaagaaagacagaatcgagaggagagagtatcggatcttcctaagccataaacaatgcagcaatacgctccatgcctttggatatttcttcggcaacttgtaaaactgacaatcggagccgtctctttcatcccacggctctcaattatcctctcgaccatatatatcatcgacaacgtgtatatatgtgtttaccaaattatgttttttattttatttttcaaaaaattgcactattaggtggacctacatatgggttcgattcgactccaataaacaagctaatgatgccgcccgatgaccattcaaatattgttggtagtggctttctcctaaatatttgcattttcttaaaagaccctctttgaaaaaatcataattgaaacacgacgtatcacctacatgcacctcttgaaaaatatttccattttattctcaacgaatgtatttattgatgtatattatttcacaacgaaagttcgcatatatgttttctaattggtccctagaatataattatgcgatattaaagttggatgcaagggaaaaaaagataattctgaaaaaaagataattctgaaaaggataattctgaaaaggacaaaatattcctctagaatgtataagagttggtcattttttttttttggggtgaaagtaaagagtttggtcatcttatttcgtttgacgtccttattttggaccgccgtcggaaataagcggtcaactctgaggaggatgcaaattcttttacgtttaaaaaaggggaaaaattgacatcaaaacaattgagtgtagatgactactttattattgaccaattacggaaattcataaattgaaatatatattttgttttgacattggccacattacacgaatattttttttaatgaaagtttatttttaataagttttttaaataataataataattatatatatattttttgcatttgtacccgaacattacaagttatgtaaaagtcgatgaaggcactattttaaactccctcagattttgaaaagccttgaaaactaatattttaattttaaaaacgacacgtgatttaatatagataaagtaatagccaatttagccaccaactcaaagaaaaaagttgtagccaccaactacaaaacctcacaacaacaaaaaaaaaaaaagaagaagaagaagtaataccaaaaggtcattacagtcatttgaagggtaccctcgagactatttctgtgttggctaccatgaaaaagctcacatgcctcaacagtcaacaacaccaccgtaaattgatctaccccgataccaatttgataaatgcgaaagattagcctttccttgcattaagcacaagttaaaacagtgagcgttaccacatttcatttacaagtgcaaaagaaaatttcaaaaaaatcctttccttttaccggatatatacacatcaccacatttgttaatattcaattggcgatactatattctttcattgcactaaccaaccagtctcctttatcatctctccatctcatcatcctcctccatttctctcccattttttcttctgtgtatctgcgggagagagtgaaatagagag

SEQ ID NO: 10699 - DNA, 3000 bp, Unknown
  misc_feature (1)..( 3000): cDNA_ID_2716438_gDNA_ID_2213669_Annot_ID_132750 3000 nt of promoter + ATG
atcttcagcaagagtgccaagtacagcttgttcgacccttgcaaagaaatggcctatatcccattggatgaggacaccaaggtttgctaacttttcctctcttttaaggaatctatatggcatgaaagttgtggtctttagccattgtgatgtggtgcaggttaaaggcaaagctgcgattgacgtggtctgcaacccattagggaaatcagggggagctttaatacagcagttcatgatcttatcctttggatcactagcgaattcaacgccgtatctaggaatgatcttgttggttattgtcactgcgtggttagctgcagctaagtcgctggagggacagttcaacagcttgcggtctgaagaagagcttgagaaggaaatggagagagcttcatcggtgaagatccctgtcgtgtctcaggacgaaagcggaaacggttcccttggagaatctcctagcagttcaccggagaaatctgctcccaccaacttataaaaagtttttttttgatatttggttttgttgggggggaaagaaagaaggatgatgaatcaaaaataagattttgagagcagtctctcaaacaatcgcccttttgcaccactcactctttatagtctgtagcttttttttccttacattcttttcagttcaatgtggtttcacgttctaagtttcttccttgtgtgtatcgttgaagtcaaaaagataatagatttagttcttctactctcaaactcatcagagtaagaatgagtgaagttgggtatcgttgagacaattgctttatttcttctgattaacatcaatcgaatcgaggagtctttgaaaagagttataaacaatacaaacactgagtgctgctgagtgagtctctctattgctacctgaaaaaaaggaaagcgtttgcgcgaaaaaaaaaaacagcaggtagttgtactgttgtaacaatattttcacatggtcccgggaaattcaataaattatttattttagatacaagatggttgatatttgcacgtcgttaggacattggactcgtccagtgtctgaaaagccgtcttttatccaacttccccggggattcccaatcctttttatctttcttatcaaatagaattgtcaaccaacagagagaaagagagctttgactttagatccaatcatggagacaactacaactcctctgctccccggtgatcgcagcagatgcgggtggctccgtcgccgtctccgcctcaaaaaccctctttcttctgaactctccggcgctgtcggtgatctcggcaccttcatccccatcgtccttacactaactctagtctccaatcttgatctctccaccactctcatcttcactggtttctacaacatcgccaccggtctcctctttgacatccctatgcccgtccagcccatgaaatccatcgccgctgtcgctgtctccgaatccccgcatctaactccttctcagattgccgccgctggtgcatccactgccgccacgctcctcctccttggcgccaccggagctatgtctttcctctacaacatcatccctctcccagttgtacgcggcgtccagctttctcaaggtcttcagttcgccttcaccgccatcaaatacgtcaggtttaattacgatactgccactctcaaaccctcttcttctcctcgtatttggcttggcctcgacggccttatcttggctctagctgctctgctcttcatcattttgtccaccggctctggcaacgacagagaagctgaagatggagatctcgccgagacttccagcaacgaaagccagtctcgccggaggagactgcgtcttctgtcttcgattccatctgcgctgatcgtgttcgcactcgggttagtgctctgtttcatacgtgatccatccattttcaaagaccttaaattcggtccctcgaagttccacattctgagaatcagttgggatgattggaaaatcgggtttctgagggcggcgattcctcagattccactctctgtactgaactcagtgatcgcagtttgtaaattatccaatgacttgtttgacaaggaactctctgcgactacagtctccatcagcgttggggtgatgaacttaatagggtgctggtttggcgctatgcccgtctgtcacggtgctggtgggttagctggtcagtatcggtttggggcaaggagtggattatccgttatttttctcggaatcgggaaactgattgtgggtctggtgtttggaaactcctttgtaaggattctgagtcagtttccgattggaattttaggggttctgttgctattcgcgggaatcgaactggcaatggcttccaaagacatgaactccaaagaagattccttcatcatgctggtctgcgccgctgtgtcgatgactggctcgagtgccgccttaggatttggttgtggagttgttctttacttgttactgaagctaagaacgttagactgttcttcagtaactctgttttcccggtcaagtgatgagtcgcaggtcgattccgaagccgctcctcgtgatgtctaagatggacttgccaaaatgacttgatggagaagtacttatgacgaaatggcgggcagctgcgagtgcatcttatgtcttcgattccatctgcgctcataggggttggtgccctgtttcattgagtgtattgagatgtgaaaccattaatcaatgttttcattgctcaactttgtgcttaagattataataatcaggtatgattaaggactaatattgacaaaccttttaactaaagaaaatcataaggctgacgcataaaagagccaaaactggatctctcccaagtattgtcctttctataaagaatcgaatcccgaatccactgtgaatgtacaattgactttgacaactactggtttacatgtttctataaatgcaatgctagagtgatctctatatacatcatcatcacctgaccttttggctatccagtcca

SEQ ID NO: 10700 - DNA, 3000 bp, Unknown
  misc_feature (1)..( 3000): cDNA_ID_2716430_gDNA_ID_2213669_Annot_ID_132752 3000 nt of promoter + ATG
aaaaatttcactgcgtgctatataaaatactatatatgttaccctttaactgatgaaaatgtaaagagacaaggcagcaccgtttatcatcagaccagtttcgagagtgttcctgcatcgttgggctccctcctcaattttgtctacgtgattatatatcatatcgtctacaaacaaaataaatacaattctatcatatgaatatgtgatcatcgatgatcgatcaatatatgttttcgaggtgacgtatatagtatatttccgtagagacggcgaagaacatgatatctctgcatgcctccaatcaaatctttacacttcatccttcttcgttacttgttcagttgttcctttctaatcccgacaacccttaatttgtatttctatattagatcgaaatatctcatttgtgataaataaaataaaaaaaatcaaagaaagctatagagaagctgcgtgcatgcatgggttggcgatgtttggcttgttatgtttggcttgttatgtggcattatctgtatgtatattaccctaaatcacatctacgacatttccctcgatcttcaaaatatgccagcaatcttcatgtttcctcatatctcttaacattggaaaatgtcttttgacctcttttgatgtattttaaattacttcgagctcatctatattacaaatcattcatggtgaattattgtccagccaatagaatagaaatctgaatataatgtgtaccacatcttttatgtaatttatacgatattctttttcctgagaatgatcaaataacaacatgcatgaattgctgccagaaaacgtcagattgatcagttatcactacaattatcaattaactagtaaatagtatcaaaatgtacgtagtgcccatctatagctagctaaggaggactccggatgtagagaaaagctaaaatgtgacttgctagagttgtattatattgaattttctaaactaatagtatcttttttacagataataatttccggaaaacctattagatgtatagatataacaataagcatcgataccaaccttttacttccaaaaaaaaataaaaaaaaaatgccaagatgagataattttgtcaatttcaattagtgggaaaataacaattgtcgtgttatttttgaaccaacgcatctcagtgaatgatttcccagttcttaagattttaggacatactttcccagtaacatctaatccgtttgggcataaacaagacaatttgtagttatgtacatttcttagtgatgtgtgttgaaaagatatgaatcaatgaggtccgacatattttgtcaatacgttagtggtgtttcaaaataaatttttagtatatatattaaaataagaccaaaggataggctttagtggtgtttcaggtatagttttaataatcaattcaaaataagtcgaaaggatatgtaagataggcgttatttcaacgtggatcattatcaaccatgtcaaaaacgcatttcaactcctagatgtgttgttagttatatatgttccaaatggaatcgacccaacagaaaaagagaaaaaaacgtaaaaggttatgcgattccagggacgtctcatatatatatatattccgatgaaatataaatataattatcgtggtctgtgacaataaatatggaaatagatgtggaaatcatgatcatgtgaagaagaagaagaacacgtgcagatgaactgcaaatgataataatgtgcatgtccatgagttatgtacttatgtgtattatctacgtgttttccatacatacatatataaatcttatattactttatggttttgtcgtaaaagttacgtagcatcaataattgtgattcgttgccataaacagacaactacttgtaacggtataaggcttggctctcatgataaaatgataaccctttttttcgtcggagacagacaaacgcataaatcactaattctaaaccgagatgattgtcgatttgtttgccatatgcataactagaatcttcagttaatattaatttttggtgttttcgatcgaataaaaaaaaataaacattgcaatatttcgaaatttgtcgtctttctttttataacactagcaagtgagaggctgagagccaagtggaacgttaaaagacaacattagatatatattatatattgctaaatctgtattatttctttttaacatacgcaacttttgattggaaatcgtaagtcgaaggaagggcctcgatttatgacgtacgcttcgtgccaaacaattcctctttagttgaggccggggaagacgagtttgttgttagtgagcgatgccatggcatcaatgaactcccaaaggccatatgttctgttaaaggctattttagtttttaattttgttctgattaactcaaccacatgttaaatcagatatcatgtttaacgatattagtttttaaacaaaatgattatcataaaacgaaatttatgatgaaacatatataatctttatcttgtttaagtatgtaattcttgtatgtttgtatacgccttgcaaatcaaaaaactagttgctgtttttggcattgtgtttacgaaatatttattaatattttaaattaattaaataaatgttcttatttctcaacaggaaacaatatgtattttctttctttataaaattacaatgaattatttgttttaagctgtctatttccaagaaacaaaacacaaaaatgataaatttataatagtcacataacctgtcttacaaaaaaaaaaagaaaagcgaaaagaaatgtgacaacagaaaatggttttgataaccaataagaatcgacaaaaaaaaaacttactccacatatactcttctcttcactcttcagtcttcactattcagtctcgagtatttcaccgatctataaatacactcctcttctccaccaaaagtatcatatcataccaaaaacataaagccaaaatataaacacataagccttttagcatg

SEQ ID NO: 10701 - DNA, 3000 bp, Unknown
  misc_feature (1)..( 3000): cDNA_ID_3037775_gDNA_ID_2213669_Annot_ID_182227 3000 nt of promoter + ATG
tagttctagtgtccgccatatgtataaagctgtaaacatctttaacgcatatatttggtttattaaaacaatagttttgtgattactatgacccattcatgtatttgcatataaatgtagtaacttggagttttggttaattagacaaaagatactccgatctaatattttttaaaataagctaattgaaacttcaacgtgggataaaacgggctgacaaaaaaaggttcaacatgaagaaaataactctaactgataaaacggcacggcgtctgaatgactataactctataaggtgacaaaacgacacggtgtcaacatccttaaaggggggaagaagagtcgtcgtgattcgtcgggtggctggctctttgataaatctaaacaataaacgacggaagcaatccgattcttcgtagataggaatagcccgaatagactggtactgggagtgttggacccacttcatcaatgttcgtgtcgatattttcaattctcatactcttctttggtcgcgttcaattattcaaatctcttaacaagtattttcttcacaagaaaattcgccaagcaaattggaaaaaaacgaagaacacacgaaataactagccaaaagagtttaattacttctttatatatgtgatcgttatttatttgcattttactcgtttttttttccaattatgtcgacacttgattaaattagaagcacaaagcctcgaagcaaaccggcaaagataataacatctgccagagctaagtaataaggtttacagttagatgatcgagagaatatgagctttggcaccgcagaaaacgctggccaattacataggaaaatgttcatttgaaaagatatatagctaaacagtatatatgtctcaaaagatagtttgactcgccgcatctttctattaggcactcgacgtcttcatcatatatgcattattattttgcatattaattaatggtagggatcaaattgttacgaagacatgcaatagatcatttggatattcatgcggtcgacatcaaataaaacagctctcgtacatacagacaggataagctcatgaagtttcctttggtatttatttttacgtccttttccatatccattatgatagttatccggtagctgatgtggacttcgtatcttctactgccagtaattgtatttctttttttataagtgcgcggaatatctattttcattcatcctcatcatcatatactaacatcaacttatctacctttttttttttaagggtttgctcgaggtttcatgtcattttttggaaataaattttgacaacatgatttaatgttgaatggtaatgaaataagaaaatcaagatgattcaatactcttcgatatatataaagtgagcgagagggaaagcacagagtatgataaatcaactgaatttagctaataaaacacatttttttatattgatagcgtcgaacagaccaacgacaacacaacggtcaaattaacatggcttaagtcaagcgaggacagaacgtgccaaagccattgaatatattgaatccttttataagcatatcttatttagtaaccacgtgagtcgtgacgatggcttattattagtacgtactacgtaactttgaagaaaagaagccctgaaatttcggaaatgggttcaaaagtccaaaaacagtttgcggttaaagaagggtacgttattttttttataacttttttttcattttttcatcaaagaaaggtacgttaaagacaaagtgaagacgtagtttaattttgacatgtttagactcattgatattcagaaacttagtcctggaattgtgttgtagcaaaaacaacaacacaacgagagaaagataagataaaagcatatatgatgggtttgtgttgcggatgttacgagaatatgagacatgacacatcatgacatcaatgatatggacaagcatacgatatatttcagaagaaataggatgtttcctccccttgcaagctttagcttctccagtgcattaagtctaattcatcgagctcattgtaggtatacgaaggatttgactgagctaacttaggaaaaaaagattgaaacgaggaatgatttagtaatggtaatttgaccttggttttgtacttcttttaattcataaaccccctccaccgtaaaaatgaaacattagaaatcctaaaagggcagacaagttgatgtccaaaaaaaaagaaaaaagggcagaagagtaaaaacgcgaatgaaagagtcaaagcaaaaaattggtaaaaaaaagcgtgaacggcaggattcgaacctgcgcgggcaaagcccacatgatttctagtcatgcccgataaccactccggcacgtccacctttgctagttgaatcatttgttaaattgaaaacccgtcattttgatctgattttgtactgtatgttgacaaattgaatagtctctgatgatttcgatcaaagagaagccacggggggagcgctagcacttaaaggttcctcgctttcttctcaagtttatagtcttctcctctgtgttggctcatttacatgggtagatttagttttcgagggttttatggcgaagttcgcgatgttctgttaattgcaatgtctttcttctttttttttttttttttttttttggtattcaattccaattttccagtgtgatttgatctgaactcgaattcaaattcagtgctactgagttatgttaaaaccattgtccattgatttttttatgttgaaattgaaaaaaggttataccattcgtttgtattaagatttgtctttcttagggaatgttttacattttttgcagatttgcaccgttttctctctggctttgtgttgtgctagatgcgatgcaatagcaatattttcctggagtttcaagtaactagtggcttaggttcataatagtgtttctttgtaggacgaaagctgtgttagtattctctccactgtaaaggacaagatg

SEQ ID NO: 10702 - DNA, 3000 bp, Unknown
  misc_feature (1)..( 3000): cDNA_ID_3037779_gDNA_ID_2213669_Annot_ID_182226 3000 nt of promoter + ATG
ttattgataatagatgtttccgccatgtaatcaataacaataagatatatacagagtgctagagaaaaatgttacaagaaagaaatccgcttttatattacgatctctaggataatttaatgtcaatctcaagtattcaattccatttttagttcttcgtttattgatattcctgcatgtaatcaataacagtaaggtctacgagtgctagagaaaaatgttacaagacctagcattcttacaaaaaaaaaaatccgcttttatattacgatctctaggatcatttaatgcacaaattcgaatgcataaaaatgaaacgtgtaatttttttaaaaaaaacatattaaaactttgagcatcccgtcttgtcgagtgtcgatgtcgtcatgcccggatcgtggtggtcggcactgatgcttaaaagtggtttgtaattattgaattaaaaaaaaaaaaagtaaaatcatttaaacaatagtagtacattacatacaaaatccacggccaaaaaaggtttgaaattacatatatagcatattgcaattcaaaaatgcaattgtatacatctctacagtatttaatgcatttgtgatcataatcttatatagcctttcgaagatccgatgcgtttacgttgtgggaagcagaatagagacctataatccaatagcatctccggttttcattaacctcatacgtttgcaagattccacaaacatcctacacaaattaaatatcatcaatcccaagaaaatttagtttccttcacagcagaataatacagtaattctagttttgatatgaatgtaagtaacaaaatagtacagaaattctagttttgaataaaaaaggaaaagtacgtaaaagcaacacaaagggtaattccgagaactcacatccacggcacatctccgactaacatcaagtcaccgtccttatcctcgtaagtagcaacaaactctcccttcctctccaactctgtcactctacctaccaccatccaaaaccccaagtgtaagtaaatttaccataatatccttcacttcgtcagtccatccaaacacatcaaaatctttattttttcctacttatctcgatcacttacatattgttattatcccctgaaacatgttttctagagcggtgaaaagctgtccatagcaatcgtacatcccaagatcaacctttctgagataggccgcaccatccaacgccactttcacgtatttccgcctcactgttttcctcgctgtcgctaccggcggccagcccaccaactggtcactaaaaccacaataaattaagaagatcaatcaaacatgcatatgacctatatgaacgataaatgaaattaatataatatatatatgccgtacttagtgaccatgcttgagatataattgttctcgtgtgcttccccgagttttaaatcaacggtctcgaggaatctacgtttgttcccgaacttttttggaccttccgatgcatttgtcggagtgccaggcaaagctagggtcagctcagttcctccaagatcaccggaatccggccaaaccctaacgtattcctccggtgacattaatatcttaatctatttatgaaagttagttaacaacaaaagtgcggaaagtgatgagacaatgtggcactaacttttggcttgagtgtgtgagactctcgaggtttccaactttgtatttatagtcgatctatacttgtcagctaaaaaactagtgaaccctacctataatgacacgttttcctgtaactggcggtttttatatctccacgaaagcaagtgaacagtttggtgattagcttctacttcgtgtggtgtgggctcatttatagttatagccacttagcatcttctaaactgtcattagtggatgtaattgcatgtgtacggatatcttttcagttttaatttctattagcctggtatcaaaagaagaagaagaagaagaaatcactgtcaactaaaaaagaagaaagaagaagaagaaatcagccctgatctttaagctcccacgtcacgactgatgggttcgattaaggagaaaaatatataatttgattatattatccactagcattcacaaaacgagaaaaatatatattctaaataccattatttactttctaaatagagttgaaaatatcattttaatcgcattcatgttacctttgcttataatcgttggaaaatataataaactttattcccatatatatttgtttgtgtttgtcaacttcagtccaataatttaacattagaccaaaaaaaaaaaacttcagtccaatatattcttcgggagagatcttcaatagtgttccttttgtctacactttgttgtcgctttactcctttaaattatcattccaactaactttttcttggtaaaaaagtttcaccattatatatgtacatcaactttcactgtcgtcggtcgaaaacaaatcatggtctaacaatatattcctaattatctatcatcgtacactacacactaattaggtacaatacttcttcattagtttaatctttcaccgaatatcagaagaaatcccaactaatatgcgtgtggatcttgtaaacaatgaaaagaatgttcccaccaaaaaaacaatgtgaacagaactaaatgttgaaacttctacttcaaaattgaaataaaatctaaaataaaatatataatgaacatcaatcattgtataaaagcgattaaaagtttcatgatttgggataaaaaaagttagagatagataactatcccttttttagtgaacaagtataaagtttttactgaaaagtttttcagtgtccggtattaatttcatattagtcatattatttacatgcaatatgaaatgagatgtcaaaaaagtttagacaaaggaaaagagcagaacattaattacagcagcgtagggtcacatgcgtaagtcacgtgactctgtttttcgttggggaacatagaatcataaatgattttttcg

SEQ ID NO: 10703 - DNA, 3000 bp, Unknown
  misc_feature (1)..( 3000): cDNA_ID_3037739_gDNA_ID_2213669_Annot_ID_182223 3000 nt of promoter + ATG
tacagttttcaagtttttgtcaacaagtaaattgtaattcacaaagacttgttctttcaacttgaatctgacttgaaactttggaacttgattcgacgaacttaaacaacaagtacgtgttgcaattatttgtctagtcatgaatgatcagataaacaatcctcgtttagaataaacaatttctccaaacatcttatatgcattggactctgcatagataaatatatatctctctgttttgtttaatcttcatgccattgatcttcgatttctcttgacttcaaattcacagatcgagagttaatgtggtgctaagtcccaaacgttagaaaagggttggatcgtgtcaaagggtttcaatcatggggaaggagaatgctgtttctggaaactctataccaatccatggtcgccctgtaactcgtgctcttgcctctgctctgcgtgcttcttctaagctgataacatcttctgaagtggctgctacaacacagaaccagggacgggttcttagagcaaagagtaaaagaacagccttggatgagaagaaagccaatgcacctaagaagcgagctgttcttaaggatatcactaatgttacctgcgagaattcttacacaagttgcttcagtgttgcggttgttaactacacaatgcagcattttagaattgctaagtttatatgacaagaagtatgtttttgctgacaattgttgcttcttctttttacttaggtggagaatatcaagcagataaagaagggacgacagagttcttcttcttccaaggtggcatcttcttcggctacttcacaagttacagatgcaaaggtagaagttgtgtcaaattcagcaggagcaagcttgtctgtttttacagatacaagcttaggcacaaacgaaacatcctatagcattatcgcaaagccaagctccagatcgcctccaagaccctttgggacaggtgaattttataaatggtcatttactgaagcttgagtgggcaatgtataacatttctgatgcatctttattcttgcaaatggtttacagttgagagaagttgtggtggagcaagtagcccgaaattcgttgacattgattcagatgacaaagatcctctactctgtagcctttatgcacctgacatctactacaacctgcgtgttgctgaggtatttatcccttggattttgatatcttacgatgatgcatttgaggcatttgaatccttacgacttgtctacttatcagcttaaacgaagaccatttcctgattttatggagaaaacacaaagagatgtgactgagacaatgcggggaattcttgttgattggcttgtagaggttagttctctacttccagtttgtttgttgcttacttatgaagtctttttgtgtagcttctcacaactcaaaatttcaggtctcagaggaatacacacttgtacctgacactctttacctcacagtgtatctcatagactggtttctccatggaaactatgtggaaagacagagacttcaattgcttggcatcacttgtatgctcattgcttcgtaagttcctcatccacctaaaatcaaataatgctctggtctgaacacaacatctaaaagagttcttgcaggaagtatgaggaaatccatgcgccacgcattgaggagttctgcttcatcacggataacacttatacaagagatcaggtcctggaaatggagagccaagtactcaagcattttagctttcaaatttacacccccacttcaaaaacattcctcaggtaatcttaccagacagtgcaaatgctttatcatgtgttgttgctttttagtctttggtgattcagagtattcattcatttttgcaggagatttcttcgagcagctcaagtttctttcccggtaatgtgcttttcttttatcagatcagatatatctattgctcataaaacatgtagcagaaagattgaaactttgttggtaatttgtctgcagaatcaaagtctggaaatggagtttctggcgaattacctaacggaattgacgttaatggactaccctttcttgaagttccttccttcgatcatcgctgcttcggctgtttttcttgccaagtggacattaaaccaatcaagccacccttgggtctgtaattgaccaactatcttcttcattaagaaacacagcgaatcttgaatctcactcttgtttactttattttatgaacagaatccaactcttgagcattacacaacgtacaaagcctccgatctcaaagcatctgtccacgccttgcaagatttacagcttaacaccaaaggatgttccttaaactctatacgcatgaagtatagacaggacaaggtattaaaaaattattaatcttagtttggttttcttaaaccgaatgaagaaatctggtctgtttcggtttaacagtttttttttttttttttggcaatttacagttcaaatccgtggcggtattcagttctggagagctaccggacaagctattcatctcctaaccgatatgacacacgaatctgtagtaacatttttctgatggtccacattcatctgtctgtcaaataaaacagtgtcttcccacggtctctcatcattaccaagtaaccggattcggtgttagttcggtttagttgtagacaggtttggttctttcaaaccggacttgttcttgtcggtaacacgagttaattgtagtggaatgtacatttttcccccggtttattcaaggcaatatctggtctgcttcgaatattttatctttttattacagttgacagagagacaaagcattaattacacattatccaacggagaaattgtgactcacatagtatgtggcaagaattgctttttcgttttacgaaaaaccaataataaaaaattatcaagttggtcttcttcttcctcgttgctgatgtgtcgctctgcttgagagagtcagagagtcaagagagaaaaggggtcgaga

SEQ ID NO: 10704 - DNA, 3000 bp, Unknown
  misc_feature (1)..( 3000): cDNA_ID_2716422_gDNA_ID_2213669_Annot_ID_182222 3000 nt of promoter + ATG
aaccgtaaaacgttattattattaggtccacgaagacctctcgttacgtccttctcacactataacagctttaacgcattagtccaatacatatacaatagaacatactgtatatatcctaaatttgaaatccatgagctttgattatgtaacttcccatgtggtaagtgagactattggttatagctcctcactgtagcttttgaattactcgtgcgttgtatataaataattatcccaaggatacttttgtttgtttgtgatgctttcttcgattatatcacttaacatcaaagtttcatatgaaagttttgacttaatcagtagactttactgccctttcacgtactaccgaacaaaatagactcaactttaactttaaaagatttgtcattttcatttcaaatctgatagtttttcgaacttcttctttttgtttttgttaaaactcgtaattgaattgcttcaaacgcgaaacaacagcaaaaataaataattaagtttgaaaacaaagataattctgaataagaaaatatatcaaacaaaaaaatattaaaaaaataaaataacttctgctatattttgataaaacggctataggtaagatgtgaaataatgtataacatacaagattaccaaggtcttaaacataacaagacctgaaatggcagattccaccacttaattatttgttcatgtcctaagtatcttttctttttctaagtggatcctgcggatctaagcatcaaaagtaattattatcatattttctttttgttttaaattaagttttttttaattctaaactgattatgtcaagtacaatgagatctaatacagttttcataactcctagtattatttaaaaagagtgttgtatataacgtttaatcgcagaaaaaactctccaagttttatttcacgtagatttggtcaaagtaaccgatgagaaaattagacataagttttgttttacacgaaataaagaaagtgttagtatcacataatgcatgttatctttttactcaatagtatacaaagaccacgggagcgtcgtaagtatgattttaaaacggagcaaatcctatagaaatagaaacgggttctttaagtttctacaaaatgtttaaaaatttgaaaggatagtgtagaatttatggatggattcttacttaacatgcatgtggagtccaaataagcattaaggaatattaaaagacacatagaaacgtaaatataaatatcagaagagtgattctggggtaaacgtgcatttggtcttttttttttttttttttttactactagttagtttttctattcaaaagttaaaaactttaccattaaaaaaataaatggtggaatctttcttcaaatcttcaaaatttgaacagagttttttgtaatttaatcatttttatttacctttggatgaatagccacgctgttactgtctttaaaaaatgcgctgttactatctatgtaaataaattatgacacatttcttggaaaacgtaactattcctcctctctatcgttcttttactttaatacaaaaagtaaatataaaaaaaacattcgaacagagagaagaaaaacaaaatctgcatcattaattacatacaacaggttaatggagaaatggaaatgacacagaacccaaactagcaatgggtgaaaataaggtaaatgattagttaccaaaatctaaagaaaaatctatgttcaatcacgtaccaaattgaaaagattaaccacaaattacttatcaaaaaaaatcccaagcaaactaaactgtagtgttagctctttctttatccccttgttttatggtcaaacagtcaatgagttgcgttataagcacataaacaaacacttctttctctaataaaaataaagtttctatttttatatacagaaaagaaaagaatataaaacttatatctttaaaccattctatatcccgctcactctcagagacagtccctttgcataaaagcgaattgactataacccatttactctctcgatctgcccaagctcccatcttttctgttcgtagagctcatttccccaaattaataaagaaaaaaaaaaagactttttttcttcttcttcttcttgaagaaatttctggagcgtagtaagtttctatcttagtctctctatctccatcttctctgttttattttgcttgtgaaatgtgatgatattatttttatgccgaccctctgttcttttttttgaggcggttctcctggagggtttcttgaaactttatcttggttttgaagcttttttggttcatgggtcactcggatttttcttggattaaagaaaatgtgactttgattacttttttttttaacgaacggatcgataggtttttttgggagatcttgcagctttaaatcatgggtcttttcgttatcctcagaagaaatttgatctagtcgttccttttcttgttcctatttcttatggataaacatttttatataaaaacccatgaaagaaatttagaaactttactaattttttcttcaaatttaattatctccaaattctgcgcaagtcgctcccgtctttgctaaaattgctaagactttttctttcgagcgttgagggttttctgcattacagttttcaagtttttgtcaacaagtaaattgtaattcacaaagacttgttctttcaacttgaatctgacttgaaactttggaacttgattcgacgaacttaaacaacaagtacgtgttgcaattatttgtctagtcatgaatgatcagataaacaatcctcgtttagaataaacaatttctccaaacatcttatatgcattggactctgcatagataaatatatatctctctgttttgtttaatcttcatgccattgatcttcgatttctcttgacttcaaattcacagatcgagagttaatgtggtgctaagtcccaaacgttagaaaagggttggatcgtgtcaaagggtttcaatc

SEQ ID NO: 10705 - DNA, 3000 bp, Unknown
  misc_feature (1)..( 3000): cDNA_ID_2716426_gDNA_ID_2213669_Annot_ID_182220 3000 nt of promoter + ATG
tagagtagtaatggatttttaaagctggttgataataatttttggatctaagtaacaaaggaaaggcgttactctttttttgttcttttcaaattggcgtaaagtaaagaaactactttttatttattttctcttaaatagattagattatgattacaccaaaaataaaaaaacatgaagtaaaaaacaagggtaggtgaagaagaagaagaggacaaagaacaggcgtgcttaagcaacgctcatctctgttttaggtttttgtcaacgatcccttttgcattaggttgagaattaattctgaatttcttgcatactagccagtgtgtatatataatcaaacaattcgatcctaattggaaaatttctccatcaggttcaggtctcgatcgaattgatttgaaatgggttcgtttgggatgctttcgaggagaacgttgggcactgatatgcccgtcatggctcaggtcaaacctcgtacttctccacttccattttcatttgatttgatttgattggtctcttgtctttttttctttaaagtgagaaattgttggggttttgcgtgcagattcggagtttgatggcggaattgacgaaccccatgtctctcgcccaggttttgccctctctagaaatgtgtgttttatttataatctaatctagtttagttcacaaaagacttgggctttcgtgagtggtcaccttctttggctatactttgtctggagttttgttttgtctgcaggctgattcttttgctcatgtgcttttcagggagtggtgcattggcagcctcctcaaaaggccttagagaaggtcaaggagcttgtctgggatcctatcattagttcttatggccccgatgaaggtcttcccgagttgagacaggctcttctcaaaaaggtaatcgcaccgtactgaaccattcttctagctagctctggcaacctttcttgtatccaataaagtgaccacttttgctgctcttgaatccaattccgtgactgagcttgttttatttttgattccttgtcttgttctgaagctgcgtgaagaaaacaagctaaccaattcacaagtgatggttactgcaggtgccaatcaggtataacctgtctttgtttactcttttgattgctcttccttctgttttcttctactctcatactctgtttctgtttttgcatctaatgtaggcgtttgtgaaccttgttattacattatgtgatgctggtgattcggttgtcatgtttgagccatactacttcaactcctacatggcctttcagatgacaggagtcaccaacataattgttggtcctggccagtcagacactctctatcctgacgctggtacctccttgattctgtatcacgtttttcatgacttaacatagctttagttgtgaccagtgaatcatttttgttccagactggttagagaggacactgtctgagtctaaaccgactccgaaagttgtaactgttgtgaatcctggtaacccaagtggcacctatgtccctgaaccgctgcttaagaggattgctcaaatatgcaaagatgcagggtgctggctgattgtagataacacatacgagtgagtttctcatttccttaattcctatgatgtccaaattgaatgtagtaataagcggggatttgaaaatcgcaggtatttcatgtatgacggtttaaaacattgttgcgttgagggagaccacattgttaatgtcttctctttctctaaaacctatggcatgatgggttggaggcttggatatgtgagtgctcgattcaattctattccaaactaaacactgggattgtcttataaaaaggtttgatggacctgcagatagcttactcagagagattagatgggtttgcaacagagcttgtgaaaattcaggacaacatcccaatctgtgctgccataatctcgcagcgactggctgtatacgcattagaggaaggttctgggtggataacggaacgggtaaagagtctagtgaagaacagggatattgtgaaagaggcgcttgagccgctggggaaggagaacgttaagggaggagaaggagcgatatacctgtgggcaaaactgccagagggacacagagatgatttcaaggtggtgcggtggctggctcaccgccatggtgtggtggtgatcccggggtgtgcaagtggtagccccgggtatctccgggtttcctttggagggttgcaggaggttgaaatgagagctgcagcggcgaggctgaggaaaggaatagaggagctgcttcaccatggaatggtggagtgagacgttgtttaaagaagggtcaaaagatggttactttgcgtttggttgaagctatatagttgttttaaaaagaaataaaagagtgtttgtttattcaataatcaatatagctgattcttctttacaaagtcattgtatttgggatgttgttaccaatggttgaatccttaacccctttggtgtatgtatatactctttacttattcaaatgaataatccagcaatgaatgcaaaagcaaaaactggatcagctttattcgttatgagtctttctctaaattcaaaaatttaaattcgagtcttatgattgacgttatgacttgtgagaaattgataatctggccttttatttgaaattttaatttctgaacccagaggataaataaagttaaaatcgatgatgattttaggctttattggtttgaaagtgggccgtagatgggcccgaatctaaaatatttgaatcgaacccgaataaagaaagagaggttggatcataactaccatcgacgtggcttccatcttcttctactttgtcttccatcttcgccgacgagtcacatctccgaaatccggagccggagagggagaaagaaggagaatttgggttctccgagatcgaagctcttgcctcggaacccttgattttgttttggaataggctatttttttagtaaaagaggaaatg

SEQ ID NO: 10706 - DNA, 3000 bp, Unknown; identical to SEQ ID NO: 10700
  misc_feature (1)..( 3000): cDNA_ID_2716430_gDNA_ID_2213669_Annot_ID_182219 3000 nt of promoter + ATG

SEQ ID NO: 10707 - DNA, 3000 bp, Unknown; identical to SEQ ID NO: 10698
  misc_feature (1)..( 3000): cDNA_ID_2716442_gDNA_ID_2213669_Annot_ID_182214 3000 nt of promoter + ATG

SEQ ID NO: 10708 - DNA, 3000 bp, Unknown; identical to SEQ ID NO: 10697
  misc_feature (1)..( 3000): cDNA_ID_4268500_gDNA_ID_2213669_Annot_ID_182212 3000 nt of promoter + ATG

SEQ ID NO: 10709 - DNA, 3000 bp, Unknown
  misc_feature (1)..( 3000): cDNA_ID_3037762_gDNA_ID_2213669_Annot_ID_182242 3000 nt of promoter + ATG
ctgaaatggcggcggctctgcagacgaatatccggacggtcaaggttccggctacgttcagagctgtaagtaaacagtcattggcaccctttagagtaagatgtgctgttgcttcccctggtaaaaaacgatacaccatcactctccttcccggagacggcatcggtccggaggttgtctccattgccaaaaatgtgcttcagcaagctggatctttggaaggttctctctctctctcttgttccctttcttatttaatttagttgctgtttcatttcaattggggactactgttttctgcttggaattgaaagatgtgagcattagaaattggcgagattttgaatgggatttacaatcgtgggttgggctcaaaggccacggagattgcctaatacattgcgtctgtgctctgtatcaggagtggaatttaacttccgtgagatgcccattggaggagctgctttggatttggtcggagtgcccttgccggaggagactatctcagctgcaaaagaatcagatgcagtgcttcttggagccattggagggtctgtcttctctcttttcccactaatcttgttggctcttaattattgttttgggaaatacagtttctcatttagtcattttctcatgttggtataataataacttaaggtacaaatgggataacaatgaaaaacatctgaggcctgagaaggggttacttcagattcgtgcagctctcaaagtctttgcaaatctgagacctgctacagtcctcccacaggtgaccatcctcagagatttcttggttgcctgaactttgtttcttgtgtgaaactctaattttgttgtttttatacagttagtggatgcttccaccttaaagagagaggtagcagaaggtgttgatctaatggttgtaagggagcttacaggaggtcagttttattacttattaaaaattgatcgtaattcttgtctttctcgtgtgacaatatcttataaaatgtcatgtctcatggtaacaggtatttactttggagagccaaggggcataaagaccaatgaaaatggcgaggaagttgggtttaatactgaggtttatgctgctcacgaggtactctattgaaaatctcagatgcagatttccgtggactgattgttaagtactagggtcaaatctaataaagcattttgtatgttcgtcagattgatagaattgctcgtgttgccttcgagactgctcggaaacggcgtggcaagctgtgttctgttgacaaagctaatgttttggaagtgcggttgataattatgttttctttgacttgttttcctctctcttgtttcctgtggaacgaacataacactgaatttttttatatgcaggcctcaatcttatggaggaaacgagtaacagcattagcctctgaatatcctgatgttgagctgtcacatatgtatgttgacaatgccgcgatgcagcttgttcgtgacccaaaacaggtacgtgtactttgtatttgccaaactagtcagctttgatgtgcgacaggtgtaaatccttgcaattatttgattgtttgataaatgcagtttgacaccatcgtcacaaacaacatttttggtgatatattatccgatgaagcttcaatgatcacaggaagcataggaatgctgccatctgctagtctcagtgattcggtatgatataaaataatatgatcttttagtatgcaagcagtatgatctagtctgaacataaacccgccatgtgtaatacagggacctggactctttgaacctatacatggttctgcacctgatattgctggacaggttctaactctatccttcaaacaaacacggtttttgttccctgatatcaaaactagtttaatgccaaaatcaaagagcacaacttgttgattctttgaattttcaggataaggcaaacccattggcaaccattctaagcgctgcaatgcttctgaaatacggacttggagaagaaaaggcagccaagagaattgaagacgcagtgttggttgctctgaacaacggattcagaactggagacatatactccgcgggaacagtatgtttcttgaaccactcttataacatgtttccttttccttaaaaacgtcccgagttagtgtttgagaaacgtttaaacaagcaggcaacaacaaacagtagtaatatttttttgtctttttgtatggggtatgatcagaaactggtgggctgcaaggagatgggagaggaggttctgaagtcagtggactcccaagttccagcttctgtttaatatttgtagaaactttgaagagttcatttccaacaacaaatgttgtaccttgtactcaaagagtctcggttttattagcgatttttataatgtgagattattagagggacttatttgatcgaactgaaacgttgatgtttttttctgagaaataaatatccttgtggagataatgacgtgtcagagtatcactcaaaaagccaaaaattagagagacaaaaaagattcaatctcccccgtagtccttatccggcgccgagtgtggtcaaacgtcgcaagagttttcgctctttccggtgagatctttttcctctgatttctgtttcatggcaagcctacttttagagctgagtttaatcgatgaatcaaggatgtgaatttttgttatttcttgattattcattattatgttcaagaaatctaaatctctgcttgggaactaattcacaatttagacatctctgatgagtttttcctctgttttttatttctatcttatcaattttgtttctggaaattttcatggctttttgaatgttcattgggattgcgtatcttggtggtggtaagtaaaaagtcaaacgccttcgtttttctgcataatctctgagttccatcaaagctctgttttgtgttttcaaggtggacttttcacttgacatgttaggctttgatccttttttgttcacacagatagacaa

SEQ ID NO: 10710 - DNA, 3000 bp, Unknown
  misc_feature (1)..( 3000): cDNA_ID_2716236_gDNA_ID_2213669_Annot_ID_182241 3000 nt of promoter + ATG
gttacgtcatgtctgcataatctttacaaaagtaagctaagattaaaagtcgtattctttagttgaatttttttcaaattacaataataacgccatattctccaatggttttaagaatgtgatccatgatggatcatccatcgtttctgtagggtgttttattgagcttaacgatcttacaaaatagccacaaaatgcctgtggttgtcacagagtggaacaacaacaaaaaaaaattaagttagagagtgaattacaaatggtacgtatatgtagtagaacacatataggaggcgacaaaccatctttcaaaaccaaatcttcggaatttggcttaagacacacaactcaaccagatttctcaatgaacctcagtgttttctcctcggttttgagttgaaacaaagccactttatggcaaagatgatataccttggggagatttctccatccaaaaggacgcttctctattgcttcatgtctgttttgaacacataaccaaagagtttcttcatatctagttatctattctctacagacaagcgtttcgtccaaggacttttctaccaactcaggccttctccttggagatagccctctttcgatcatttcctcctcatattccctagccatatccaacattcctttctgaatcaacgcatcaatcacagcattatacgccgctgaatcaggagtatccccagactctttcattgtcttccacacatataataccggctgaagaaatccccatctctcaaacttcctcattagcatcacataagtatccatctttggcctcactccactccttatcatcctaccaaacagacttaggatctcactcggtttctccaaacgggaaaagagacacatgtaagtaatcgaatcgggttgacaacctctcttaggcatctcatcaagcatccgatacgcgtctctcatcctcccgtcttcacatagaagcttaatgattgtgttatgagtcgcaacattaggttcacaacctctttccctcatctcccgaaataccctgataccgaattcaacaccttgcgacgctccaatggctcgaatcacagtgttataagcaaccacatcgagtttcatccttctactcttcatttccttatacaacttcacagctttccacggtttcccgctcttgcacatgatatccatgtaaatggaatacgaaaaaagatccttagtaacaccttcagtatccatcttcttccaatactccttgcatttaccccaccatcccaatttcgaccacccacgaagaatcagattatgaatcttagtattactcacactaaaaccattaccaatgacattcttcccaaaacaaagctcttcagcttcaaccacatgtttatgctcgcaaagcgcatcgaccagattataaaatgatgtttcatctctcaaattgaaatcatccaatttatcatacgcatcaatagcctcctgaacaagatgagccgtcacataacgcttaaagactatacgaaacgtgacgtgattcggcacagattccgtgtttccgatcatgcggttaatcaaagcccaagaaatttcaaactcgaaatacttacccagaatatcgatcacccgattgaatgtctcggtggtatgtctgaatccggattctctctcgacccagttgaaaaactccaacgccttttgccaatcgttgctgtaacatgtgagagcttcgcatactgttttctgatcgtaactggactgatcttcttcttcctgagatcgaaacttcgcatcatcgacatttgaaataggttttactgacagaagccgaacggagtaaggggaagcaatccgaactcgattgagtcgccgcaacaagagcattctcttgtttcccctctccgctccctgtacacacgaaattagggttcatcatctaacgggcgaattttgacccgaatacccattttaaaatctgacccgaataccatttatgggcccaaagcccgctggacttgtgttaatatttggaacatttgggccgatctatcttctacgaatctttcttaggcccatcataattgagccatccagaggtgaaaataaataatcgaacggttaatattggtttgattataaacacaaaagttctttccaggtctccttgtagtctttgttgtagtaaatggcgggagtcatccacgtcagcagtacccagattccggttgcgtttatgtccgcaaccaaacagagctttaggagagcttctgtgatcagatgtgccgccaacactccaaagaaacggtacaccatcgcggttcttcccggcgatggcgtcggtaacgaagtgatcccagtcgctgttgacgttctttgtttagctgggtctcttgaaggttccttctttctcatcctgttgcctaatttaatttgattttcccaactgaaatcgtgtttttggatatcagggatagattttagcttcgaggagttgcctataggaggtgttgctttagatcttgtcggagttccactgcctaaggaaacattgatcagggcaaagcaatcagacgctcttcttctcggagctgttggatggtatggtattattaccataactttcgttcatctcaagtttggattcatctaaagtttggatttttgaattgaaggccgaaatgggataacaatcccaagcatttgaagccgataacggccttgttgcagcttcgtgcggctcttcaagtatttgatgagccctccttcttctgtgaggtgctgctaataaatggatatatatatatatatatatatatatatatatatgttgtatgtggtaatgtaaggtgtccatttacaaaattaaaaactttggggtcaattctgaaaataaaacaatgtgcaaaaaaggacccataaatgcaaagaagtaaagtctgagtgtactagtagtatccatttgacttgcggtttcaaaatccgaaaaagaccaatcaatcctttctccctgaa

SEQ ID NO: 10711 - DNA, 3000 bp, Unknown
  misc_feature (1)..( 3000): cDNA_ID_2716224_gDNA_ID_2213669_Annot_ID_182237 3000 nt of promoter + ATG
actaatttgtgacgcgatgtcgtttatcttcaggattgggtctgcaatgctgtacacggggcaaaacgagttctacggtagcgtggagaggacgtttatgtacattgtgaaacaagcaactggagttttgactaagctaacgagcttatgggactcgattcaatctgctaaagacattcagctcgatggacacaacctgtttcctcccgagtttagaggcaacatcgatcatttcaacaacatgatcaagatgtctaacatcacttaccccgaccgtgtcgctaaccagacaatccgttatctcaccggagcactaaaccctgtgtaagtaataagtattcgcttgatatgtttcttgcctcacaagctaaatatatatagaagctctgtttgagtatttgactcaaatgcgttttcctcaggagatatgtgttaaatgtgatcgctggtgtaatgctcgcagtcgcattcctcggcctttgtaagtcacaaatcaaaacatatctattttgatctgaagatacagaataatctcattatttttgtttctgtttttcttcttctttcgaaacagtgttttcgttctgtggattgcgagttcttgtctacctgtgagttacacttagactacgttgttatattatcatatcatatccaaatcaaatgtttataatcagtgtttcaattatatcagattggtaattcttggttggattctcgtcacagccactatcctcctcagcgccgttttccttgtattccacaagtaaatgatatttcgtcgtcacttgatctaattcaagattcaatttgtttttatcaaactaatgatgttacttaataaacagtgtggttgcggacacgtgtatggctatggaccaatgggtgcatgacccagcggcagactcagcattgagtcaacttcttccgtgtttagatcctaaaaccattggagagacattggatataacgaagacgatgactgcgacggccgttgacatgaccaatgcgtacacggtcaatgtcagtaaccatgatcagttcccacctaatgcccctttctaccacaaccagtctggtccgctcgttcctcttctctgtaacccactcgaccaaaatcacaaaccgcggccttgtgctcccgacgaagtcctcttagccaatgcttctcaggtacatacattttctcataagtgatacatatgtcaaatgttaatgttaattcaatttgtatatgtttttgtaattaggtttataaaggctatatttgccaagtgaacgcagaaggaatctgcacaacgcaggggaggttaacacaaggttcgtacgaccagatgatgggtgcgatcaacgtggcgttcacgttggaccattatggtcccttcttagctagtattgcggactgtacattcgttagagacaccttcagagacataaccaccaagaactgccctggacttagcattacaagtcagtggatctacgcaggactcgcgtcgctctctggtgcagtcatgttctcactcatcttctggttgattttcgtcagggaaagacgtcaccgatctcaaaccaaaaagtctatgatccagatgaatagattttaattagtggagccagcccattatggactcggcccatattatcacccctttttttttttttttggaaacgttaatgatatatggttttaaaaataaagtcgtacgtgcaaaggaattcgtcaatttttttttatttgttgttttttttgtgcaaacgctcttttattgttttactcggtttattaacttttagaaagtggatagtctgtaaatcaacaacttatttagactattaacttcactagatagctataatagtattgatgtttttttcctggtctaaaaatataaattataaacttttcttttagataatattctacttgtataattatttactaatttcattctatgagaataagaggtgagaaaaaatgttgaacattctaagatacatgacatgagtaggtttttcaataaagcaaagccattgaatttgtcaacgaacgtcgccgttggacccccaaactaaatgtacttagtaattgcgacgactagttggggctagctaggcaccatacctaattgctatttgtgaaattctgacgtgtcggattgctatttgtgcctcgaggccggtgcagaaccaggtgtcctgccgtttcaacttgcaaattattgttttttttccgtcctcagtaggtaagatttttgagtattttagttaaggtccatatgtagcagtcaaaacaaaacaaacaaaaagttaggccccctctttaatttatttttatgcaacgataatcctgtaattgtcggtttttgactctataatgttttttaaatatgccatgggaacgttaagatctatgccaataccaaagtgatgtatcgggcggtccacgcgggacgaagtcacagtcaaatgacctcacgtgtttcaagcacaaaaatcttaacaagacaacaatttcctctcttacatatttgtaccataaaataaattttcaaattaagccaaaaaaataacggaaagtgtttgattggttagtgcttcttataactgtcgaatttcagacaaaaaataaaatagaataggaacaaaaataaaaaacgtaggatttttgtcattagttgtgaataatactaagaatctaactgagacccacttgcaattcttcaagaatttaatatgattagtttcaaaagtaatgctaaacctcttgcgaatcacgctttttatcctcttgagtttttttttaaaaaatagtatgaaactactataacgtatgctttaaatatgttaaaaaatatgacgtcattttgaagatgtttaatgctttaaatagaaacacaccaaacaataaagtgagagtgagtgagtctgattcatctcctctgtttaagcaaagcacttttctaaaatcccacaggagaagagagatcggaagagatg

SEQ ID NO: 10712 - DNA, 3000 bp, Unknown
  misc_feature (1)..( 3000): cDNA_ID_3037769_gDNA_ID_2213669_Annot_ID_182235 3000 nt of promoter + ATG
tatttggatataagttcatttgccgatttagcttgcttttttattcaaatactgattaacatggaatgcaagaaaaaggaaaaaaaaaccttcttcttgccatggcgagtgagaggactactaaaaagaatacagtaattccaaactgataaatatgagtttttacgtgtggaaaaaaaaaatttgagtattaccttagctctgcaagatatattaagaatacagcaaataaagaagaaatcaaataagcatattagatttgttttcacaaactgaaaaatcctcaaatacataaaaagaaaaacacataaaaatccaaactaataaatatgattaatgattcactgattttcgcctgaactaaattatggtcgtaagttttttgtaaaaaattgttaaaaaaacaaaaactgtcttatcgagacttataacaaatgatgaaaatctgaagaaataatatatatttttcaaataattatgtggtttgacatgtcaacgtctttattatcaatcagaagacagtaaggaacattaacaatgaaaagggaagttataaattaagatgtcaatatcagacaactactcgtcaatccattatgatacgtttcattatgagtcactaggtacatgtgcatgatgtaattatcacttattaaacagattataattttcaactaaaaattcgatttggtttctaaataatatttacaaacaatacaaatcatcaatgacaaaaaaattgtttgctacaacgtcaaactattttaaatgagtagattctcgatagatcctctacaatctacatactttactttgaaataactctccactctccagatcagaacacaaattgtaatagattaatagctcaaaaatagatgagtacttctctttagaaatataaaaatcagactaacacgttgaaaattatatagtactatgttttattttgtaaaccggtcattaaaagttgtggagaagtgaatggtggtcagtgttcactgcatcttcaatattttttatacattctccggccaaaaaacagtgcacgttggtcccatctggctggtctgttaaaaagtctaacgggataattaaattcttacgggagatattactaaatcattcaacgatgctatcaaatcactttcaataaaaaaaacaaagtcaaatataaaatatgttttcaattaatagagccacataccgattttttttttccaaagaaggcattgatttttctaataattgtatttattttaaatattggaatctacaaaacattattttaggtcagttggtcaatgcaattggttagaaaatctgtaaccaatgaaaggaaaatagtgtcaaattatactagtgagtatgttcataagttactaaagtccactaagtattaataaagcgcactatgtgaaactactacaattattattggctatttttgtttgtactacttgttttgtttaatcatggttagttttttaaattttaaaaccaaactttaagttgattaataaataaataaaaacgtagatgagaagggtgttggctaatggctattggttactttccacttatgtatgtcctctcttcttctcttaaaaagcttaattgctttgctattttgatactagtacagtctattcttcaatttatcagcttcttctcttctctcatatcgcggtaattaaaggcgatatactgattgctttctggggagaagttgtcggttgtcttttgccattataattataatgtgaatttttgtaagccataattatttgcactatttatttatttagcccaaataagcacgtatgtatatatagatagactaatttccacgtatccaagacattgccgctaactattttttgttgggaaaatttgatttttgttatatgacgacgacagcgacaccatcaaatttgtttatttatttcggttctcttgttatcccaacgccgcttggattgatatttgtctactatcaaacttcattatacttttgagcgaattaaccaaaagatttgtaatgacacctttttatttcaaaacgtacggataatattttgtcatagaccaaactatttttttcataaaaattagtctatgtactacatatcaaacttgttggtaattcgttggggttggtttctagtcgtcttcccatctcgttgggactaaaacaacattcttttagccactttcactattatataatggaacgaaatgacaagcccgttaaagacccaatagcccaatattgaatcaaaccgcagatcccctttcttcctccaaaattcaggtcacaaacccaaacttctcacccgtatctaaaaagttctcgtggtgtatagtcctaaactagtacacgacagaatcaaacctgtttgaagtatttagcacggatccaaacacgagagacatcccaaggaatctgattctccaatgtttgtctagacataagatgcgttgatggtaaagaagaaacgatacgcacatcagattcacagggttttacttctttttttggtaagattggatttttctctcacccccatttcttattccatgcttcttagatcgttaattgaatctgcatcccgcagtgatcattctttaatttacgaatttgtttttgttgtcttgttgtcgatttttgtcaattttattgtgtaatttaccaagtgtaaattgtgattgaatcgattgggagggcattgcgaggtaaatccatattgtgattttttgtttagtgtctaactagctgtatcgtactccgcataaatcacaggatttttttggtgagaatttggtaacaagaggaaattgttccattgatgacgaagctcctagtgttccattgagaatttttggtttccgattggattattaaagaatagaagaaaaatgttgaaatctggggtttgattttggtatttcaggagacacaagatctaggatttcctttatttagagacgagggattct

SEQ ID NO: 10713 - DNA, 3000 bp, Unknown
  misc_feature (1)..( 3000): cDNA_ID_2716206_gDNA_ID_2213669_Annot_ID_182232 3000 nt of promoter + ATG
tcatgaagtgataataaatttaaaatctattttttattatattcacatggataggctattttcttgtgggacgagtaaagatggggaatcgttcatagttgagtggaatgaaagcgaaggagctgtgaagagaacttatcaaggattccacaagcgttcccttggtgttgtccagtttgatactactaaaaaccgttatctcgctgcgggtgacgacttctccattaagttctgggatatggacaccatacagcttttgactgccattgatgctgatggaggtctccaggtatgcaaacaaatacctcgattctccctgggaaccgaatgttttcatttgcagccatcatggctctctatgttttgtaggcaagtccacggatcagatttaacaaggaaggctctctcttggctgtttccgcaaatgacaatatgattaaggttatggcaaactcagatggtctaaggctattgcacacagtcgagaacttatcttctgaatcctccaaggtactgaattttgtgctcactggatcttcaacaagcaaattactaacccccaatttgaaatttcttcaacactttatttttcatgtacatttgcagcctgcaatcaacagcattccgatggtagagagacctgcctctgtcgtttccatccctggaatggtacgaaaatcgatactttttccgtcagtttctctatctcttggtctgggtccaatcatcgttgttgatcacttacctttccaacagaatggagattcgcggaatatggtggatgtgaagccagtgattaccgaagaatcaaatgataagtctaaggtatggaagcttactgaagtcggcgaaccctctcagtgccgttcattgagactccctgagaatatgagagtcaccaaggtactaacacatagactgacataactgtacttatatggcttgattctaatgactcaaaacttgagcagatatcgagattgattttcacaaattcgggaaatgcaattttggcattggcatcaaatgctattcatctgctatggaagtggcagcgaaatgaccgtaatgcaactgggaaggtacttatggtctaaaatcttcctttaagatcgccaaaagagttgaaatcatgatgaaattcaatttgagattttgtgtaggcaacggcttctttacctcctcagcagtggcaaccagcgagcgggatcttaatgacaaacgatgtggctgaaactaatccagaagaagccgtaccctgttttgctttatcgaaaaatgattcctacgtgatgtcagcatcgggaggaaagatctctttgtttaatatgatgacgtttaaggtaaaatcccagctacagacagcactatgtctaatgtatgcaaacaatgcttcatctgttacatttaattgtgttgttggctaagcgcagacaatggctactttcatgccgcctcctcctgccgcaacgtttcttgcttttcaccctcaagataacaatatcattgcgatcgggatggatgacagtacaatacagatttacaatgttcgtgttgatgaggttaagagcaagcttaaaggacattctaagagaataaccggcctcgctttctccaatgtattaaacgttctggtttcgtctggagcagacgctcaggtgctgattcatctcatgttttgtaataaagaatccaaatccttagaagtcttagtgtgaatcttttggtttttgtatgcagctttgcgtatggaacacggatggatgggagaagcagaaaagcaaggttctgcaaattccacagggaagatccacgtcttctttgtcagacacgcgtgttcagtttcatcaagatcaagtacacttccttgtggtccatgaaactcagctcgctatatacgaaacaaccaagcttgaatgcatgaaacaggttttagtctttatatatgttcattctctctccttgcatctgagtaacccttatagaagaaagaaatgtctttattttgattccagtggcctgtgcgtgaatcagcagctccaataacacatgccacattctcatgtgatagccaattgatatacacaagtttcatggacgctacaatatgcgtcttcagctctgcaaaccttcgattgcgttgcagagtcaatccctctgcatatttgccagcttctctcaggtgagttaatgaaatgaatataaactagtgcaatgttggatcatgaatcttgagtcttcatgttgatgttttgtgcagcaactcgaatgtccatccactggtgatagcggctcatccgcaagaatccaacatgtttgcagtgggtctgtcagacggaggggtccatatattcgagccgcttgagtcagaaggtaaatggggagtagctccaccgcctgaaaatggctcagccagcgctgtcacggctacaccttccgttggagcttctgcctctgaccagcctcagagatgatctgcttcagtttcttactctgttttttttgtgggggttttagatcttttccgatttattattgttttgtttgtgtggggggaagaaagcattctaacaaggtaaatgaattaatagcttacaagttcttcttaattggttaattcgatgttgcttgcctctgatattttggtcttgagaaatatcagttttgcaaaaggacgaatttgcaattttgcactccgaatctaagcacgaactaaggattgaatgccacgtgcagcttcgagataggtttggatattcgttttgagatacgaaggaagaattactaaggcctatgcggcccacggcccacagacttatatatctacaatgataaatatcttcaaaaatagtaattttgagaaaatattgagaagagacagagaaaaaaaatcgagtgaaaattatctggtgtgtgtatctagaagaagctacagagtgggacgaggtttaaactcgccaatcgccattgacctctcgcttgctttctttaactaaaatg

SEQ ID NO: 10714 - DNA, 3000 bp, Unknown
  misc_feature (1)..( 3000): cDNA_ID_4266572_gDNA_ID_2213669_Annot_ID_182230 3000 nt of promoter + ATG
taaaacaatttaatattttatatacaaaatcaactaaatcttaatcacataaaattagcacaaaaaaaagtattcaacaattaaaaaattatcaaatctctatataagttttgatactatattcgaataaagtgtaatattccttttcaatttgtattctttaactaatttaagcgaactaatatatttgctaatcttatacctatcaaaaccgactatcgtttcttatctttatagtatatttgcaagatcttttttggtggatttggataaaagtgcatatcgtcctactatattatttgggaagtacattttaaatgtaaccttaatttttgtaattaattacatgacaatgccattagaaaaatttaatcaaaaacaaaatcttttaatgacatcattaagattaccaaaatcatttaacgacaatattcatctcttaattatagggtttattggatttaaagacgggtcatcaaagatttcctaaactgaagcaaaatatattgaatattaaaatatctatctgttaccaaattataaacaaataagttcgtaaaacaatttaatattttatatacgaaatcaattaaatcttaatcacataaaaattagcacaaaaaaatgtggtacattcgggtctatagtagttttgcaagacttttttggtggatttgggtaaaagtgcattcgggtcatgtagtacattcccctattaaataaatatggtgcactcctatgttattagctaaaatatttagattataatttagagtcatatcataaataaaattaatattaataaaataaatggctttttggcaagacggatttggagggacgtgtttttgaatcaacattaataaaaagtaaaatataattaatccactgtttcaatacgggttaaattattaatttattattttttaataacaattaatatatataaatacttaataataattataaactgtaaaaatataaatattttataaaaataaaatttacaagttttaatatatattacttttaaaaaataaatcatcccgcggtataccgcgggttaaaatctagtttcatttaaacttgttaagatttaaaagtatttgattatttattttgaaatatatgaaaagaaaataaaatataattccttacagtccagacatggaaacaaataaactttgataatctcttcaaattataaattataaatagaaacgttttcatcataactcattcagaaaataaaaaataaaaaataaagaaaagataggggtgaaggaattagcatgattttgattatgatgatacattaagttaattacccaattagatttgaaagtataattttcttgaagcttcaaaatgggtgagtaatataataaaattatgaagcctcgggaaaatgtaaatgaaattaagtagatatgggccagaccaacgatattaactgaataataattgtggactaaatattggactccgtaaaagcccaaaacaaaatataaaacgaacccacacgacacgagttattatcagaaacattactgttacaatgcaaacgcgcaccagtagagcgtatagcgcgtgtgtcgaaaatgcctagtctatatacccaccaaaaacgctgtttttagcctaaatactttattttaaaagaaatcagcgcgtgggagaacccatgaacatttgggtttgtttatccattgttttgatatttatttatttcggttaattccaaaacaaaggattgcttcttcttggtatttttgactaacaaatacttttttttggcgacacacttatgtatagcaaaactaaaaagtatgaattcaaacaaacaaacaccggtataatatgtttacactaaactaaactaggagaagatgtttaatttatgaatgaaaccaaaattggaattattcactaaatgacgatttcgtaaactcagcttaacatttattgacgataacatcataaagagctcaaaatgatattgtactacataaaagaaaattctcttccatactagctataaaagatatttcaaatgaaacaatagtattattggttacaagtaaatcatagtgtacctcttaacaagtcaaataacttaaaaagatcaaaatatgcacaatcattttattaacaatccatatatataactgggaaaattaaagtggcgtaaatttgatcaatttatgtagctagccggtgattataattgaatatacgatgatgttccgagacaagttagttgatcaaaatattaattcatacatatccatccaacatatgttgctattacaatttacatatgataatcttagggcaggcctcataatatatacattaattggtaaaatctggtcaccaaatttacgagcagtagtaatcaatattagtagtagataacccagtttttgtttttttggtctgaagtagataaccccatttctatccataatatctttgtatttaagatacgttttcacgagggccagccgtaaaattgaattaaaatcccatttgtttataagtttatagtaaaatatagtagcttcagacaagtagtactaggaaaataaatcaacttaatagaagaaccagatctgtgaacggagaaagggacatatgagtttgtcaaagtcaacgatagaaacggttacaagaatatccaatgaaagagagccacgtgggagatgcagctgaatttaagtaagaatgatctcataatcttgaccatccaccaataaaaagcttaattaatacatcatcatccaatccggtggagtaaatgcgtagatggatagagaacggtgaagtttccaacaaaatctctgactctgattcagctttctatattcaatcgttcccattatctcattttgtagtttagttttatcctcaacaaccatcttcttcgttatattccttgagataacaacaaagcatcgttcttcacctttaccaaaaagataaaaaaaaagaaaaatg

SEQ ID NO: 10715 - DNA, 2070 bp, Unknown
  misc_feature (1)..( 2070): cDNA_ID_3037797_gDNA_ID_2213669_Annot_ID_182211 3000 nt of promoter + ATG
ggtacgaccaagaccatgtcatcttgtttctgaccggattgaatgaactccacaaagccgataatgttccagtttggtacggcggttcgttccttaaccacggatcctttcatttgggagggtttaggacccaactcgaagttgccgtttggtaataaacctgaaacaaaaaatattaagaaatgttaatttataatctcggatttgagttgaaatgagctttaactagagttactaccatcgcggactggggccgataagacgacattcgaagagatgaagaggagagctaagaggagtgctgcttcttggtacatcatgacttccttgggtgatagatgaagatcagatggtgagtactatccaaagggtgaagaaaggctgggtttttatgagtttgagaatagaagacgagcactggttttgaagaaaacaacgggaatgccactggaagcatcctgggttctattgtcaggtgccacgcagacacagacagctagctcaggaaacatttgacttcatgattagcatttccatttcttcaatgtattgtttaaggggctgccttaacaaccattatattaaactatatattcaaacgtaatttgcgtttgcctatctaaattattcacataaattttcaaagtattaaaatattttttggctttttcagaaaaacatttttgaagatcagtacatccatgcgtaaacgccaaaaaagttctttttgaaaaaaggtttacgggtaagtattccttaaaaagtgattaatctggaaaaaacatacacactaattaatataaatatatagggtacgtaacaactaatgcaaacaaacaacggaaaactaaaatatgtagagaaaaaaacatatatatcatcaccactcaactataatgccatggttttggaaaatgaaagaaatataatgtatatttgagatgtctctaagattagtcatttaacgccatgcaactcatcccaactctaatcaataaaaaataattatgattttcgtatagaatgcgacaaccaaaagttaatgacgggggaaaatatgtgctgttttggaataaatcaactcaacttaaaaatgaagtcaaaaatggtattgattgatgttagatattgatcacattgggatgaacacgtgcaggggtaggttgttttctggtgcagggcacgactgccgactttaccgcattagaagtttcgatcaatattcctaatgtccttattaacatgtcaaccattatcataatccaaactcttcccaacatctttgattaaattatgtatacattagttttaagtttcaatttgttaggcaaagtagagagggacattatggtgaaaaaaaagacaagggacattaagaaactttagttatacgtcaacatatatataaaagacaatggttgggagagagatcacgtgcgacaaggctggaaagattgatttgccgtaatttcaaagcgaaggatttaaaaaaagatgagtcagaaaaaaaagatgaggatatagttcgggggtttgaacccgacgtgaatcgaacacgcaaccttctgatctggagtcagacgcgctaccattgcgccacggatcctcaggtaattacatctatacgtttacttatttatactaacaattagtgaatgataaaaaattaaaaaccccttccgattctaatttcctggcggagcaaatttagggtttatcgtttgcatcggtctcgcgtctcgtttcccacagacacatctctcgaatcttttgaaggccttcattgcaatagattgctcgtaagggataggtaggcctttatgttctgccgcttaatttcttcgccggattctgtttgattcattttaaggtgagtgaccccatcgcttttagattacagacaagtatgtatttatggtttgaatgatgcttattgtcttgttgttagcttagattttacattcagccattaatttagtattaataagcttcggttctacttgttttaagcagttaaatgctttaatctctgaatctttgaaacttgctcctctcttaggaattaggatg

SEQ ID NO: 10716 - DNA, 3000 bp, Unknown; identical to SEQ ID NO: 10705
  misc_feature (1)..( 3000): cDNA_ID_2716426_gDNA_ID_2213669_Annot_ID_132753 3000 nt of promoter + ATG

SEQ ID NO: 10717 - DNA, 3000 bp, Unknown; identical to SEQ ID NO: 10704
  misc_feature (1)..( 3000): cDNA_ID_2716422_gDNA_ID_2213669_Annot_ID_132755 3000 nt of promoter + ATG

SEQ ID NO: 10718 - DNA, 3000 bp, Unknown
  misc_feature (1)..( 3000): cDNA_ID_4266553_gDNA_ID_2213669_Annot_ID_132756 3000 nt of promoter + ATG
aagaagcgagctgttcttaaggatatcactaatgttacctgcgagaattcttacacaagttgcttcagtgttgcggttgttaactacacaatgcagcattttagaattgctaagtttatatgacaagaagtatgtttttgctgacaattgttgcttcttctttttacttaggtggagaatatcaagcagataaagaagggacgacagagttcttcttcttccaaggtggcatcttcttcggctacttcacaagttacagatgcaaaggtagaagttgtgtcaaattcagcaggagcaagcttgtctgtttttacagatacaagcttaggcacaaacgaaacatcctatagcattatcgcaaagccaagctccagatcgcctccaagaccctttgggacaggtgaattttataaatggtcatttactgaagcttgagtgggcaatgtataacatttctgatgcatctttattcttgcaaatggtttacagttgagagaagttgtggtggagcaagtagcccgaaattcgttgacattgattcagatgacaaagatcctctactctgtagcctttatgcacctgacatctactacaacctgcgtgttgctgaggtatttatcccttggattttgatatcttacgatgatgcatttgaggcatttgaatccttacgacttgtctacttatcagcttaaacgaagaccatttcctgattttatggagaaaacacaaagagatgtgactgagacaatgcggggaattcttgttgattggcttgtagaggttagttctctacttccagtttgtttgttgcttacttatgaagtctttttgtgtagcttctcacaactcaaaatttcaggtctcagaggaatacacacttgtacctgacactctttacctcacagtgtatctcatagactggtttctccatggaaactatgtggaaagacagagacttcaattgcttggcatcacttgtatgctcattgcttcgtaagttcctcatccacctaaaatcaaataatgctctggtctgaacacaacatctaaaagagttcttgcaggaagtatgaggaaatccatgcgccacgcattgaggagttctgcttcatcacggataacacttatacaagagatcaggtcctggaaatggagagccaagtactcaagcattttagctttcaaatttacacccccacttcaaaaacattcctcaggtaatcttaccagacagtgcaaatgctttatcatgtgttgttgctttttagtctttggtgattcagagtattcattcatttttgcaggagatttcttcgagcagctcaagtttctttcccggtaatgtgcttttcttttatcagatcagatatatctattgctcataaaacatgtagcagaaagattgaaactttgttggtaatttgtctgcagaatcaaagtctggaaatggagtttctggcgaattacctaacggaattgacgttaatggactaccctttcttgaagttccttccttcgatcatcgctgcttcggctgtttttcttgccaagtggacattaaaccaatcaagccacccttgggtctgtaattgaccaactatcttcttcattaagaaacacagcgaatcttgaatctcactcttgtttactttattttatgaacagaatccaactcttgagcattacacaacgtacaaagcctccgatctcaaagcatctgtccacgccttgcaagatttacagcttaacaccaaaggatgttccttaaactctatacgcatgaagtatagacaggacaaggtattaaaaaattattaatcttagtttggttttcttaaaccgaatgaagaaatctggtctgtttcggtttaacagtttttttttttttttttggcaatttacagttcaaatccgtggcggtattcagttctggagagctaccggacaagctattcatctcctaaccgatatgacacacgaatctgtagtaacatttttctgatggtccacattcatctgtctgtcaaataaaacagtgtcttcccacggtctctcatcattaccaagtaaccggattcggtgttagttcggtttagttgtagacaggtttggttctttcaaaccggacttgttcttgtcggtaacacgagttaattgtagtggaatgtacatttttcccccggtttattcaaggcaatatctggtctgcttcgaatattttatctttttattacagttgacagagagacaaagcattaattacacattatccaacggagaaattgtgactcacatagtatgtggcaagaattgctttttcgttttacgaaaaaccaataataaaaaattatcaagttggtcttcttcttcctcgttgctgatgtgtcgctctgcttgagagagtcagagagtcaagagagaaaaggggtcgagaatggcggtcgcaatatctgggagtagtttgatatcgtcgactcttcagcattataataatcggatttatatccgagattatccgattccgtgtcactcttctaatccaatttgcaattcttttaatttcaaaagacgttcgttctctccttcttcccccaaatttaacgaccatgtcgttaacccttcctcttcttatttatcctccaagctttctccaattcgaacccattcctctttcgctggtaaacgcctccaaatataatctcttttcttttcctcgcttccttctaatttttgaggtttgcttttcttttcttttgatgattgtttggctatttcgtaaattttatgcaaaattgctttagaatttcctcatgagattgttttattactctcctcgacgttctctggttgttttgttctcttgttgttgttgttgttaagggtttgattgtttccattgtgttggtttggctctgcaacttcaggttttcagattgtgaccttctttttttaattacgtgtgtagcgtgtggctgctcctggattcaagacaattca

SEQ ID NO: 10719 - DNA, 3000 bp, Unknown
  misc_feature (1)..( 3000): cDNA_ID_3037779_gDNA_ID_2213669_Annot_ID_132758 3000 nt of promoter + ATG
ctacctataatgacacgttttcctgtaactggcggtttttatatctccacgaaagcaagtgaacagtttggtgattagcttctacttcgtgtggtgtgggctcatttatagttatagccacttagcatcttctaaactgtcattagtggatgtaattgcatgtgtacggatatcttttcagttttaatttctattagcctggtatcaaaagaagaagaagaagaagaaatcactgtcaactaaaaaagaagaaagaagaagaagaaatcagccctgatctttaagctcccacgtcacgactgatgggttcgattaaggagaaaaatatataatttgattatattatccactagcattcacaaaacgagaaaaatatatattctaaataccattatttactttctaaatagagttgaaaatatcattttaatcgcattcatgttacctttgcttataatcgttggaaaatataataaactttattcccatatatatttgtttgtgtttgtcaacttcagtccaataatttaacattagaccaaaaaaaaaaaacttcagtccaatatattcttcgggagagatcttcaatagtgttccttttgtctacactttgttgtcgctttactcctttaaattatcattccaactaactttttcttggtaaaaaagtttcaccattatatatgtacatcaactttcactgtcgtcggtcgaaaacaaatcatggtctaacaatatattcctaattatctatcatcgtacactacacactaattaggtacaatacttcttcattagtttaatctttcaccgaatatcagaagaaatcccaactaatatgcgtgtggatcttgtaaacaatgaaaagaatgttcccaccaaaaaaacaatgtgaacagaactaaatgttgaaacttctacttcaaaattgaaataaaatctaaaataaaatatataatgaacatcaatcattgtataaaagcgattaaaagtttcatgatttgggataaaaaaagttagagatagataactatcccttttttagtgaacaagtataaagtttttactgaaaagtttttcagtgtccggtattaatttcatattagtcatattatttacatgcaatatgaaatgagatgtcaaaaaagtttagacaaaggaaaagagcagaacattaattacagcagcgtagggtcacatgcgtaagtcacgtgactctgtttttcgttggggaacatagaatcataaatgattttttcgatggttcacgacactattcttagaccaataagggcaataagagttaaaccaggggctaataggtcctactggcgacacatagacgaatttaccggtttcgattacaaacccgtgaccggtaattccggtcagccattgttttctaagtttgttttctttcgttataatgcgcatggaatgaaacagtcgtataattcatttaactcgactcgtaacaaaatatgtgagataataataagaagtacataaatttggtagctagtatttaatgttaattgatactttttgtctcaaataatcgaaactgcttttaggctctagaaaactgatattgatgtcttggacatttacttgggtataataaattgcgataacataatagagcggtccgagacttagagaattacgaaaccagtaaattctatacagattgtttatccaattaagcccaaaccaatccaggtttcctacagtgggtcaagaatacatcatggcagatttgatacatcataatgccattatggtatcaagcccaaaataagcccagttattttttctttcttttgttgtcattccataaaaatctacataacggaatccagaatttgattaagatcttattccgttatgttccagataattagagtgtcatatctctataatgaacttcatattaaatttctttgtcttaacatgcattagaaaaaagggtttaaaactctattaagaactaaatatatcaataacatttacagtataattttaaaatttagaatgacaaaagaaacattatagaattttaagaaatgatttgggaatagacaaatcaataaacctcagactattatgagatttgtttttgtctggaaggaaattgcttaatcaggtaataaactcaacaaagcaccttctaaacaaggagtcatccacgaccgtccgatcagattagtacatagaaacccttaagatccaacggttaaagatttaagacagaaggacgaaatctgtaatcatgagtttagtaaaaaactaataaatcaatcagtcttctccctatttactgcaactctgcgaaagctgcaaaaataaaatcagccgattcctatttttttatttgtcttcctgtgaagaatgaaaaagaagaagagtacaacaagtactaagaagacgaagaaggtttcaacaatagcttattcgcagcttttccaattctggtaaaaaggcttcattaccattttatcgtctactcttcttcttcttcctgttttcgatcttctgtctttttcggtaatttccgaatttgtgtttcaagaccgtatcatcttatgctacgattgaatttgttggaattccagttttgggttcttcaccaagctcagaatttcaaactgtcagaattgtttgaaagagtcaaacttgaactgggattttttttgacttagggttcgtcagatgttggatttgttaatccttgcagagtcgtttaaggggtttacaaaatgctttatttataatcctaaaagctatctactttctgatttttttcccccagttcttggtttgaattctaaagctgtttcctgtgctataacaggtgagtgtttcgcactacattgctcttgctctactggagattgcggttgtgtgttacgagagctagagttgaatttgctttggtcaacacaatggggacttgtggttgctgacttttgtgattttcagttttctacttggatttag

SEQ ID NO: 10720 - DNA, 3000 bp, Unknown
  misc_feature (1)..( 3000): cDNA_ID_2032973_gDNA_ID_2213670_Annot_ID_132762 3000 nt of promoter + ATG
aaaatatggagtttggaatttataataataaaggaaataatcgattccatttggttggattacacagttaagtttttgtgtttcttttgttatatgtatatgagtaaatcaaaaagacaattgattgaagtgtaaacatatttcgttatgacccccccaaaaaaaaaaaaaacaaacaaacaaaacaattttcgatatagtttttggttctggattaggtttatttgatcataattacatgcatcatttctttgattactatgaagattttcttaccaattaaaatttcgaattcatatctcttgattattaaattaaatacgagtgtgaatatccgtttatcgatcactccaatcatgattatgattcttgtgctaatccagcaaattattaacaagagtattgagaaaaaaacgaaaataagaaaagggaaagagtagtgacccatggagtatgtgaataattatcaaagagaataagagatgacaaccaaaaggttgtggaataatggtccctgccagctttctctcacaatcaatatcgaccctatttggattttctggatattcgttaaaatttgcgataacgattgtgaaaaatattttatttgttagctgatctcaatattatgttccaggtatttgcataatcttctgtttaaagcatattttgtctttctttttgtttcgtttctcttaactatatattatcgcggatatatgataacaatgatatatcacaaaacaattgtctgggaccattttgaataaactttttctcaaacattacgggacactggactcgaaccttaaatacgattttacagcgtcactagttgagattactagcataaagcataaaggacccgttcaagctatttatacaaagttacaaactgaatatagcttgaaatcctttagaaaattttggaattaccggttgttatgtaaatatagatttagtggtaaacaaatatgttaatcaattagtggtcaacatatacataattccttacagaaaaaacaaacttaagagaagttaacatatccatatatgggtatgctatacctttcacgtatgctatactagagactaaagaatagttatgtgatgtcgataaatgaaattcacacgcgtggtaataattatgggaccgtatgttacgatcactgcaaatatcattcttggttggtcaacaataaaaacaaaaacaagaaaaaaagaaaacgatttttcttggattccattcaatgatctaaaatgcatagatcttttgggttacagtttcgaagtcctctacaagcgtgtaaccatctgcaactattaaattgctttctttaatgcatctttaacatatttattgttagttggaatttaataagagcgaacttgtaacattacaatatttatattagatactagtatgtgattattccaaatacatactttggatgtttaaacttaatcttgtttcttcctacgtataaatattaatcatcgaggtaaaaaaagttttgtcttattttcgcgatgcatgaaggataaacctaatgactttaattttttgaaaatgtaacccttttactcatagattaattaccgtatgtttttgttgccataatgacagcctctacaactgtgatagtcaattttttctgcaaatattaaattaggaattcaatgctactatcaatagaagaaacagctgagtattacattttaatttaaagacaaaatttttgaaaaatgttataatttctaacaatattattaaaatatgatgcctataatgtatttcctatgttcttaaaatatttttttttatatttagttataaatacattatgaaccaataatagttggtgaattcaaatatctccattaatattttttgaaatctacaaattattaatatttagtcaataacaatgcatagaaagttccaaaaaaaattttgttaacagaaacttccaaattttttttttttatggaacaagaaataacagatagaaaactattttgttgtggaatggaagtagtaatatacattaagcaaattttaaaaaattatataagcctatacgcgctcaaagtatgttatctagtaggtgtaattaataatgcatggtgcgattcagaattgggacaacaatgaaaacggaattaaaatattaactttaaaataaataaaaatttgagtaaatgtgttttctgactattgaggggcaaaaaaaagacaatgccaaaagtctacgggtttgactgtccagttcggtaataatctaataactctgtctttgaccgcacgctcgtgtaggggtccttctgacattttcactgttctacccctactcgtgagcccacccttttcccatatcctaagggtaattttggaaatcccaatttaaaccgattgagaccgtaccggacttcctgggattctgctggagcatttatcaaaaattattagcacgaatgggtttattaatttaaaaactcacaacttgatcagataaaatttcataaacacttttacgatggattcgtacgatctatctaatgacttttttttttctaccacggtggatgaaagttatagtactattagccagagacaattgattatagatatatccattaatccatgatatttatgatataaatagctgttaaactatttcagcatcgcagctttctgcaacttttgtttttaatttaagagtttaataaataaaagtattaaaaggagcataacgaggcaacaaaagtaatgaacacggagaaacaaaagccatgaagctcattggttaggtttaagcttaataagaagattttattaaattttaatgacgatgataacaattatattttctgacttctttaaaaccccctcttacaaacagaagctccctttttcagtagaagtccgattcccaatcttaaagacaaagccattagaaagagaaagtgagtgagagagagagagaaactagctccatg

SEQ ID NO: 10721 - DNA, 3000 bp, Unknown
  misc_feature (1)..( 3000): cDNA_ID_2724793_gDNA_ID_2213670_Annot_ID_132763 3000 nt of promoter + ATG
attaagtataaaacacacacacacacacaatgatacattctgacagcaaattctcctagttccttgccttagcgatagatgtggttacatgataacacacaaggcaacagttaaggctaaacaacttttgaaaaggtaggagaaaatcaaattgaaggatcaaaacagacaaattttggatatcaatgtaaaatgaaatctctagatattgttgacacaactgttttcttttggcaagaaaaacgagtatgatacaaatcgaccaaacacaactgttttcttgcagcctatgcacaaagcatcgctaacaaatgtattgatgactgcgccgtggccctctccgaaggaccctacagcgagaatatagccatcgcggataatccagattcggggatgagcggtcctgtcgcgactaagtattggattgacgatgggccatggtacatttatgacacgaagaagattgatatcatttttaagaattcatgtagacttcttcacaacgaaaatactaccatccatatttagatctctttatgtctatgtgatagattttgatagaggcgtgtagaataaggtattgaactgacttgattttattgattcacaaactatggtatttatatacaatgatctctatcaagagataaacataaatccctaaaatataggttagaaactctatcatcaaagatattgtactaatcctaatcggataacatatatccccaatactcccccgcacgacaaacgtggtacgcaaaacacaaactttgcaatcacaaagcggaacacgtatgtcgtggacaatatgtcgaggacggacaaatcatgtaaataaacatcttagggtataaacttcattcttggggtggaacttcatcatgtcttcggtcttggtaaaagggaatacatcccgtgtacgcaaattatgctgctccacaaacaatcatctttatcttggacggtctataactcgggactaaacatgacctaaaaacatgaatgttccacaaactctactaatggctaaaccataaccaaactcccccgtaacggtaaaactattaccaaactctcttactaagaacacaaaaactctgaaaatttcttaactcaagaataattccagtaacataaaaagaaaaagaaaaaccaaaaccaatcctactaaaaacatagaaaaccaacgacttaaagttttggaaaaataatacccatgtgattaagaaacaatcacgtaacctccatcccttaacatgccgacatcttcgtcgttttcatttccaccgtcggaggcaccgtcttctccttcagtgatcaccatcttcataatcttttcttgattacaaaatctataatgcggaagctttaattatgatccacaaagatcgactgctctgataccatgtagaataaggtattgaactgacttgattttattgattcacaaactatggtatttatatacaatgatctctatcaagagataaacataaatccctaaaatataggttagaaactctatcatcaaagatattgtactaatcctaatcggataacatatatccccaataaggcgcctaagttcaggtgcgacaaggctccaacaatttctactacgatggccaaacgcagttaccaaggggagtcatcagtcccattatatgaatacataaatctgaatgataaaattgcatacctatgaatctatgataattggcaacgtcttcttcttgtggaacacgcaatggtaccctccccgagtgttaacacacatgctaccttcgcaacaatatttgtgacgtccattattgttgagtattctacactcgtccatatctgtagatgaaaaaccacataattataataagcaagcattttccacaatacaagaaaacagaacgagtcagtttctcactttgcatccacctaaaagatcttatgggttacattgtaaccactggaacatgcacaaactgaatatccaatctcgtactcataatccgtcaggttatatatggcacttgcaacggtgatgtgagcacccgacagatgagagattcacagtttgaattgaccattgtaggtggactatcgtacgtttcatcgcataaatccatcgagtatcactaatttttgaggaagggtatatgtcaaactcgtctgttaaaattgccactttgcaccctcgcctattgttgtgtttctactatccccttgtatactaagagaccagttacatgcccgatcacataaggttctttctttctgcagcatctatagccattgcaacctttttttatccattctcgcttctggtgctgtagtgcacaaatggagacgcaaccaactattcttggctcattttttctcaaaaggctttgatgttgcaaccaacaacaattacgctgttagcgcacgagaccaatggtaaaaggtgtgcccgtcaagttcaatagatctccaacctcggttccatcatacttaacaaaatcattggatggagagccacatcctatggaagtgaatcagtgatggtcatttggaaatgcttaatttttcttattatggttactttaaaatatttaaaaatttagagcctgttattgtaaaaataaataaaattggaatctattttaattatgttttttgttaatggattttagaaaaatatgggagccaaagatcaacgaatgcctacaaaaccaataatttgacatgttaacaaaaaattgtaaaatccaaaaaaaaaggtaattgaagctgataaccctcttgttcagcgagtgggttaaagtgtgaccgagatatacgagcacggcatcgttttacgtatcgtgatctgttggatctcaactcggttttcttaataatcagaatccggttagagattgaatttgggttttgttagttttgcttcttctctctgcaaaaatcctccatccgcttcctcacgaaaaaccctagcacagctccgagatcccttttgtcgccatg

SEQ ID NO: 10722 - DNA, 3000 bp, Unknown
  misc_feature (1)..( 3000): cDNA_ID_2715784_gDNA_ID_2213670_Annot_ID_132764 3000 nt of promoter + ATG
ccactaatgtttttgtagatttgataattcatctttgacaaaaaaaaaaaaaaggccgataatggcgtttttggtaaatatgtcaaacaaaggggtccactattagttgcacacaacagagacgtgtcgaaattgtccagatccaaatcctccttacgtccttctacacaaccaaaacaaaacaattcaatcaacaccttccattacgccacgtcatcgatcctaaacactttaatccaacggtttatcaacacgttaaataattcacacaaaattctccaaaacaacccacccgtccccactttttaacccgacccgaaccgaatttccccaatcaattaagagcccaacaaagaacaaaacaatgttaggttttcgtcttcctcacgaggttttagtggcgactggtggtgaccgtacaaattaggtttttccggtagagaaatttttcaaaagagagagtttttgattctgggttcttcaaatcatctcttacccttcatcgatattcatcaatttcttctgttttaaccctctttttcccctttcttcgctctgttgtgataccttcttctcagcgagtttcgaagctgttctctgttttcagagagaaggtgtgttgtgagctttaaggtgggtttggttttgatggatgagatttgggaaagagctgtagaagcggctctagatggtcaaacagataggttagctacacgaacgctaacacttgatggtgctgtgaaatgcgttcagggacgtttaccaccacctagtgttctcgagaagtttcagaatcttcagcatctttctgtagctaacatcggtgtttcttctctggaacagtttcctagacttggtaatttacagaagctaatcttatctgataatcggatcactgttggtttagagtttcttgttgaagctgggcttgattcgttctgtgatttggatttatctaataaccggatccagtttgttgaggatctagctcctttggcggagttgaagcttgtgtctcttgatctgtatgagtgtcctgtgactaggcttaaggattatcgatctagggtttttgggttgattaaaactttgaagtatttagataagactgatgctgaagggaatgagaggcctgagtctgatgatgaagatgatgaggaagatgaagaggatgaagaagaagaagaggaaggtgatgaggaggatcctggaagtggggagattgatggagatgaaagagcagaggctcctcggatgagtaatggccatagtgaaagggtagatggtgttgttgatgttgatgaggatgaagagagtgatgctgaggatgatgagtcagagcaggctactggagtgaacgggacgagttatcgggctaatggattccgtcttgaagctgttaatggggaagaagtaagggaagatgatggggatgatagtgagtctggtgaggaggaagtaggggaagataatgatgtggttgaggttcatgagattgaagatagtgagaatgaggaagatggggttgatgatgaagaagatgatgaagaggatgaggaggaagaggaagttgataatgctgatcgtggtcttggtgggtcagggagcacaagcaggttgatgaacgcaggagagattgatgggcatgaacaaggagatgacgatgaagatggtgatggcgagactggggaagatgaccaaggggttgaggatgatggagagtttgcggatgaagatgatgatgttgaagaggaggtgacactttgtacttcaaacattatgttttgagatatgaatgttgtgcttgggtttcactaattttcttgtttttttcactggtttgtagttgcggcagataggtggtgatagacttactacttcattttgataaatttttgtgcctaagttcactgtcttgctgctattcagagatcgatattagaactttggtgattgatggaggacatataagaggggactttagtatcgtctctaattttgctaccggtttagaatactagtctggtcttgcattgttttgtttgctgcataaaatatcaggttagatttacgaagtaccctgtcgtgttaaccataaggtatcatgttagacaaccaaagccaaacttgactctctttttttttttttgtgatggaatgcttccatgcgtgaagttatgatttgtcaaattgttgctttgtgtttagtgctaacctagtatttgatgaatttgataggatgaagaatctggtgaagggtaccttgttcagccagtttctcaagtggaagatcatgatgctgtgggtaatgacatcgagccgatcaatgaggacaatgatccagatgaagaagaagaagtcgaagatgacctgccaattcctgaccagtccttggcttcatcatctcgcccaaagagaaaacgagatgacgatgatgacggtgaggatgatgacgatgatgatgaggaacgttgaacatacagatcagaatctctagtttgatgagttttagatggaaaagaagctcggctccttcttgattcaggcggctatatctgaatgttcaaatgtcagttatggtcaggctggtagattttcaaatgacggttactcagcttggatttaccgcccttttagaaaccccactttatggagggaaagaaaaacacaaaaaaacacaaaggaagagtttcgagaccttgtttctctgttagagggtcttgtaagaatgcttatgtggataaatcttttgagttatatcgtcttttgttttacatccattacacttacacatgtcgtatcattattggtcaggatggttttgctaggattgtcgtagtgtgtgtgatgcactaagatcaaacggtcgtcaaggctctccttaaaagcttatgccgagaggttttttgctattttgtgtggtaattaactggtgagagagttcaacatccaatctttctctctctctctctatcttttatctctcacactcttaaaatg

SEQ ID NO: 10723 - DNA, 3000 bp, Unknown; identical to SEQ ID NO: 3312
  misc_feature (1)..( 3000): cDNA_ID_1820368_gDNA_ID_2213670_Annot_ID_182278 3000 nt of promoter + ATG

SEQ ID NO: 10724 - DNA, 3000 bp, Unknown
  misc_feature (1)..( 3000): cDNA_ID_2704702_gDNA_ID_2213670_Annot_ID_182273 3000 nt of promoter + ATG
atcattgtaacttatgtatacatctacatttgtatattaaaagagaaaaataaataattaaaagaaacaagaaaaaaaagaggaatcaagaaagagttttacgtagtcaacattagaaatttatatctacatgtgttcgaaacttggcaattgataattgagattctaggtaaacgttgccagtagaatgattttaactctcttggcatatataaattattgcacttgtattgtttttaagaaacaatatagccgtttttgtcagtaagaaaccatataaaaatgttaagtctcatggctgcttaaaatgtttcgaaacttttaaagttattaatagtcaactgcaagcagtagatggttggaattggatctactagtccatgataaataaataaataaagtaattccggttttcaaattggtttggaatagaaagttaattaatcaatataaaatccccaaaccttgaaaatcaacctcgttgacccatctttatttcacccgtcgatggtaatttgtcgcgtatcggttatagacaacaattactaatattcttccaccatatgcaatgtcaacaaagttactatgaatgattgatttagcgttagttttttttaaatcgtcgtcgtattcatcggtttggcatagacactatatgattctcgaaccaatgaactcgttatgtaatgtatatttgtctcgattatgattatctaatttttgttcaaatcaacaaagtactagtctattgttagaagcgttagttacgttagttgatatcatagccatgttaagctagtatcatcctcgacaaaagtaatattatcatcgatgttcccgttacattagactcttaatacatgttaattatgaatatccatatattaatatgattgtatgcttcaagaaaataaaaagatcatgatttgataattgatactacacttaaagtaattatagttttttttatttttttttattttcacatttccaaacatatgtgatcgaatacgaatggcgatgtttaagatgctaaatcaacaagatccttacacaaaatcgaagcaatttttgaggagtatgtaaacagtgaccgacttgaataccttcagtgccacgtttttcctcacttggacaaacttgttcttcatttttatttgtttggaccaagataactcgttattcattacgagggctttccacggaagaaaatgcactacctacaaaagaaatggaataatataaacttgaatgggccctgcttgggatatcaagacttcggcccagcaatgtccgtgcatgcaaatattttgttaatcactttttaaagtagcatttggattatcgcttagtatatttgcattcccatctattactaatactacaatactaggagcaaaagttattagttctttaatttgattgctagatagtgctggaaactttatttcaggaaatggaatttctaggctggctaaatagtgttctggattcttgagggaccctgttacgcctaaaaataatgttgtttttttgaaggtcatcaaaataaacattttataagacagtaaaaaaagaaataagacaattatatttatgtagtcaaacgcttgtttttgctggatatataattacataaaagttgcatttatcctttaatcaattgccaaaaagcaagaaataatatcaatccaatcttataaacaactatattatgaaaaagatgataattattgtacgcaagatgttatacgacacacgtaatttgtagatacacaaaaaggtcaaggtcaacaaataacacgatcaattgcattaaatgtgtactagcatggttatcagaaatttttattgataccatggaatcgatagacgacaaaaccaaccgtaatttcaaaatttccgtaattgtttctcttctcttttcttgttttatcgacgattatggaaattttttttttttaacggagatgtttggtccgacaacgtgacggtaaatcctccactgtcttcgcttaaagacaaacgacaattaatctttttaactcctcgtttcacttgcaaagttatttcatcattttagtagtttactctcattctactaaatttgtatttttattgtaacataacggtcatatcagtatttggttagttgattatgtgacatgactatggataataagacttgatatgaattcccatatataagaaatcgtcgatgacataaaactactttatctactaacttcataaggcaaaaatgagtagataattagattattagaaagagagagacaatgagattgatattttttatatgggagtccaaaatcaagatagatatacttgaaaacactcgaaccccacaaggatcgacaaaatatttctttttaaatagctcaaaaaaattatttaaaaaaattcaaaatctttttaaaatatccaaaatgttgaaaagttgtaaatcgataaaagagaaaaataataataattgtgccaatagagagaaagagagagacagaagaagaaagaaaggttcctttgtctcggaacaaccaaagagccaccacccaaaaaaaaaaaggttcttagctttttttctttctttcacacgaaatctcacgagacgccttatttcttcttctctgtctctttccgacggcgtaactctccggtggaatctcagctctcttatcagtagaagaagttttggtctttaaatgtaatttttttggttttgctttaaatttcaatcgttgttatcagaaaaagtaggtagcaaaaaaagagattttttacgaaaagcagattgactggtagctgaaacaacggaggagaattatagaaacgagtaaaaaacaaaaccctaaaggttgaaacttggttgacgaaaaaaatgagctgatttttttttcttcatttatttcattcttaactctttttcacatatttaagaatcagtaagaaacaaaaaaaaacagagtgagactaaaaaaaaag

SEQ ID NO: 10725 - DNA, 3000 bp, Unknown
  misc_feature (1)..( 3000): cDNA_ID_2715781_gDNA_ID_2213670_Annot_ID_182272 3000 nt of promoter + ATG
aaccaaatactgatatgaccgttatgttacaataaaaatacaaatttagtagaatgagagtaaactactaaaatgatgaaataactttgcaagtgaaacgaggagttaaaaagattaattgtcgtttgtctttaagcgaagacagtggaggatttaccgtcacgttgtcggaccaaacatctccgttaaaaaaaaaaaatttccataatcgtcgataaaacaagaaaagagaagagaaacaattacggaaattttgaaattacggttggttttgtcgtctatcgattccatggtatcaataaaaatttctgataaccatgctagtacacatttaatgcaattgatcgtgttatttgttgaccttgacctttttgtgtatctacaaattacgtgtgtcgtataacatcttgcgtacaataattatcatctttttcataatatagttgtttataagattggattgatattatttcttgctttttggcaattgattaaaggataaatgcaacttttatgtaattatatatccagcaaaaacaagcgtttgactacataaatataattgtcttatttctttttttactgtcttataaaatgtttattttgatgaccttcaaaaaaacaacattatttttaggcgtaacagggtccctcaagaatccagaacactatttagccagcctagaaattccatttcctgaaataaagtttccagcactatctagcaatcaaattaaagaactaataacttttgctcctagtattgtagtattagtaatagatgggaatgcaaatatactaagcgataatccaaatgctactttaaaaagtgattaacaaaatatttgcatgcacggacattgctgggccgaagtcttgatatcccaagcagggcccattcaagtttatattattccatttcttttgtaggtagtgcattttcttccgtggaaagccctcgtaatgaataacgagttatcttggtccaaacaaataaaaatgaagaacaagtttgtccaagtgaggaaaaacgtggcactgaaggtattcaagtcggtcactgtttacatactcctcaaaaattgcttcgattttgtgtaaggatcttgttgatttagcatcttaaacatcgccattcgtattcgatcacatatgtttggaaatgtgaaaataaaaaaaaataaaaaaaactataattactttaagtgtagtatcaattatcaaatcatgatctttttattttcttgaagcatacaatcatattaatatatggatattcataattaacatgtattaagagtctaatgtaacgggaacatcgatgataatattacttttgtcgaggatgatactagcttaacatggctatgatatcaactaacgtaactaacgcttctaacaatagactagtactttgttgatttgaacaaaaattagataatcataatcgagacaaatatacattacataacgagttcattggttcgagaatcatatagtgtctatgccaaaccgatgaatacgacgacgatttaaaaaaaactaacgctaaatcaatcattcatagtaactttgttgacattgcatatggtggaagaatattagtaattgttgtctataaccgatacgcgacaaattaccatcgacgggtgaaataaagatgggtcaacgaggttgattttcaaggtttggggattttatattgattaattaactttctattccaaaccaatttgaaaaccggaattactttatttatttatttatcatggactagtagatccaattccaaccatctactgcttgcagttgactattaataactttaaaagtttcgaaacattttaagcagccatgagacttaacatttttatatggtttcttactgacaaaaacggctatattgtttcttaaaaacaatacaagtgcaataatttatatatgccaagagagttaaaatcattctactggcaacgtttacctagaatctcaattatcaattgccaagtttcgaacacatgtagatataaatttctaatgttgactacgtaaaactctttcttgattcctcttttttttcttgtttcttttaattatttatttttctcttttaatatacaaatgtagatgtatacataagttacaatgattctctatattcgatcgacaaaaactatttcgagtcaaatttcccaatagagctttaaatcacatattgactcaaatggtttaacacgttaaaatgatctagacttgtaacaaaaaaaaagagcttagtgaaccatgttgaattactttttaccaaacatacaatttgggagaattatatgtgtttcaatttctaatgatccactaatgtttttgtagatttgataattcatctttgacaaaaaaaaaaaaaaggccgataatggcgtttttggtaaatatgtcaaacaaaggggtccactattagttgcacacaacagagacgtgtcgaaattgtccagatccaaatcctccttacgtccttctacacaaccaaaacaaaacaattcaatcaacaccttccattacgccacgtcatcgatcctaaacactttaatccaacggtttatcaacacgttaaataattcacacaaaattctccaaaacaacccacccgtccccactttttaacccgacccgaaccgaatttccccaatcaattaagagcccaacaaagaacaaaacaatgttaggttttcgtcttcctcacgaggttttagtggcgactggtggtgaccgtacaaattaggtttttccggtagagaaatttttcaaaagagagagtttttgattctgggttcttcaaatcatctcttacccttcatcgatattcatcaatttcttctgttttaaccctctttttcccctttcttcgctctgttgtgataccttcttctcagcgagtttcgaagctgttctctgttttcagagagaaggtgtgttgtgagctttaaggtgggtttggttttgatg

SEQ ID NO: 10726 - DNA, 3000 bp, Unknown; identical to SEQ ID NO: 10721
  misc_feature (1)..( 3000): cDNA_ID_3037097_gDNA_ID_2213670_Annot_ID_182269 3000 nt of promoter + ATG

SEQ ID NO: 10727 - DNA, 3000 bp, Unknown; identical to SEQ ID NO: 10720
  misc_feature (1)..( 3000): cDNA_ID_2032973_gDNA_ID_2213670_Annot_ID_182267 3000 nt of promoter + ATG

SEQ ID NO: 10728 - DNA, 3000 bp, Unknown; identical to SEQ ID NO: 10725
  misc_feature (1)..( 3000): cDNA_ID_2715781_gDNA_ID_2213670_Annot_ID_132765 3000 nt of promoter + ATG

SEQ ID NO: 10729 - DNA, 3000 bp, Unknown; identical to SEQ ID NO: 10724
  misc_feature (1)..( 3000): cDNA_ID_2704702_gDNA_ID_2213670_Annot_ID_132766 3000 nt of promoter + ATG

SEQ ID NO: 10730 - DNA, 3000 bp, Unknown; identical to SEQ ID NO: 3312
  misc_feature (1)..( 3000): cDNA_ID_1820368_gDNA_ID_2213670_Annot_ID_132771 3000 nt of promoter + ATG

SEQ ID NO: 10731 - DNA, 3000 bp, Unknown
  misc_feature (1)..( 3000): cDNA_ID_2716544_gDNA_ID_2213671_Annot_ID_132776 3000 nt of promoter + ATG
gattccagatttcgagttagtgtcgttaatggtataatattgtatttccttatgtagtgtacccactaatccaaattctaaaatcgttataaattaggatgcaagtctcttctacctccataattacactatactagaatttaacccgcggtacactgcagagctattattttttaaaaaatgtaaaattattttttaaaagattaattgaagatatatcatattaatttgtattttaaaatatagatatctatctctgtattatttagtatatgattactattattttggtttcaaattttgaagtatagatatgaaaacatatatttttttaagtaacaatgtatggtagattttaaaattttgaatattttatccgcagtataccgcatgtcgattttttatagctattttttaaaattttaagttatatttgttttgttaatattgtatgtttttgtgtttaaggttgtatgattgtattttgattgttaattttatgatttcatctgtgatatacctttgtttattaatattgatcaaaacccgtcatcccatataaatctgtctatattatctcgttagctaaatgattagtgttataaaatccaagaaaataaattattattgttctaattccaataatttaggatctcacccgtggtataccgttccttgaatgatttaaaatttatattactaatatagattttaaatttatcatataaagtatatgatttcaagttttgtgcttttaatttaaataaaagaacggtttaaatgatgataaatatagtttttttttcttgtatgtgtatatggttttttatgtgaatatttaattattataaattagtatttttattgctatgcaaaatgttgatataaatatttgctataaatcggatttatgcatattttttgaagtaaaattcacgatttttttttttaaaaagatatatgaaaagattgtgtagagatttttagaaacaaattaggcaagatatagtttggttaatatctttttaattttttttaactaaataattaatgtcagtgacaagcattgtaaataaatcccaactccaaaatttatttcatgtaaataaatggctgtaaaaatgtatatgttgatctttagggaatatcacgtaattctcgccaaaacatttaatgagatttggagacaataattaataatatccgcacgaattattgattttagttattatgagtcttttctttgagacccaatgttcaattataagcccttacactataggcccataaggcccattagtgtttactagactattcagggtttagcgaaaaattcttcgtttcaagtctcgaactttgttggaatcggctaagtgataatttcgaagcttgatcggtaaatccaggagcttttggatcggaatctgttcgctgatgctttggtgaaaatgggtttcggtgcaattagatcgattttgcgtccattgtcgagaaccttagtttcgcgtgccgtcgttaactactcgtctgcgccgttcaatgcgacgattccggctgctaaacccgagttatgttccttcttcggtggatcgatgactcatttgaggttaccatggattccaatggctaaccattttcatagcttaagcttgactgatactcggctcccgaagagacgacccatgactcatcccaagaggaaaagatccaaattgaaacctccaggttcgctattttgtgtttgatggttgattttgagcttcatttttagtctggggttgtaaaaattgatgctttgtttgtgaaattagagatgaatgttgtgtgattcagaatggagttagtgtaatcttcttaggcgggtgttgtttatgctgttttcaaattagcatttggtgggtatagtattgatcttgtgtaatcttaagtggaaagtgattgttttgaatctcaattttgggtgttgttactgagaagttgatatagccagagataatctacggtgggattgtttagatgaattaaaagatttgaggataatgcagggccttatgcatacgttcaatatacacctggccagccaatttcttcaaacaatcctaatgagggaagtgtgaagagaagaaatgcgaagaagcgcatagggcagcgtcgtgcttttatactggtttgtctgatttctttctagcttgttttaagaactttgatagctttttgatctttgcatagctctacattgttagatgagaaatgttggaatgttgaatcaatagattgtacaaatgagaaataagtttgaaagctgagaaatcataagtaacctatgggatgataaaaggctgtatctctcttagcttctccgttctgtttccatttacaaaacaatctgcaatgttcttttttagtttactaataagatggagttctcgtgtatatatttttttcgcagtctgagaagaagaagaggcaagcgctggtgcaagaggcgaagaggaagaagagaattaagcaagtggaacgtaagatggctgctgtcgctagggaccgagcatgggctgaaagactgattgagcttcaacagctggaagaagagaagaagaaatcaatgtcttcttgagatcaaacatagaaataatcctaaatgacaatctcttttcttgtcttgagttagagaattactcttctttgttgtgtttggcatgttctcttgagagttaactcgctatgttgtctgaagaactgagagttacttgacgtttgtgttctttatatccagtcatgtgtttcttgtttcatgaatttggctgacattcttttacttacggcaacccatgaaactgaatcaggaccagttaccgccacgtgtaatctaactagaggcctgatttcatattccgccacgtcatgtgtgcatccatttctcaactcttgtgataaagtcttcaccttggtcgctgattttcctcctctctctcacaactatcaccaacaagaatcatg

SEQ ID NO: 10732 - DNA, 3000 bp, Unknown
  misc_feature (1)..( 3000): cDNA_ID_2716532_gDNA_ID_2213671_Annot_ID_132781 3000 nt of promoter + ATG
ttatagaccggaaccataacaaaggggaacaagttataacatgtcaagagtaatagaacaattaatccaacatcttaagagatatataagagtggaaagcttaagccaagtgtttggcaatggtagactgaagctcatctttcttggctccaacaactttgtccaaaatcttcccttccttcaaaaacatgaaggttggcatcgcctgtatcgcccaatcacttgccaccgactgttccaacaaaaccataaaagagattgtgatcgaagaaaacaatatctctcaagaagaagggaaaaatgttggtgaatgtaccttcaattcatcagtatcaaccttgaggaaaagcacgttaggaagtttcttagccaaatcagcaaagaatggagcgatgaaacgacatggtccacaccaagaagccgtgaaatcaaccaccaccttcaacaatataaccaatcatgaatcattttcattgaaaaaccatttacactaaaaacatatcatatcgtaagaattgtgaacattacatctatcttcagcgtaaacatttttctagggatcccttagtttcatagaattatcaacatgactcgtaatataagtcattatgatctcctaccaatcctaggatctaatctatggtaatgcagatccaagaattgtcataaaattcaaacatgaattcatacaaaaaagaatcatatcattacattgcttaagtatgagagatcaaagactctatttaaaaacgcaacccaaaacaaaccaaatcaagaataataacaaatccatatctcatcaaaaacaaaatgaaatcaagaaatttgggagaagaagattacaagagttttggattcattagccttctgaagctgctcgttccatgtctcaacggtgtggcaggcgatcacttgtccttcttccgaagccatcttctctctttttcttctctgttctgtttcttctcctcttgtgttttttttttttcaattacttagcatgcgcgtcacctaccaatcccaattttgcccgtcaatagtttttctcttctactttattcgacgcgtgattttgtttcccataattacacccaccaattgctactttccttctttacccaaatcataaatattcacacttttactcctcaaagttttacttgtaacaaattaaccacacacaaagcaaagttgtaaatatccatcgtaaaaagtaaaaaacattttgtagacatcatttgtacattatgattcaaatctacagctgaatcagtttcttgaaacaatacgttccaatgatgaaccacccggtaagcaaaaccactagaatcgagcaggaggcaatgaaagtccaaccaccgagtaagattcctatagtgtagactatgagtggaggcaacaaggactttactatagccgttttgttcacccaacgtcccttgaaaagcactagtgtcgcgagattcaccacgttccatccgcctgactttatagatagacggttcaggttgttggctacaaaggaatgacagttgcatgtgagtatgttatatgagtgatgttggtactcttgcgtgctttttctcagtgcatcatcccatgttggctctttctcatgactatcttcttcttgctcatatctcctctcaccattgaacataccagaactggaagaacgagatgactcctgattcaaatccaaggccaatatgaataaattgttactttgtatcaaggttgaaaatgaaagccggcatcttgcaaacgttaccatttctttgttgatttgaatatatcgagaaacagctccaaatgcaaaattatcaacacagacaaaattaggtcctgcaaagtcgaggatgacaccgtcttctctgcagataccgacgtggccgatgaagggaaccagccatgaaatgaagggaagaggtgtccaaacaatgcagcatggaaaccggtctcttttgggatcaattttcataggatccgataatccgatcatcatgcgatgttctgaatctgttgctgtctctcccatatccaaatccagttgagctcaattatttgattctctgtaagcaaaaaacaacacgtccagtgatccccatgtaagtaagattcaataaagcacttggatttgatatgtaaaagttgttcttaatactcgaatagctgatgcatatcatttacatcgaacccaaaacataaatgcatatcatcccatcatggaagtccgagttgggactgagccttccagaagcgataagcagctccttctagccctgtgctgctttggatttttgcatataccaagctactaccaattcattgattactggataaacttgaaacaagagtcgtctaattgatattcaatcaacacattgtgctaaaacactacgaccactacatagaaaagctaagtaaacaattctcgtagttctacgaatcgcgagtcttaaacactaaacgatgaatccatacgaacatggcgaacgagggatccagaaaacgccattaaagatacataatccaactagcaacgagtcaacatcaaagcatcttcatagacattgattccgaaactttttcataaagaatagatcaaagcatacataccagttcaagcgaccaggaagacgattaatcggatctaatacaatcttcaatcactgcctttttcctgggaaatttttgtttctctctcggccccaattttacgaacgatgacactaaagaacgtgtttggctccttgtttaaactaatcctctctcggatatcttcaccgtttcaaggatagtagtataaacgacataacgttcggtcaaagagaacaaaaacgtcaggatgttattctattaaacgtctgatatatctatacggcgtagttttgaagttgtcgactattcttcatcgttctctctgctctggtaaggagattgctgctacctactgatgcaaatctgccattgatacatctgcttgcggttagggcaaag

SEQ ID NO: 10733 - DNA, 3000 bp, Unknown
  misc_feature (1)..( 3000): cDNA_ID_2716528_gDNA_ID_2213671_Annot_ID_132782 3000 nt of promoter + ATG
cctctctttttctcctccacgtcaactctgattcccaccttcctctatttatttaattataaattagtcttccttatttcttcttaattagtattctcttatttttattactcctgaattctaaattatattctgaattcctgctatgtcattttcttttattttgggtcgaatatctatctctcattggcaatggttttgagatcattggcctattggcaatggtttagaattccttagaattattgtaacaatgatttcagaattgaaaaaagctgtttactaactccatgcattttgaatttatttgagggaagaaaagctttcgttggattttggagtattgattgacagaaagcgcctagagaattgagtgataagcaattttgttttatataaacacttgcccccaaaataaaaatattttttctttaataataaaaataataaataacgacttagaaaaaaagaagagaatgttatggacaaaaaaagagactgtggttagactgaaaaacgcgtgcagagaggccgcgacagtcttatcatcaattaaatttcttcttaattagggtatcctaacttgcattttactctcagttacgttctacacagtattacttaattattcatattatacacgtataggtttttaatgcatacgtgcaacgttgacatgtagaacagattttgaaaagagaaattgtttagtataagtgttgtttcgataacatcctaagtttcgtcatagtccaaatctactccagattcataggcttctcagttccatccatctcttattcaaattccatacaaattaaaagtttttttttgtgaaactccgttataaattttgtgtgttggttgctggttggttctgcctgaaactattattccgaaatgatgcttatacttatttgacatttatatatttttgtaatgtagcaaataaagaatagactactggagaaaaaaggtcttttttttttttttgtcaaaagagaaaaaaggtcattgtctcgattgtaatgtatccatcacaaccccttgaattaattgattccctctattaatctagtatactcgaatattttgtggttttttacttacctctaaaactatatcgatatataatgaacaacctaactattgttttcaaattgagagcaataataatcattcgattattaacttaaattattggatttgtaaattaaatcaagaaccggtacggaagcgtagggcggcgaggcaatgcttttaccctgtctcaaactattcattattcccattttgaatcttaatacttttgaaatgtctcatttaaccccttctacattagtcaactctctctactcttttggcaaaatccttttaaacgtccccatcttttactttatttttatttcatgtcctaacttttttatttatatgacacccatacatacttctctagatttcggatttatcgggacatattttttcgtgccgttattctcaggcaattcaaaggataatacctaaaaaaatactcagctaattataatgattagttaaattaggatccatgatgctcacggcacgggcatagaggtgtgtttgtctgtatataaattctgtaaacatttagtagtactattatacaaaaagataatgcagtaacatagggcacctcaacaaaatcgtacgtttgtctctctacaagagagagtatgtttacgtgcatttttatttatatataaaatattactgtgatatactactagtatatacagaaatgtgtatatcataatgtttttcgtttcctcggaaacatggacaaaagcatctgcttttcagctacaaactttaaacacttaatttaagccacaggtgcacccaaattaatattttttaaaagaagattatgggctaatggatgattaatgcctataatttgcaaatcctccttactttaaagtaattagttagattatttaatccacatgtttatctatttgatgaggatttttgaaaccttgaagtaccttacattttttcaggcatttttagtttgctgatgctcctaactcgtagacaataatatatttgcagcatttgtcacaattagtctcatagtcactcatatatacacaaaatgaaataaaaatgaatggacctatggacttttgacaaggttttgtagtcagttctagatcatgattaggaggtctaattaataggtcccgaaatatatatagaactatcttaggataatcaaaaatagtattctgataccgtaatgatattatttttactcctttttaaggaaaattagttattcacattccaccatttatacatataaaaatttcatatatgtaagaaaaaaagaagaaagaaaaaaagcgggtttcccggaatgaaaaggaccaagagagaaaaatccattttatgctaacgtggcagcataataaccgcccgattatatatcaacgataagagatgaattgttttcattttgtaacaacaaaacatgagagaaacaaaattatatttttgcaaaatctggaaaaacaaaacaaagaaacaaacaaatgaagaagagatgagaggagacagagaattaaattagaggagcagaagagagagagagagagatatagagattaataaggtcatggcggcgttgcagagcgcaagaaagatgatttaaatctctcttcttcttcttccttcttacatatctctgtgtgtttcttaaatactctctctctcgtaccgacaaacaagttttgctttttcatcagagtctcaaaaagctattccaacttcaatacactacaaacccagagaatgaattcaacctaaaaaccctagaaatcctctaagatctagagtgagaaagttagagtgtatagaactacaaaacataggatctttggttttgggttttgttccattttcttgattggttagtgggtgagtggtggttatgggtggtggttgttgtcttggtga

SEQ ID NO: 10734 - DNA, 3000 bp, Unknown
  misc_feature (1)..( 3000): cDNA_ID_2705073_gDNA_ID_2213671_Annot_ID_132783 3000 nt of promoter + ATG
tatccaactccgatcaatacattcatggccggtacacaattctttcccaacccaagatcatgaggaaaatctgacataaaagcaacataactcttttgaattcttagaatagaattagggtttataaacgttaattgtcggatcatattatataaaagagtatgcagaagtggggaagtgaatctgtttatgcttcccctacttttagacactcaaagttgttgcaagttttaggggtttttaaatggaaattcaattcaaataataccattgtctttttatatggttttgtgaggatatagtgttgtgtatcatttaaatgttaggagcacaatatagctcttgttgtctgaatctttgtttcattaatgtgtctgtttcttgtttgtgaaacacgtaaccttagaatccggggaaaatgtttttcatctttatataacaccttttgtgtcttctttcttctattcaatataaagaagaattcattacatttgtaccatacattatagtacaatttcatatttttcaacccattttattttttatttttttcaaccatggtttccgttacgacagaatatggtctgcccatcccatgcatttaatggtttctaaagtgtattatttgttagttactagtaattgatgtatgccataattgacatgtgatagaatcagagaagatgactagaagagcgacatgtatagatgtgacatgagggtgcgttctacaatgtacgttaatcccaattagttacttctcccgccgttgcccacaccattagttctttcattactagtttactataatgatttagttaatttctactatcaggtttttgatttttctattctttcacattgactagaagtcttgaacaatactactaatctttctctattttaaaataagtcttttcatgatcttgagggaatgtttctgttttaaaaagggtttttaatgatttaaatgtaacgtttgtcaagaaatgatctcattgtctctttaaaattacttaaatagaaatttaatataaaatataatttaaaagttaacatcctttgtaagaatacaataggatattaaacttttcttatatgcatgatcagtgtcaaaaccatgtctaatttcaaatggacgcgatattatttttatttgtataactaaatcaatcataacttgtaaggtaacatggtcgaagaaaattaatgatcataaggagtttacctttcatgtaagcttacgtatatataaggcatccttgcatgagatgtatttttacaccctacacgatgatatacacacacatatatattaatagatagagattttgcagattctcatagtggatatatcatatatgtgaaacctatatatattacatactaagaaatatataaatatggaatgcaatgccatcaatttcagacgagtatgtttggctacagaaagctatttactcctccttcctctctttttcatcaatcatttcggttttgctcatttaaatacaaacaacccttaaaccaaaaaaaaaaaactaaatacaaacaaccccatcttcgtcttctcttctttcatactctcacatttaattttggtttagctttcttaaagtatgtaatatatcatacaaaaatatgtaatatatgatgtgaaagaggatatataagaaacaataatacaatgggaaaaacaaaactggatcccttatacaattgagatatattgcgtgacaacattacataatcggtaaatttggtacattcaaatagtgctgcggtccaatcggccgactcgttccgacttttactctctgccgtatcccacagcttgtcatatcccacaaaatttattcatttctaatctttatatgatgtttcttactagatccaccagtatagtgtcgtatcccttttgttgtgtgttctcatatagtttctatgtaaatttgatgtctcttatttggataatttaatattctgagaagaaagccaaaagagataaaatcataaaaatgctggctaaaatttccaagactaaaaatctaaaatttgtcattgtccgacatttataaatccaaagcttcaggttccactcaaagaaaataattatactatttggatgtcttttggaccttttggtgcattgatgacaataagcaaataatactatacacattttgcaaatttgcaggatgaatgttacaactggatatatagtagaccaataaagagaagacatgtgtgatgtttataccaatgattgacatttgagttatgtgagttttaattagggaaagaactgaaccaaacgtaggagaaactgatcttcatactaatgctcacactacacattttattagtatctcaaaagtaaaaagcaactttaaaataaaacatatagttttgtgaaagatgcaaaaattgagaaggtactaaactattattacttatattagtgaatcaaaactttttcttaatccatttggagttgtttagttcaaatgaacggaacatatgtaatccaatacaaacacaaatataaaaaaatacaagagaacaaacagagaattccagtcaaacatgtttttataaataataccataacaaccaaaaaatacactcaaattgaaatcaacatacttaatcaatcaaaattcaaattaaacagtcttcgaatacattataccaaaaaagcacaagcttgccatgtttaatatatccttgactaggcgttacaagttaacattggattacatggcactaatttttcatggacaacaaaatatgaaacacagagaccataactaaatttagagacacgaaattgaaagtcccatatccgactctataggatctttgatccagtcttgtctcttcacaacctctctttctcttctttttcttctatttttacttccttcaactcccattttactccttcatttttcttcttcttctttctccataactagtactatacgcaagaccgtaaag

SEQ ID NO: 10735 - DNA, 3000 bp, Unknown
  misc_feature (1)..( 3000): cDNA_ID_2184864_gDNA_ID_2213671_Annot_ID_132784 3000 nt of promoter + ATG
tagtgttaaaactgcaacaagtaaaagatagaaattttatgcagaatataatggttccttttttctactatggcagtctttgaaaaacattgcgtggggtaaacgtactcgggtcatattggatgttggatgtggagtggcgagctttggcggtttcctctttgaaagagatgttatagcaatgtctcttgcaccaaaagatgaacacgaggctcaagtccagtttgctcttgaaagaaagattccagccatctcagcagttatgggctctaagcgactgccattcccgagcagagtgtttgatcttatccactgtgcacgttgtagagtcccatggcataatgagggtggtatgcttcttctggaacttaatcggatgcttaggcctggaggttattttgtctggtcagcaacaccagtctaccagaagcttgaagaagatgttcaaatctggaaaggtaatgactaaagtaaaatgcttgaacttaactagagttcctccttcttttgtttgtttcactgaacctgagatgttttgagtgatgtagaaatgtccgcgttgacaaaatccttgtgctgggaacttgtgacaatcaacaaggataaactcaatggtattggtgctgcaatctaccagaaacctgccaccaatgaatgttacgagaaaagaaagcacaacaagcctccactgtgcaaaaacaacgacgatgcaaatgcagcctggtatgattgtttccacaatttgcatagggaatgaataaccataaggttttaacagaacaaagaaagtcaaaacttgaatggaaatttcaggtatgtacccctacaagcatgtatgcataaagttcctaccaatgtggtcgagagaggaagcaagtggcccgtgaattggccccgtcggcttcaaacaccgccttactggttaaacagctctcaaatggggatatatgggaaaccagctcctcgagatttcactacagattatgaacactggaaacatgttgtaagcaaagtatacatgaatgaaataggaatcagctggtcaaatgtgaggaatgtaatggacatgcgagctgtctacggagggtgagcatcaacgaaaacaaatcaaactaaaatctcacttaccaaaactaaacctttttttactaactacgtaaaaatgcaggtttgcagcagctctgaaggacctacaggtgtgggtaatgaatgtagtaaacataaattcaccagatacactaccgataatctacgagagaggcctattcggaatatatcatgactggtgtgaatcatttagcacataccctcgaagctatgatctcttacatgcagatcatcttttctcaaagttgagaacaaggtataagcgtaactcataatatccacaccttttggtaacgtttcatcaacaataagtctcttgttttgttttgttttgaaaggtgcaatcttgttccagtaatggcagaagtggatagaatagtaagaccaggaggtaaactaatagttcgtgacgaatcaaatgtgataagagaagttgagaacatgttgaagtcactgcactgggatgttcacttaactttctccaaacaccaagaaggaatcttaagtgcacaaaaaggattctggagaccagaaacttctcaatgaaagacgctctgagaatctgcatttgaaagtagcagaagcatcattataatacaacacactactcatatctataatccccaaaagaatttgtcagtataagaaatagctttagtcttcttaaactatatagactaattagaacatttttgttttccttacttcatattgctttttttaacatggttatgatattctcttgtaaggctatgaatcatttcactgggaaaagtaaggcacaccaataaatgaaattttgttccaacaagtagaaacatagcagtaatgaagaagagattatgatgctttagcgataccacaagccaaattcaccataagctattgacaggtagcgaaaagtcaaattacaaaaggaataaagtagacatgaaatgaaaccaacaatcttaagcccacatatgaattcaaaagagaggttaagaaagaagagaatctgacatcatgggcagagtaggagctgaagaagatgggtttctgcaaatttgaagcttttaatcgcatatcgctgagtaatcatcacaaacagttttgaattgaagaagacgggaggagaaaagccattgttaatgagatacccaaatcgtaaaatttcagaaagcccagcccaacatagcccaatacagcccaaatatgtatgtgattgggtaacgaaaacgagaccgttcttttttcagtcatctctcgtttcacagtagcgcgtatgtacgctttgaatttacaaaaagtagacatttttatgaatttttgccggttgagtaaaaaggtaaaaaaaaatagttcccaccaaagcaaaatatttcaatttttatcttttttttttggttcttgggaaaataagagattgagaaagaataaagaagagaaactcacaacttttttagttttaggagaagagggctttggtctggagtcactatcatattcaatgctttaccaaactcacctcttcttctaaattctcaccactcttcttcttcttctcattcaccgacatatctcctctcttcactctctgtctcttctcatctcaggtaattccaattttagttttttttgaaggttacttactcgtcacattgtttgaaaaagattgaatttttatctgtggcttagtcaaatcatggttcgtttcaccaagttgtggttctgggttttcgtgatttttcttttgggtttttctgtttgaatttggaaaaataaaggaacgttttttttttcggggggagttttttttttaaagataatttttggagagtttttgataattctgaggaagccaaaagaaaagaagaaaacctaatttgtgttggtggggtttgataggaaata

SEQ ID NO: 10736 - DNA, 3000 bp, Unknown; identical to SEQ ID NO: 10731
  misc_feature (1)..( 3000): cDNA_ID_1014850_gDNA_ID_2213671_Annot_ID_182288 3000 nt of promoter + ATG

SEQ ID NO: 10737 - DNA, 3000 bp, Unknown
  misc_feature (1)..( 3000): cDNA_ID_2705069_gDNA_ID_2213671_Annot_ID_132785 3000 nt of
atttttattttactcttattccaaagctacaagagacttctttttttttaaaatgtcagtgaaactttttattaaataaatcggtttttggatctagagtttatgatttgggaaatttttaactatgttttttaattggcttactcaacaaaaattcaagattaaattaaatatcaacataaaattaaaaaattaaattattaattttagaattcatgctttaaaccaataaaaaaccaataaaaatgatgaactaattatttaacgacatttttcttattgttaaatctatatcggtacttccgatatattccgctactcatggatactgggttcagtttcggttacggaatttttggtagggatttttaggacctattcgattatttctaaaaactggttcgggttcggtttggatatttttcggatcggaccaattcgactaatcggttccggtttctttcccggggcaaggtagagctagagatttcgaagaagaaacgaaagggagagagagagatagacaagttccgcgatgaacgaaggctcgagcgaagaagtaacgaggacggtaatggaagagaaaccagaacagaaacaaagaggatctctggagaaaggaagatcgtgcaaaggctatttatattactcttccactctcaaatccaagtctaagaaccctcgctgcgtcggaatccctcgtactctccgtcaaggtattcgtcttttttgagtcatcgaaagctccaatttcccctttgattgatgattttaatggccgcttcttctatattagggttttaaaatccaccgtgtagctctctgttattgtaattgaatcttatcttatcgcaaaattggccacgaaatcaattttagattaacgaaaatggttgataggtagattccaattcagaagttatctcaaaattgaaaccataggctctgtataactgaagagaaatgtgtgtgtttgcttttttttttggtaactcaattgttcttctctttgctgcttcaatggtttatgcatatgctaaagacgttttataactttgtagttcctgattatgttgttggacaatctgaagctgaagcttctaaagaaggaaggaccttagctgatttttactatggatgtttgggttattccgtctacatgactgataaagactcatctgccattaagcaacatacaaagactcaacttcccgtttgtgtcggtcttgaggtttgtcgctcgtaacacttttctcgaaaatccattacattgctttgaaagttacatattacgcccatggactttcatcttaagcttactatcaattgaatcggtttggtgaggcagtctggtcaatctttttagtttgctttatgcataatttagaagacgttatcaacttctgcaaaaactggaatatatctagaagaacttgataaacttcactggcattaaagaaagaatatggtcgacttggtgctgtctgcaatctctattttctccattgaactttgttatgttcattgcagatattagcagatagaagagcagcttctggcaatacttcatctgttccagcccgtgtccaaaatagaaaaggtacaccgaagctgctctcattcaccagtttacaacaatgaaacgagtcttacctcttatgtgctcatcatttttttttcctattctctagattctcgggaggtgcctgtgcctcagcaccagaacaataaaccagcctctgccactgccactgccacaaacacagaaaacggcttcttaaccaggtaagcaaagagcttttgctttcgctggagatagctttaagatttgacttgttgtagcttaatgggtaatggcattggtatttcacttgactgcctaattgattgtacgtgaatacaaaccttaaagtttgatccttgtacaactcttggatctgcagtagtttagtcaaactaatcagtcttatctaccataaagcgtgcattgttgtatgtgagtcatgaaatgagcattgtttataacacacaatattaaattccgtgggaatgtatcaggttcacaagaaacgcaaacctggttgcagcaggggtgatgaagaacatgaagagagttggtaactatgtgaaagaaactgtggatgattccttggacccatatcgcaagcgaccaaaataaagaaactttttacattagatgtggagacaacaaacccaaaaaaaatgaccgacagacgacaggatatgaaatcttatttgacacttttttggattctcttgaatcatcaaaataataaaatcaacaaaaaaaatggctgtatgatttgtttaagcaggccatgtcccaaagtaatatgtacaccttcctcagttctggtttactgataatattcatatcccaatgaggttcacttttattacatatgaaatatcaaaacatttctaagactttgttcttcatggtgaagactaaacataaaatatgaactctgctttacaacatttactcatagattctctgttctttacacaaatgctaacatatcaaacttgtagatatttgtgtttctcttactgaaacagagcttaattatattaattataaaaatctgaaactcatggtcaagtttgggaatttagagataattagcacatggagtagagtaattaaaatgaattgggaaacgtgcccatttagggaaagacaaagacgcacgctttctctatcatcgtcgtccgtctgtttcatttgatggtgcggagacgtctaagcgatttccatggatgacaccaccttcataagaacaatcctcaccaaacccatcttcaaatttttcttcttttgaccaccattgcatgcttacccgattgggaaactctttgttatccttattgatcttcttccaacggcgatttcccgatccaaattttgggttgattgaattcaaagtttccgtttttacaaaccaatttcgggaaagttttcatcttttttttatg

SEQ ID NO: 10738 - DNA, 3000 bp, Unknown
  misc_feature (1)..( 3000): cDNA_ID_2716520_gDNA_ID_2213671_Annot_ID_132788 3000 nt of promoter + ATG
aaacccatgatctggaaagctaataacaacatccagtttcaaaggatcctgcatgaggcaacggaatcatagaaaactcaacaaacaatgaagataagttggataaaagaagtatctaatacaatccgtgacctagtacaaacctcgtcgtagtatttaacatgaacaacatcatatatgttaggctgctgctctatttgagcaaatgcttcacaaatcggcattcctgaaacaacacaacaacttgattagtcggttctgatcggaagatgaaacagtctgctaaagaactaaaaaactaacacagcatttgctattactaaagatgatccaacagttatctaaaccacgcaatctcgagaaacttcatcgcgatgttttcaaagaattcccaaaacaacacgcaatctccgatcgcaaatcgatttgcaatcttccaaatccgatagacgcagcgtagatgatactccttctcgaattctagaaactaacgaaaagtagcagaaattatgatatttgagagaatcgcaattaccgatagagaaaggtccgatgccgacgccgggacggagatcgaacacggtggcgcccatggcggtgccttccaaacgtcgtctaggtctctgcatcacaagtttatcgccgatcttcgagtaatctttcatttgttggatcaatttcctgaatagaagagaataatacacaattctgtttttgctttctgatttctgaagttctgaattaagtcgggtccactttagttcctctttttacaaacttttgctgcacgggtcgggtttgggttgttgtttgacctatccatatatgatggtacttccccaccaatcagaatttaacacctactccctctaataaatttacgaaaaattaagctatataggcagaaataatttcaattaagctaatgagtaatgaccaattgaccatgtaaaaatgtacaaatatgaaaaatatgctctagctgcctaccattacaattttgttctctggttactaaaaatgtacaccttttcaaaaaaataattagagatatatacttaatgttttgttaaataattcataaattatgtgatgttgttctgcagacacttaattaatacggttttgtggttaacatcattagttgagaagattgtgtgttagaaatctttaatttgtaaggtgacaaatatttaagcactctaaccaaataaatttgagatctgaaatcattccctcacgttggattgtactcttttttccttgttagctcgtttctttttttacttcttagcatcatcataaatcaaagatattgactcgattgaatagtaccttcaaggtaaaagaaaataaattgaattttgactacaataatctcagtagctatgtcatctacaaaattttgaaaacttcaaagaaaatataaatctacaaaatgtagttttaacagaaaatgtgttttttccaaagtttgtaagactccgaatatcaccgatgtatacttttattagaaatagtaaaaggataatatattactataaacaaaaagatcaaagttcaaaactttataacaaaagtgaagtctaacatgcacgtgaacaatgcccaacaaaggtacaaagcctacctacaataccatgtgagtgtcgcgaatgaagttattcaagcatagatgaccaaatcatgaaatttctatgagattacactcctttgggttacaattttatgtttttattttagtaaatagatgttttaaggtacttgtttcttcaaccttgggatactaattgtgtgaaatgcgtaaaatgatgtgaaaacttagaacatattgagtcaaaaaaaaattctattatcctccacacttgatttcttggttggattcttttttttttttttttttttgtttgtttgttgtttgttaatatgtaagaatattcatagtaactaccaagttgaaaaaaacaaaaaaatcatagtaactacccaaattgtagaaggttatttgcaaataactttctattttattatttatttttattttttttgctaagcaactttacaaatatagggtttttaggtggactgttaacaaaatttacattgttttcgcatcacagttttcttattaaaacatacaagaatatgatttctttgttgtgtgttggtatttaagaatattcatagtgaatacaaataacttttctatttttagtttttgtgaagtaactttacgtaggtagaagttttacgtggaatgtaaccaaatttacattttttcttgtcatgtttttcttacaaaacattcaagaatatgccaaggaatttttaatactatataatattttttggccaaggaattttacgtaggtaagatttttaaatgatgttgataaattttacgttattgtatatgaacattgtatattacataatatcatattttcttaaataataaaataaaatgctccatatattttgctaaattggacaccacaaatagatgtctacctatgtttttttaagaaaataactatctacctaataagctggaattccatatctacttaactcaaatgttatttttggataaatatttgaaggtttaaccaagctaggaaatctaacataagattttagaaatgaatttgaaatctagaaattatagtatttttggaatctgtagaaattggtactagtatttttgaaataataaaaattctataagcagaaagaagtgacaacatttttgttatacatttggtcataacaaagtaagaactaaagaagtggaaaagaatagaagaagaaaaaaaaagtccatatgattttttcttcccactagtcttcgttttctaaacacatcacccatacttctctccatcatcatcatcattcatcatcgccaaaatccccaaagaacctcagattagggtttctatttcactagttgatctgcaagtactgctcacaattttttcaaattcttcactaatcatg

SEQ ID NO: 10739 - DNA, 3000 bp, Unknown
  misc_feature (1)..( 3000): cDNA_ID_2716508_gDNA_ID_2213671_Annot_ID_132791 3000 nt of promoter + ATG
ctttgttttcgagagattccaaactcctcccaatgcagtccttgtcaaaacagcagtcacgtttgcagttcttggcgttctaaccgttctgttcccgacagaagaaggaccgaccttgcaggttttgttatcactaatagctaccttttacttcatccaccaaaggctccagaagaagctctggactttcctttacgggtaataagctgatcttaattgtaaaaccgttgctacctacttgattagaatccacacctgatcaggttgatattttgaaacagagcgggagctttcatcttctcgtggctggttgggactttcttgatggtatctgtgatcccaccgttcatcaaaggaccaagaggttttgaagtcatgtcttcgctcctaagctatgttttgctttgggtcgcttcgagttacctccggtagcgtgctagcttttttcttttccccgtcttttgggccagaaattcaagtgttatctcggatatatgaaaacacacgaacagagaaaaaatgcatcattttcatgtgacagagagagagagagagagagagatatgatttgtggtcttggagttgttatttcacggagacctcattaactttcaaagctcagtttccaagttgtggctacaaacaaagaatagtaagagttgattacggaaattagtcggatactagtctgatttcataggaattaggaaacatggcctcatagcacatcatgtgctgtctcatacataataactatggctgcatgattttgtccatggcctcattatatgtgcatggccctcttatttatttctgtgtctaatttatgtatatctccaccgaaataataaacattttagatcaaaaccatttgtcagcctcacgattaatttttttctttcttatcaacataattctttttttttggcaatgtacggccttccaaactagtgaacgttgtaaaattgggctatcattagaagttcaataatttgaaacgctaaaaaggttggctaacgcaaattttggtcgtttcaaatataaatataaggtttatttattaattaatccatctagatgattaactagattggtaacgacgactaatctttagacgatattttcattgaaccactttatgtatgttagtaagaaaaagcaaatgcacatgccttcatgtgctctgcttcacttatcaatagtgaactaaaaattcgttaaccataccttaaaaacgcgaaaaatgtaaataaatgcttgtataaaatagttgcttgcaaaatcatataatttattgtgtggtactgatgtgatgtaccattaattaagatcgaaataatgtgtgttcatcataggtgaccgtttaatgatgtgattaatcaactttagactgattttggattaaaacattattattagataatgtgcataattattttttggaataagaaagatatggcctagacaaagtcattattcttttttgaaaaaaatatgtggataataaaattgagacacatttatggcatatattattaatgaggagaaatctttgaaattttgcaatttggttattaaaaaaattggcttcatttggtaaccttttaattaagctgaaaccaaatgtagataaattacagaagctgatccatttttttttattttttttttaatattcttggacaattgtctgatttacgagcaacaagagagagtctctctacacaaaaaaaaaatcattagctgctctaaatgatgctttctttagcgcgctaatataattagctaattccttaattgtaccaatgaagacgaagaaaacaaaaagccattaacgatttaacagctccacaattccgactttttttgaaaacacctgaattattttttatcgctgtagcgaaagcgaaataggtcgcctgagaaatctctggtttctccgaatcgcctccttagcatcgttcctccgtcggaacaccgtcgcttctgccattgttctccatctcgcatttggtctcgtttctcagatttccatacctcattcgctgattcgcaggtgagaacaaattcgttgattgttcttgatccctttaccggattttatgattttgtggcattggttcgtcttaatgctttgcggttccggtttctagtagaactacgcacgatggttggattttggtagttttggttttgaattttgtgagattcgttgatttgaagttctagtgtgagtctgtgagccggtgaaaggaatttctgagctcctcgccgaaacttaggttcatgttccggcgaggcatgtcacactattgaaaggatttgaaatttgtttgggtgtaattgcgtcgtgttcgttattatattagtactttcttggatcttacggctaagtttgtgttggattttttgttctttgttgtttaccagagacatgtgtaagtagtcacaaactttgtttcctcactgtgcacatggagttaccaaagattcttggctccacattgaacattctgcagaaacggctgtgattattataatatcaaatctgttaaggtaactgatttcttttgtttaagtgttttcttgtggttttaggcaataaaatatgagcgtaggcttgaaacttatgcaacatgcaaggaagactttttgacagactgtttaggagggggaccattgcgaaaacacacaaaatcctctccataatattatatgaaacttgggtttctttatgtctcaaacaatgatgagaaaaaccatgttactgatttcgttgtcattttctgctgagatattttggatataaaacacgtggatagagacaatgttcttctgccaaagacatgaatatagacaagttgataagtagtctgatgatctttagtgattgatttgtcctcataattcctgttcgctctctctatatgtatgacattgctttgttcttgacctggtttcttttggggtaggatgcgggaagggaggtgacgggtgaag

SEQ ID NO: 10740 - DNA, 3000 bp, Unknown
  misc_feature (1)..( 3000): cDNA_ID_2705061_gDNA_ID_2213671_Annot_ID_132794 3000 nt of promoter + ATG
gagttgtagataatttatagctattttaactatactgtaaatccgaaaatttgtaaattgatcgtaaactgtttcgcactaaaatagataattacataaaacggattagctcatttgacacttttaacatgatgaattgatgatcctatcaatcggttgttttattaaattttgatgtcgagataacgagaaaaatggttatgtggcgtagacgtcttgagactattcaattgtgagatatgaagaaagagcattgacttgatcaaagggacgacaagtttgatccacgtgattagacctttttcttttcttttggaaacaaaaattgagtcacaacgattttgacagcccggtttcttatagtctgactggtgaccggtcgcgccgtcgtttgttcttacttccttggttggccaggcccactcatgtaataatttattattgaaaccattttaagctacgcaccagttttattatataaagctgtatgcatgtcacctcggattaacacgtagtgaaattatgacctcgtatgtgttttctttttcttttaaaaatcttacgaccatgacaatgttttttacgaacgattccacgactaacagaaatttacgatagatagttctagctaggtagaccacgtttacatataacaaaattatttttaacatacgaaatcacgagaaacgactttacatgcactatgctataaatttctgataacagtgtctccattattactattctttcacattttctagaattaatcgaacataattaatatatgatgtaaaaccacttaataatttactagccactaaaccaaatggcttcactaatatatgtcctattaatttgaaataaagtaattaatatataaccaaaatatttgtataacactaaaactacaaggaaacatctcaaattctaacaaatttccaaataaattaaaattctgttaactagtataatactataagaaaacatcgtattttctcaggcgatgtctgttggtaaaaccctcggaaaaggactttttcagacagatttatgagggattgttgtctcggtttgacgtggttgccatgtcaagcaactagtatatatgatacaaaaaatgaatatgatgacatcaagcttaattaattagattcaaaatagataaatagatctgatattgtttagtgtcagaccaatttaatccatcattatttttaacaaaataaataatattcctaattccaaagacatgattattcagtcatcacttgctcgatctgtatatatatctctccatcggagtcaaaataaacaaaaacatattgacaccatacccattcacctgtatataagagtacataaatatacataatggagataaaggaagcaagtaagactcaaagagaaagacgaggagcatcgtcactaaagcagatgctgatgaagagatgttcaagcttcgtgaagaagagcaacgaagaagacgtgcccaagaagggctatttcgctgtctacgtgggccacttcagagaccgccacgtcatcccaatcacatccctcaaccatccaaccttcaagatgatgctgcaaaaatcggaggaagagtttgggtttaggcaagagagcggcctcaccattccttgtgaccaaaacacctttctcactctcttagactcaatcacatcttactagctaggatcgtagttatatttttgaggcttcctcacatgatgataagaggaatatatgtacaacttttgtttttcatggcctttcttcaattgtgttccacgtttcttcacatgcatgtgtgtctgtctatctctacatataatatacactaactgatgatctaatatctaaaatcatcgatacagcatattaattagcatataattatgataatgttaatgagtcgtataatcatggcgccttcaatatcaaaatatcaatatttaacatcttaattatcgttaaccagtacttatgatacatgaaatgataatattaggagtcgtataatcatggcgccttcaatatctgaatgtcaaagtttaaatactatacttttagttttgaacttgtttttatatatgctgagaaaaacataatcacgatacaaactagtaggagatgagatcaaattctgatcatcttacagtgtagtaaacacaaagcaggtaaatgcgcaggtgtgacggataagcatgaaaatggacttcctccgccgccacataagtccaactacatgactatttgttttctatcaaagattttattctgtctggactcttttgtttttggtttttgtcatatgattaaacagctaactcattctttttaaacataaaaaataatgaacgcattattcatgcttatattgcaggcagcagcatgcaagttgatcatttattataatggctttgatagtccggtacttctataccggtgataaacacaaagcaaaagtatagccctctaaactgtacatacaatcgaaatatattttttgatttcttaaattggttgtatagaattggaataacaatgtagttcaacaattttgcatcggctgtcacttgtcagcaaaatatataatttgtaacgtaacgtataaagaggtccactttctaagatatatgagattttgacagcatacaatttacgtttctattaaagaatctgtctctttttattttagttgttatacatacccgtaattaaaatgcaaatataagtatagaataatctgaatttttgacacaataataaaaagtaaaacttttacataacattgggttaacataactgggccagtatttctaacataactgggcctgcagtctatttacaaagaaggttacatgaaggccccataagccgacgactatgaattaggtagggtttctgttctttgacaaaacattttagggtttttgtgcttataaataagggatgcaaccaagaagaagatgaatattacgtggcggtaaagaaatg

SEQ ID NO: 10741 - DNA, 3000 bp, Unknown
  misc_feature (1)..( 3000): cDNA_ID_3037840_gDNA_ID_2213671_Annot_ID_132799 3000 nt of promoter + ATG
tcattgcaagaaagttaatatatagttcatatatacacatatgttacgattgatatatgcatttgatatatatatatatatataaacaacctctacggacttgctgatgtaattatctccgagaagaattctctcgccgaaaagagtaacagcctctttaacagaacggaaaggagctccggtttcgatctcggcccgaaccatgatcaagagatgtttgttgctttagttatatgagttggtccatgtcatgacgaaccctcagctttttataaagaaagaacacatatgtttcatgaaagattgcaactgttggttgttgtcacttaaacggatggtgactagattactgactaagatgaaactaaccacgttatgatgattaaatcaatttcaacatatacattgcttagatttttttgctattttttaaacaaacttcattttcatataaataaaacatttataaattggtcttacaaaactaatagtataaatcataatcaagaagatctagttccatagttgatacattactatgtgatggttccaccatattatataatcatttattttaaaatgtaacacattgccgacggaaaattccactaaatgacaaaaatgatgagaagttgttaagtttttcgtggtgcttgttttttagtattgcaaaattagaatttaggaacaagatatagttgaaaatgtcttggcgtttacttcacactaaagaacaagtttgggtaaatatagaacaagtagaaaggttcgttggaacgtccttttgttttctcatgtgttctgttagttttaccaccaaattttattagacaacgacctctctcctatttaaatgggcctttttaggcctgaaaaacacagatcactatctcgtgaccaatattacaaagcaaagcccaataaagattcttattcttcttgagtagcaaacctaaaatgctttcctctcggagttggaatccctttcaaatgcaacacttctttagcctctacgatctcatcgtcttcactgttgtaaagaaatctgttatgtttccctgcaaattcagcttgattcgtctctacattcatcttcttcattccttcacacaacccatcaacctcctcttcttcttcttcttcttcttcttcttcctcataaagctgacttgtcggtgaagtcaaacagtaaagaacgagttatgctcatactcttgtcttctttctcttcagatatctgagaggttctcaagtttccagcaacaatcggagatgcgatcttaatcttgacatcatcatctgaaaagtttggaaattggggagtatttgctggagttggagcgagaagtctcattggagaagtgaccagatggataaaaggacgagtctttattgaatggataagctctgttccttcttcaaccttgtgtaaaagggttttgacttgtcctctcaaaagggcttcaccagatccaggcgtgatcttgattctgctgctttttctcttaaccatgaaccctgaaggaggtgtctgcatcgttagacccacgatcggtgagtcgttggttatgtcgattagtgcagacctgtcttcttcttttctttggtcgatgctcgaatcctctgttttgtctgagccaaaaagcaaagaaaaggattaggttcagaaagatcgagtctatctatgttacttataaataactaattactctgcagatgctttaaggctaaagaaactacaagaacctaaaaaagaagatgggaaagacaaacatacttgatgatgaaaagggaactttgaagtcagaatcagagtcgttgattgcagagatagcctgtgatctagtgacccttttggctgatgatggagtctccatttgaatttcgagttcttgtaaacaacaacgaaaactgaactgaaagagaatttgggaaaaaacaaagtgtgaatgaagctcgtttaggtcgcagtcttataacgttttataactaaactagccgttgtggctcctctcttgcaaagtggaagatgagccgttgccgttaccgttccgttagtaaacccacgaattatttttcttccaaaactagccgttggatccgttctctcatggaaaaagtagacgtctttgttctgtatgggcctttgactaactaaatggcccagcccgttcataacattaatcatttaaaaaatcacattgatggtataacactaattttttttttcacaggtgtataaccaactaatataaatatgcacattcacttaaaattaactaatatcataaagagtattatggcgtctgttttattgtttatccataactacatcaatcaaatccaagttgatatactagttagaacctaatactttacaaatccgatcattaatttatcttgtctgcttaagattttttttttgtgaataaggtttaattatctcatcaatacgatttagtaaaaagtctgtgcaaaaattaatgacgattgggatttttgtaacgcaagcccgtaccagaacatgtctccgccacgtgatttctccacagaccacaagcatttttaagacgtggctttctatcaaccgttaaaaacgtaaatcatattaaccatgtgtctactacctacggtgtaaacgaaactgtataacgtccctatcatataatagtaatgtgatacgttggaatgtagccaaaaagcataaaaaataaatagataattaagtttataatgttttcctacaaaatattattataccgtatgtattttttattttattttctgaagttaaaaacagatgtagttagttgagtaaattgtgttctagaaagagaagagagagcagtagtaccgtggtaggtagctagcgacctcttcgttcgtcagtcatcacaagctttgaaagattttcagctaccactctctcctttatatattcattacacatctcttctttctatatctctcttaatttagtcttttgtcttcgtaattaca

SEQ ID NO: 10742 - DNA, 3000 bp, Unknown
  misc_feature (1)..( 3000): cDNA_ID_2716486_gDNA_ID_2213671_Annot_ID_132801 3000 nt of promoter + ATG
ttaaaccggcgggagtacacttttatttatagtctatttttacgccacgtcatctctaccttgaaaaattgaaattcatcatttttcttcctccttaagattttttttttttcttttctaattaacgacaacacgacgaagatgaatccttctcacggtggcgacgacaagcaacgaccggcgatgtatccccaagttgatcaatccattcctgataatccttttgcttctacaaatccttacgtcgcttcttcaccttatctatatccttctctatcctctcataatctcggacctaatctcttcccagaccacggagatgcatccaacgaccaatcaccatctgctcctcctcaggcgacggaggaggttctcatccgtgttcccggcgctattctcaaccttatcgacaaatcctacagcgttgaactcgcgtgcggtgatttcaccatcgttcgaattatccaggggcaaaacattgtagcggttctagccaatgttggaaatgagattcaatggccgttgacgaagaacgaggttgcagctaaggttgatggatctcactatttcttttcgattcatccgccaaaggagaaaggtcaaggatctgggtctgattcagatgatgaacaagggcaaaagagtaaatcgaaatcggatgatgagattcttaattacggattgaccattgcttcgaaagggcaagagaatgtattacttgtgcttgatcaggttttacgagactacagttgtttcacagagcagagaatgtctgaaaaagccaaggagactggagaagaggtgctgggaaattcagtggtggcggacacttcgccggaggagcttaagggtgagagaaaggatgttgtggaaggtcaatgtgcggcgtattggacaacacttgcaccgaatgtcgaggattatactcacagtactgctaaaatgatagcttccgggtcaggtaagctgatcagagggatactgtggtgtggggatgtaactgtggagagactcaagaagggaaacgaggttatgaagaataggcttagtcgtgctgagaaggagaaagatgttagccctgagacactgaggagaatcaagaggtatggttatacttaggaattttgcatctttgaccttgaaaataactgcttaggaatctagtagggattctcttatctggttccttgtttcatgatcattagagaactgagtagtaagggatgattattgtttgcagaagaccaattctatgagcagtgatgaaatttcttgtttaaaaatgtttgaacattgtgcattctcatggtagtatatcttgaatgaaatcaatttttatgcctttgcttatctccctcatgtggtttctatctaaagggttaagagagtgacacaaatgacagagaaagttgccactggtgttctttctggtgttgtcaaagtctcgggattcatcactggttcaatggcaaactcaaaagctggaaagaagctttttggtctcttgcctggagagattgttctcgcatccctcgatggatttagtaagtagattacttgtttttggtttctcatatttcctatcccatgcttggagggtcataaaagcttcttgattcacgagttgccttgctttctttcatctcacttgaatacatgttttgacatgaccagcattacaattattgtttatccgactttccctctgatggccattcccataatttttccaatttttcgaatatgacatttagcagaagttccttgatatagtgtattagtgcttggatctgcttcttgcattgaacaagttagtctggtggactttggagcattattctttttgtgggtttttaatttcaaagttaccaaatgttttgtaatcgctggcttcccttatataccgaacccttttttgtttaaggcacatgggattagtacccttcttttcatgtttacttcttgttgcaggcaagatctgtgatgctgttgaagttgctgggaaaaacgtaatgtcgacttcatcaactgtcacaacagaattagtcaatcacaggtattgattagcaaaggcatatataaacaatcacatatctccgcatgagtgatcttcagcaagagtgatcaaagtttccttagatcttaaagaaacctcatggattctgtttcgaaattacaggtacggcacaaaagcagcagaggctactaacgaagggctagacgcagcgggacatgcatttggaacggcatgggttgctttcaagattcgaaaggcatttaaccccaaaaatgtcataaagccttcatcattggccaagtctgtttcggaactaaaggctaagaaaggctccaagtaaacactaaacagccttcaactgttctgtgttcatctaaacttgcatttagtttttcattttggaaaagtatatgaagattgattgatgtaactctatatttagttttctgtgtatattgtgattctatgtaaactatataaacagtttcttccaatcttctcccatttatgggtttgatttgtaacttcttaatgcatcgagaagcagtattagtactctttatctttcttttgtactgctatttcttaccgctaactctcatctctggtgacttatcctgccttcgtttaccttttttagtgtttgcttagaaacactaattgcacctatgttatgtattctaccagattaatttgacaaaaaacaatgttaggagttttaatgttttgaagaagtgggccagatgtttggagttttaggccaatgtagctcatcttgggcccagtacagaaataaatccagtgatgattctttctgattggctggaaggtgtgtgtacgtgaacctgtccgcaggtgattaaaacagagctgggcttttggcttgtcgcctaagtcgggaatcgtttactgtgaaataaaaacgagagagagtttttgaagaagaagaaagaacactcacaagatccagaaaaaggtaaaag

SEQ ID NO: 10743 - DNA, 3000 bp, Unknown
  misc_feature (1)..( 3000): cDNA_ID_2705049_gDNA_ID_2213671_Annot_ID_132803 3000 nt of promoter + ATG
caagtataagcttttgcaccacgattcctctaaatgtgaggaattatctctataggcattagtaacttttcttgatatgtcttttgaggattggaagtcttgttaagttgcagaatcttatcgctattgcgttctttgtttatatctgtctagatgatggattccgactcacctatctgggttatgactttcttgccattaaaacattggtcaaccggggtatatttaccggtgtcggtcgtcagattggtgttggtaaagagtcaggtatgttgttttcctatttatttttattttatcggtgtcgaagagatgcgtgttggtggctgatgtatcttatttatttgttctttgcatataatagacatatttgaggtcgctcaggaagatggaactattctagcaatgaagttacatagactagggagaacctcctttagggctgtcaaatctaagcgtgactacttgaggcatcgcagtagtttcagctggttgtatctctcccgacttgcagctctcaaggagtttgcttttatgaaggttattgccttcttccactaatgtaacactattcttgtgggtgtatcatctttttattttatttttggcctaatgtttgtttggcttctgggtgagcaggctttggaagaacatgactttccggttccaaaagctattgactgcaatagacattgtgttatcatgtcccttgtgcaaggttaccccatgtaaggacctaactacatatttacacaaagaaaagtggttatgatttatgatgtttgtcatcatctactgatatgttgtggtcggatattgattttaagctaagataatcattggatttttgagtttctaagaaagctaaaccatttgcttcactcactcactaagaaacagttacaccctttctgctgtgaatcacatcttttcacatttttcatttatgcagggttcaggtgaagcaattacagaaccctgagacaattttcgagaagatcattggtattgttgttcgtttggctgagcatggtctaattcattgtgacttcaatgaattcaacatcatggtgagatacttagatctatctagttgaattataccttctatttgtaagttactttgctgaaaatatcatgcatttatttgaagctgccttctcatataagttaattaatacttctgtaagcatgctagttttgtcctctgcctacttacaattttcattgacacatcctgtttatgtatgcatgtatgttatagattgatgatgaagagaaaataacgatgattgattttccacaaatggtatctgtttcacaccgaaatgcacaaatgtatgtgacctctcatctctgcaccatgcctcagtactttcttccaaatttctataaaatattcttggtttgttaatgaattttgtctctcaggtactttgaccgtgatatcgaatgcatcttcaagtttttcagaaaaaggtgatttaccaatttgattttctttttaatatatacatcatttgttcacaatacctagtagaaaataatctctcagtcgctgaatccatgtcatgaatgaccctgaaattctcatttttctttgaactctggtcctttcttacaggtttaatatgtctttccatgaagataaaggtgaatcagaggagacggaggtggatgagaacagcagaccatcttttttcgatattactaaagatgctaatgctctggataaagatctagaagctagtgggttcacaagaaaggagcagactgacctcgataaagtatgtgagcctatgaccttagttataacactgcttatcaatcttcaatcaaccgtttcttggtattgcgtatatattttgaatcttaggcagactaatttgcagcactggtctctgtgtggttttgtttcctcattctctctggtatatagaatgaacatatggtttctgtcttttatagtttattgaaggtggggtggagaagagtgaagattctgatgaggatgaggaatctgatgatgaagagcagacttgtgaatcaaacgaagaaggaaacctaaatgaaataaaatcattacagttgcaagacaaggtataaaactttccaattcatcatacaactgaaacatgtaccaagtaaagatgtcctctacttacagtatatgcttttggcatgatgtaggagcaaaaaagttcagatggtgttgaggcagaagttgagttggataataccgagaacggtgaaagcaatggagatgaagatgaagtcggaagtaatgaggttagtatcttgtgtgtgagtaactcggagagtgaagtaatgaaatcacttacaaaaatgagttttgctacttcctttgtacaggaggaggaagagaaagaggcagagctggagaaaaatttgggcaaggtaagacgcagagccatggcagcagccaggggacgtagaaagtcacagtcttcaagaaacacatacaaggacaaaggacgcggatcccaaaactccaagatccacagcaacatgagcggcttttgatactccaactgtgggcttgaatgggccgtataatgatgtaaacgggcccataatctttttctagtgactttttctcgaatcgttgagttttccaaattgaacaccaaccaatgtactgagacagagaaattaaattataacggatatgtttcttaataaatcaaatctcaaatgttattttgtccaaattttgtttgatgtagttttagcggggctaaactgaaaacacatgaaagtcaaaggagtagatgcgaaacgctcccccagtaattagcggaaatagaaaataatggaacgcaacggctagtgatctcaacggtcgaaaatttaaacttttttataataattgacagacctctctcttttgttaaaatcctaaccttgttctcacattaatcctccgccgagattccttttgtcttcttcttcttcatcttctccatttcaattacaaag

SEQ ID NO: 10744 - DNA, 3000 bp, Unknown; identical to SEQ ID NO: 10740
  misc_feature (1)..( 3000): cDNA_ID_2705061_gDNA_ID_2213671_Annot_ID_182307 3000 nt of promoter + ATG

SEQ ID NO: 10745 - DNA, 3000 bp, Unknown
  misc_feature (1)..( 3000): cDNA_ID_3037872_gDNA_ID_2213671_Annot_ID_182306 3000 nt of promoter + ATG
aaacatctccgaagatccggcttggtaatacttgacggtacggccactgtcgatggtgtgagatctgacggcttcaaggagacggagagcaccggttgcgactacatcggctgtgtaatcagggatctcgaaggagacagcgacgtgagattgagcagctaggttataaacttcgtcaggtttgatcacatcgatccaacgacggagagaggaagcgtcggtgagatcggcgtagtggagtttcatcagagctttgttgacattgtgtggatcgatgtagatatggttgattcgctgggtgttgaaattcgatgatcgacggatcagaccatgaacttcgtagccttttccgagaaggaactccgtcaggtatgatccgtcctggccggtgattccggtgatcagagctatcttcctcggttcaacgacggtggaatcagctttgggagcggtgatggattcggaatcggatctggatccgttgttctctgacgccattgttgggttttcggatctgggatttcagagacaaatgctaacgtcagctctgtgttgaaaatccgtgttgaattgggctgttagagttttagctgatttaaatagggtcagagaggttgaagacggaggggtattttagtcaatttcaggataagggtagtttggtaatctttgttggtctttaagttttttttaattgactattgattggatattttccttgtttatgtataacacgttaatgatttacttattttgtggtcaaactcatcaatggtgtactatagaattttcttagatcatttgcaaactttccacaaaaacaaacatattaagattttcaaatcattttatgaactgtccaaacaaaaatagtgaaaagtatttgaaagtttataagacaataattgcaaaaacaattagagtgaaaagtagtcaaacaaagcatttaatatacatttagtgtagtcaaaaattaattaaaaagttacaaatttgatacattaaaaatattagtaattttttgtagaagcaattactattttgtactcaactgaaaaaattgagagaattggattgaaaaaaaagacagaaatgaaactcaccatttactaaaaaaatgaagcaaatgataagagtataacttggctcaatgccgaaacatactaacatatatatttagtctcttgagttgtgttcgagtggtggacaatatgtaatctccacgatttgttttaggaatcttatgcttcaaatcacctttgttgttttccttttacaaatcttcaatcattttcatttatttttcttctttctgtcacaaataattgattggtttgtcaagatatgcttttatatattatttatctttgcctgttattctttcgacaaccaagcaaagtgatcatttgaccacaacaaaaaagcgttgagacttgagacaagtgaaaattataaaccatgcgttggaccatcttatgcatccggaacttaggtataccaacttagtcttaccaagaattatattcgatcagacactaattaaagaagttaattatttcatatgttcgacaagcatcaaaatgtggcccgtattactatccatcgaacgaatattctagcattagtggatttctccaagctaaactacaatctcaatctagaggatgcaacacggaaaccaaaactgaattgctcaacaaccatgattttcaacgttaattatggtgtttggtcacttgactcactttggctacaacttgtgttgaggttgataaacctttgttgtcatctcttataatattggactaatgaacttgaagacagaaagaaaactttagaccaccgtgataaagaggaaaaaacattcctagggtttttttatctatacaaaaaacccgatcaagtggctgatctttttactaaagcattgggtagttccagttttagagtatcttttctccaagttgggtgttttaaatttacacacaccaacttgaggggagtgttatcgagatagatgtgaatatgtcgagctagatagatatgaattttgtttagatgtgtttagtatctctaaagataaggtttagagaatattgatgtacacacataggtatatacatgtatataagggaaacgtatcccaagtaaataacacaactcaattaaaccaaagtctcttcttaagtttacaaaacttgacgaattgtggtgtaaaggcaaagaagattataaaggtcgttcgaagagatgggaatgtgatagttcttcaacttgttcaagtactaggaagagtctattcgggcaatggtgcaataggcaattgagaaaacaattgagggtgtgaaacaaagggttgcaatttggttatacatgctcaagcctcacggtgagcgcaatttgtttttggcaattatcttatttgttggctattctctgaaggaaagaacattaaaaaattgggcttacaaaggtttgaattcaacttagattgcaaagacttagtgatgggccttatggatgagattacttgggcgtccttgagaattgtggcccacgaagttcaagagatactgataggatacattcgacgtattccccatttcgttttacattttaagatgatgatgtgtgaaactagttaagaagggttcttcttagtcctaaaagagttattaaagtttttttaaaactctataaagtttcgggcttcttaataataaacacagaaatgataatggcacttaaaaaaaaaaatcataattctcttaagattttctgaccaattgtccaataatcattgtccaataatggtattatttgcttatttttttactacataatctaaagttaatcaatatcctttaatccaataataatgacaacaaaactgtgtcacttttctagtggggtataaaatatataataatatggctcttctcctaaagtactgcaaagagaagaagatctcgttgacgccccaaaaaataaccagaggta

SEQ ID NO: 10746 - DNA, 3000 bp, Unknown; identical to SEQ ID NO: 10739
  misc_feature (1)..( 3000): cDNA_ID_3037880_gDNA_ID_2213671_Annot_ID_182304 3000 nt of promoter + ATG

SEQ ID NO: 10747 - DNA, 3000 bp, Unknown; identical to SEQ ID NO: 10738
  misc_feature (1)..( 3000): cDNA_ID_3037892_gDNA_ID_2213671_Annot_ID_182301 3000 nt of promoter + ATG

SEQ ID NO: 10748 - DNA, 3000 bp, Unknown; identical to SEQ ID NO: 10737
  misc_feature (1)..( 3000): cDNA_ID_3037896_gDNA_ID_2213671_Annot_ID_182298 3000 nt of promoter + ATG

SEQ ID NO: 10749 - DNA, 3000 bp, Unknown; identical to SEQ ID NO: 10735
  misc_feature (1)..( 3000): cDNA_ID_2184864_gDNA_ID_2213671_Annot_ID_182297 3000 nt of promoter + ATG

SEQ ID NO: 10750 - DNA, 3000 bp, Unknown; identical to SEQ ID NO: 10734
  misc_feature (1)..( 3000): cDNA_ID_2705073_gDNA_ID_2213671_Annot_ID_182296 3000 nt of promoter + ATG

SEQ ID NO: 10751 - DNA, 3000 bp, Unknown; identical to SEQ ID NO: 10732
  misc_feature (1)..( 3000): cDNA_ID_3037903_gDNA_ID_2213671_Annot_ID_182294 3000 nt of promoter + ATG

SEQ ID NO: 10752 - DNA, 3000 bp, Unknown
  misc_feature (1)..( 3000): cDNA_ID_3019786_gDNA_ID_2213671_Annot_ID_182323 3000 nt of promoter + ATG
agattctcagagcaagtcaaaaccgttctaggtggccatggtttgcctgaaatgggcagcctagactactacaaggccttggttcatcgtgatcgaggtcgccagctaacctccaacaacaacaatcagacaactatttctttcgctcaaggcaactccaccgaagaaatcagtttgtatgataaaaatttggcacctcctctgtatttccatttagtaagtactatatagacctttgattatatgtttctttattcttaatgatcagtctacattatgcgaatgtgacgatagggacaccggctcaatggttcttggtggcattagacacaggcagtgatttgttttggttaccttgcaattgcaattccacttgtgtacggagtatggagactgaccaaggcgaggtaattttatacaatcttggaatgttatttgttatgacatcaaaacttgatcatcttttaagacacacatgtatacgtagagaataaaactcaacatctacaaccccagcaaatcaaaatcaagctcaaaggttacgtgcaatagcacactctgtgcattaagaaacagatgcatttctccggtcagcgattgtccttacagaatccgatatctctctccgggaagcaaaagtacaggtgtgttggtggaggatgtgatccacatgagcactgaagaaggagaagctagagatgctcggatcacattcgggtttgtaattctttctaaaattggcaatgcactgattaatatgtctttcatatagtattttaggtctcttcttacttcatatatgaaaagtacttaaatggtggcagatgtagtgagtcccaactagggttgttcaaagaagtggctgtaaatggtataatgggacttgcaatagccgacatagcggttccaaacatgttggttaaagccggtgtcgcgtcagactctttctcaatgtgttttggtcctaatgggaaaggaacaatcagtttcggagacaaaggtagctcagaccagcttgagactccattgagtggcaccatctcaccgtaaaccctccttacacctttttcttttatttgtcccaataagtatattcatatgtaacgaacatgcatgatctaaacacaggatgttttacgatgtgagcatcaccaaattcaaggtaggaaaagttacggtggatacagaattcaccgcgacatttgactctggaaccgcggttacatggctgatcgagccttactacactgctctaacaacaaacgtgcgctttacgtacttttgcatttagttcattccattacctaaaacctcgaggcatgtaacattacaaaccgacccgtctgtgtgttgtgttatgcagtttcatctctctgtaccagacagacgactttcgaaaagtgtggatagcccttttgagttttgctacattatcacatcaacgttcgtaggcttatctttagatatacatatgataaatgtttgtagttaaaaaattattgatgcatgtgtgtgtagctgtttgcagttcagatgaagataagcttccttcagttagctttgagatgaaaggaggagctgcttatgatgttttcagccccatacttgtcttcgacacttccgatgtatacacatatcttctcatatcatcattttatcatatttactatatctaaatatattaatctccattgcattaacagggtagttttcaagtctattgtttggctgtcttaaagcaagttaatgctgacttcagcatcatcggacgttcgtttttgttctttttttcccacaatcaacacaatttcttcttgtacattttaaccaattcctaaatcagatgaaaatttttctttatgttagaaaatttcatgaccaactacagaatcgtccacgatcgtgagagaaggatcttaggatggaaaaaatctaattgtacgtcctacttgaactaaactcttctccaaaaacaaaaattactcatgttaataactaatttcttgtggacattttcaggtaatgatactaacggtttcacaggacctaccgctttagcaaaaccgccatcgatggcaccaacgtcgtctccaagaaccatcaacctttccagtcgtttgaaccctctggctgcggcttcttcacttttcatcatttgcttcatttcttttgtatctttgtgatagtgactaatttaattacatctaatgtgcaaagagctaatcttattctcgtttctaccctctgagtttcacatattattctatccaccccatcattctttgtttctcatcttcttgccatgttcgtcccattcatccaagtgggacatttttaaatacaatatcttaccttatataggagcacgcatgggtcaaaaagtttgggtcgtctcccaaaatttaaaatatccaaaaataaatcgatggaatgacttaacctatataatattgtataagccaagactttaaacaaaatggagaaaaggaaactaattcaacttgtctatctttgatttataaagttataatgcataatgccctcctcgtctgttgatttctctgaaggaacttctatttttctaaattttttgtatacaagtcgaattttagtatgataataaaaagctcgtataaccttttaatataagattaggtatacatgtactattgatactctattgcggcatgattagaaggtcaactgtaagagaaaacatcaacaatgttgtctattatgagtaactagggaattatatgatatcaacaacaatagaaaaagatattgttcgttaaataaaataagacaaaaaagagaaaataacaggaatgaagtgcaaaatacgaagtgtagaggggcatttcaacaaaaataaaagagttgacgaagacacttataaaaaggaatggctaatttcaaaaagtctcccaccgcaaaagagaactctgtcttcgtcaacctttctccttcagggaaacaagacgaagatacaaaataatg

SEQ ID NO: 10753 - DNA, 3000 bp, Unknown
  misc_feature (1)..( 3000): cDNA_ID_3037848_gDNA_ID_2213671_Annot_ID_182321 3000 nt of promoter + ATG
agtgtaccacttaatctatacactcccaatgcatcgactacgagttcaagcattcgatgcagtgacaaacgttgttttggatcgggaaagtgttcttctcctgaaagtatttgtccttatcagattgccttatctagcaacacagtcacgacagggacattgttacaggatgtattgcatctagtcacagaggatgaggatttaaagcctgtcaatgctaatgtaacgcttgggtaagtaatgactcttttcctctgtctttcttctatgcacctttaagaataaagggttcattcctggagtaacctattgaatgaagtgagattccggacatgtaaaaagtttaggtcttttgcctctcttagaactcatgtacggttccatcaactgtcctctgtttagagaaatgaccaaggagatgctaaagaactgaatccgtgtttgtggtgcagttgcggtcagaaccagacaggtgcgttccagacagatattgctgtgaatggtgttctcgggcttagtatgaaagaatattctgttccgagccttctggcaaaagcgaatatcaccgcaaactccttttcaatgtgtttcgggcgtatcattagcgttgttggaagaatcagtttcggagacaaaggctacacagaccaggaggagactccattagtctctcttgaaacaaggtaagaagtcatttccagattagcggcgccaaagttttataatttgtgtatatctactacaccaattctgcttctatctcccattatgttttccttttcacatttttgacctaaaatgaaaactagtacggcatatggtgtgaatgtgacgggagtatcagtagggggtgttcctgttgatgttcccctgtttgcactattcgacactggctcatcatttacactcttactggagtcagcatatggtgtttttaccaaagctgtaagtgtttagattagactataccatgtattataatgctgcctgaccaaattcatgtaaaaaagcgagatatgtgtaaactattcttcctcggagaaactattgtgctgttaaaccattagatatatctgtaatttttgcagtgggcattgaaaattgaaatgaagatttctcagaagaaagccattcctccaagctttgtttgttacatcatatgacgtacatcttttacttttgcagtttgacgatcttatggaggacaagcgacgcccagttgatcctgattttccgtttgagttctgttacgacttaaggtcatgcttccactcttatcagtgtagttatatatgcttttgcctatattaatagcacattcttttaacgcacgccagaacacgtaaaaagtaagaaagatgggaaacattttatagagaagaacatctgaattctgatgctcgtcctcgtcatatgcagtccaaatgttacaacccctgtagagatgattttcgttggaggatccaaaatgactctcaggaatccgtttcttacagcaacgtctaaggcatgacatggtctttaatttttctttttcttttcctgtattaacgtatctatttacattttctttttgtttttggttttgaacactggtaacaggagggtactaagatgtactgcttgggtattctgaagagcataaatctcaatatcatcggacgtaagtatctcaacaaccaattctgatgcacaaatttatatatatatatatatatatatatatatatatatatatggatataatgagagtatgtgtggaatgcagagaacttgatgtcgggccaccgcattgtatttgatcgggagaggatgattttgggttggaagcagtctaattgtaagttcctaaatcaggaagtgactgtatatacttaggaaccaagcattagtaatgatgtggttttgtgtcaatgcaggttttgaagatgaaagcttagcatctgagtctcctccaccaccagagatcgaagctcctccaccaagtgtatccactccaccacctgctgcttctgctacaccgcccacaatcgatcctcgtaactccaccagaaactctggcacaggcggtgcagccaatctcagccctcttgcagctcaactcctatttctcctaccacttttggctttcctctgaatcacaaaagttcgttttgtgttggtttaaccatttttgtgttcatttaataataaacatcgtttgatgagcaaaacacaatgttcattggtttgagattgttgaatcttattttatctcccttgttacaatgtatgtttttgttatgtaaaatgtttcggatgtgtcaaaagtgattgaagcaaaggaggacatgtatccgtaaagcaatgattcaaattgtctatttgtgattcacttaattcataatgccctcatcgtatgttgacttttctaaaagagctaatctttttctcaacttgttgcatataattcgaatttgagtttagtattgagatactctaatgcggcataattaaatcagcaacaattatgagcgaatgattgatttgactaggaaattatttcaccaaaaaaaggaaaataaattgttcgttgaatataaatagtataaactataaaaggagttaagtacgaaataagaagcgtagaggggcttttatgcaaaaagaaagagatgactaacagacttataataacggctgatttaaaaagtcgtctccctccggataaaaaaactctgcctttgtcaacctttcagcttcagggaagaagacgaagacgcaaaataatggctactactccgattaaactagtattagcttaaatattattagggccaataatcaaatcagcttctctggaacaatgcgaacgagtcaatctgttgacttttccaattcttcaatttccttacatatacgttattcttcgaggattatgtctttatctgagaaattaaacgtctttttatcccggaggtgtttttgttttctcggaaaagctccgagattgaagtcatg

SEQ ID NO: 10754 - DNA, 3000 bp, Unknown
  misc_feature (1)..( 3000): cDNA_ID_3037856_gDNA_ID_2213671_Annot_ID_182319 3000 nt of promoter + ATG
tccttctcctccctgcactctcgggtacagcaaggccaaccacttctccagaaccttcatcttcctcttcttttggattctcttgcacttggtattgtgtttatcaatttaacagagtgtaataagaggcgtgtgtgttggatagacaaacaaaaaaagggggttggtcactgttgcgtgatttgcaaggcttttctcttttatggattacaatgtacgttaaacacacctctctctctttctttatgttcacacaccaacaccagatccttacttctcaccttctcttcttctcctctttctttttctttttttcccttaattcaagcagataacaatctaaaatcaattaaagactcgatctgattcggatatatagatgattccaacagaagaaatatcaagataagaaagactctctagataattcagcttatcttaaattctgcttttaaagatagtttttgcttgtaatgaattggtaaatgtctgtctcttataaattttcatttgaaacgccatctaaactaaaattaggtactcgtgaggtgccttatcccattcacaccacttttaaaaagtgtttttatcttctttttttcctaaaattgcaaaatggtcctgaaatttgttgttattatggaaacctctatttaattatgttttgacttgatccaacaaaactggaagtctccttctctcagagaaggtttctcttaaggtttttacactgagcgattcttctccttcgccgcaacaccttctcctgagctgtaatcattccttgagaccttgacatagctatgatcgttggttaatggcgatttctgaatccaaccctgactcaaatcttagcattcaagctggagatgaatggcaaaagcttcctctattcgccaattcgtcacatccagattcatcgtccccggaacgggtctgcttaagggtttcaaacttgtcgaagattccaactctattacacacctcttccaagtccacgcgaggctaatcacctccggtaacttctgggattcatcttgggctatcagattgttgaagtcttcttcgcgttttggtgattctagctacaccgtttcgatataccgcagcattggcaagctttactgcgcaaatcccgtctttaaggcttatttggtctcgtcttctccgaaacaagcgttggggttttacttcgatatactaagatttggttttgttcctgattcatacaccttcgtttcgttgattagttgtattgagaagacttgttgcgttgattctggtaaaatgtgtcatgggcaagccattaagcatggatgcgatcaagttttgcctgttcaaaattcgttaatgcatatgtatacttgttgtggtgctttggatcttgcaaagaagctgtttgttgaaattcctaagagagatattgtgtcctggaactctataatagctgggatggtgaggaatggtgatgttttggctgcacacaagttgttcgatgaaatgcctgacaaaaacattatttcttggaatatcatgattagtgcttatttgggtgcgaataatcctggagtttccattagtttgttccgtgagatggtcagagcagggttccaaggaaatgagagtacgttggttttgttgttgaatgcttgtggtagatcagctagattgaaggaaggtaggtcggttcatgcttctttgataagaacctttctgaattcgagtgtagttattgatacagctcttattgacatgtatggaaagtgcaaggaagtaggtttagcacgtaggatattcgatagtctatctattagaaacaaagttacttggaatgtgatgatattggcacattgtcttcacgggcgtcctgaaggtgggctcgagttatttgaagccatgatcaatggtatgcttagacccgatgaagtgacatttgttggtgttctctgcggttgtgctagagctgggcttgtttctcaaggacaaagttactattctctgatggttgatgagttccagatcaaacccaactttggacaccaatggtgcatggctaatctttactccagcgccgggttccctgaagaagcagaggaagctctgaagaatctgccagatgaagatgtgacaccagaatctacaaagtgggcaaacttgctcagctcgtcgcgttttacaggaaacccgactctaggggagagcattgccaagtccctgatagagacagatcctttgaactacaagtattaccatttgctgatgaatatttacagtgttacgggacggtgggaggatgttaatagagtgagagagatggtgaaggagaggaaaataggacgaatacccgggtgtggccttgtggacttgaaggagatagtccatggccttagactaggatgcaaagaagcagaaaaggtgttcactgagactagtttagaaaaatgctacagtgattcaccgtcataataaagttaaatccccaagttaaaagcatacggttgctcttttaccagatccagggtatgaaaagtcataaatggaagctgtgtccatgagtttggtctgtttttgcagacaaagagtagtaaaatccttgtttagaatggaaagaagagaagttaatagtctctcaaaatgtacttgatcctgtttcatttttgttctttttggggtcagatttgtcaattctttaatttgagaaaggcttttacacaatcaatgtgaggaaaaagggtaaatcaaattctaaatcatgtgatctatttacgtaatttaaattaccagcttactcaaaagtcaaaattgaagttgtgagagataagactaatgtagcctaatgactatgaaatgagttatgtcaccatctaatttaaagttaaagctgataatgaagaaagaacaaatttaaatgaggagagtttcaattcgcgaagatctcagaaaattcggtcaaaattgagacttctctctgtagagtaaagtagtgaggaacatagaatg

SEQ ID NO: 10755 - DNA, 3000 bp, Unknown
  misc_feature (1)..( 3000): cDNA_ID_2705047_gDNA_ID_2213671_Annot_ID_182318 3000 nt of promoter + ATG
ctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcaggtaacaacaatcaagctcttgtcttctcttctttgattgattttgattagtgttttgtgtttgtttcttcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaaggtattcactttttgacttcatttcattcataaagttgcaatctttgaacaaaacaattaatctttgatgtatcttcatatgttaagttttgtggaaagagtttgaaaatgttgtttatattcagtttgaagtttgaatattgaaattgcttgcttagatttcatccaaatatggataaatgttttgtttttgggaatttggttgattcatgtgggcattaaaggcttgtggtgggtccaagcgtgagcagatagtgtaagagacccacgtgtgtacttaattctgatgaataatgtgttatgtacactggcacaaatatcttgccaagtagtgagtgagtgtttgttgttttttgaatgtgggttttgttgcagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggtttgttttgtgcattcccattgcttcattaacctaaagtatcttatgttggtcaatgtgaacaaggttcttgtatgaatgtaatgtaggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttgagtttatgctgttttcgaaatgaaattggttaaatgacttttcattgaatcactgcttgaaacttcatcaattcaactacttcttagccaagtcaaatcattggaaggtgacctaccaaggtattattaacattggagaagtgttagttagttagttagtgaggtagttaaggggattgcttaaagaagtaagcaagtttaatgataatcaaacactcgtgatgtgtacgtaacagaagaaaagagagatgattcgtttgagcggcagaaaaagacaagtgcctaatttgatttcccataaataaacacacaatcgattggtaattttgattagttgggagctattaaaagaggaaatccacaataatcggaaatagaaagacaagtttggttagcggaacgtttcaacgccatttttcccggccaaagctaactctaactaactctttgttttttttcggtttttgtgccatcttccagttttcattttttttgtttcccctctatctttttgggtaatagggtttctaatctctgggacaaactccaatcgtttcgaatccgcaatgcccagatggtcgatcaatagaaatatcaagagtctccaattccaaaggctaaatctttgagatctttttttttataaatttccctgaaattaataaactttgaggggaa

SEQ ID NO: 10756 - DNA, 3000 bp, Unknown
  misc_feature (1)..( 3000): cDNA_ID_3037860_gDNA_ID_2213671_Annot_ID_182317 3000 nt of promoter + ATG
agcggggctaaactgaaaacacatgaaagtcaaaggagtagatgcgaaacgctcccccagtaattagcggaaatagaaaataatggaacgcaacggctagtgatctcaacggtcgaaaatttaaacttttttataataattgacagacctctctcttttgttaaaatcctaaccttgttctcacattaatcctccgccgagattccttttgtcttcttcttcttcatcttctccatttcaattacaaagatgatgagagatgttttcaggccgactaaatcagccccttgttctcctgcaaagccacttggtatctctcgcactcaatctgaatcatttcatgctattcacaaagttcctgtcggagacagtccttatgtcagagcaaagaatgttcaggtgatttgattatatcccttctatagatctgaatttgtgtttgatttgatttttgttctgtctctgattgttgttttatggatcagttagtggagaaggatccagagagagcaattcctctgttttggaaggctattaatgctggagatagagtggacagtgctttgaaagacatggctattgtgatgaagcaacaaaaccgcgctgaagaagccattgaagctattaaatcactcagagttagatgttcagatcaagctcaggaatctctcgacaatatcctcttagatctctacaaggtccgtcctttatacataaccctgtttcctctgtttcgtttttgcatttggtttgattctgtattgaaatggatttgttactgcagagatgtgggagattagatgaccagattggacttttgaaacataagctcttcttgatacagaaaggactcgctttcaatggtaaacgaaccaaaacagctagatctcaaggcaagaagtttcaagtctctgtggagcaagaagctactcggttactggtaagcagcaatttcaaaatgtgcattatgtttagcaattaccaagtttgtgttaattcttaattggatgatgattggtttgaaacagggaaacttgggatgggctctgatgcaacgagacaactttgtggaagctgaagatgcatacagaagagctttatcaatagcaccagacaacaacaaaatgtgtaaccttggtatctgccttatgaagcaaggaaggatcgatgaggccaaagagactttacgacgtgtgaaacccgcggttgttgatggccctagaggcgtggattcacatctaaaagcttacgagagagcgcaacagatgctgaatgatcttggatctgagatgatgagaagaggaggagatgataaggttgaacaaagaaggctctttgatgcaatctttggatcttcctctatatggcaacctcagccttgtagtgagcagactgtgaaggctaaaccaaagcctggtttaagcaatggtgatggatacggtgatgagaacgtgaagatgagtgtgaatccagtagtagtaaacccattaagggttgatgcaaaaccgttcttctcttcgaagttggtcatcagtaacaacgagaagctgaagagaacgagatcgtcgagccaagggatggggatgttgagtggtattggtggtgatcatgagggagagacaaacacaagcacgagaaggagattgtcaatggagaagaaagcaacggagtgtggattaccagacaataaagactttgaagatgcgatcatggctgctgttttaggaacagaaaccaaagtggacaagaagaggctcaaggtgttccaggatatcactttgtgtctcaatcagagtctctaaccactcttatcattttatcattctaatttataatttagtcaaggaatcaaaaaaggagatgagcttaattcttcttggtaattttattaatgtttttgtcagctttaagttgctgccatttttttcacaattattgtcttcattgaccagtaataaaagctgaagttattattttccttgccattctacaaatatagttattgatcaagaatagtgttgtaaaatgttactaaaatctaatgagatagagagaaacaaagaagatgaagatgacatgagtggttaccatgaatatcccattaattaatccatcagaatcttatttactgcgttaccattaatcagatggttgctcttactctttttattcaccactcactcaacttttgtggtcaagtttgtagcaaattaggggtaattagtatccattaaaccaatcatttgtatctatcaatttggactcttctgcttccaatttgtagtaacgcttacccacacttttaattcggccaaaatacatccgttgaaattgtataaagttccggaagtgcccctcttattttattaaccatggcaaatgaaacggtgtaaaaacttgtttttttcccacttaatctctctctatttgaaagttatgcatttttggtatccgcattaactcgagtcttttaaactttgactgtcagaaaaaggcaaaaaaggtaaatttgttttgataattccatggtacattttgtaatagaattgagaaataaaggatattttagtcaaatggactgttttggtttttggaagaaaagaaaaaagaagagatttaattggaggaaagggctctctgaccaaagcttaaggagagtgtgaggttaaactgaaaaaagaagaatcccaaattccaactacattcctcagggaagccaaagtggccttcacaatcctaaagttaaaactcttgagtgttttttttcagatcaagacaaagtttagatcttttctttttggtttaattgttttgacacaaacgaggtaagcacaagcagaagaagaagaagatagagtttgagttcaaattagatttgttgagaagaaaaagagtgatttttgttttctgatgcatggtgaagaagaagaagaagaatagtgagtgagagaaaaagagtgattttttcatttttcagacagagagtgagtacttgaagaa

SEQ ID NO: 10757 - DNA, 3000 bp, Unknown; identical to SEQ ID NO: 10743
  misc_feature (1)..( 3000): cDNA_ID_2705049_gDNA_ID_2213671_Annot_ID_182316 3000 nt of promoter + ATG

SEQ ID NO: 10758 - DNA, 3000 bp, Unknown; identical to SEQ ID NO: 10742
  misc_feature (1)..( 3000): cDNA_ID_2716486_gDNA_ID_2213671_Annot_ID_182314 3000 nt of promoter + ATG

SEQ ID NO: 10759 - DNA, 3000 bp, Unknown; identical to SEQ ID NO: 10741
  misc_feature (1)..( 3000): cDNA_ID_3037840_gDNA_ID_2213671_Annot_ID_182312 3000 nt of promoter + ATG

SEQ ID NO: 10760 - DNA, 3000 bp, Unknown; identical to SEQ ID NO: 10756
  misc_feature (1)..( 3000): cDNA_ID_2716478_gDNA_ID_2213671_Annot_ID_132804 3000 nt of promoter + ATG

SEQ ID NO: 10761 - DNA, 3000 bp, Unknown; identical to SEQ ID NO: 10755
  misc_feature (1)..( 3000): cDNA_ID_2705047_gDNA_ID_2213671_Annot_ID_132805 3000 nt of promoter + ATG

SEQ ID NO: 10762 - DNA, 3000 bp, Unknown; identical to SEQ ID NO: 10754
  misc_feature (1)..( 3000): cDNA_ID_2716474_gDNA_ID_2213671_Annot_ID_132806 3000 nt of promoter + ATG

SEQ ID NO: 10763 - DNA, 3000 bp, Unknown; identical to SEQ ID NO: 10753
  misc_feature (1)..( 3000): cDNA_ID_2716466_gDNA_ID_2213671_Annot_ID_132808 3000 nt of promoter + ATG

SEQ ID NO: 10764 - DNA, 3000 bp, Unknown
  misc_feature (1)..( 3000): cDNA_ID_2716612_gDNA_ID_2213672_Annot_ID_132812 3000 nt of promoter + ATG
ataagatttgatatctaaatttttattaatttaatttaattagataaacgaaatacattattaattcccaaaaaagtaaccaattaaaatcaacaaattagatttgatatctaaattatcatattaattttttattaattattatagttcacttctcatctttatatgattccatttttgccgaaaaataatatcatcattatagaaaaataattagagttttttcgcatatgccataatttgaatttttaaaaacgaatataaactgttcaatacatgaaaaaatattataacgggtgaaaaatagatttaagaaaactttctactgagtaacatgtcataatttgaaatatttatattcaatttcatacatattatattgaaaatttataatcttatatactacaataattaataacatagtagatgtgatttaatttttaatacaagctggaaaatcctagaattgacgggtttagatcgatattaatacaagatggtatactacaggtgaaactcttaaattaataatcaaactacaagtgtataatcttaaacactaaataatatagataatatcaacaaaacatatacaactcacagtttactatacatttaaaatcaaataaaataatatcatatatttttaaatcatctttacaataaaagtttttagtttaactaaaatataagcctacctgcggtatactgcaggttaatatttagattacagggcttattggatctaaagacaagtcatcaaagatttcctaaactgaagcaaaatatactgaatattcaaatatctatctgttacctaattataaacaaataagttcgtaaaacaatttaatattttatatacgaaatcaactaaatcttaatcacataaaattagcacaaaaaaaaagtattcaacaattaaaaaattatcaaatctctatataacttttgatactatattcgaataaagtgtaatataccttttcaatttgtattctttaactaatttaagcgaactaatatatttgctaatcttatacctatcaaaaccgactatcgtttcttatctctataatatatttgcaagacttttttggtggatttgtataaaagtgcatatcgtcctactatattatttgggaagtacattttaaatgtaaccttaatttttgtaattaattacatgataatgccattagaaaaatttaatcaaaaacaaaatcttttaatgacatcattaagattaccaaaatcatttaacgacaatattcatcttttaattatagggcttattggatttaaagacgggtcatcaaagatttcctaaactgaagcaaaatatactgaatattcaaatatctatctgttaccaaattataaacaaataagttcgtaaaacaatttaatattttatatacaaaatcaattaaatcttaatcacataaaaattcgcacaaaaaaaatatggtacattcgggtctaaagtagttttgcaagacttttttggtggatttgggtaaaagtgcattcgggtcatatggtacattcccctattaaataaatatggtgcactcctatgttattagctaaaatgtttagattataattcaaagtcatatcataaataaaattaatattaataaaataaatggctttttggcaagacggatttggaaggacgggtttttgaatcaacattaataaaaagtaaaatataattaatccaccgtttcaatacgggttaaatctttaatttattatttttaataacaattaatatatataaatacttaataataattataaactgtaaaaatagaaatattttataaaaataaaatttgcaagttttaatatatattacttttaaaaaataaatcatcccgcggtataccgcgggttaaaatctagtttgcttttacttgggattacagaactttctttttctctctttgtgaactaaatgcattatgcattatggaagtcttaatgacactaacgattagggctgggcataatatccgaatccgagcacccaatccgaatccgaaatctcaaaatacccgaacaggttcgaccgggtatccaaacatatccataatttaactatataataataatatattattaatatttacatttgtaataatataattgtcaaaatatgcaattttttggatatttaaattatttttacgtatttaatctacttttgagtaaatttgagtaaaacattttcaaaatatttagatattttgtgtattttcgagtagtttggatagatttggttataaaaaaatttgatttttggaaattcgggtattccgaatccaaatccgaaatcttacaatacccgaacgaattgtatatttctaaatccgaaaacctaaaaattcgaaatacctgatccaaacccgaacgggtacaggaaaccccagacctagatgacgctagtacaacactactaagctacaaaatatttcttaattaagggattatgaagtttatgtagaggtgactctaaaagccataccaaaatttttaaaagtttaaactaaaagccaagtataataatttatctaaaaaatgattgatgcttaattatccaaactgaagaaagtagaatcaaattttataaagccgactcaaacaaagtgaaattctataacttaaatattttattcgaagagatatgaatccctatcatttaattattatttttatatagaaaagataatattaattaaaataattatttgttggcaagtgggcctaaatttgagcccataaagtataataagacagaacacattgctgatttgtagttttaaaacgacaaggcgttgcgaatccgctgaactcaaccggagggaaatctaattgttgtgttccttcctttcacagaccgatcgctgataaagtcagaatagttcggaacaagagacggcgagaaaagggaatgcgaagaagataacggtatagagaaaaggcactatg

SEQ ID NO: 10765 - DNA, 3000 bp, Unknown
  misc_feature (1)..( 3000): cDNA_ID_2705125_gDNA_ID_2213672_Annot_ID_132813 3000 nt of promoter + ATG
tggttgcgaggtagtgatgctttgtattttattactgcttcaaatgtgataaagagacacacacatgatctggttactgaagtttattgggttcttagtgatagtacttttgatgtagatggtttcccccaacagaacgttctagggcggttggtattgcaatggcagggtttcagcttgggaatgttgtaggactcatgttgtctcctattcttatgtctcaaggaggtatatatggcccatttgtaatttttggactatcggggttcctttggttgctcgtgtggctctctgcaacgtcaagtgcaccagatcgacatcctcagattacaaagtctgaacttgagtatataaagcaaaagaagcaaatatctactatggagaacaaacgaattagcacaagtggaatacctccttttggacgccttctctccaagatgccgacttgggctgttatagttgcaaattccatgcatagctgggtatgtatacagattcctctcaatacaactctttcattcttgttactatgaggatttcttgtggaagggaaattgttagtaccaactactgtgacttacagttatgatcaggtgttatcctatttgttggaattctttgaactgacttaatgacttatttccagggtttctttgtgattctttcatggatgcccatatacttcaattcagtaaggccctagtaccaacatgttcttaatataatcttgttcgttttagttctcttaagaaatttataagaatattgtaccgcaggtatatcatgtgaacctcaaacaagctgcttggtttagtgccgttccatggagtatgatggctttcacaggatacattgctggtttttggtcggatttgttgatacggcgtggtacaagcatcaccttaacgcgaaaaatcatgcaggtgcgtgatgtgtcacaagatttcattcaatcaagagctctctcagactgaagagttctgtaaacatatccgaaagatgttgaagcctgatgcaatgaaatctggtgcattcagcattctttttcttttgctgactgggggatttcatttcttgtttggcagtccattggtttcattggtcctggaattgctctcattggtctaacgacggcaaaacaacctttagtggcatcagcctggcttagtttagccgttgggcttaaatcattcagccatttggggtttcttattaatcttcaggtacccaagcgtgtgattcatacctaacccaatacaaatgatgagtatctttaacatttattcccacttgtttcaggaaattgctcccgaatattccggtgttctacatggtatgctttctaattctcctttaatagacattggtttccagagtttcctattgttttatcaaacacatatagctaatttgtaccatctgagaaggaataagccttagactcaatcaaatttttgttgggaatctggaaacatttttccaaaaatctctaaccgtttctgcgctgttttaggaatgtgtcttactgctgggacattagctgcgatagttggcacagttggagctggtttctttgtagaactattgggctccttccagggattcatccttcttacagcaatattgtatctcctttctgctctcttttacaacatatacgcaactggagaaagagtagattttgacacaacaggtccgtcccttctcttttcttgggttatgttgtttgctttacctgttcagtttcattcattttgaatcaatgttttgcataattctaatggtatatatatgctggtcttcttagcagcttgaaggtgaccacaaagtcacttaataggtggatcagctagtaaagaagttgcaactctatatagaatcagcttttgctctccaagtaaataccaggaacaagacctcggctttgtacagaaactagaatttcttcgtctcgatggttctctccttgataaataaatgaaaaaatgtagcaagttatctatgttcaatgtcgtgaatcgccttagagaagataatgaaaacaatgttgacgtagtatttgtttgttatacggttcaatggtatagagacacgaagactttcatcaaatattgtaatagttttagactgaaaaacagattaagggcgggcacagaagcagagaaaagtgaagttacaggtgcagatccgtgatttgggaccttgaggttctcgcacttctctacctcgtgatttgcatacacacgtgttcgtgcacctcagtcctggtaataatttcccactctagtcctctcattaccgtattgatacgtaagcgagccactacgtttggctttttactcaaattggttacctttttaattcctttcgttgccaaaagttcaattaaattccttacaaattacttattttcttttgatgaatgtccacattgcggttaccaatatttatttctaattaaattcttagaaaatgatcaatggtcccaaaatacgaaaacaatggtgttctttttacattgaaaataatattaagggtgttgctaactaaaaaacaaatagatgtgggggctgcttgttagatattttcaacaaaaaatacaaaaatgttcttcggagcttcctctgacacacaaaaacttcacttcactctctcttttcttgtgatcctcacattttcaatcactaaatcaaatcgccaaaacaaaaacagaaaatcaaatataaaacaatgaaaattacgtttctgtcattcaccttctgaaaaatatcttacgcttcttttttagtatatactgattctccgtagtatcttctcccttattaagctctgaagtgttggctcatctctttccagattccggcttcgaaatttggtaattgctccataatcttcggcactaccttggtgaaattgtattcgagtttcactatgattttgattttattcgtgtttaagcaatttttgaatactgtggttgttttagggagataagcgatg

SEQ ID NO: 10766 - DNA, 3000 bp, Unknown
  misc_feature (1)..( 3000): cDNA_ID_2716601_gDNA_ID_2213672_Annot_ID_132816 3000 nt of promoter + ATG
aaaagacaaaagaagagtatggcagagactgaggagtcttcatgggtttacaagaaccgagacgcgccggtggaggcgcgtgtgaaggaccttctctctcgcatgactttgccggagaagattggtcagatgactcagatagaacgctccgtcgcttctcctcaagtcattactaattctttcatcggtaatagtgatacaataacaccactgaacggtttttgtttttgttttggtcaacgaaccaaacttttctactttcctttcgaaaataaaaatcacaactttggttttacaggcagtgtacagagcggcgccggaagttggccgttggaggatgctaagtcgtcggattgggctgatatgatcgacggttttcagcgttcagcgttagcgtcgcgtttgggaattccaataatctacggcactgacgccgttcacggcaacaataacgtctacggcgccaccgtcttcccccacaacattggactcggcgccaccaggttcttaaacattctcttccactttaagcaaactttagtttctgcaaaagagagtcagagaatgagagagttttgcatataatggggttttaggaagtctatggatttaaagcttttgaattttgattaaaaagtttgaatcattttgttaagttacaagcaatgtcggattgttttaattcatgttccacaagaatttggagtttctgatgattttgcttcaattagcttttgatcacacagtagtagtactagctatgattagaatctgattgtgtttaagatctgtccatgtactgtgtttggttgttgttgatgtgataacaatcgtagttttgtgtggtatctcgatagagacgcagatttggtcaaaagaattggtgctgcaacagcacttgaaataagggctagtggcgttcactggacgtttgctccttgtgtggccgtaagtcccttgtagattgttggtatattgggatactaatttgtaaatattgaaatgaaattgttgttactcacaggttttgggagatccgaggtggggacgatgctatgaaagttatagtgaagctgctaaaattgtatgtgagatgagtttgcttatctcgggcctacaaggcgagccacctgaagaacacccttacggttacccttttcttgcaggaaggtatagatgtacatataaacattaaaatgcagtagacttgaataggcttgttgtcatttttcatggatttgtttacttggtgatagaaacaacgtgatcgcgtgtgctaaacactttgttggagatggtggtactgagaaaggcttaagcgaagggaacactataacatcatatgaagacttggagaaaatacatgttgctccctatcttaattgtattgctcagggagtgtcgaccgttatggcctcattttccagttggaatggaagtagactccactccgactatttccttttgactgaagttcttaaacagaaactcggtttcaaggtttattgaatatggaaaagaatctttataagctagaggtgtatgcattgagctcgtttaatgtactttgtcattttgttaccagggatttctagtttcagactgggatggtttggagacgataagcgagccagaaggttccaactaccgtaactgcgtcaaactcgggattaatgctggaatcgacatggtaacgaatgattttcatatgtttcgaatgatttatagaagacgaagattgttaatgaatgatatttcaggtgatggtgcctttcaagtacgaacagttcatacaggacatgacagatttggtggagtcaggggaaataccaatggctcgggtcaatgatgctgttgaaagaatactaagagtgaagtttgttgctggtctctttgaacatcctcttgcggaccgatctttgttgggaactgttggctgcaaggtgaggtatctatagctgaggccactattgtaagatgtacgagagcatgattgactatgttttccacaactgcaggaacatagagaagtggcacgtgaagcggttagaaagtcattagtgttgctgaagaatggtaaaaatgctgatacaccatttctaccactagaccgcaatgccaagaggattctagtggttggaatgcatgcaaacgatcttggaaatcagtgtggaggatggacaaagataaaatccggtcaaagcggcagaatcacaattggtagttgaatcgaattagaagatatcagaaaaaatgatgtggacacttatatacttgtttgttttgaaatgcaggcacgacgcttttggattcaataaaagcagcagttggagacaaaactgaagtcatcttcgagaaaactccaacaaaggaaaccttagcatcaagtgatggcttctcatacgccattgttgcagtgggggaacctccatacgcagaaatgaagggagataactcggaactcactatacctttcaatggtaacaacattataaccgcggttgcagagaaaatcccgactctagtgattttgttctcaggacgtccaatggttttagagccaacggttcttgaaaagactgaagctttggtcgctgcttggttccctggaactgaagggcaagggatgagtgatgtgattttcggagattatgacttcaaagggaagttaccagtgagctggttcaaacgcgttgaccagttgccgttaaacgctgaagcaaattcgtatgacccattgtttcctcttggtttcggtctcacttccaatttcggttaactggtttaacttcaccggttaacttgtattaaaaatatgcgattaccatatgaaccacacgtttaatttaataagttaatcaaattgatgaattttttacataaagcaataatcattaattaagcattttgagtcaaaatcaatgtgtcacgtctcatcttgttatagataaagagaaagtcgtacaacaactacaacgaagaagaagagtaaagaaaatg

SEQ ID NO: 10767 - DNA, 3000 bp, Unknown
  misc_feature (1)..( 3000): cDNA_ID_2716586_gDNA_ID_2213672_Annot_ID_132820 3000 nt of promoter + ATG
taactttgtagagacgcggatttggtcaaaagaattggagctgcaacagcacttgaagtaagggcgtgcggtgctcactgggcgtttgctccttgcgtcgcagtaagtctcctgcatacctagattttagcaacaagatcgaatatgttttggttttattagtcaactgaaagggatggtgttcttactaaaggtggtgaaagatccgagatggggaagatgctatgagagctatggtgaagttgctcaaattgtttctgagatgacttcacttgtctcgggtctacaaggggagccatccaaagaccacacaaatggttacccttttcttgcaggaaggtatgtttatatatattaacattgtggcttaatttgtgtctttagtatgcttaatttcatatctcatggactctggtcacttgatgatagaaaaaacgtggttgcgtgtgccaagcactttgttggagatggtggtaccaataaggccataaatgaaggaaacaccattttgcggtacgaagacttggagagaaaacacattgctccctataagaagtgtatttctcaaggagtctctaccgttatggcctcttactccagttggaacggagataaacttcactcacactacttcctcttaacggaaattctcaaacaaaaacttggtttcaaggttggttcagtttgaaaacaatctaaataaagctagagatgtattcattgtattcatttgatttcatattttttgtttggttattagggttatgtagtttcggactgggaaggtttggaccggcttagcgacccaccaggttcaaactaccgcaactgcgtcaaaatagggattaatgctggaatcgatatggtagtgaactttttttcattgtctcggatgatacaagagaatatataattaaaccaattaatgttattgtaggtgatggtacctttcaagtatgaacagtttagaaatgacttgatagatctagtggagtcaggggaagtatcgatggctcgtgttaatgacgctgttgaaagaatacttagagtaaagtttgttgcaggactcttcgaatttcctcttacagatcgatctttgttacctactgttggttgcaaggtgagctctcttgttctgaaatgctattaaactggagtgctaagattattgaagaccatataaaagatgatttcactctgttttacgaggtttaggaacatagagagttggcgcgtgaagcggttagaaagtcgttagttctgctaaagaacggcagatatggagaatttctgccattaaattgcaatgccgagagaattctagtggttggaacgcatgcagatgatcttggatatcaatgcggtggatggacaaagacaatgtatggtcaaagcggaaggatcacagatggtaactagagctactgcaatatggtttgaaaaacacctttggtaggaaatgctaaatggtctcgtcgaatttctaactatattgtttgaaaatgtaggcacaacgcttttagatgccataaaagcggcagttggagacgaaaccgaagtgatctatgagaaaagtccatcagaggaaaccttagcctcaggatatagattttcttatgcaattgttgcggtgggagaatcgccctatgcagagactatgggggataattcagaactcgtaatacctttcaatggtagcgagattataaccacggttgcagagaaaataccgactctagtgatcttgttctcaggacggcctatgtttcttgagccgcaagttcttgaaaaggcagaggcgctggtcgctgcttggctgcctggtacagaagggcaagggattgctgatgtaatattcggagattatgacttccgagggaagttaccagcaacatggttcaaacgtgtagaccagttacctcttgacatcgaatcaaatgggtatttgccattgtttcctcttggttttggtctcaatggtgattccgtggagaactctgacacggtttaaatttgttgttgaatatctttaacaaaatttcaagggactacttttctgttttaaaaatgattttgttaaaatcggttcatacattggaataagtttggaggattatatgcacaaaaaggtcactctcatgcttcatatgctaacagcttaagattggtctctcaaatatgttcgtcaatcttgaaaagacatgttaattagcatatcagttacatacgtctatctagccttgattatctctatattatgtcgtcaacacaacatttggttcctcctatttagactcatgcatcaaagcattttctcaaataaactattttcaagtctttgttttttaattcccacggtacgaattgttccagtagttgggtttttgtattcaattaatcattgaccaacatttttatgttttgagtcgtagttttatatttagacgacctttcaaaaaaaattagacaagtctttttttttttttttggggcaaagtcttccttaaagaacatagttgtggaaatattggatatgaaatatgtgttactgtttttttctttgttcttcatcatatttcatgttaatgggtagtctttttgttgaaatcatgtattagactagattaggatgtttaaacgatggttattatggttctttgctctatcatttatttaggttgtgtgatttatatactagatttgacttgatcattcaaatttacttaggcttttcccttagtaatcgaaaaaaaaaaaaatgtagaactggagaaaaattcagatcattactatttttcacttaaatctataattctttatcattgaactaatccactctaagctaaatttgcatatctagtcggctacggcagaacttcgtatgactttatcatgccacgtatcctcaaccttggcaatatataaaggttaagttgcaaacttgtaacagaaggataaaaaaataagaacaaaaggaagaaacaacaaatattgtgtatg

SEQ ID NO: 10768 - DNA, 3000 bp, Unknown; identical to SEQ ID NO: 6774
  misc_feature (1)..( 3000): cDNA_ID_1815548_gDNA_ID_2213672_Annot_ID_182385 3000 nt of promoter + ATG

SEQ ID NO: 10769 - DNA, 3000 bp, Unknown
  misc_feature (1)..( 3000): cDNA_ID_3037925_gDNA_ID_2213672_Annot_ID_182380 3000 nt of promoter + ATG
atataaggaatataaggagagaagttatgttttaatcaacggaaaatatggaattaggttggtatataaatatccgttttgtcatattgttatagaatatttgtttgttatggaaatattttttaatgtaactgaaccaaatctgtaataagttttaatcagtgcagatatcaagcttaaattcaaatgcatcataaatgccctaattggttaagcccaataagcccaattgggttattacgcaaccaaaattaaatgattcgtaacatccgcgtgctatccagtctagacccgatctatataccgaggatccgcgcgttttgtaatactaaatgttcattttacccttctacgaaaccattcatttattcttagaattcaaaaattctaatggcattctttgtaatatgtttagttttcaatgattcccaattaatagtatagatgttttattatatatttgttccatatgttttatttgtattttcatgggatatattcctaaaaaacattcatttttgttgtttgtattattgtcactaggaaactcacgcaatgcgtgggcttaataatttgtttttgaaatataaattgtaaattacatatgtatttgtttaaaaccttttgatggtgaaataaaatatcaaagagaagcatttaatgaaatgacttctaaacaacataaatcctactatattatttgggaagtacattttaaatgtaaccttatattttgtaagtaattacataggtatgccattaaaattaaaattttaaagagtaaattaattcatctctttaaaaattaaaaagtcaaaaactaatttaattaattaaattaaattaaaaaacgaaatacattattaatttccaaaaaagtaaccaattaaaatcaacaaattagatttgatatctaaattatcatattaatttttattaattattatagttcacttctcatatttatatgagtaacccattcgagttcgggtagaacccgttcgggtttgggattaatgggtatatgatttactacccaatagaataattctaaatatttggttctggttcgggtcgggtccatttgggtttggatcagtttggataaaaagttttaggccctaaaaattcctaaaaaaatagaaacgggtattttgtatgtagatagcgggtctccaaacaaaaaaaacttttaaatttgttaagttttaataaatttaattatatttgaatatattttactaaattttgacaaacataataaataatttttgaatagtttagttgttttggatatttaggtccaaaattaattaattgacatatttagatttataattataatcttagataattagattatattacgattaaagataattaatattttggatattaaattaatgtttgggtttttgaataccctttttgcgtaacgggtaatttttggaccaatcggatatccacgggtattaaaactctacccagtaaggaaatttcctaaaattctaactcgccctaacccggtttttttgttcggatattggattggttatcgggtccgttttttcgtgagccctatcaaagataatcttatgtaggactcaattaggttcacaaatataaccaaaatactatacaaatataatctaatatagggcccaattaggttcacaaatataaccaaaatactatacacagactaattttaagttaggccaaaaattagatcctctaatacaaaggaaacatgtttcttaccaaaacaatttgtatacaaattttacatatttacttaaaactacatatgttgtatttattataaaaataacatttttaaacaaagtcaatccaatgcaatattatatccaaatagtaaaaacattgaaaaatattatagtatcacttttatattatactatttcttatgtaattcaaataaagtatacaatttaatttatacaaaatattaatgcccgtgctgtatagcacgggttatgatctagttagtgagatttaaattgggatttatacatatatattctcatttttaaaccatgaatatacacacatagtggagtcatcactagtatatatctatttatcgagaattttcggcgattatctaaaaaaattggttgatggaaagctttaccttaggtggctattagacctcacataagataaatgacaatccaaagtcttgaaaagtcactaaaataacaaaaatgtttttacgatgtgttagttttagtacaaagagttttttttaaccgagcttcgggtgaaactttgtctcgccatttctctttatatgtagacatgatgaagccttctaattcgtatattgaacaacctctagagaaaaaaataaattattattgatgatctgcaaacttaagtccaaacaaatgcatgtgtgccatacatataatctatgcataaattacgcaacataatcacatgcaggggcggacctacgttggtcttgagttgggcatgtgatggttggatacatgcattgactatcttagtaacgtttcatttggtatataaatataatatgatggttggatatatgcatcgattatctccaatgttcaactttatttttttttctgtgctacagaaaatattgttgattttgctttatttcatgtctgtaaaatagattttcttctaaaatagaaaaaatatagaatagttttcttttttactctatatatagagtaatttctagattttgtctctatttttgaagtaactctattttaaagacatacaatggagaaaaataacctatttttactataaaataaaggaaaaaatagagttgtgcaatgaagatacttgtaacgtccgtgtcccgagttagggagtaagcaagatcttacacacgccgaattcgaggacgaattcagtttaagggggtagacttgtaacgaccgcgtcccgcgttcataaagaggccaggttgttttaggaaaaaactagaccatg

SEQ ID NO: 10770 - DNA, 3000 bp, Unknown
  misc_feature (1)..( 3000): cDNA_ID_3037975_gDNA_ID_2213672_Annot_ID_182345 3000 nt of promoter + ATG
tacttgaacttttatcggaacatctcttactatctcattgacaaaaggttcagtagtctcgacctgagcagtggcaagattggcgttatgtaaagtatctctttcttgatgatttgaatgattgaggaagctttgttgacccgtaaacttatccgtttgttggattctcatgatatcatctggacgagaagcatagaaagctgagctcacatatggcacatacattgtagaaccatcatttccctcccgcataatcggatcagaatgcatatgaggaaaagatgtctggcacatatgacaatcatttaccctttgaaaactttcagccatagttacttgttgatagaaacttccatcggggagaacaacatggttagatggtggaacttgagacccgccataaccatcaaatggtataccaggagaaatcgtaccttgatatgcagtgtttcttggctctgtaggaagcggtactaacttttgagcagcatgatagttccccaacagattttcttgggtttgcattaccgggttaatcaaaactggtgtggaactaatctgagaattcaagggagccattgacatgtgagcagcaggaaggaactggtgggatgagacacttaaaggactatcttgaaaaggttgttgggagaacaaagaagtactacttggcaaaagctggataggtgaatgaacaatatctggttgtcttaaagcttcttggcgagattcaacataggccggtggatgatgttcagatggtgtagtatacccctgttgttgctgctgcatcttaccaactattggtttctctgaaacagtctcaagctgaaaagaatgaggcggatcggcgtggacagtcattggcacaacataagcagaagagcgtggatcaggaggaacaagtcttgatacattactatgataagtctgaggtgaaaaattactcgaggtccaagtagttgcgacaaaatcactctgaccaacgcccaagctatcaacaacatccacgccactaaaatcagaattcggattagaactaccactagctacactttccttactcacaacaacaccattcacagcctctacatatctctgcccaatatcaactccatcaccatactccaatattccgaaagaatcatccacctcagacgaagaagcatcaaacaaaaaaactctcaacttccctgacccatcagaagatctctctaccaacttctcaaactcctccatcatattatcaatatcttcactagatgaaacagaaaccaaagcatcaagatcctcatcaggaagctgatacttaacaacaacagggtgaccataaacctgaatcatcttttgctcaaattcatcaaatctcacattctttttaacactaacgatccttgtttgaccaccaacgtaacgtaacatgccatcacttggtctagggattatctttccattgtagctacataaaaacttcaccttttccaattcttcatcatccatatcacttcttttattgcctaaatttggattgtttctattcgtagcatcaatacttacctgctcactcccaaacccagaaataattccatcagagacacgcttattactcaaatcagagctataatctaacccagaagctgaaagattggccggattagaaacaagattcgaacttgggctactgggttcatgtgccattgtttggagcagggagagggatagggtttatgattactcacctggtcagtatcgtggtcgtcgtattcgaggaagaaacgaagaatcctattttgtagagagaagaagaaaggagaggcaaagcgagtcgttggaactgatacaacgacgacgtttcattgggagtatcaaaacctcaatttggattttctctgtagtctttttagaatttttctaaaagggaaacacgtgagagatgggaagaggcacgtggtcgagcctcatgcaaaagaatggttgcgtttgttttccaaactgcgagagaatcgtgtgtgtaaatgctcccagttccaacactcgacatgttttttttgttttaggttattactgattattcttgaacttttagcaaaataatgaaacaattttgacttttataacacacaaaaaaagcaatacaatttcaaataataaatcgattaagagataaaaattgtgataatttggatattttaattagtttgtgcaatattcttttctcgttgatctctataaattagagaggcaaatgcgactgctaggagtagaaccttaccattggactacaaacgcttttgtgtttaagttgactattaaatttagatatctgattgtttaggatagtttaaaacgctaccgttttggaatctttatacgctaccgtgttattcttctttgaccaaaattctggagaatttgtcttcccttcgtatttctggcaacttttttaatactaaaattctctctaaagccgtcaaagaccaaaaaaaaaaaaaaaatacgaactcgaaatctctctcgtcttgttgttgcttaccattgaagctatcaatttctccgtttgatttctctcttctcaaaacctatttcgacggattattccgattcctgtttccccgaccttcacgcttcgtacttttgttttttgaaaaattcgtgtttcaggtacgttctcgatttctatttcgtttttttctgattcatcaatgaaacaaaatcgtttcttaatatacttgttgttctttgattcgattgatttttgttaggaagagcgcatgtgtagagttggtggtgtaattcagaaaactttccggagattttttggtgatgtgttgttcgtaggtaaattttgaaattttggatttaatggttgaggaagatagatggtgtttcttcaatggatctgtgaagacgagattgttggagattgatacttatcttattcgtctttatggctttgcttgattaagaaattgtgtgattgttttggggaggggtttaaac

SEQ ID NO: 10771 - DNA, 3000 bp, Unknown
  misc_feature (1)..( 3000): cDNA_ID_2705113_gDNA_ID_2213672_Annot_ID_132824 3000 nt of promoter + ATG
atcttgttgagctattacttgggaataataacttatcaggacatctcccacaaactttgggaaaatgtctttcgatggaagttatttatctacaagaaaaccattttgatggaaccattccagatataaaagggttgatgggtgttaaaaacgttgatttgtcaaacaataatctctctggaagtatatctgaatattttgaaaacttttccaagttggaatatctcaatctatccgataacaatttcgagggaagagtcccaacagaaggaatatttcaaaatgctactttagtttcagtattcggaaacaaaaatctttgtggaagcatcaaggaactgaaactaaagccatgcattgcccaagcaccaccagtggagacaaggcatccatctcttttgaagaaagttgcgattggggtcagcgtaggcatagctttgcttttgctattgttcatagtttctctaagctggttcaaaaaaagaaagaacaaccagaagatcaataattcagctccttttacattggagattttccatgaaaagctaagttatggagatctacgaaatgcgacagatggcttctcttcgagcaatatagttgggtcaggtagttttggtactgtgtttaaggcattgctccagacggagaacaagattgttgcagtgaaagttctaaacatgcagagacgtggagctatgaagagctttatggcagaatgtgaatctttgaaggatataaggcatcgtaatctcgtgaaactattgacagcttgcgctagtattgatttccaaggtaacgaattcagagctctcatctatgagttcatgccgaatggaagtttggataaatggctgcacccagaggaagtcgaagagattcataggccctcaagaactttgacacttcttgaaaggcttaacattgccatagacgtggcttctgttttggactatcttcatgttcactgtcatgagcctatagctcattgcgatcttaagccaagcaacatacttctcgacgatgatctaactgcccatgttagcgacttcggtctcgctcgtcttctcctcaaattcgaccaggagtctttcttcaaccaactaagctcagctggtgttagaggaaccattgggtatgccgcaccaggtaaaactattacacatatggaacgtttaaatgaagaatatttatgtgttccttttttcattacaatcttgttgtcgtttttgtgtgtgtgaattatggtgcagaatatggaatgggaggacaaccgtcaatacacggtgatgtatatagctttggggttctcgttttggaaatgttcactggaaaaagaccaaccaatgagttatttggaggaaactttaccctgaacagctacaccaaggcggccttgccagaaagagttttggacattgcagacaaatcgattcttcatagtggtctcagagttggtttccctgtacttgagtgcttgaaagggattttggatgtgggacttagatgttgtgaagaatctccgctgaaccggttggcaacgagtgaagcagccaaggagttaatctcaatcagagagagattctttaaaacccggagaacagccagacgttgaagtgtttatggttttctctacaaactttgccatccacttaaaagccttactttgaggcctatataatatcatactgtctttcgtaatctgtggtttgtttttttcctctgtttatgctctcttatttccatcattgtcttaaaccctaaaccctcgtttctctttctcgttgctgcaaatctaaaacgcataattgggctcctcaataaaccctaaaccagacaattcttggatctctatccttgtcttttcgttactgttttgatgcttcttgtttcctgctgttaggttttggaaactagactacagtttgcagtttcttggctgggaagtcatgtaaagccaaatacagagactctttaaatccaaagacttgggtccaatggtcgatgggtccatattcgtgataagatataaagcccatttagttttgtcaaggccccaagtactgtttaatgttgttgtctttcattatatgtaattgtatggttatgccataaaattgcactaaacagtgcatcatgcatatagacttatctctgtatttggtaaagataatccattttcttgaacgtatatctatatcaagattttaaagctttttctaaaaatctgattctaatttttgttaaaacaaatcttattagagaatgagataatctactctaaaacaagctattttcttttcatactttcgttttcaggaataaatcgagaaaatacaaatttcataacactcaatatcgagaaaacccaagtttgtgtcctcgttaggtccgtgaacccatctccatattcttcaaccccctacgtggcaatagatcaaaccgaagctatatcaaccaacacgtgattcattctcatccgtcagatcaagatcgatgaagccgcgatgaaagcaaaattttcccgaataaaccgcgtcgcttagtttagccgaatccttatcattcatcacctgtaaccgtctctacccgtggaataaataaataaaaccaatctcttctctaaaatagcacgcgccttttcaccgcctatatccggtaaattaattaaataatttactaatttttctctcttggtatataaacatacaagggcttttgtcttcttcttcttcttcttctctgtttctaacaaagttcaggagctctcgtaagcctctgaattcgatttgacctgacaaccatacaaaaaattctcccgagaaaatctctctctcaacgaacgaatttcgaatcaccaagaagaagtaagctctctctctttctcattctcattctctcttatctttcaatttctcgtaatcaattttgtcttaatctttatagcttttctcgatttatacagattctgagatttgtttgcgtttcatcggaataatg

SEQ ID NO: 10772 - DNA, 3000 bp, Unknown
  misc_feature (1)..( 3000): cDNA_ID_2705109_gDNA_ID_2213672_Annot_ID_132825 3000 nt of promoter + ATG
tcgggatacattccatattcaattcagctctgcaggtgttcgtggaaccattggctatgctgcaccaggtatgcttattttactttaaaatttataatcgttattaggtaattatctcaagcagagaccagacagtcgtcctaatattctttagtcttgttgttgttattactgaactttgtagaatatggtatgggaggtcatccatcaattatgggagacgtgtacagttttggtattgtcctattggagattttcactggaaaaagacccaccaataagttattcgtggacggtttaactctacatagttttactaaatcagcattgcagaaacgacaagcactagatatcacagacgaaactattctccgtggtgcatatgctcagcatttcaatatggtcgaatgcttgacccttgtgtttcgggtgggagtcagttgttcagaagaatcaccggtaaaccggatatcaatggctgaggctataagcaagctggtctctatcagagaaagttttttcagagacgaggagacttaacgagttgtcgtacgagagactactattaaagccacgagatataggtacgcatgtatatatatctctttactagatgtgtctgtatttttatgaatgtacgagtattctactgaatggtttgtagttttaaattattgtgccagtgtcatgggtgtatttgtaatgtgtcttgtgcaatgagacaggctattaaacattctctgtcttattcaataaaatatcttcacattgtagattaattttttttttctttcattttttcaattttttttactattaacattctaagtatcttgctgaatgagtctttccgcatcttcaacagcagctcccttgtcacatgcctcttctttttgtcttgctaactctttaaagagacgaactctataatgtgaccatttgattcaacctgcaggtacaaaaggagttactgacatttagaagacttattcacctatcctctcttatgaatggataagaaaatacagttttcatagctctcatgtctctaagaaatctgtatcagagtatggtaatgaggaatttgtacagctatggacccctgctgctggagatgttacctgaaaaggacgacagccaaagtgtcaatggtgaattatatagtttgtcacactctgagcactctttcattttcatgatgactccaaagaaagtcttaacataaaaagtattaacgagctttcgctattttttaattaccgcccacttctgttgactatttacaatactgttgatggcttccaatcaacatattgtatttccttaaaataacatatttcttctcttaatgatgcagggatgttgattattttccaattaattgattaggaaggcgacactcttctggcagaggtacttttgaataattactgccattttttaatatactttaccccctcaggaagggaagactacaaaattacacaaatatgtctttcatttactctcttcatgctcttgtgttctactgtcaggcatccacatacactgataagaccgataaacaagcaccgctcaagtttcagtaaactctaacctatcagagaacacctgagttgtcttggcttcatggaatgactctttttctctctgcaaatggactggggtcacatgtagtcggaatcacaagagagtcactggttggatctcgaaggaatgaaactaaccggtgttatctcgccctctatcggtaacctctatttcctcacatctcttagtctcacgtacaactcttccaatggtagtatccctcttgaggtagggaagctgttcaggcttcaacacttgaacctgagcaagatcattcttggaggtgggattccacttggcatatatatctaactgtttttcccttttgaccaatgatctatcctccaacaatcttgaacacgaggttccttctaaactgggttcgcttcctctgcttgtccttttatctctccgtgtaaacaacctgacagggaatttccctgcatctcttgggaacctaacagcaatttcaaaggaagccattcgcttaccttctttaccttctcttcttttttggtaccgaagagtaagaaaaagtctctggattgtgatgttagagctgatcaagttttaaactgaaaatgtgtttttctgcgatgatcatgctaaacttttaaagctgcaaccatttatttttgctatatatttctgtggttttttctgaaccagcagctttgaacgtgttcatgattgcagtgatcaatcaattctcgtcttaatctttagaaagcaagtttaagaggtaaattgcatttcttctttttcattttaattcaatcttattgacttggtctatgcaaaaatggaatcaaagaattatttgggtaaattgcttgattatttagtgttatttcagattttctgtcatgtaagtgtaacgtgtgttctgtagtttttgtccatctgagttactgggaagaataactgcgagcaccttcgctcaagctattggttcgaggctgaagtgtttttttggtttcctctacaaagtttgcaagcaatgaaagggcttgtcacatgtatggttgctcaatatcataaagtagtgttgtgtggtttaagacaaaagatgactgccgtgtgatagtaatgttccatgcttaagctaattaattgttcagattccagacatatgggaccgataaatccagccaccacatgatgcctatagaaaagtcagaaagactagttaaatgcgcatcttaatctttccttgtctttttaggcagttgacttcttgacttatattttggaaaaatctggtagttgatcattcctatttggcttcaagttgcgttagcactacaagtaggcattttgcaattgcttcgtctcttatatatttacttcctgcaaagtttgagaagaaccacaatattttaaccaacaaaaaaagaaaagagaagcatg

SEQ ID NO: 10773 - DNA, 3000 bp, Unknown
  misc_feature (1)..( 3000): cDNA_ID_2716580_gDNA_ID_2213672_Annot_ID_132826 3000 nt of promoter + ATG
tccataacttagcttttcatggaaaatctccaatgtaaaaggagctgaattattgatcttctggttgttctttctttttttgaaccagcttagagaaactatgaacaatagcaaaagcaaagctatgcctacgctgaccccaatcgcaactttcttcaaaagagatggatgccttgtctccactggtggtgcttgggcaatgcatggctttagtttcagttccttgatgcttccacaaagatttttgtttccgaatactgaaactaaagtagcattttgaaatattccttctgttgggactcttccctcgaaattgttatcggatagattgagatattccaacttggaaaagttttcaaaatattcagatatacttccagagagattattgtttgacaaatcaacgtttttaacacccatcaacccttttatatctggaatggttccatcaaaatggttttcttgtagataaataacttccatcgaaagacattttcccaaagtttgtgggagatgtcctgataagttattattcccaagtaatagctcaacaagattttgtaatcttccaatatcgtttggtagagagccactcaaagaattagattccatgttgaggtgaacaagggttgggatttgcatgatctccttaggtatagtcccatttaacttattatacccaatctgtaagtcgagcatgtgactacaatcaccaagactcggaggaacgattccttcaaaactattgttggataaatatagttttactaactgagtaaggttgcctataaaagagggtatctctccagaaaacctatttgaaaacaaaattaattccccgagccctacaagatttccaagagaggttgggagtggtcctgttaatagattatctgccaacaaaagtgattgtaggcctatgagatttccaatatcatgaggaatgcttccataaatgaggtttcctttaaggttcaaaacggtgagttccgtggacatattgacaatggatgtaggcaaagcacccccaagcctattgtaactcacagataacccatgcaaatgggagcaattagtcaaagcatcaagaaatgcaagatctccaaaagagtaacttcccaaagaattgttagcaagttctaggtaatgcaaattctctagttttccaaagttgggagagatacttcctgtcatcctgtttttaccaattccaaacatttccagagttgaaatattggcaagtgttgttgggatggctcctgttagaaaatttccatgcaaagataactcatgaatgtttggtagcagattaccaaaatcaggcttcaagttacccgagaaaccattaccaaggaggtataaattctcaagtgaggacaagttgtagaaagcaggaggaaaaacgccagagaagttgttcattgttaatgtaagagacaccatttgactcagcatagctatatcatctggaatttctccttccagatgattatatcccaagttgagcactattagagacgtcaagtttcgtataaatacggggaactttcctttgaggtcgtttagaccaagatatagataaagaagctttctcaatgaccctagttctgaaggaacaccgtctccaagattgtttgaaaataaatcaaggtacaacaatctagagcagttggacaaactggctggaatctctccttccagataattaaagcccacagccaaatatttaagtctaaacaagtttcccatctcttgagggatggttccaccaaaagagttattagagaggtcaagatatatgagaaacgaaagattaccaatagatggtgatatcactcctcccaactgcaatcctccgaggtccaaacgagtaactctcttgtgtttgcggccacatctaacccacttccagctgcagagagggaatgagttattccacgcggacaaggcatcccttttgctttcagaaacttgagacttgatctccaacaacgcttgcctatcactttcatcggtaaaaccatatgcttcgagttgcatgagagcattgaaagcaagtaaaagaaatagtctcatgcttctcttttctttttttgttggttaaaatattgtggttcttctcaaactttgcaggaagtaaatatataagagacgaagcaattgcaaaatgcctacttgtagtgctaacgcaacttgaagccaaataggaatgatcaactaccagatttttccaaaatataagtcaagaagtcaactgcctaaaaagacaaggaaagattaagatgcgcatttaactagtctttctgacttttctataggcatcatgtggtggctggatttatcggtcccatatgtctggaatctgaacaattaattagcttaagcatggaacattactatcacacggcagtcatcttttgtcttaaaccacacaacactactttatgatattgagcaaccatacatgtgacaagccctttcattgcttgcaaactttgtagaggaaaccaaaaaaacacttcagcctcgaaccaatagcttgagcgaaggtgctcgcagttattcttcccagtaactcagatggacaaaaactacagaacacacgttacacttacatgacagaaaatctgaaataacactaaataatcaagcaatttacccaaataattctttgattccatttttgcatagaccaagtcaataagattgaattaaaatgaaaaagaagaaatgcaatttacctcttaaacttgctttctaaagattaagacgagaattgattgatcactgcaatcatgaacacgttcaaagctgctggttcagaaaaaaccacagaaatatatagcaaaaataaatggttgcagctttaaaagtttagcatgatcatcgcagaaaaacacattttcagtttaaaacttgatcagctctaacatcacaatccagagactttttcttactcttcggtaccaaaaaagaagagaaggtaaagaaggtaagcga

SEQ ID NO: 10774 - DNA, 3000 bp, Unknown
  misc_feature (1)..( 3000): cDNA_ID_2705105_gDNA_ID_2213672_Annot_ID_132827 3000 nt of promoter + ATG
ttttttttagataatttaagtatttttgttacatttggttatatttggataaaaagtaaccaatatatttacgggtaatcgggtatttcggatagatttgggtatatatgagaaaaaacccgaacctaacccgaacctgaaaatattttggatatttttggtcatttttacatttttactaaaataaccgaaccgacccgaatcgaaaccgaaccgaaatttaagaatacccgaatggttctcaatctcctacccaaatagatccgatacccgaaaaaagaaccgaatctgaacgggtatccgaaaaaaagaactgaacccgaacggatacccgaattcacgtagaagatgtaaaaataatattagacatttattctagaaagggaatagaataaatgggcctcaatccgggtcggttaatctaattaggaaacgggtcattaaaacccgacccgctcaggctaatctctcatttcctagttttagggttcctcccggcaacgaacgcagagaaatttgaaaagatgaatccattgacgcaggtgaagaatctacagaagataaacgctagggaatcagatttaggaatatctgatgaagcttcatggcacgctaagtacaaaaactctgcatatgtctacgtcggaggcataccgttcgatctcaccgaaggtgatcttctcgccgtcttctctcagtaagtgttgtgtttcgtttctaaagtttcaatttttttaatgggtttataggtttaatgtctttttgttttgtggaattgcagatatggtgaaattgttgatgtcaatcttattcgagacaagggaacgggtaaatctaaaggttttgcttttcttgcttatgaagatcagagaagtaccattcttgctgttggttagtgaaactgactcttgtacatgtgaaatttactttttttttaggtgttaggatttgtaattgggttctgtttttggtgattgtagataatctgaatggagctcttgtgttgggacggaccattaaggtggaccattgtggggcatacaaaaagcacgaagaggaggatgaagagacgcgacgccagaatagagaggctcgtggtgtatgcagagcttttcagagaggagagtgtactcgtggtgattcttgcaaattttcccacgatgaaaaagtaagtaagcgtgattttgtactttattcttttcaacagatgattttgatgaatgcttgatagaagttaaccctttttttttatggacagagagctgcaaatactggttggggtcatgaagaggatagaagttccaagtgggatcatgacaagaatagagagggtcgtggtgtttgcagagcttttcagagaggagagtgtactcgtggtgattcttgtaaattttcacatgatgaaaaagtatgtaagcgagtaatctattctttcgagagatgattttgaataaatacttgatagaagttataacatactgtttatctcatttattttcttgaaaccttttttaatggacagagagctgcaactactggttggggtcatgaagaggatagaagttccaagtgggatcaagacaagttaaatggtgctaaaaagggtggtacaagttttggcaatcgaggagatttcaaacctgatgtggaagagaaaagttacagaggaaggggtgatggagatgcctcgtatggccgccctaaagagagagaaagagtggatagggaggatatggggccaaggtcaagagatgcttatgatatgaaggaacaaaagagatcaggacggtatgataatgcgtattctagaaggcacaatgatgaaattgattatgtaagggaggacaagggatccagagcacaagattgggagaaaaggaaggcagaatctagaagagatcgtaacgacagggaggaaaaagatagggattcattaagaagggaagatcgccgtcgttaaaggggtagatagtggtatgcatactcaatggttttcagttttagctagtgtctgtggaaatgacctttgttctttccaagagagttacctgtggttatataaactgcttcattctgtaacggggattctatgtttgttgtgacacctgagacttgttgatttttccgtttggaatgaaagaagtcgttatatcctttttcgtttatttacagaatttttgctatctcattataccttttgttgttagtggctgtgttgacctgtggttacagactcaggttctacagggatgagtgactctggctctccttgtacgtgtcatatggatggattagtgcaacgcttgctgttcttgtcatatgcaaattaaagaggtaaactgtaaatattttcctttcaattcctaatgactttgtctataaaaaactgaacaaagaattgtgtataaattactgtatcatatagtgagatttgaatttttcttctgctagatatgaatatgattaagatactctcgaattatttattttattgtattttgctgagaaatatatagaagcaagttggtgtatatcgaaatcgttgatgtcatggtcactgctaagaacttgacaaacatccctcagctacatttttataagaatggtcgttgctattagtgttaattaatcaagttttccttggtaaaactaaagtatatagtatttgataagcgtctgatagttgacttgggcgaaatgaagcagtgaataatgaggcaacatgagaataagtcattgctctattggactttgaccctaatagtcaacgaggattgagaataatctgcataccgcaggctgcaagccccgtggttttggaatatcattactttgtttgcgagtttctaaaaggctactatactacatattcctcattattgtatagggaaccaaagccgccagatttttatttgctcataatctcaacagtcatcctggttgtgaaagaattttttgtctccgtttcgtttaggaaaaaaaaagcttttccaacccatg

SEQ ID NO: 10775 - DNA, 3000 bp, Unknown
  misc_feature (1)..( 3000): cDNA_ID_2716576_gDNA_ID_2213672_Annot_ID_132830 3000 nt of promoter + ATG
gttagtctcgtcgcctaacccatacgtatcttcctcttcctcttcctcttcttcatgttgtgtaccttataaagatctgaacgtctttaaaattaatgggaaactagtgtataatgcggttcggggcttgatctgcataagtagactaagtatggggatttgtaaccctagcacaaggcagcttcagttttttccccaactcaagtacaaagaagatccaaaactttttacatgccccaattattttgttgggtacgattctattgaagatcaatacaaagtgctcgcaattgatcgttttcatttgagaatggagcacaagattctgttattgggaagagaagaagcttggagagaggctccatgtgttgcatgtcctcatgtttctcatacctcggggctctatatgaacggtaccctgtactacggggcgtctaggacggatatcgatccctggaataacaattctgtaattgtgagtttcgatgttaggcttgaaacgttcaaaatcatcaatgtaccaagcaaagttctaccaatgggttatgaaaatatgtggcttgctgagaggtggaggaatcttacagataaaactctgatcaactacaaaggaaaaatcggtgtggttgagaatgctcgtcaaggtagttttcgaatgtgggttgtggaagatgctgagaaagaggaatggtctatgaacactttttatttgccccaatctgctgctggccttgacttcaacatcatggataccttttataccggcgagatttgtcaggttccgaaagaattgtcagatcctttttcgtctattatggtcttatgagaatatgcacaatactaatatgtagatgtgtacgaataaaacttcgatcaactagggagaaaaatttggtggggttgagaatcctcataaggttttcgaaggtgggttgtggaagatgctgagaaagagggatggtccatcaacacttttcatttgcctaaatctgcttttttccttgacttcgacgtcacgtacggatacctttgatgctgcaacagcctcaatggtttttttttgttgacacaatggtttcttcttcagttcttgacacaaatgttaaagaagatgacgatgaaaggataatgaatctgtgaaagatgattagtaattatctgtcatagttctcttaaaagtgttcttaagtcttagtacatctaccttctgtcttttttttttttttaattgaatgtaaaattaattcaaaaccataaaaataaaaaactgtttttacatcaagtgctgcaactaccttctgtcatggttctttttctaattgtatccttgttaagttttcatttgtttccgaatcttgagattgtagttgatgatcatataaattatagaactgaacaaagttagaccaaatctataaatgttatagtcaacagtaaactcgaatccgtgagtgcagttccaagccttttagctctagatttggaggagaattgaatggtctgttctggaatgatcttctgtcatgtttgtttgaatatttatccaagacacacacaaaaaaattgtttgtttgcattcactttttgtttgttgggttgattttttaaaattcaacaatccatgatgatctaatgttctagacctatcattttggtaaatctataccactaaaaaattcatagttttatattttaaattagtacttgataaataaccgtaaaagtaatgaaaaaattatgtttgaaaatataatgattgaatataacttaatatatattgataactaccttgtttttgagttattatttgaaaaatacactttctttattttttaacaaatattacaacttttaatatataaaataacagttttgtccagatttaaaacaaaaactgttttcttaataaattaaaaaaaaaaaaaatttagaaaaaataaaataagataaagtcattagcttgtttatttttcaaatatttttgagataaaaacagtttattatttttatattaaaattttacaaaatgatatctaaaatattgtttagtctatcacttaataaagtttatttatttatttgtttggacgaattttatttaaaaatatttaagataagaattatctttaaaaattttagttgcatcaacttttaatttatggatttctttttattttaagttcaaaatatttttaactattgctaaattttagtgaggctatttaattatttatatattaaaattttaaatttaaaaaaagaaaaaaggatagggtatttttcaaatgaaaactcataaagaagttattttccaaatttactctaaagacaatttcttaaagatgaatttcaccaaatcaacatcataatttaatttaaatttcatgaagaaaagtatatattgtaaaagttctattattttgattccatttataaaaaaaaaacaaaatctgttaaatattgatgatgattttgttttaaattattcttaaataaaatctataaaatcaattctttttgttaacactataaaatcaattcttgtgatatttttcttaagacttttatatttccattgccatttatttcccctttttccttattcatattgtttcttccggaggaaaaaaaaaatagttttagggttttgtagagaaacaaggcttctgtccgattttgacagcaatctagccgatgaaaccgatttacattcctctttatctccagattaatatactcttaagattacctgtgaaatctttattgagattttgatgcgtctccaagctttggtcaactatcatcaccagccaagatttcggaaaacagcactttaatattacttcttcctcagctcctcttcgtctcctcattgcttttgaggacttttacggaggaaatcttctgttagtcttgtcgcctaaccgaaacatattttcctcttcctcttcatgttgtgtaccgtactgagatttgagcctactcaaaattaaaggtaaa

SEQ ID NO: 10776 - DNA, 3000 bp, Unknown
  misc_feature (1)..( 3000): cDNA_ID_2716572_gDNA_ID_2213672_Annot_ID_132831 3000 nt of promoter + ATG
gtttgtttgcattcactttttgtttgttgggttgattttttaaaattcaacaatccatgatgatctaatgttctagacctatcattttggtaaatctataccactaaaaaattcatagttttatattttaaattagtacttgataaataaccgtaaaagtaatgaaaaaattatgtttgaaaatataatgattgaatataacttaatatatattgataactaccttgtttttgagttattatttgaaaaatacactttctttattttttaacaaatattacaacttttaatatataaaataacagttttgtccagatttaaaacaaaaactgttttcttaataaattaaaaaaaaaaaaaatttagaaaaaataaaataagataaagtcattagcttgtttatttttcaaatatttttgagataaaaacagtttattatttttatattaaaattttacaaaatgatatctaaaatattgtttagtctatcacttaataaagtttatttatttatttgtttggacgaattttatttaaaaatatttaagataagaattatctttaaaaattttagttgcatcaacttttaatttatggatttctttttattttaagttcaaaatatttttaactattgctaaattttagtgaggctatttaattatttatatattaaaattttaaatttaaaaaaagaaaaaaggatagggtatttttcaaatgaaaactcataaagaagttattttccaaatttactctaaagacaatttcttaaagatgaatttcaccaaatcaacatcataatttaatttaaatttcatgaagaaaagtatatattgtaaaagttctattattttgattccatttataaaaaaaaaacaaaatctgttaaatattgatgatgattttgttttaaattattcttaaataaaatctataaaatcaattctttttgttaacactataaaatcaattcttgtgatatttttcttaagacttttatatttccattgccatttatttcccctttttccttattcatattgtttcttccggaggaaaaaaaaaatagttttagggttttgtagagaaacaaggcttctgtccgattttgacagcaatctagccgatgaaaccgatttacattcctctttatctccagattaatatactcttaagattacctgtgaaatctttattgagattttgatgcgtctccaagctttggtcaactatcatcaccagccaagatttcggaaaacagcactttaatattacttcttcctcagctcctcttcgtctcctcattgcttttgaggacttttacggaggaaatcttctgttagtcttgtcgcctaaccgaaacatattttcctcttcctcttcatgttgtgtaccgtactgagatttgagcctactcaaaattaaaggtaaaatggtgtataatacggatcggggtttgatctgcgttggaggtttttcaaatgttgcgatctgtaatcccagcacgagacaactgcatatttttcccgaattcaaattcaaaaaaagtccaaaagtttttccacgcccccagtacatgccgttgatactcttccttggagattagagcacaaggttattgtattgggaggagaagaagcttggagagagacttcgtgtatcgcctttcctcatattggctatacccaggggatgtgtatgaacggtaccctctactacggagctgcctggaaggacactcattccccggatagtaattctataattgtgagttttgatgttaggcttgaaacgttcaacatcatcaatgtaccaagcaaacttctaccagtggattatgagaatatgtgggtagttaagacgttgattcctacagataaaactctgatcaactacaaaggaaaagttagtgtggttgagcatcctcgtgagggtgcttttcgaatgtgggttgtagaagatgttgagaaagaggaatggtccatgaacacgtttcatttgcatgaatctgttgttggccttgacttcaaggtcatgaataccttttatactggcgagatttgtctggttccaaaagtattgttgacaagtattgttgacgatcacttttgtcttttctattacaatttggagaggaaaagcatgagaagtgtcacaattgaaggactgcctatacccgagcttaagcgactccgtaatgacctgtgactgtttctgatcatcatgagagcttcatgttcttagaaaccgaaagttaattttggcttttctttatatatatggttttttctggtaatcagggtgtgataccgcttttaccacttattagttcttctacggtgagtgtagccatctagtagctcactgaccgggttttctaatgggtagaaagcattgtatcccttcgaataaatcaaagataataatttcattgaacttggtttattatatatgagaacattagggcatctccatcagtcggatactttctgagtttctcaaaaaaaaaaagtattttaataaatattagttttataattaaatttttaattataaaataaaatttaaccaatagttgatatacatttgtttttatggatttcaagtgataaatgagtttctcatagtttctcactttagagactttctccattcacttagactaccagttgtattgacaactttccatcttgttgacttatggtggtgggatgcttgtgtacttaaattcagttcggtctaattcctcactttcgtttgaatcttctcttaagcatgtttgatataaatatttgaaaacatatataaaccaaaaaattatatatttgttctgactttaatacacaagtcagagaagtaaagagaaatacaatatatggaaaatatttctactacaagaacacttccaaattccaatgagggaagggtttgctagggttttcctttgattatttatagggttttgtagagaaacaaatcaatcttaaaaagaagaca

SEQ ID NO: 10777 - DNA, 3000 bp, Unknown
  misc_feature (1)..( 3000): cDNA_ID_2716560_gDNA_ID_2213672_Annot_ID_132839 3000 nt of promoter + ATG
ttggatatttaggtccaaaattaattaattgacatatttagatttataattataatcttagataattagattatattacgattaaagataattaatattttggatattaaattaatgtttgggtttttgaataccctttttgcgtaacgggtaatttttggaccaatcggatatccacgggtattaaaactctacccagtaaggaaatttcctaaaattctaactcgccctaacccggtttttttgttcggatattggattggttatcgggtccgttttttcgtgagccctatcaaagataatcttatgtaggactcaattaggttcacaaatataaccaaaatactatacaaatataatctaatatagggcccaattaggttcacaaatataaccaaaatactatacacagactaattttaagttaggccaaaaattagatcctctaatacaaaggaaacatgtttcttaccaaaacaatttgtatacaaattttacatatttacttaaaactacatatgttgtatttattataaaaataacatttttaaacaaagtcaatccaatgcaatattatatccaaatagtaaaaacattgaaaaatattatagtatcacttttatattatactatttcttatgtaattcaaataaagtatacaatttaatttatacaaaatattaatgcccgtgctgtatagcacgggttatgatctagttagtgagatttaaattgggatttatacatatatattctcatttttaaaccatgaatatacacacatagtggagtcatcactagtatatatctatttatcgagaattttcggcgattatctaaaaaaattggttgatggaaagctttaccttaggtggctattagacctcacataagataaatgacaatccaaagtcttgaaaagtcactaaaataacaaaaatgtttttacgatgtgttagttttagtacaaagagttttttttaaccgagcttcgggtgaaactttgtctcgccatttctctttatatgtagacatgatgaagccttctaattcgtatattgaacaacctctagagaaaaaaataaattattattgatgatctgcaaacttaagtccaaacaaatgcatgtgtgccatacatataatctatgcataaattacgcaacataatcacatgcaggggcggacctacgttggtcttgagttgggcatgtgatggttggatacatgcattgactatcttagtaacgtttcatttggtatataaatataatatgatggttggatatatgcatcgattatctccaatgttcaactttatttttttttctgtgctacagaaaatattgttgattttgctttatttcatgtctgtaaaatagattttcttctaaaatagaaaaaatatagaatagttttcttttttactctatatatagagtaatttctagattttgtctctatttttgaagtaactctattttaaagacatacaatggagaaaaataacctatttttactataaaataaaggaaaaaatagagttgtgcaatgaagatacttgtaacgtccgtgtcccgagttagggagtaagcaagatcttacacacgccgaattcgaggacgaattcagtttaagggggtagacttgtaacgaccgcgtcccgcgttcataaagaggccaggttgttttaggaaaaaactagaccatggtcaagaaatggactaaaatacttagtcggaagaacgagaaagttcaagctgaaccagctaggtgagctggacaaactaggatgaactagctagctaagctaggtgagctaaaccagatggaagactagctagctcagctaggtgagctgaccaacagctcgactgagctcggtgagctgatcgagtactgacccagttgggtggtccggtcatctgacactcgagctagttgactgtggtagctcacgggtgaagaggtgtctcggccaaaaggtgtaaggtcgagcgggtaccaacgaacagttgcatcaccaaaggatacaaagaacggatgtgacctttcggaaggatgcaaggaacggatgtgacctttcggaaggatgccaggaagggatgtgatgcttcgggaagcatccattcgccccctatataagggaggacgcccaaggcctttggaatcatctcacaacattcaaaacaccacaaaacattcttaaaagagtcccaacacatcctgaagttgttggtcggaaaggggtgcggctcggcgagtataactcgaccgaactgatgcgcatactacctcccggtccaacggttcgatggagtgtagaggatggagagggtagaccgttcgtcttagagacgaatcagatctggtagaccgatcgtcggatcggatcggatcggccagacggattggatcgcacagaccaatcgtcggacggatcggatgggacaggccgatcgtcagacggaagggtcagatagactgatcgtcggatgggatggatcgagaaaagtgttcgaggaagcacaaggataagtgcatccggacacacccaagggtcgcccatggatgcaatcttaccggtaaagggagaaagcaccaagaatgggtaaggaacgtgattcaccatatgggatcaatatcgcggctgccttcatgtatctatctccttagccatggtgaaaccgatcggagatcggtaagaccaaagggtgactcgacggataaccaacgggaaagtccacggtgggaaccgatggacaaaacggatgttggacccgtgagcaaacctaacgccgacggaggaaggatttcatgggctagcctacgatgatccgatggatgaatccacggacccttgggtgtgataaggatatcgttcggaccgcatggatggatcattaagccgaaagctttatcgaccaccatggaccggacgggtaaacggttagtaaaccgtgggcggtcgtagtgttaaacgaccggatcggaaacatg

SEQ ID NO: 10778 - DNA, 3000 bp, Unknown; identical to SEQ ID NO: 10774
  misc_feature (1)..( 3000): cDNA_ID_3037951_gDNA_ID_2213672_Annot_ID_182364 3000 nt of promoter + ATG

SEQ ID NO: 10779 - DNA, 3000 bp, Unknown; identical to SEQ ID NO: 10773
  misc_feature (1)..( 3000): cDNA_ID_3037955_gDNA_ID_2213672_Annot_ID_182363 3000 nt of promoter + ATG

SEQ ID NO: 10780 - DNA, 3000 bp, Unknown; identical to SEQ ID NO: 10772
  misc_feature (1)..( 3000): cDNA_ID_2705109_gDNA_ID_2213672_Annot_ID_182362 3000 nt of promoter + ATG

SEQ ID NO: 10781 - DNA, 3000 bp, Unknown; identical to SEQ ID NO: 10771
  misc_feature (1)..( 3000): cDNA_ID_2705113_gDNA_ID_2213672_Annot_ID_182361 3000 nt of promoter + ATG

SEQ ID NO: 10782 - DNA, 3000 bp, Unknown; identical to SEQ ID NO: 10767
  misc_feature (1)..( 3000): cDNA_ID_3037960_gDNA_ID_2213672_Annot_ID_182356 3000 nt of promoter + ATG

SEQ ID NO: 10783 - DNA, 3000 bp, Unknown; identical to SEQ ID NO: 10766
  misc_feature (1)..( 3000): cDNA_ID_2716601_gDNA_ID_2213672_Annot_ID_182352 3000 nt of promoter + ATG

SEQ ID NO: 10784 - DNA, 3000 bp, Unknown
  misc_feature (1)..( 3000): cDNA_ID_3037967_gDNA_ID_2213672_Annot_ID_182350 3000 nt of promoter + ATG
tcctgcttcttcccctcaccaccagcagcaatacaaatctttcctttagaaactaattctttactctctggtttgacatttttaatcgaataccaattcgaatccctaagttccttctctgtaaccaataacttagcaccatgaaacaaacctacagtttcaggtgatacctttgcattcgatatacctctcaattcatcaacctcaagcaatccttgtctcttaatcgaaaccgaccgatcaaaactccttctccgacgagaatccgagtaatagttcttcgtttgaaccgtcccacctggactcttctccttctcctctacttcttcttcttcaacaccacatttagctttagcatcttccgtcacagtagacaatgtcgtaagcttgtgatatgatttttcaatcaagcaaccatcccatgaagacctaggtttctcaaacgagatcctacctccatcaaaagacaatctaggatccacatcagaagagtgacgaccattcacaattccggcgaatctggaatctgatttttcgtcatttctcttattcaatgtaaaattcttcaatctcctgctcaaaaccgatgctatttccttcaaatctttgccattgttcttcttaatctggtttctccaatctagatctatgaactccttcatcgtcttgttctcttcgacgatcttcctcggcttgccttcatcaaaaccttttatatcttctccatcgtagtaatcttcttcttcttcttcctcttcttcctcctcttttaaatctggaaccagaggctttcgaatcgaactatccacccgttcttcgtcatcatcgacaaacaagtccaggagagagcttgcgcttgacctaacgtcacatgatctccgtcgcggctgatccgaaacggagactgatgcgttacgaacggagtatgatcgaatacgacggagctcgggagtctgaacggcggcgagagaagaagactgagcttctattgttacgagacgttcacgaagacaggaagcgcagaaaccgctggttggtttagcggaagggtgacggtggcatgaggaggaggaacgacggcgattggtttgtttgacgttagccatggctgacgaatagttcgtttgatttgcttgcgtgcggcggtgacttaagagagagtgtgtgtgagagtgtcttgatgatagtgtaagtgttgtttgtagggtcaattatggaaatttcacttaaaccctttcttcaattttctatttgttcagtatttttctcttgtattaatttttataaatagtacaattttaagttttcttcacaaaagtaatattcaaaattattttggacataaataatacctaaacaattattttattttaaattattaaaattaaaaaattataaaatacacaaattcatcgccaaatatttccgacaatattttttcgaaaaaaaaatttttgtccacaaaatatttgagtgctattgttgtcatttttcctttatttttctaggtcacatcattcttttgggtatttttgtcaaagatctaatgtaaattatccataacactctatagttagtaaaaaagttcgtaaaaaatattatttacaaaaataatcttatatgaatactcaaaaattatggtttaattacaatttacatgcgtatcataattttaatataataacatcatattgaagcaaatattcgtagaatttacttaagtttttttatatgaaaagtataagtaccgtatatctagccatttttcgttaaagaaaatgtgttgttttttgtttttgtattggattgaatggtagctattataatagcggtacaactttaacagttaccaatcacaataactttatcaaaagcgttacaaaaagttttactctcagtttttttatacagatttagatttattatacagcttattttaacagctttgcattattccgataaaactaatagctaaaaaactcgtacaacttatagttaccaatcacatccattaccttttcttacttaattatcgtaacaatagaaaatgtgttaattttgtataactgtcaatcaacaaataagttaacacttaacatagcccaccgtcaatatttggccgtttctatgtgtcaactctttggattccattctaaatagataggtcaaagtcaactttttctatttcattgattgaatatgtttatcagcaaatgaaatcttggtttaataattggatgattttgttttaataattcgtgtatgatatgcataatttgaataattgcgaattttaaaaggaatctatggagaatacgactacagttaaagtgaccaacacgagtaacatagagattcggatctacgacaagttcccaagagaagaaactgtgttcttcaaaaaacattagtaagtcccgaagccaagacagtgtttattatatttactgtttaccattttatacttttctctttttgtcgatatatacagatttactgtgattattttcattttctgataaagattggaatcttccacgtgtttaccccagatacagtgactgacaattattttattttattttttccaaggcataatgagagtaagatattagaaaagataaggaatgctcctaagaatttctgttcaaacaacaaagattttttggataaatatgcactaatacttgtatatttggcacaacaacacggtattaaagtctaaacatttttatttaattatttatgacatctaaattttgaaaaaaaaaagttgttttacatataatattggctttatttccaatttagctcctaactttctattttctctcacaaaagagaaaccaaacaaggttttgattaatttgtttagctaaaaataaataaactgcattatacacttcaaatcgtgctaattaggaagcccaaatcatatggaggacgagccacttttaccacttatgggcctgttattagtggcccaagacgagacggatg

SEQ ID NO: 10785 - DNA, 3000 bp, Unknown; identical to SEQ ID NO: 10765
  misc_feature (1)..( 3000): cDNA_ID_2705125_gDNA_ID_2213672_Annot_ID_182349 3000 nt of promoter + ATG

SEQ ID NO: 10786 - DNA, 3000 bp, Unknown; identical to SEQ ID NO: 10769
  misc_feature (1)..( 3000): cDNA_ID_2716557_gDNA_ID_2213672_Annot_ID_132840 3000 nt of promoter + ATG

SEQ ID NO: 10787 - DNA, 258 bp, Unknown
  misc_feature (1)..( 258): cDNA_ID_3038063_gDNA_ID_2214449_Annot_ID_182389 3000 nt of promoter + ATG
caatttaaatcttctgatctagtttagctgtctaaaacacgcattgagagtctacacttgtttatgaacttttatcgtagtctagcaagtcacactggacctaaatatttggaatgagacttcgtattgtaaacctggatattattaccagtagttgggagttggtcactgtccccatttgtatctatgctagagaattcttccagcaatcaaactggaattatgaattcatcctcatcctgtattggcttgtaaatg

SEQ ID NO: 10788 - DNA, 3000 bp, Unknown
  misc_feature (1)..( 3000): cDNA_ID_3038049_gDNA_ID_2214449_Annot_ID_182394 3000 nt of promoter + ATG
acttggattgtacatcacttttagtgtacaaatatatataaaaatacacagcgtacattttacatttgtacactaaaagtgatgtacaatccaagtgtacgaatcaaacagtgaaaagtgactattttgcaaattatgaatagtaaagtgactactttcctaattaagtttgaaaaaatgactattttgcaaacacacccttaaaaaatttatggtggaatggataatctttatacttaaagcttattcgatgaccaactatgattgtagttatagtaatactatggcgtataaatatactgtatagagttatttctctgcacaaaattttaattgcatgttaaaacaataagacagagcactcactgacagtatccttttctcttacgtaagacattgaaattaatcgggagcgaccttgcaagaaatcggtatgttaataaccattaattccaggcattcggttctggtttggttttggattcaaaagctcaataaataaataatcgcttttattaaccaattgtacaggtcctagcgtttgcagctgcattgaagtcgcgtaagataacagcaagcgtaaggcaaacaagaggacttggagcgagtgctgcttgtggtcagttgagaaataagtttcagaaaagcccttcacttgccactggtaggctctgttcaactttgatttgaaaaggagagatggctcagtgacgaaaaagtgaaagttgcgtttacggttggttggtcagtgcagctgagggtgaagtgattgaagcacgtttgagaagtgaagactttgataatagctgcataggttttgcatttacttatatatgtgatgcatgcgttggtttataattatgacaagtgagcaaacttaacgagtgttgttgttgctaaatgaatgatattaatccactacagttgtaaactacaaatatacaaagcagtaaaaatccatgtatgatgattaataagaagctttcgaatggatatagaaaaaacttgaatcattgagtgtgaaaacataagtaatgtataactttttttttgttatcaagttgtaaacaactgaatttagattttggtacataaaacaaaaataaaattacaaacttgaagacaatttaattacaaagtgaatgatgtatgtaattggcggtagacttcatgacacatcataaaaagactacacaactcccattacaaatcttgcaaaacaagaataccaacatctacttttttttgcatatcctaaaatatgtttcgttaacataaaaatattacaaatatcattccggacatctcccatttttttttacgtataatatcattccggatatctcccaattttttacgctatgttggacttagaatatgctatgttggacttagaatattcttctaccatcctatcaatcataactactctgataatatggtgaatggttagataccgatgaatgactcattcgcttgttgagaaaaatcacaagaaaacaaagttgtctcctcctgaaaatagatctccgtattccgataaaaccaaatacagagagcacgggactggtcgaaactgacacatggctggtgacaaatagaccgggacatcgaacctaatatctcaaaacctcaatctcaatctagctatagaagctactcaagagaagtaaaagaaagtacctttctatgagacaagaccatgactcgatttaacagcggaacctgatctaagaacctatctcaacttttgtgttaagatggagttacagatcgtagttgcagagcttgacggcgctcatgtttactctttttgttaaatgacgtcaggcttagccgcttaggtttagatttatgaggtcggtaatgagtgacttgggtttataaagtcccatcgttttccctatttgaccttttttgttatgtaaagagtacaaagcctttttgggtcaaattggtatgtatacggcaatcttattaaagttggatatattttgtcaaattgtttaactctgttttttttttattggaaaagaatatattacttatagtcacgttgaaacttaactgggaaaataattttctttttgccaacataatcacgttgagacaaaactgaaatatattggaaacaaagttaattataactcttttcatataataaatttactgttaaactatacactatccaattttaaaatataagagatttatgttaaaactaaccgatctcaaaatatcctttcaagtgttgattatcataatttagatataaaattaacaatacttacctatataaaattgggttcttgacaatcaatgtccaagatctctgttcaaacataaaatttcaaagattaaaatttcaatagaaacatttggaaataataaagtcaaattctaaaacaataataaccttatctctttgtaaaattccgttgttacgattaacagatgataaacgaagacatagtaacttgattatcagacaatttttgcaaatgatttgtattacgaagaaccgtctggtttatttgggtgtgttttagtgaagaggatgataagacaagacctgttctgttctgtgaaaaaaaaactttcatctattcggaaaaaaacaaatagattagtttgtcgtttttattcatttgcggccactttgctctagcagtacgatttttgttatatactactatagcttattttattttctcttaggagaccattagatctagcttcagatcacgcaatgcggtaataatgataattaaaggcatgataacactttttgatcattttacttcactttaaaaataaatataatatttataaaaagataagtcaactccccaatgttaaagtttcccaaaaccactgaacctaaaaaatcacacatagcctatataaagaaggcaaagcattctttcagactcacaacattaactatatatctccatcttcttaaaaataatcatcactaaagatataaatacgacaatg

SEQ ID NO: 10789 - DNA, 3000 bp, Unknown
  misc_feature (1)..( 3000): cDNA_ID_3038045_gDNA_ID_2214449_Annot_ID_182396 3000 nt of promoter + ATG
ggtcgataacgatccatgatctctctggttcaccagtagctatggcttcaatggtcacacctttcgtaccatctcctggttccaaccgcgtctctcggtctagtcctggagcttggctaatcctcagacctgatggctacacctggaagccatgggttcgccttcaggcatggcgtgaaccaggcgtctccgatgttctaggttaccgtttcgagctttataaagacggtatcgctgttgcagtctctgcttcctcgtcgatcagcacaaaacttggcgggagtttcatcattgatggatccacttctacgactacgactgcttcttggagtagctctgaaggaagtttcgatctttcttcgtggtcaagcatcagatcatcaagaactgattcaggatcggggtcggatttcaggttctcactgtctcaagcgcaacaaaacttggggtttgtgatgtcgacgagggtgcaaggagtggagaaacagagcaagcctaaggtggaggtaggtgtgaagcacgtgacttgtacggaggatgcggcggcgcacgtggcactagcagcggcggtggatctaagcatggatgcttgtaggctcttctctcagaagctaagaaatgagctgagacagccaagtcgtgttgatatcgtttgacgtttattgctttgtcgttttgatacatgagatagaattgtcagttgtcttccactcgctagttttttttttgtttctagtgagggaaattggggaaatttgagtaaagtggaaaagtctttttgaattttatgtcaaagtttggactttcgagttttgaattaacaggctttgggctttgggaagcaactaagcataataagttcattaatagttcaattccactggcataaaattttatccttactggcccatatttccttgcgaaaagtaattcacgaaaaaaggagtgaaaaactatgggagctatcttggatcgaagacaatcatacctggcttcaggtgtcccaagttttagttttgtatatttggttgatttttttttgttccacttggattgtagttttacctctgtgtaaagcgaaacggccctctcttttgtgatcatcatggaacctcttagagatagttatatatatcagttctgattctcaatatttagagacaaaaaaagagaggttggaattaactgtgaatcattcccaatggaaatatacaaaaccaaaataaaattgtctaagattacatgcaatataatttgatattttttaccgaatcaaccaatagagtacataaaaaactatctatatattaataatctaatattactatctcaatagtgtttcatatagcgttgatcggtttaattattgtggtgatcgagttttgacaattttataaattattggcgttgatctgttatcatgaaagtattaaaaatattaatttttgaaaggtacctaattaaattgtaattgcaatgtcgatgatatgatctctacgtatatatgaatacgacttttaactattccaattttttttttttttaaaaaactttaacactaaaaaaagattgaaccgacaacgcaaaaccaccattatattagctgctagctagaccaccacctctttgatccattaaactattacgcgttcttttatcttttagttcgaatccgaatgtatctttaccttgctcgcatgtatatatgtaatgaatcctttagcgttcaacccacgataggttaatttatggtctactatcttgatccacttggtatcttccttattttttttactatttatgtacgtcgttttcctctcttttttttatgtcaaatgtttacgtcgtcttctttacactctatctactgatatttaacgtttgatgtggttggagaatggtacaagtagatagagtttgttatctaaactaagttctatattaacactatgagtactgtcccattaacgttgcaaccggcggaggatcacggcctttcacatgccatcatatgtaaataaataaacattgatattaaaagtacacatcttcaaagcttaaatacatgtatatatgacctatccagaagataaaaaatctctattcatgaatatatcgttttgttttcaggaattaatattgtaatttaacataatttcatgaatattattactattgtcattttcgataaagtgataatattcaggatcctcttttgaagaaaatccgttttaaaatattataatttaaactcaccagtttattttacaattctaaattaaaagaaaaattgttcgaaaattacaaacagatctagatatatatgacctatccagaaaacaaaatatagaagagtgcaagaccatgcaaatctctattcaactttcttcttcaatggataatgctaaatatgtagataattacggtttggtgatctataagaaattaaaaatctgtattcaggaattaagattttaatttaaaataatttcatgagtattattactgttgtcatcttcgaaatagtaatcatattgaggatcctcttttgaaggaaaccagttttaaaaatatatatatatatatatgtatatatatatattcttataatttaatctcactagtttaatctaaaattctaaattataataaaaaatagttcgcaaattacaaaatgcattttattagattttatccttttgtttcatttgcgctaactattctctctagaagtatactttaaatacatatacactgcttattttatttctgttttgaaaccatttgatttagcttaagattgcttaattaatgatgaattcatgacttaattaatctatatacaaagaaaagtcaccatttccccattgtaaaagtctcccaaaaccactgaccctaagcatgtacttgcctatataaacaagaccaaagtattactcaaactcacagcataaacaatatatcaccctcttcctagaatcatcactaaatacgataatg

SEQ ID NO: 10790 - DNA, 3000 bp, Unknown
  misc_feature (1)..( 3000): cDNA_ID_3038055_gDNA_ID_2214449_Annot_ID_182392 3000 nt of promoter + ATG
ctttacccggaggaggaacctaaaaccgaaaaaccattacactactctttagcagcaactactaaagatgagagtaacctacgatagagaaccacatcagaaggaactagaggtacaatggtccaatagtccatacccatttcttgttggcaagcacagtttgcttaactgcctcgacaaattgttctagagtaggaggtgtcatacaaagcctctccgcaccagtttgcatgcgaagagcgttttggtcaggccggaaaatcctaatccggtcgtcttctgttctgtaagctttgagaccttcaaatagtccctacaaagccaaaccaatatcaaaaggtatagacgctaaagttgctgacttttacagtcaattcaaacaatcattgattaaaggcttcaaatttcttaataatgtttctgataaataccgaagttcctacaatcagtgagatttggtaaggcttatacaaccagagaaagcaaattagcactaatttgatgaagtaagagccataatggtcctcaaaacctacctggccgtaattgagaatcggagaacaagggctaattgaaatgtcgccataaggaacaatcttcccttgtgtaaagctctctccttgtctgcatttggctacatacatataatctattggagtcagagcgaatccaagctcttcccatttgacattcgcatatttttcatctgtttcactgatttgatttcaatgcatgcccaccaaaagaaaacagaaaatgagtaaaatgaatttaaatgaacaaacacgagataaccccagatcaggggattctaataactataaatctgtccttttttttttcttctcatttatcataaaaagatgagacctttttataccttgtagtacgaagaggtgatgaagaaggagccatctatggagaaatagagaaagcagtagtgaagtgaagcagaagaagagaggcgtgtagtggtcacgtggtttcaggagcgtctttttatagtgtgactgacaacaaacaaacccttttgattccttctccacttttttcttttaaagaatttgttgatgggaatatactaataaattgtagaatcttcaactatttttctttttatacgaaggttgatgggatggctaaagactttttttattaagctaaagtggccgttctttgttgagaaaaggtgtctttaattcattagtaccaatacattgcaccgagactccgaatggagagtaaaccatatagtgcaatgcagtttcatagtaccgaaaacatttacatattattgataccgatacattgtactattttttttttctttataatcaggataatcagaacctttacaaccggactatttttttccaaaatgataaatttttagtttttatttcatttttaataataaaatatatctattactaaaaattaaaatataaaaaagaagttacaaaatttatcgggtgaaaatggagtaagattcaagttgcaatgaattgttgggcaatcactcactttgttaaattcaatggttcaccaattaatccgacgacaaagttcagagatttagttccagttgattcgcttttttactacagtcacatttatgccaacaaagctcaagtcaacaacatgtttgctaccacgataaatatgttttgctttccctttatcatttttttttttgtttgttttagattctaaacaagcttcgtaactgatatgatttgtcttccatggactactcatgagcaaaaaatcgttttgagtaatcttgatagaatcctaaggagtattgttgcctagttttgcatttgttactgattcagaagaggtggccataaataatgaactagctcttaccaaagcaatccgtgatgtaaatgaccaaattttatggattttatatgatttggtttcgtgtgattatagataaactaactcgcaaaattagacaacttcaaactatattgttcaattacagtttcaatgttttgcaaaagacaataggaacaacattttgctaagaatcaagacacctagatagttttatgttcatgtaaaagacaatcagtgaatgcaagtaaatacttaagatagaaagacaaaaagtctagcctactttaaaatccatgatacataatccaaaacacactaaattgaatgtttaaggaactactactgtatagtatttctaattagccgagtacacatttttaagatgtcgaaaagatgctaaaattgaatatgaaaatataattacttctttgtaaattaggtgttttttaacgaatcatcatatgtacaaaaatatgatgagccaatgatttattgaattagatacatgtagaaaggatttgtatgatcctaaagaacttcgaaacgaactaatcaaatggatcaaaaatatgattgcagaatataagaaatgttgggctcatgttgggctgaaataagacgtagagattaagttaagctaagctttctaaagtaattgtaagcttctcctgcagaggagaatagaagtcatcaaacaaggatctcagaaaattgcttatctccctaatttcttcatctccctctaaactctcttccagaatccttgctcaattctcttcatttgtgatctcggctctcttatcacgaagacttctcccggcggcaccgtcttcacatttctgctcgtcattctcaaggaaccaaggtagaagctcactctctgtgaacgaaacatttgccttttgttcggaacgaaatctcacaaattggttctatgatctgcgcgattcgcgtcgtcttctctctggatctgaagtaattgattgccattcgttagctactgtctgccaattttttatgtttgtcctctctctggaacccttgaatgattcaactccatccaagtctcgtcgtccttgtaattagcaccattgaagcgattcatggaaggcattgttgtattggttaagaaacacagccattgaagcgatg

SEQ ID NO: 10791 - DNA, 3000 bp, Unknown
  misc_feature (1)..( 3000): cDNA_ID_3038059_gDNA_ID_2214449_Annot_ID_182390 3000 nt of promoter + ATG
ttttgattgcagttgttttatacgtatgggttgcatttgcatactactcagaacactgaacaaaaatgcgcttaatgcagactagagcaaatgacgcatatgatagtggtgaggatggatatgacagttcacgtgacgagatctcatctgtttcttcctatcccaacaaaagcaatttaaacagaacatttggcagttcattgtccttgaattctggaccgcgattgtcaatgaaagacacgtcatatgttgaagaacgtgtgggatcatctccaaagatgatgctttctcagttatcagctgccgtggtgtcttatgattccggaactggttagtgatttatgtgcgagtacatacctaaaacagtattttaatggggtcactgagaatagcaccagctcatgtagcctctctgttttttggtgaaggctggtttcgaactaatgctaaacacagtactgttctcaaataccaataaataattgatggaaagatgctaaataaaaaaagacctcatcatctgttttgtttatcagctctataatattcgtgaggaaaagattactgaagaatactttttttttttttccttttagatgtatcttcccctcataaatcatcaaattctgtggtcccgagccaacagcccaagcaaacaaatggtgcaggagcatctatgtcgcctggagcaggagcaagagaaccagttccatgtaaactactcgtcatttctagtctttgcttgtatatagattctgcaagtacctacttatccagatgcaatcatttcttgcagcagaaggatttacaagaggaagatcatacaacattagaatggatgaccaagtccttcttaggttttcccccaagaatgccgattctacttattacttcagcgatactgtaattggctgtttcatctcttctcacattcttctaaaacattgcctgcatctgacaactgtttccacgaatggtaatttttttttgcagataggtggaactcttacattcttccatgaagaaggaaccagaagatgcctcgaggtaaatccagacaagacaaaacttctggtgtacattttgctatatcgagggccattggtactgatgatccatatctgtttccaggtctcggttactctagaaactttagagacaataaacaggagatttgttcatccatcaaggagaaattctccaacacttactaaggtatggatgcagcggattataatttggctatggatattgttactttgctttttccgctggatgctatgtctctacaattgtaatcttactaccccatatgtttttcgtcaaaaggtccaaagcgatcaccatgaggtggtggcagaccttattcaaaccagctttctattttcaattccgacggatggtccaatgtcgttttctacgccccgtgtttctgtgcaatggattcttcggtttgagttcctaactactcctaagagtgtggacttaagcaggtattactcccaatactcaaacgatccattctctggttgagtcttttgaagtgctcaagttgttgaagtcagtttctggttctgttttgtggtaatttacaggtacgaacatccattgttagtaccggaaagggaaaaaagcgaatgggttcttccgattactgtacatgcaccgccgcctcggacatcaggtgctcaaaaccgtggagataagctttttggtttggagccgtcttggattcgtagctaaatttgtttttggtgaaagatacagtttctggtctctgtctagctcacctcatgcaataatttgtttttcttttgatcatttaaaaataacttttcaagggaaatatatataccacaaacctattttgtttagtttttaattactagtttattagactatagagagcagatttatttttctttttggtgtcctatgataaaagatcttaaatctttaatcacaaactgtttcttatataagcgttacttaaatcagtttcatcagttttgggcacataaagtaacttttgataaacaaaattgtagaaaaatgggtaagagaaactgatgataaatccaaatctcaaaatcttaatcctaccaaaaaaaaaaaaaaaaaaaattattaatagaaaagttggaaaattggaaaaaaccctagatgtctttacttgttctatattaatacaacattgagagggaaaagaaaaagaaaaaaaccctatcgtctctgcgctccatttttctctccttgcactaagcttctctctccctatctctctcgcgtacggtgattgtttgtttaggtctgggcaggtactgtcacctaatggcatctgaatccaatagctttgcgaaaagagatcgtcttctcgagattgaggtagcagttcgaaagtggtgggaggatgaggatgttttcagggctgaatctcgtgatcatcttccaaagccaggagaaaagttcttctccactttcccttttccctatatgaatggttatctacacattgggcatgctttctcactctccaaggttgattttgcttctgcttaccatagactaagaggtgccaatgtgcttcttccttttggtttccactgtactggtatgcctattaaggcttccgcggataagctttctcgtgagatcctacagtttggagaccctcctgtcttccctgctcaagataacctagctcctcaagttcacgaggagggcagtgatacaccggctttaacgggtcagttcaagggaaagaagtctaaggtggctgcgaaatctggtggacaggtttatcagtggcagattatgcgcagttttggtcttactgacagtgagattgcaagatttcgggatccagatgaatggttgtattactttccccctttggctgttgaagatctcaaggcatatggattgggctgtgactggagacggtcatttgtgactactgatgttaatccttttttcgatgcctttgtgaggtggcagatg

SEQ ID NO: 10792 - DNA, 3000 bp, Unknown
  misc_feature (1)..( 3000): cDNA_ID_3038043_gDNA_ID_2214449_Annot_ID_182397 3000 nt of promoter + ATG
aacaaccaaaaatcataaacaaagtcgcatacttgatggaaaccaacaacaatagatcaaaacccacaaattgccagacctataagaactaaaacttcgaattttccattaaccagaacagagagattccgtcagataagcaataaaagcaaaagggttatatgggtttctactaaagcataaaaagggagaatactttacaatgttcttcattaccttaggattaccacggctgcaaaggtcagcgatgacacgattcaaagtgtcaaagcttccgccaccagaagcggtggctgagggaccacaaaagcggtgcgattgcgaaggggaagccatggatgcaggccgtccagccacaaaagattgcgacgaggtagacatcgctgcagggccagtccagccacaaaaatcttccaaaaaccctaaatctgacccctttttggttcaacaacacttgggcagagagagagtatgtacagaggaagatagaagaatcttcaacacatgatgcgtcgagaaccgaagatcgcagaagaaatcaagattttttctcttatttttttacaaattcaattcgctgagtgtctttttagctttcttaggttttgctttgttctttcagagaccaattatctttggtaaataaattggaaaacccgaaaggtttttactaggaaaatatgactttttccttggaaaattgtaaaacttatgtttgtctatcaaaaacttataaatacaatattttcatttttttttgtcactgattaattacttaaaaccctgaaagggtctttgtttgggctatgtaatgtttagaatgtttaatatacacttgtcaaagaaaaaaaattacttgtgaaaaaaaaaatagtcaaaaactcatatttgttcactggacaatagaataactttttttgtcaaggaataactttgtagtttcttgaataagttttcttttattgtcatttcactttattattattatttccaattatgcttttaagcagataaggagtttttaaaatgatcattaaattgtaggaaaataataaactatagttttgttgtaattagtagtcattacgaacaaaaataatggggaaaatgaaaaaattcaattgaatgcatatggttaagtttgtcaacaaattaaataaataagaggaataatatctatacaaaaaaatatcgaatattagtcaaattttgaataaaaaatgtcaaataatagtagaattgtaaaatagttgtatggtaatcgatatatcatatattgaaaaattgatgaaatgtgaatcatatcattcagttaatttgaattgtttttcttttttttggtatggagtggatttgaattgttagatgtgatgaaactttgtttttctattcataaaaattctaaatcatagaaatcattatttattctccaatggtaaatttttgttttgcttgtatgttaagtagtattcatattcatatgtataggaaaaactaaagaaatggctcctccaaaatatagttcgtgtttctccgttgttacaacgaaaataatcacaatgattgtgtatgacaaaataagcattacattcgaaaattaaacgaagcacatccaacataaaatttcaaaagagttgtggcttgtgggaggctatagcatcgcttggtttcatcgtacacatcaaggatggtgaatagacagggtccaagtgttaacgttgcgcaatcccataacgtgacaagaatgtcggtgaaaatattggtgttcttttctctccaaattaataaactacaactaagagtactatttaaaaaagagttaaaatgacacaaaataactcaattttttatatcattaacgcattatacgtatagaatttaaataataacatatacatttccatataggataaataacctcatcaaaaaaaaagaagaattttattattagtttagacttttttgtcaatattaatttattagcttcttaagttttatattattagcaaaggataatgatgccaactatatacatgcgtgctccaacttttgggaccaattcatctaacctaagtgataaacagatagataaattatccacttctaactattttccatcagcttatttcaaaatttaaaagctaaatcatttcaaatcaaaaaggtctttggcttttttttatccactgttccattatttctctcttccattaaaaaaactgcattttacaagatctttcagtttttagaagtaatcaagtatcagtgccaaaaaaagctacattaaaatcttacaaattacagtatacgacgtattcctattttcaatcgttatctaagtagaaatatatttaataaaacgtgtgaaatgtcaataaaacaacaacaaaatgtacatacattaaaaagaattcaagaccagcaaaaatatatatacacgttactatttaatctcttgatatgtttcctgtataaaagaaaaaaatctaccatataaacctcaataacgattccagaaattatatcaaaattgtaaaagacaaaaacatttaactaaaaaaatcatataaaggagtaaagaaataaatctatttagaacactagaaatttcaaggttaagaatcaatacatacttaaactaaaaaaaaacttttatttaccaaaaaataaaaaaataaaataaaagaaagaataatattatttcaatttacacatctggaaattgacaggcgatagtttggttttttggagttttgaccccacaaaatctttcacctaatttccatttgtttttctcaacaaaaaaatcacagctatattccagcctgtttaattctcatcaatcttccatttttatagctcttctccaaaatcccttcttcttccactccaattctctcttaaaccctaaactagttagggttagtagtgttaaagttcctttcttcgtagctctgactaattaacatttaccgataattcaatcttcaattcacaatg

SEQ ID NO: 10793 - DNA, 3000 bp, Unknown
  misc_feature (1)..( 3000): cDNA_ID_3037991_gDNA_ID_2214449_Annot_ID_182400 3000 nt of promoter + ATG
ccgtttgatacttatatcgtctatctgtgggatcgtcaacacggttgtttggtatcgggttacttgcaggcacaagagtttattgttcatcaagagtcagagaatgggagtagtagtgaaggtgattgttgtcgcgtaaacacgtcgggtactgaggggtacatggaagagagatgcgatggagtccttatgttatcccagtttgtgctcccatcttggatggactcggtaccccgaccgccaaattgattatccttcttcgggaagcttgttcttcggtgtttatgtatttttatgtatccttgattccttgtttatcatgaggctttaatattcaaacatcctctttgttttcttatcaatgatgtccagactcaactaagcaaaatctctgaacacaagacaaagcctaaaggcaccaaaaactaaagcctaacaagcttttagatcatctcttgagagtcagaccacatcactagagttgccaaaagagcaatggttgcggtctcaactcgcaaccggtgtggccccagtccaactgctgtgccgcctgcttccaacatcatctccacctctttcttcgtaaagtctgcttcaatttcattgttgaccgttagataacaaacatattttttatatcactgagacaagtcatattaacaagagccataagctactgttcattttgtgtctactcgagcattaacccatgatttcattttcgacaatgtgaaagtgtagcaagtcagtagaaattttaaaagagaactacatcagaaatgtattgaagagaagatttcttaccgccttctggtccaacgattaatagtccgctggattcttttgctgaggagtttactgcattaagaagaggtttagcttcggctgtagcaaccaaacataactttgacttcaaaatctagaaaaccccaaaaggtgtcaaaacaagtttagaagaacaaaaagtcagaaattttataaaccaaggatcttagagtttgcgtagaaaaatgttcaaacatacatgatccaagagggtaccaaatttgattggagggttcagtaccatttgatgaagtctttggcctgtgacagtgaaagataaggcaaatagtttctgatcatacaactataatgcgaaggaaaaagaagagcaagattaaccaaccaattgttttctttcactattgctacttacattgcttagctgcagcaaaactaacgcgttccaatctatcgacccggttttcagagattatgggtgatctttccgttaaaagtggtgtgacactgctcgctccgagttcctaagacgagcatatacacatattcagtgacacaatattcacaggtgatttagacagttacatactaaaagtagatacatactgtacatttctcaattagccaatccgctcgaccacccttcaaagttcctgacaagacattttcaaagaaatcatgactcaagctgagccagagactataacatccggcgatatcgtaaagttaggttgaagtcctatttcataccaaaagctgcaaacacctgccactgcatgccctgaggaagaatcaccttctgatcttcttgtgcgataaaatcaactccagttttgtctatgctttgtatacagccttctactagaccccctttgccattaaagagttctacccttgcaaagaaaaggggtgcaagtcattacttacattcacttaaggtttagtgatcttaaactaaagaaaaggttggcctcctctcacctcagggttacttttgatgctatcattacttaaacaactgaattcctcatgataaagatgcataaaaatgaaaggatggatccagatacattacaaacatcattcagataggataaaacttttagcaacatggatacaagcaaacaaaaaatgaacaaatcaatttttaaaagggcctttcatgaatgcaacactggaaaatgacaataacatatatgaatgtagtaattacctgtcctcctgtttcagtctaagaactttagccatatgccaaaactcagagccttgaacacgaacaactccaccctataaacaatcataaaacgatttacacaaagaggagcttatcatttcaaacaacaagaacatttaatattatcatttcaccatgattttaccagaaatttcttagagattacagtgaattacagtaatttctaaacttctcagtgattaccctcactctcatttcgattggattcttacacagatttaaagggaacaaaaattatatgagataaagatagagatagatagggtgtgtgccttgcgagatggaagatcatcggaaaagaatcgaggaaggccaccgcgagattgattccggagattcaaatccgacggaggagacgaagatacagtagcaaacgatttgaagctagaagtcggaagccatgaacgaacgagactcggcaaatcggaaaacagtggccgtgaagccgccgctagcgctctcatcatttactcaaagctttgaatttttggttaccatttcgaagattttggttaatactagtttcttatcgtttcggtttactttaaatattggtctgatccggttcaattctaattaaattccggttcatttccacgcaattcaaggaattttgctatttcaaaaataaagagaaacggtcagaaagcgattgccaaacagaatctaaggaatcaaaattcaaaattagaaaatacgcaactcacgaggatatcaacaaatcgtggttttaacgacaacccaattacatcactacacgtgtatcatacgtgccgttacatacagatggatactttcgcttataaatatagcatcaaacagctctgtaaaaacctagaaatcgaaaaaatcagatctagatctaaaagaagagcgtcttcataaacgcccttcttcttcttcgtcttcttccctgcaaatctagtttctagatcttttctttcttccgcgaaacgaaaatg

SEQ ID NO: 10794 - DNA, 3000 bp, Unknown
  misc_feature (1)..( 3000): cDNA_ID_3038039_gDNA_ID_2214449_Annot_ID_182398 3000 nt of promoter + ATG
aatcagcttctcaccggaagcagcgacaaatccacacgacgcactacggcgagagtaaacctcgacggagagaacactccatttagccttcttaagagacgtctcaatctgagacttacttagactaaagcaagcagcgacggttgagacgttaccggaacaacaccgagactctgattccgattcggttcgcaacagaacgggaacagaaacaatctggcgtgggaaactcttgaacttgattttacaatagcaattaccagaggatacatccgaaacagacggtccagatgaagaagaagacgacgatgatgacgacggtgatctcggaaacctaaccgccaaattcccgacgatgatgcgtacgaaagagcaaggatccattgtgaattgaagattgaattatcggtaaatgttaattagtcagagctacgaagaaaggaactttaacactactaaccctaactagtttagggtttaagagagaattggagtggaagaagaagggattttggagaagagctataaaaatggaagattgatgagaattaaacaggctggaatatagctgtgatttttttgttgagaaaaacaaatggaaattaggtgaaagattttgtggggtcaaaactccaaaaaaccaaactatcgcctgtcaatttccagatgtgtaaattgaaataatattattctttcttttattttatttttttattttttggtaaataaaagtttttttttagtttaagtatgtattgattcttaaccttgaaatttctagtgttctaaatagatttatttctttactcctttatatgatttttttagttaaatgtttttgtcttttacaattttgatataatttctggaatcgttattgaggtttatatggtagatttttttcttttatacaggaaacatatcaagagattaaatagtaacgtgtatatatatttttgctggtcttgaattctttttaatgtatgtacattttgttgttgttttattgacatttcacacgttttattaaatatatttctacttagataacgattgaaaataggaatacgtcgtatactgtaatttgtaagattttaatgtagctttttttggcactgatacttgattacttctaaaaactgaaagatcttgtaaaatgcagtttttttaatggaagagagaaataatggaacagtggataaaaaaaagccaaagacctttttgatttgaaatgatttagcttttaaattttgaaataagctgatggaaaatagttagaagtggataatttatctatctgtttatcacttaggttagatgaattggtcccaaaagttggagcacgcatgtatatagttggcatcattatcctttgctaataatataaaacttaagaagctaataaattaatattgacaaaaaagtctaaactaataataaaattcttctttttttttgatgaggttatttatcctatatggaaatgtatatgttattatttaaattctatacgtataatgcgttaatgatataaaaaattgagttattttgtgtcattttaactcttttttaaatagtactcttagttgtagtttattaatttggagagaaaagaacaccaatattttcaccgacattcttgtcacgttatgggattgcgcaacgttaacacttggaccctgtctattcaccatccttgatgtgtacgatgaaaccaagcgatgctatagcctcccacaagccacaactcttttgaaattttatgttggatgtgcttcgtttaattttcgaatgtaatgcttattttgtcatacacaatcattgtgattattttcgttgtaacaacggagaaacacgaactatattttggaggagccatttctttagtttttcctatacatatgaatatgaatactacttaacatacaagcaaaacaaaaatttaccattggagaataaataatgatttctatgatttagaatttttatgaatagaaaaacaaagtttcatcacatctaacaattcaaatccactccataccaaaaaaaagaaaaacaattcaaattaactgaatgatatgattcacatttcatcaatttttcaatatatgatatatcgattaccatacaactattttacaattctactattatttgacattttttattcaaaatttgactaatattcgatatttttttgtatagatattattcctcttatttatttaatttgttgacaaacttaaccatatgcattcaattgaattttttcattttccccattatttttgttcgtaatgactactaattacaacaaaactatagtttattattttcctacaatttaatgatcattttaaaaactccttatctgcttaaaagcataattggaaataataataataaagtgaaatgacaataaaagaaaacttattcaagaaactacaaagttattccttgacaaaaaaagttattctattgtccagtgaacaaatatgagtttttgactattttttttttcacaagtaattttttttctttgacaagtgtatattaaacattctaaacattacatagcccaaacaaagaccctttcagggttttaagtaattaatcagtgacaaaaaaaaatgaaaatattgtatttataagtttttgatagacaaacataagttttacaattttccaaggaaaaagtcatattttcctagtaaaaacctttcgggttttccaatttatttaccaaagataattggtctctgaaagaacaaagcaaaacctaagaaagctaaaaagacactcagcgaattgaatttgtaaaaaaataagagaaaaaatcttgatttcttctgcgatcttcggttctcgacgcatcatgtgttgaagattcttctatcttcctctgtacatactctctctctgcccaagtgttgttgaaccaaaaaggggtcagatttagggtttttggaagatttttgtggctggactggccctgcagcg

SEQ ID NO: 10795 - DNA, 3000 bp, Unknown
  misc_feature (1)..( 3000): cDNA_ID_3038016_gDNA_ID_2214449_Annot_ID_182405 3000 nt of promoter + ATG
atttagctgagagtaacaatttaataatacatattgtctatgagaaaagaaaaaaaagatgcaagaacgaaaacagaatacctcaatgtaggcaccaattgttgttttgttacagccaccaggttctttcagggtagctattgcttccattataaggctatccaacctgcaacgtttttaaaagttacaatttgtctataataaaagatttgagtgatacaaacatctacgtgtaagtgggactttacaaatcctcatcataatttcacaattataaagccacagtgataggattgagcaaacggctcgcatgataatagtaagaaggaggagaaatgtactaagccagtgaagacaacttaaacagaggtgtgaaaacaaacccatatcacatgaatgtaatccaacacttatcgacttgcacagaataaaaagtgacggcaaaccatacattttgagatgtaatccaacttcagaaataccagcgagagagatacaacaaagcaactcctcttcaatacaagaaacaaaatagacacatttctaaccttacattaggtctccttggaggaggattagaagaaacttggagtccagaggtcgcatccacattttcttcatcactttgcaaagaattggttagggctagtgagttctcttcctgtttaggaagggagaacgtccttttaacagctaacctagacttttcgcgcgatccccagccatttgccatgacactcatgtttctccatttgtcctgtcccaatacaataaacaaaccatctcccagtcagataaaatcacaaacaaaatacagtagcattatcaaagctgacaaaaaggataagaagtaatcatgaccttaagatcaacattggaacgcaggtacaagactccgctaaattcaggatctttgagaattgtgcgccatttaccaggtccatgctttataactccagactttaaagctgactcttcttcttgagtccatttctgcttaggagcacccatcccgatttacggtctgctgtgtcaaagcaagtccgttctgcaacaatacatatcaaatgtcacgaaaccaatcagaactaaagtttctacataaaaatgtaaactttttcttcagttgtagctcacaattcatcatcaaataccacagaatagtaaaaccctaattccctgttccgaggaaaccctaacatagattatcaaactataccgcagcaatagttcagaaactaagacgcaatagcaaacaccaacttcacatcactgaaagatgccgaaactcaaaccctagaaaaatccgttctttcagaatgaagcctaatctcatgctgagaatatacacaatcgagaaagaagaaacagatgaattcaccaggaatcagagtttagaggaagaagaatcgatcattcgcaataccaatttttgtttaatctctggattcagatttcgagacgcttgggaagcagaaaaagttagggttaatgcgaatacaaggattcagagtaacggacctccgtcaattctgatgcggcaaaccgcttagaccaattaagctttaaacgcgttttttcacaaacggccttaaaacgcgttttttacaaacggccttaaaacgcgtttttgtttacgctagttattatattctgaagattataaattgtctaaatatttacaaattcaacttttaataatgataaagaaaatatcaaattccccaaatgaagtgttaatatgattgtcaagaaaatatattatcaaaactaatacgcagtgacccagatcatatttacacgaacaatttggtttatgtttgaaagttttggtggtgattaaaaatttgatgattaagtggtattttgaacataaaatacaaatatgttgctagatataattcagaaatgtgtggtggggtggtagttgtgatattttttttcaaaaatgctattttcattttatccatagaattttctctattgtttattttttctgaaaattatctagttgactgtaccactaattaaaaaaaaattgtggacatggtagttgcgatattttgagagttttccaaatctatacacttgttttaaacacattaaaaagttttataatttatttatttttgaatttctccaaaatttgaaatataaagatcatttcgtaaaaaaaagaaaagttcgttgaacatagttttagttgatttgttttactaggtttattttctgcagatgttcagtaaaaagaaagaaccttctctaatttcacctagatatttatgattttataatacaaactaatttcatatttgggtttaaattaataattgtccaaataatttcaaattacagtcaaaataaaacattagcaattagttccatccaaaataaattattaaattaccaaattaacatttttagctcatgagcccaaaattatttatgatatgaaatatgtacttgataataattcaagtcagcaacaataattcatcaaatttatttcaaaataaacctccttaaatctttctggattttttaactgataatcctattgttttatcttattttcattaagccaacaataagtcataccaattagtcattagttataattcttgatattggttaaagagaatgtttaagtggtggatggagttagttgtatacttttttggcattaagatgagaataatttgctacttataaagactttgtaatattaaacatcatattcttcacatgaatatacaagtggacaattctggttaagtcacaccagtggtttaatccggttcatttttctacgtatagcattagtgttaattacgtgcacgagaacacaagacagaaagtaaaaaaagcaagaaagagtcaacaaagttgcccgcctaacgattacttagcacttttgaatccgttttaagcaaagccttagtttgaatttacagctctcatcacaaagagagtagcccttctcgaagcgagtgagatatg

SEQ ID NO: 10796 - DNA, 3000 bp, Unknown
  misc_feature (1)..( 3000): cDNA_ID_3038020_gDNA_ID_2214449_Annot_ID_182404 3000 nt of promoter + ATG
ttatatgtctacttgtttatatgtttacttgttgttaatattataaactcctggaattttaaaattactatgacaaatagttacaatttaaatacataactaaaaataacttcaaatacaacttttaggttttacaacaattatcaaaagaacattttttggttcataactctctctttagctttagatatttaggataacgacgtctttttacgtatgaaataaattgttgtatggagaataacttcgacgactttcttattttggtacccgtaaatttactattgtttttcgtttatcttcactgcattggttagtctatatagaagtatattcataagcttatctacattttcttttttaatttagaacgagtaacgcatgcatacgtgttttggggaaaagtcgttttggtcttttgatttgaccatttactgtgtatttttgcggtaaattaatattatttaattactttgactaacattaattactaaaatgtgttctattgatcacaagaacaacgagatgtagtattttccagtggtgaagacgccggagataatgtttatccggtgaaaatgaaggtgtttattaacgaggtgcctgtcaaaattgtgaccgtatatttatttttctgaatttgaacttttagtatatatccttatttttaaaagaaatttgagtttgtttacgtttttttaatctaggatctaatttaatttcttgttgataaaaaaaactgaattcatttaaattatattaagggaccaattggttacaattatggttttggttgtagatattctagatgtagaaatattgactgtaaaagttatgaaagttaatttagatatttataagagttttattcgcgatatagttgtatctattatactattaaaaatctagacttctttattggtgaataatatgcattatgtgatatttaaaatcaagttatggtataatgacagatatcgaacaaattactaaactacacgttttgtaaaaattaaatttttaataaactttaaatagtgcaaaaaatatatactaattattttataaataaatattcaaattacttgtttagattttgagttggcaacaattactattatctgatttttatgtcataactcaaaagtaacaatgattattttcattaaaatgctatagatttctctctttattttggaacattaaactcattaataaaaacgggaaattctgtcaaatggccaatacataatatgtcatgtaataacaattggatgacttgtgtttaatttgaaagtaggtaaaacaactttggtaaaacgatatactgtatggattaaaatagagaatttaactattcgtttctataatacaatataaatcttgtaatacgatatgagtgtgttcttgttaggtttagactcactaaatcaagctcaaggtagattgctggccttaactggagaagcaagaaaccgcataagaaggcttacttgagacacacgaaaccatctaatgcttttgtgtgtttgatcttgtgacggaaacaggcggagtttcttgagaagatacctagtagaagcacattcgcacacaagtgaaaggcattgtattctcatctgtccacatggaaaccataaggatactacaaaatcaagaactttagcgaccagaaacgccgtggacaagcttatctacgagtggagaggttttaagcacaccattgactggaaacaaacggtaggctctttagaaatatttatctcccatgagacactatgagcttcaattcacttccccactccactctcctgactatgttattgcatccacaagattgagcttggattctggtactccgttttcgaaaataaagtttgttgagaaaagcaaaaccgattcaacaaaaacatatacagagcaagatatataaattactgagcagccctttttaaaaaaaagtttcatagacaaacaaaaacttatcatcattatcaatttatcatcatcatcatcatcaattcatcataatcatttgttggctttgagccattccagaatccgtttttcagattcactgagctctgcttctgtctttccctttatagatccttcaacaaactcaaagtagtctttataattcctcttgtaaaaactgtccaatctctgtttcattttcccaatatgaacgaaaaaaagatcataagaaaatttcctacaaaagacataaactatgtgcgttatggtatataaatgtcattctctttacctccttatcattcttggctttgttttcctcagtcttcttcaaatactctgaaacaattcttccccaaagaacgacatagtttaggcaaaagaaacattctaaatgtaaagaagaaaaacacaactaagaatttctaattactttggagaagctggtcgctgctggtcaaagcagcggcgatgaaagacgtggaggagaagagaatgtttctgcgtcctaaatcagcgggtggagcagttaaagaatggcgtttggtatcgtttctgcgtacagcttgaacattggaagaagcatatttgttaacagttactgttaaagccatgagaatgctttggcttatggagctcatctctctcttgaccagaagataagattcttgttttatgtctcttatctacattacagagaagaaacaaacatctttttatttattaacaaagagtccctaactatgtaatttacaagaacaaaccctcaaatctattaaaaatagattccaaacccagatagaaatttgtagagacaaaaccggtttaatagacaaatattctcaaagcgattctggttcggtcgggattttgactgtactcagtacttacatcttcttcatctgacgatagcaaaaatgacaagcaatccctaatttcgcctcaaaaaatcccaaaaagcttcgttcttttttagtcatcatcatcttcttcttttcttcttcttcggttgctaaatcgaag

SEQ ID NO: 10797 - DNA, 3000 bp, Unknown
  misc_feature (1)..( 3000): cDNA_ID_3038027_gDNA_ID_2214449_Annot_ID_182402 3000 nt of promoter + ATG
ccagcagcgaccagcttctccaaagtaattagaaattcttagttgtgtttttcttctttacatttagaatgtttcttttgcctaaactatgtcgttctttggggaagaattgtttcagagtatttgaagaagactgaggaaaacaaagccaagaatgataaggaggtaaagagaatgacatttatataccataacgcacatagtttatgtcttttgtaggaaattttcttatgatctttttttcgttcatattgggaaaatgaaacagagattggacagtttttacaagaggaattataaagactactttgagtttgttgaaggatctataaagggaaagacagaagcagagctcagtgaatctgaaaaacggattctggaatggctcaaagccaacaaatgattatgatgaattgatgatgatgatgatgataaattgataatgatgataagtttttgtttgtctatgaaacttttttttaaaaagggctgctcagtaatttatatatcttgctctgtatatgtttttgttgaatcggttttgcttttctcaacaaactttattttcgaaaacggagtaccagaatccaagctcaatcttgtggatgcaataacatagtcaggagagtggagtggggaagtgaattgaagctcatagtgtctcatgggagataaatatttctaaagagcctaccgtttgtttccagtcaatggtgtgcttaaaacctctccactcgtagataagcttgtccacggcgtttctggtcgctaaagttcttgattttgtagtatccttatggtttccatgtggacagatgagaatacaatgcctttcacttgtgtgcgaatgtgcttctactaggtatcttctcaagaaactccgcctgtttccgtcacaagatcaaacacacaaaagcattagatggtttcgtgtgtctcaagtaagccttcttatgcggtttcttgcttctccagttaaggccagcaatctaccttgagcttgatttagtgagtctaaacctaacaagaacacactcatatcgtattacaagatttatattgtattatagaaacgaatagttaaattctctattttaatccatacagtatatcgttttaccaaagttgttttacctactttcaaattaaacacaagtcatccaattgttattacatgacatattatgtattggccatttgacagaatttcccgtttttattaatgagtttaatgttccaaaataaagagagaaatctatagcattttaatgaaaataatcattgttacttttgagttatgacataaaaatcagataatagtaattgttgccaactcaaaatctaaacaagtaatttgaatatttatttataaaataattagtatatattttttgcactatttaaagtttattaaaaatttaatttttacaaaacgtgtagtttagtaatttgttcgatatctgtcattataccataacttgattttaaatatcacataatgcatattattcaccaataaagaagtctagatttttaatagtataatagatacaactatatcgcgaataaaactcttataaatatctaaattaactttcataacttttacagtcaatatttctacatctagaatatctacaaccaaaaccataattgtaaccaattggtcccttaatataatttaaatgaattcagttttttttatcaacaagaaattaaattagatcctagattaaaaaaacgtaaacaaactcaaatttcttttaaaaataaggatatatactaaaagttcaaattcagaaaaataaatatacggtcacaattttgacaggcacctcgttaataaacaccttcattttcaccggataaacattatctccggcgtcttcaccactggaaaatactacatctcgttgttcttgtgatcaatagaacacattttagtaattaatgttagtcaaagtaattaaataatattaatttaccgcaaaaatacacagtaaatggtcaaatcaaaagaccaaaacgacttttccccaaaacacgtatgcatgcgttactcgttctaaattaaaaaagaaaatgtagataagcttatgaatatacttctatatagactaaccaatgcagtgaagataaacgaaaaacaatagtaaatttacgggtaccaaaataagaaagtcgtcgaagttattctccatacaacaatttatttcatacgtaaaaagacgtcgttatcctaaatatctaaagctaaagagagagttatgaaccaaaaaatgttcttttgataattgttgtaaaacctaaaagttgtatttgaagttatttttagttatgtatttaaattgtaactatttgtcatagtaattttaaaattccaggagtttataatattaacaacaagtaaacatataaacaagtagacatataaaaacatatatttcaaaattttcaataaaagcttttagtcacacaaaaaattattaaaattttaaaaatagactcacgcgtagtttgggttcataacctagtttcttttaaaaataaggatatatactaaaaattcaaaaaaaaaaaaaatatactaagccatccattatatattagattttacagaaaagaaataaatatatattagattttactttttatttgggtatcatttttggataaaacgaaaatataaaataaaagacctaaaaattcaaattgaaatccagattaaagacctcttaagaaagacaacaacagattgcataattgcgaatagggttcctttatcgaaattttgaaatttaaggatattataaaaaagttgaaatggaatgaggcgttaaatcgcaatatataaataaataaatataaatttcggttcggttcaggtatgaatcgggcgggcttttccgatacgccttgcaaataaaattgcggcgaccaaactgttcctcttcttctccagcaagcttcgaagagaaggaagaagattggagaagaatg

SEQ ID NO: 10798 - DNA, 3000 bp, Unknown
  misc_feature (1)..( 3000): cDNA_ID_3038031_gDNA_ID_2214449_Annot_ID_182401 3000 nt of promoter + ATG
gatgaaaatattatcagaaacaaacgaactagaacaaatggctaccgccacaagcaagagatagaaatatggtttttgaaaacacaagtacgactcgtaagagtttcgagcctattcacacaaacacgagataatagaaatcccacataaaaccgacaaccttcttagtactcctctccttcatcatcctcatcgtcaccaccttcagcaccaacctcttcgtaatccttctccaatgctgcaagatcctcacgagcctctgaaaattctccttcttccataccctcacccacataccagtgaacgaaagcacgttttgcgtacataagatcaaacttgtgatcaatacgggagaacacctcagcaacactggtggagtttgagatcatacacacagctctctggactttagcaagatcacctcctggaacaacagttggtggctggtagttgattccacacttgaatccagtaggacaccagtccacaaactgaatagtacgcttggtcttgatggtgccaacagctgcgttcacatccttggggacgacatcaccacggtacatcaaacagcaagccatgtactttccgtgacgagggtcacactttgccatcatggatgctggctcaaaagcactgtttgtgatctcagcaaccgagagctgctcatggaaggccttctctgcggagatgactggggcataggaggaaagcatgaagtggattcttgggtatgggaccaagttggtttggaactcagtcacatcaacattcaaggcaccatcgaacctcagagaagcagtcaaggatgagataacctgaaaccatcaagagagagttaaacataagaaacgaaacagcaaaaagactgactgatgtaaatgattgaagctggctctatacctgagagacgagacggttgaggttggtgtaggtgggtctctcaatgcttagggaacgtctgcagatgtcatagatagcttcattgtcgaggaggatagagacatcagtgtgttccaagagtgagtgagtggagaggacactgttgtaaggctcaacaacagaggtggagacctgtggagatgggtaaactgtgaaacccaacttggactttttcccgtagtcaacagaaagtctctcaaggaggagagatccaagaccagatccagtccctccaccaacagcgttgaagacgaggaatccttggagaccagtacagttatcagcgagctttctgatacggtccaagcacagatcaacaatctctttcccaactgaaataagatttcaaaagtaaatcagtgaatgaacagtaaattcaacaagatatggttgatgatgaagaaacaagggaaggagtaacttactggtgtaatgcccacgggcgaaattgttagctgcgtcttctttaccgctgatgagttgctcagggtggaaaagctgacggtaagtaccagtcctgacctcatcgatcacagttggctcaagatcaacaaagacagcacgtgggacgtgcttccctgcaccggtctcactgaagaaggtgttgaaagcatcgtcacctccgccaacagtcttgtcactcggcatctggccatcaggctgtaacattccacatccaagacaacacatcaatacaaagagacatataaaacgaaaagatctacacatatagaagcaacgatgaaaagagaaaatcacaacgagatgcttcaactatatcgcaaatatcaatcgccatctctttaagcaaataaagcaaagttttccttcacccaatattataaaacaaatacggatatggcatcagcaaaagcaatctgacatgaaatccaattcaaacacagatctatccaggttcatcgaataatttagaaatgagaaacggatttcgcatcaaccacagaaatttcataagacgtcgaaatcaaacacagatctaaacgattacgtaaaatagatctacgaggtcaatgctgcgcaaaaatatctcagatttgatcttttaaaatacgaaaaatatgaagaaaaacacagatcaagatagaagaggaagagacgaacctgaatgccatgttcaagacagtaaagctcccagcaagcatttccgacctggataccggcctgaccaatgtggatcgaaatgcactctctcattttcgtttcgcggaagaaagaaaagatctagaaactagatttgcagggaagaagacgaagaagaagaagggcgtttatgaagacgctcttcttttagatctagatctgattttttcgatttctaggtttttacagagctgtttgatgctatatttataagcgaaagtatccatctgtatgtaacggcacgtatgatacacgtgtagtgatgtaattgggttgtcgttaaaaccacgatttgttgatatcctcgtgagttgcgtattttctaattttgaattttgattccttagattctgtttggcaatcgctttctgaccgtttctctttatttttgaaatagcaaaattccttgaattgcgtggaaatgaaccggaatttaattagaattgaaccggatcagaccaatatttaaagtaaaccgaaacgataagaaactagtattaaccaaaatcttcgaaatggtaaccaaaaattcaaagctttgagtaaatgatgagagcgctagcggcggcttcacggccactgttttccgatttgccgagtctcgttcgttcatggcttccgacttctagcttcaaatcgtttgctactgtatcttcgtctcctccgtcggatttgaatctccggaatcaatctcgcggtggccttcctcgattcttttccgatgatcttccatctcgcaaggcacacaccctatctatctctatctttatctcatataatttttgttccctttaaatctgtgtaagaatccaatcgaaatgagagtgagggtaatcactgagaagtttagaaattactgtaattcactgtaatctctaagaaatttctggtaaaatc

SEQ ID NO: 10799 - DNA, 3000 bp, Unknown
  misc_feature (1)..( 3000): cDNA_ID_2714279_gDNA_ID_2214450_Annot_ID_132908 3000 nt of promoter + ATG
gcttcttcccgatagcgtttgtagttgcagacggtagtggttggcaaaaaacatttttttatccaaatcttttatttactactaaaatatacataaacaacaaatatattaaaaaatagtatcaaaccctctatatattaacattaattctcaaaatcctaatatttttctccatcaaaatcatatagtcaattcatcaacaatggcaagatacaaactaagtattgtaataatactattgatccaaaagttttgaagtaattcgaaacataatttatttattttgtaattttgtcatattacttgatgttggtttttatgaaccaaaatgcatgaagtaataagcatttaactgataaatttattcgttttgaataattgtgtacagttttatatggtttttattataaattatatttatattattttttattttatcataataatataaacttttcaatcaaatatgaaatatgtatatatatatatatatatatatatatatatattcttttctataaatatgtttacaagtaaaagattcatatttttttctaaaaaataaaaagatataaaatcaaatatatatatatatatatatatatatatatatcttactataaaacgtcgaattatatatatatatatatatatatatatatatacgttctataatatatttacaagtaagagtatcatatacttttctattcataaaagatttataaaatcaaacagatctcctttctataaatccgtatgtgcaatgcatgacacctctataaatcttctttctgtagtctcttaatttttcacgttaatcaatattcactattcagtatacgagtaactaaatttaagagaaaagaaaaaaagaaacaaaaatggccaaggcaacttcttcacttgtcgtccccatcatctttcttgtgatatttgctttaggtatgcatttatctttaatttaatcatagagtaatgagttggcatatgtatccaatattgtagacttgtcattcacgtaactctactgtcatttttagtttcggctagattcattggcaatatatcatattgtatatatctttgttcagtgtattgataactcctaaatcttaatatagcttttgttatctgagtataaacgaaattaattaattttgtttgatatagttgagcagaatacgggatgttttgattatgatgtttaccaaccgtgcgatcattgtcgagaaagatgcctcaaatattatccagttacaagaaaggccatttgtcggaaaaatcattgtgtttgcattggcccttgtccggatgataaagcgattccagatgttaaactcttcaaaaatgtaaaagaacaaatcctaagttgaatgtcaaaatcataatatatctaaaaaactattttcagttgaagctttgattataataaaatttatagaacacaaaatttccagacatatgtttgttattgatgtggtgagcccacaaattttctcacaatttttatttatttaattctactactatcggtattcttaatattctaaaacaataaccaaacagagtattaaatctacttatcataaatatatatttcaaatttttaaatattgtcttatatataaagaagttttctgtaataaatgcattgaattcatgtattggaatattgttctgtcatcaactagattaaaaagctaaaacttataaaatatatgacttacacaacttatttaatttttcttctattgttctaaaaagcggtttagacgctaggtgctcaagctaaacataataaaatatatattagtatattatcccaatttttaaatatgttttattttcatagacatagttataaacatttatttatattttaatataaattattctttagttttggtttacaattttatattgtaattttctaatagatattttatgtaatttttatgtataatatcatacttttagtgttttataattataaataattgaatcacttaaaccgcttatatcacttaaacatcggttaaacgttctcgacgctaggcattggatcaccgcatatataacgccttgcgctttcttttttgaacattgcctataactaaaagatttacattgtgtcgttgttcaacataaattttttcttcatatgagtttttttataccttctatctaacttttttcatttgactcattcaacaaaaagagtgacaacgaattaccaattccatatctaattccatttggatacactttcaataccctacacaagtaatacacacccttcacattaaacccaaagtgagccctcttggtgaagtagagggtctaacattaaacccattttttcaaaactcgaaaataagaatttattttgaaaagacacttttaaaactcacataattaagggtataatagtttcaattaatataaatcatagttggacaattctaataaacaaagatatatatggacaaatcacaaaaaaaaataaaaaaaattcaatgttccccaaaaatacccacaaaaaaggaatatacagaccaaatataaaaaagagggaaaatacagaccaaatataaaaaagaggaaaactacagaccatatacaaaaccaaatacaaaaaaaaaggataaatacagaccaactgccataaaagaagaagagaaaagaagaccaaatacatatccattgcttgactagaggagagagattagctttctcatttacattcatactttaaattcgtgctaattactatataaattcgttgaattgcatttttctccataactagaatacagtgataacatttatgaacaatcaatccagtgaatatgatgaatatttgatatctttgaaagttatcttgtaattataaacctgtataaatacctactctttccctaagatcagatatatcttgtatcaactttcatcttctgatattcaccaaaacttctatccaaaaccaagttcaaaaat

SEQ ID NO: 10800 - DNA, 3000 bp, Unknown
  misc_feature (1)..( 3000): cDNA_ID_4266342_gDNA_ID_2214450_Annot_ID_132909 3000 nt of promoter + ATG
tttatgttggtaatgcacaacaatcatatggcaattcaacggtttcggcacttttcgcttttggagactcaatacttgacacaggcaacaataatcttcttttaagtgtttctaaagtcaatttttatccatacggtagagactttataggtggaagagctactgggagatttggaaatgggagagttttttctgatataattggtatgtatatatatattgatctctacttgttgatatacttgtaacggatgaattcaatgtttgtaatactatgacacaaatattatctaatagcaagtctttgttttcagctgagggtttgggattgaagaatctcttaccagcatatcgtgatccatacctctggaacaatgatctaacgactggtgtttgtttcgcatctggtggatctggacttgatccaatcactgcaagaacaacagtaaatttttcttagtttgtccaaaagattataacaacttttattttatctatagcaaattttaatagattatattttggtgtgattagggaagtatatgggtgtcagaccaggtcacagacttccaaaactacatcaccagactaaatggtgtagtaggaaatcaagaacaagcaaatgcagttatatcaaatgctgtttacctaatctccgcaggaaataatgatattgctatcacttattttactacgggggctagaagattacaatacactcttccagcctacaatgatcaattggtctcttggactcgtgatctcataaaggtacaaagttagattgttttacatatatataggacatagtaagagattaaaattttggtcaaattgtatgtgacatattctattgttccccctttttttttgttatttgaagagtttatatgatatgggtgcaagaaaatttgccgttatgggaacattaccgctaggttgtttaccaggagcaagagccttaacgagagcatgtgaattatttgtaaatcaaggagctgctatgttcaaccaacaattatctgccgacattgacaatcttggtgcaacatttccgggtgccaaattcgtgtacgtagatatgtacaatcctcttttgggtctcatcattaaccctcaagcttcaggtaataacatgattcataattcaagaagaatactcatgtgtatatatatacgttacatttacaattatattttccaaaaatgtagggttcattgatgtagctgatgcgtgttgttgtacgccaacgcacttaataccgtgcttggatgcgtctcgttacgtgttttgggatgtagcccatccgacccagaagtcatacgaaaccatcgctccacagattattgaaaatatcaaagcaaagctcgcatgatcaagttatcaagctcttttgttttgataataagttatcaagcttttttttttctttttttctttcggcaagctttttagattgttatgattaatatcgatcggtaggttttaatatcgatcggttacctcaaccacaacgtcgctctttggtcaaaaaccaaatatttgttactcttaataaatatttgttttagatcttcgtgttgacttgatccctctcatcttttatgatccaaattaattaaactttgtcgtcactttatttccgatattgaatccaaaatatttagttaaaggccataggctttttgagttttctagtagcgcttactagccaatatcccgaagatacatgaactatatacatcaacgttggattttttcaatgaacatcaccaatttcatgtcaaaaaaaaaaaaaaacaaagaacatcagtatcaacaaattaaaaatctaatctcctgttttagtttttttttttttttaaatcacgtgcatagctttgttttgacattagaacatgacttttccaaaatatttcagatttatgaatgctactgtactatttcttttcgattcggtccatattccttactttattcagagagccttcaaacaccgttttcgtggagcatctttttatgtcgattgtgataatattgaagtttttgaatttatttttcttacagtttttgtctttttttgtaaaacgaaaactctagatttaaatctcacactgcttcatatagctagattcctttgcctgccactaaatccaaaacctcacgtgaattttagttttgaactagtccccatttcgagaattttagtgtaggaatagcaatataatttaaacgatcttgttaattataaaatacctatcagttcataaaattaaatttaatttgatatagtttggaaattagtgaactctacaaaagtgttttaacttttaacgattagaacttttattgcttagacaccagtacgtcttgtgattaaaccaatgtggagaagaaaatgtaaatggtatcatgtatgactagcaaattattgacttaagagtcatataaaacaaaagttcgaattaagttctttagtcttctgacagcatcgagaggtgagataagtttcctcattactacattccccaaaacacatattcgttaagacgttaacgttcgttgtctacaacaacaatgtaaaataactttaaaaaaaaaaaagtaagtaactaaatgtacaaatcttctttaggactgatggatttagattgatatatgatagttactagttacgttgttaaaaaaaatggtattaaatcactaacaacgaataattcattttatagctactagtcaatacgataattttagttttcagctaacaatattaatagttgataattctctactttcaacttatttcttgtacaaaccgtattatgtaatgtaggtaagcttattctcatgattagctcatttgatctaattttaatatttatataaaaaacttataaaccctaataaaaaaatatctgaccaaaaaaaaaaaaaaaccctaataaaaaacaaacagtacactgttttttctctctataaagagaaaatctccaaaagca

SEQ ID NO: 10801 - DNA, 3000 bp, Unknown
  misc_feature (1)..( 3000): cDNA_ID_2714272_gDNA_ID_2214450_Annot_ID_132912 3000 nt of promoter + ATG
tattttccgaagtctatccccagcaattggaggcaactgttgaaagcaaaaactcgactgaagccaagaaagagagaggaaaagatttagagacaactcaggaaggaagacaccaaaacggttttggtccagtgaggtttttgcctccattaccaagagtgcaatctaaaacaaatgcacatgatcaacgtgataatggcaaagttgtaagtcagtctgattcttcacattctgaagcatcttcgacagaatatgccagaaccgtccctgctgctgtagctgcagctgctgttgttgcatcttccatggttgctgctgctgctgccaagtctgcaaactcagactcctcccccatagaacttcctgctgcagctgctgccacggccactgctgctgcagttgtggcaacagctgcagccgtgtccaggcaacttgaattaggctcgaatagcgacggggatgatggttctggtgggcatgagcctcaaggtagtggggactctaatcatgggccaaattcaggaggggaaagaatatctgacaaatctattggcaatgaaagttctaagtcagactgtgatgatgtatctgactgtgagattttgtgggaagaaattactgtgggagaacgtattggacttggtacctgacttatcatcatctgttatctgctttggtgtaactacatcttcaaataattaactactttacttcttttgatacaggatcttatggagaagtgtatcggggagattggcacgggactgtgagtattatatttgcttttccaatttatactgtgaatttgaactcgatgaaaaaagagtttagaaattccttagtttgagttccatatcgtcgaaactcttgaactttaggaagtggctgtcaagaagttccttgatcaagatttaacaggagaagcattggaggaattcagaagtgaggtacgagcctttcttctaatcttttcttttacctgattttccatgttgattagttctatatcaaacccttcttatatattcttgtgatacaaggtccgaatcatgaaaaagctaagacatcccaacattgttctcttcatgggagctgtgactcgcccaccgaatctttcaattgttacagagtttcttcctaggtaatactatgatctttgcaagattcagttactttgatatgattctcatggctacaacgatttccatctccttattcatgatgcgcatgcctctgtttttatctattttgtgacctctaaatgccaaaatcttctttgcatcaatgagtgttgttcaagtatttgctttaagttctaaaatctggatggtttgaacaggttcaatccggttgtgcttcgtttttggatctttacattataatatttttttccaaacttgtgcagaggtagcttgtataggttaatccaccggccaaataaccaattagacgagaggaggcgcctgagaatggcccttgatgctgtattagtcttttcttctcttactatatcacctgtttgtaacttcttgattctttcagtagagtgttgaggtaacatattacttgtattcaggctcgtggaatgaactatttgcacagctgtaatccgatgattgtccatcgcgatcttaagtccccaaaccttctagttgacaaaaactgggtcgtgaaggtcagattctctccataaaatttattgtttcttaccaagtggataatgttatatcgtatgtaacagctataagtttacataacaaatactggattttcatatatatcaggtgtgtgattttggattgtctaggatgaaacacagtacatacctctcttcaaagtcaacagcagggacggtaagaagcaagttatagtctcccctgtcttaatcatctctttttacagttattgtaattgccagttcgttaatctaattatgtgttggtcttataaaggctgaatggatggctccagaagtgctaagaaacgaacctgctgatgagaagtatgctcttagatcttttgctactagatattcattttgttcccttttgtcagaagcaggcctaatgtcaggaaaaaacaatacgtgaaacaggtgcgatgtttacagctacggtgtgatcttatgggaactctttacgttacaacaaccgtggggaaagatgaacccgatgcaagtagttggggcagttgggtttcagcatcgacgtcttgacattcccgactttgtagatccagcaattgcagatctcatcagtaaatgctggcagacgtgagtatagattatttttcaatgtttcagccacaatatgaagtagcagtgcttaaacaacatcatttcacttgaccatgtctcagttaacacatgtaatggctttgtgtgtgtttatcagggattcaaagttaaggccaagttttgcagagataatggcgtctctaaagcggctacagaaacctgtaacaggttccaacatcccaagaccagtccccagttcctcttcattaccaactgaacatgaacaaaaggattgataacagaagaagacgaccaaagtggcaaacacatttttgacgaattcaatctgtttgaaggaaaaaaaagctacaaatgttccttctctgctactttttgcctcagcttcagtgtttgacacagcttgtgaattgtgaaaaagaaagattcatggaagatgacgattgaagaaggtgaaggattgtgctcgtgtgttttgttgtctttgcttgcaagcgatgttcatgttcatgcgtaatttcctctattttgttttccaatattgaaactgtacaaagagagaaagaaaaaacaattgacaaactcgtcgaaacgttgaccgaaaacatatattaaaaaaaatcattgagctctgtctttattcatcacacgaacaagataaggctgatctttattattgggatatatgaatcaaaataatataatattttaaaaaactttgcttttacgaaaaatctttgacaatg

SEQ ID NO: 10802 - DNA, 3000 bp, Unknown
  misc_feature (1)..( 3000): cDNA_ID_2714268_gDNA_ID_2214450_Annot_ID_132913 3000 nt of promoter + ATG
agagattgggcacagtatatgtgaaaccaaggcaaaaataaatttgtggatgattaggatgtttcattctaaatatttttcagtggtatttactcagatcatatttaaccatgcgatttgaaagcgaaaaaaaaataatctagacaacacataatggatggtggttatgagtttcgacttataaagatgtgtagatagacaatgagaccatatattttttcacgtatcattttatgtataagtgggttcttaaagaaaaaaaattataagtggattcttaaaaaaggataaccacctcgacgcattcaacaaaataatgccatacttaattcctaaactagcgtgcatagatatagaaacttaaactaattaaaacacattagcaagatttttttcaatgatttaacgaaggaggagtatgagatagaggagaaaagtgataggtggggaagtggtcccagcaccaaaaaaaatgtgtggctgtcaccaattggaatgcaccaaattctttttacgacataaaaacaaaaactgaaagattgttttttttgttttgctttctgataggataactatgacgtggcatgcgtcactagacgcattatcattcgcgcgtccatttcacgtggtacagtcaaattagtcaaacctcccgggagaaacgaatgttcttttacggttttaacttttaacttttaatcttgctgctttggcctattaaactcttcttttctgagcaaaatcacacacgctatgttttatggttacgtaaacgcttttttttattggcttaaaccaaacataacgtgtagtaaatagaaactctccattcacttcttctttttttgtttgtttaaatgttactaagatttataccaaatcaaaaatattttcttatgttttcggacaaaactcaagccccatttacttttttttttttttttgtatgttttaatgttactataagatttattccaaatcaaaaatcttttcttatgttttcggacaaatctcaagccgcccaaaattgaattgttagccaactacccttgagcacttaaaacctccaatcgttttccttttttcttgttttattttatggaatacagatcctttatactataaaatagatttttgagaagtgtcatagttggaaaagtagataacatatttaagtcgaatggggggggggatgaatatgaaaaccacggtaatagtatatttttgttttttaccgtatttatcattccagtatataaaaattaaaatgtaaagtttaatttttaaaaaaaattacgtataaattatttcaacaaataatcatcttctatggtggaaaacaatttccaagacacataaagagttaccttaattaatgatacattaaaaaaaaattacctgatggtttctgaacctcacaatcgtgtggacactatagagttgatcactggaaaaatcataaatattcgtgttggtcaactattggctcatagctcacaccatttaataagttcaaagaagatacaatgattacctattacataaatcatacatgcatacgtgtggttgtccatattttgacattaatcatatactataataaactcatatattttgtgcatatatgacatacatagctatctctattgtaagttgtaagtcgtaaccactatataaactaattaattacatatgtatatagtgatagatatgttgaatgatcgaagagataacggtgtctcttcacgaaaatagagtttcatcaaaagcaagataacggagtactaattatctaactcgttaattaattgagctctatcttagtaagattcaccggacactgcaatatacaattaaccacgtgcttttcaagtgaatattcagttaaattctcatttgtcttttctttagaattgacaccttaagctatttctagtcattctcaaaatataaaaagttaatggtccttaattgccgtgacaattgctattcttcttttattcccaaaagagatacaagtataaaagatcgaaacgctatactatttattaaaaaaaataaaaatacagttttaattatatgaccaaaaagacttttgatatatttgatcgaaaaatgaaaattgatttagaacttgattggttctcctactaccatatgcaaatgttgagtttgcggttgctagcgtttaaaatgaatcaaagaaattgctttaaaccactttggatagtttttttattgttctaatgcaaaattttaaagaaaacattcccgtaagtatttttatttatatattagtgaattaaggacaaaaaatgtatctcacagttttctcagaattttcttttttgacatagtaatgaataaattgatgtagattctatgctgtttatagaaacaaaaagtaaccgttttaaatgcctcaattgacgttaagtctgtcttggtgcaatttaattatgtttcgtcatcatcttttcaagttcacgcactaagcttagtgaaaaagatacgccttttttcttgttctgttttgttttgcatgtcacagtaagtaactctcctcctcaattatcaaaaatgcaaactttaattttcttctagagaagagccactctctccacttctttctttgtccaactttttagacagagaaagtggcgtcagagatagatagagagatacatattcaagttggttgaaggaggagaattagcggttcatatcagtacggagaaaattgtcagtcatatgctttttttctttaaattctgcatttgagtgggtgtgtgcttttaaccattttggtgatttatcaaaaaaaaaaaaaaaattctgtgtgttttgagctcaagctctctacaaattttgctgtctcaagtttttgccttttgaagtccaataaagttgaaatctttgttctttttgattggtcttcgtgaattccggtgaaagtttcaaacttttgatttaaattccggggaggaattagggtttatg

SEQ ID NO: 10803 - DNA, 3000 bp, Unknown
  misc_feature (1)..( 3000): cDNA_ID_2714264_gDNA_ID_2214450_Annot_ID_132914 3000 nt of promoter + ATG
tcactaagcttagtgcgtgaacttgaaaagatgatgacgaaacataattaaattgcaccaagacagacttaacgtcaattgaggcatttaaaacggttactttttgtttctataaacagcatagaatctacatcaatttattcattactatgtcaaaaaagaaaattctgagaaaactgtgagatacattttttgtccttaattcactaatatataaataaaaatacttacgggaatgttttctttaaaattttgcattagaacaataaaaaaactatccaaagtggtttaaagcaatttctttgattcattttaaacgctagcaaccgcaaactcaacatttgcatatggtagtaggagaaccaatcaagttctaaatcaattttcatttttcgatcaaatatatcaaaagtctttttggtcatataattaaaactgtatttttattttttttaataaatagtatagcgtttcgatcttttatacttgtatctcttttgggaataaaagaagaatagcaattgtcacggcaattaaggaccattaactttttatattttgagaatgactagaaatagcttaaggtgtcaattctaaagaaaagacaaatgagaatttaactgaatattcacttgaaaagcacgtggttaattgtatattgcagtgtccggtgaatcttactaagatagagctcaattaattaacgagttagataattagtactccgttatcttgcttttgatgaaactctattttcgtgaagagacaccgttatctcttcgatcattcaacatatctatcactatatacatatgtaattaattagtttatatagtggttacgacttacaacttacaatagagatagctatgtatgtcatatatgcacaaaatatatgagtttattatagtatatgattaatgtcaaaatatggacaaccacacgtatgcatgtatgatttatgtaataggtaatcattgtatcttctttgaacttattaaatggtgtgagctatgagccaatagttgaccaacacgaatatttatgatttttccagtgatcaactctatagtgtccacacgattgtgaggttcagaaaccatcaggtaatttttttttaatgtatcattaattaaggtaactctttatgtgtcttggaaattgttttccaccatagaagatgattatttgttgaaataatttatacgtaattttttttaaaaattaaactttacattttaatttttatatactggaatgataaatacggtaaaaaacaaaaatatactattaccgtggttttcatattcatccccccccccattcgacttaaatatgttatctacttttccaactatgacacttctcaaaaatctattttatagtataaaggatctgtattccataaaataaaacaagaaaaaaggaaaacgattggaggttttaagtgctcaagggtagttggctaacaattcaattttgggcggcttgagatttgtccgaaaacataagaaaagatttttgatttggaataaatcttatagtaacattaaaacatacaaaaaaaaaaaaaaaagtaaatggggcttgagttttgtccgaaaacataagaaaatatttttgatttggtataaatcttagtaacatttaaacaaacaaaaaaagaagaagtgaatggagagtttctatttactacacgttatgtttggtttaagccaataaaaaaaagcgtttacgtaaccataaaacatagcgtgtgtgattttgctcagaaaagaagagtttaataggccaaagcagcaagattaaaagttaaaagttaaaaccgtaaaagaacattcgtttctcccgggaggtttgactaatttgactgtaccacgtgaaatggacgcgcgaatgataatgcgtctagtgacgcatgccacgtcatagttatcctatcagaaagcaaaacaaaaaaaacaatctttcagtttttgtttttatgtcgtaaaaagaatttggtgcattccaattggtgacagccacacattttttttggtgctgggaccacttccccacctatcacttttctcctctatctcatactcctccttcgttaaatcattgaaaaaaatcttgctaatgtgttttaattagtttaagtttctatatctatgcacgctagtttaggaattaagtatggcattattttgttgaatgcgtcgaggtggttatccttttttaagaatccacttataattttttttctttaagaacccacttatacataaaatgatacgtgaaaaaatatatggtctcattgtctatctacacatctttataagtcgaaactcataaccaccatccattatgtgttgtctagattatttttttttcgctttcaaatcgcatggttaaatatgatctgagtaaataccactgaaaaatatttagaatgaaacatcctaatcatccacaaatttatttttgccttggtttcacatatactgtgcccaatctctaatacataatattttgatctgtttaaaatattttcttattgtccggatctaaaagggtatccctagtgttgatataggccaaggcccatttatattctatagcacgtgaacgcccaaagttagtggttcacaaatcacaaatcaaaccgcaaatcatgtaaaccacacatcaaaccgatttggtcaacaatatcctttctcttcccaataatttttgactcatcagagaataatttggtcttcgtctctgcgcgcgtctctgtctgtctctttcagattcaactggagcaagtacgaaacataaatatcaataaattaaaggaaaaaaaataacagtagagaagaagaacatgttttcaactcctcgggagcaaaaaaaataattcagcaagagaaacggcgaataaggtggaaatgatttgacgaagaaacgcttggctgagagtaaaatcggaaaaacaaaatctgtaatttattattatcagcctctaaatca

SEQ ID NO: 10804 - DNA, 3000 bp, Unknown
  misc_feature (1)..( 3000): cDNA_ID_2714260_gDNA_ID_2214450_Annot_ID_132915 3000 nt of promoter + ATG
tcttccacaaaaaacttattgcaagactaaacaaacagacaagtcttagaattaaggaaatgaattaagttttcggatctaacaaactttataaaaatcaattcagccaaaatttctgagaaatttagagtgccatgtatttaatcttctttatactttcttttatattataaccgaaattcaccacaagaatggataactgccaaattagctagagcttatctacacatttattagttcactctcactctttgatgtttctttcatctaaagtcaaccccttcgacacaccactatcacacatccatacacttgtcgtgtcttagtaatcatttcaactatgttttgagatccgagtccaaattatcattaaaaaggttctttctacatgccggtttacatttttgtttggtttaatgtgccggtttagtttagtttcatgtagggcttataaaatcaccttttagttgggttcaatatatatttttggtttcgtgaaagtcaactggtaatgattgattatataaccaaaataggtctcaaattaaatctcgaagaacggttataagaaacaaaagggaatgacgtacctatacatacttaccggaaggttcgataacattttaaattcgttgcttctaatttttattactttgcataataactctgaaagcggttgatcgatggttaattgttcaagaagttcttgtatggacggtgatatacatatatatatagaaggatctagatcgaaccatacatatgtggcaagttactctctacctagctagacaactttttaagtggcaacaagagccacgtagtaataagttggtgtacttgtatcattgtaatatgttacgcttttaattcgtatcagtatatcttagtacactgatacttatacacagatcatacctgtattgttctttcgtcaaagttaaccaatataaaatatatatttcttgtccccattccttacaatttgatacgtatacgggaccaaaaaatacaagatatgacagaacaaacaatagatattttcagtcagaaaaacatatcaaattttttatatatatgtaactggagatcggattcataactgtatcttaattttcatatcttattattaggattcaaataaacgatttctttgatatttctgtggattgaacttatagccactaacaaaaattcaaccacacaactcactttttccgtctgtaacaactatttataaaatggttacgtataacaacaaaaatgcgttcaagtatttataacgatgcaggtggtcgttacccgaccgacttaaattcatttctcgaatttcgtggagcattgcatgcaaatatttctcatcaaaaagaaaaaaaagaaaagaaacagttgacatttattttattaaaattctattcctagagtataattttatcgtcaatgtctttcataaccagcttgaaatttttggcacgccttagacttttagataatgcttccttttataaataaaatctatcaataacataaatacctaataaatattagtaaccttgaatatatacattaatacatatggaaatgtcatcaataaaaatactataaaaatagattcttaaatttattttgtatctaaaataatataaatacattaaactaatatgtattgtttgatagtatcgtaaaataaatataaatgtagttgaggttaagtagaagataagtcaaactaggagagctttacataaatacaagaaattaaaggttcatcaacaagacaatgaaatctttagtattactattgaataaattatgagaaaaatgttaagaaatgtgattgaatgtacaacatttaaaatgtatacatgtatatatagttatacacacacacacacacacacacacacacacttatatccttaccatacactagatcacttaaatttgtttgatagaatacatttactagatctataacaactacattttaatttatatatatatatatatatatagagagagagagtaaaagtgatatttctattcactctttaagtgtttttattttattttaataattcatcaatccatttaaatcatttactaaaaatttatgcatgtactgataattgatttatcacttgattatattttccagcaacatgcaatatatctatctgaactcgggtgttgacccaacgaaaacactaacacgacctttgtactacatgtacttgtcaaaagatcaaacttcttagactgcattattatagttgttaactttatatatataactatataaggagaactctgttggcaaataaattaacatatttacattagatgttgaatcatagtcaattcatgcactattgatactagagtagatagtaatccaccaggccaattgggatttttagataataaaaatactatgaataaatgcatcaatccacctgtcaatgattctacactataaattacagtgtgaataatttgttagtcaatattattttctttacaaagtaatctaataatgcaagataagaaaggttgatcaaaacaaggaaataaatatccatatatagtgaattaattgaccatgattttactatttatttgcagatactattctctttttatacaaatcctccctaaaatgttgaatttaatctgaagaaatcttagtgaaatatattttgccacctagtcattaggaagtgatgctcacgacgatgaaacgaatagtcaatccgatggctaaataattaattatttagaatttactcgttgacttatttaataaaatgacatattcaagattaacttgacatacatacatatgtaaatgtgagtatgcgtgtgggtctatataaatacatgagagtaatcgtgtgaatacaaccattacaattgtgtgactatcatttaaagaataaagcaaacacatgatccaaagaagatagatagggagacaaaaaaaaatcaaggcaaaaaatg

SEQ ID NO: 10805 - DNA, 3000 bp, Unknown
  misc_feature (1)..( 3000): cDNA_ID_2714248_gDNA_ID_2214450_Annot_ID_132919 3000 nt of promoter + ATG
gttattatgcagatgtatgtcaatgaaggtttagtcgtacaggcaaaagctctgtttgagaggttccagttggattgtgtgctttcgtcaacgacacttgcagcagttattgatgtctatgctgaaaagggactgtgggttgaagcggagactgtgttctatgggaaaagaaacatgtcaggccagaggaatgatgttttggagtacaatgtcatgatcaaggcttatggtaaggccaaacttcatgagaaagcactttctctcttcaaagggatgaagaaccaagggacttggcctgatgagtgcacttacaattccctattccagatgcttgctggggttgatttagtggacgaagcccagcggatcttggctgaaatgctggattcgggctgtaaacctggatgcaagacctatgctgctatgatagctagctatgtgcggcttggcctgttgtctgatgcagttgacctgtacgaggcaatggaaaaaacaggggtgaaaccgaatgaagttgtttatggttccttaattaatgggtttgctgagagtggaatggtcgaagaagcgattcaatactttagaatgatggaagaacatggcgttcagtccaatcatatcgttctgacttcccttatcaaggcttatagcaaagtggggtgtcttgaagaagctaggagagtgtatgacaaaatgaaggattcagaaggtggcccagatgttgctgcatcaaacagcatgctaagtctgtgtgcagatcttggcatagtttctgaagcagaatccattttcaatgctctcagagaaaaaggcacatgtgatgttatttcgtttgcaacaatgatgtacttgtacaagggcatgggcatgctcgacgaggctattgaagtggctgaagaaatgagagagtctggtctactaagtgactgcacttcatttaatcaggttatggcttgctacgctgctgatgggcagttaagtgaatgctgtgaactgtttcatgagatgttagttgaaagaaagctcttgctggattggggaacatttaaaacgctcttcacgctcttgaagaaaggtggggtgccaagtgaagctgtgtcgcagctacaaaccgcatacaatgaagctaaaccactggcaacaccagcaatcactgcaactctgttctcagccatgggtttgtatgcatatgcgctggaatcatgccaagagctcacaagtggtgaaattcctcgcgagcattttgcatacaacgcagtgatatacacttatagtgcatcaggagacattgacatggccctaaaggcatacatgagaatgcaggaaaaaggtctagaaccagatattgtcacgcaagcctaccttgttgggatatacgggaaagcgggaatggtggaaggtgtgaagagggtacatagccggctgacgtttggggagcttgaaccaagccaatcgttgtttaaagcagttagagatgcttatgtgagtgcaaacagacaggacttggctgatgtggtgaagaaagagatgagcattgcttttgaagctgaaagggagtgtagttcaagatctggagaagaagaagaagacgatgaagaggaaaattctgaagaagacgaggcattttgaagtgtagccacagatgtatgtaagaaatattgtagaatataggatttagtggaaatggactgtacagtttcacagaagccaaaggaaatatgcatacttaagcctcagattgatctctggtaaagaaatgtgtatcttaaaactgttatagaaagaaaaaaaaaggttccacagggtcaaatctataaaagcgagcacctttggctatggttttggtagaggaattagcatacgctccttacaacaatagattgatttgcatcatcgggttggtcttctgttggttttggtctctggattgaacatctttctcctgtcttgcttgctcttattttcaattgtatagcatcaaagcccatgaaaagagccagatgttctggaattgattccaatttggaatcttgtcagttactggtgatgaatatcaacatggaagatatgaaacagagtagccagcaaattccttccattcggaacaaagagtctctcagcttcagtcaaagtatatcagttattgatctcaagaaagtaatagtagtgagcaatgaagatgatgatggagctctagagttgaagaacagaggagtggaacgaaccagtggagaactcttgaagaccacagtgtcaatgtgtttattgttgtctttgtctttctctaaaagttgtaaaaaaaaagggtgtgaagctaaagctaaatggtatgtaagcaatgttttgcaattttaaatttacaaaataacactcggagtttctgaaagtttaattttgacccataatatttgatatttgaggcattgtcctggaattaaaaccaaattgaaactccttcgcgtgtgttttctgctgcatttttacctcttagcgtctccggcgaaaacccactacgactgagtatggcgctcgaaatcgaagctcgagagtaagatttcgctttctcttacaaaccctagttttcgtttagtgtcactgatatgaattgtgctccaagaaccatcgtttacgaatgctcagatggatcttaggttacatgtttggagaaaacatcttgaatgttggtttttttatatcctccatactaaagttgtggtttttaaatctacccataatttgttttagcttggttcttctaaagctaattgcttctgaatatctagattcctccgtagctattcttcgtttaaattaacgtcgtatacgaaaatttgagggagatcatcgttagagtgttttgattctttgcaatgcgtctcgaggaaaaatccaatttgtataaatttgaactcttgttaattctcggcttggattgaaaccattgacagtattattagccattttgttagtaatattggatggagaacgttttgatgctat

SEQ ID NO: 10806 - DNA, 3000 bp, Unknown
  misc_feature (1)..( 3000): cDNA_ID_2714215_gDNA_ID_2214450_Annot_ID_182447 3000 nt of promoter + ATG
agaatcgagagaagaagagaaaggaggaggaaatgtttggaaatgatgaagcgtgttgctcagttctgctagttgtcttatgggatcatccattgtaaatgtctgaaaatcagaagagagattcgccatttctgagtttcaatttttattttttttttgaaaattggtgaaaatagaaagtggctgttttcgagcgagtggcaatgtttatatatagactagagttttcttattattatttttttgaaaaaaattggaataaaagtggggttaatcaaaaagatgagaaaataaaaaaggagggccaatgaaagtgagagttatgggatttttgtataggagtgggtcacacataatttatcaggagatatatccaaatagagaagtgggccaacgtttggtagccggaccagtgagcactgtttaagcaaacttctttcattatttctcaagggggaagtacttacttaagacctcctcaacaaagtattttatttcaattggtgctcccttttctgctttcttcttctagtctattgtgatttgtgaccaacgagcgagtaatccaatcctattatcgtacattgattgcatttgctatatggatttaagatttcattggttatacagttttagttattttaccgtttagtattaaacactttggtaagaagaataaaaagttgtatggattatattcaagaatagtttgattgatgatattcactggtttcaaatagtattaacatttttagttaaatagtacctatttatgttaaacaaaagaaatatttttgtatgatacttataatgtgatgtgatagtatacgagctaaattaatgttggctatttataattttttttttttttggaaaacaatatgtggattatgcagatttacatccgaattaagacgtatcgaccaccttgccacaaactagtagcagaatacatgtcatgatcgatttatctatatttatagtttattgaataaacataattaattaacttagctaggtctactttgaaatttaaaatgtggtctaagttgaaacttaaaatgtcgaaatcaatataagttcgttttaacttggtttggtgtctctagacttctgaaaacgtttttctttctggtatattttactatatagtacaattaggttcctatcaaattaagtaaattgacctatcactatataccattttcaactgatcaaatcacatgcagttacatatgcattcaagactcaatctaacttgttgttttgactttaggcattgttatttttaatacagtacttaactaattgacacaccggaagtgctgataacaagcataaatggtcaaatcttttgaataattgttcgacaatctttttaaaccccttgattttttaattctttttgataaaataaaaccccttgaatttccaaagctttttaggaacagacgacatatataagattttgaacgagtctttagtccctaatagtgttggacaaaaatagcagccaattcaaagtttttgatttacaactgaaacaaatagcaaaccccaacttgaagaaagaaatccaaaaacgacataactgaggaaaacagtaactgaatacaagatgtatgctacatatcaaactttacataacataccaggcccgaccatgagtgtattactgggtctaaaaaaacaaaacaaataacaaaaacataattgtaagaaagaaaaagtcaattgatggcaaaaaaaaaaaaaaaaaaaagaaagaaaaagtcaaaaaaaaaatttgtaaaatttgagaccataaaaactaaaagagtagtaactactaaacattcaaaagaattttactaaaaaatgttttgtcttcaattttaaatacattttgaggtttattagtttgatgggttttaggcatgtacctgacttgttacacacatgatacacccaatcgaaaaaaatcaacaaatagaacggaaccggaaaacgatatcacatagtataagactacatagcttagttttggttttaaagaaaactctgataaaaaaaaaccggtagttcgacttctttgcatgtgaaactaaacttccttagtaataatacttagcttgttcaacttttgttatggtcattaattaattatctctttacttagaaaacaaaaagtcctatagtctgtaattaggttggtgccaagctgttcctctttaggaagatggaacttgaagttgaaattatcgtacctataaaaattattactttgaaagacatattacctaggtttgcctaatacagctccactaaatcagactcgattacgcaaaataaacataaacttcgaaaatacaaattttcttctgttgctaattcatatcaaattatgtattaagatctcaaatataacgaacgatccataaacatataatttaaaaggtcctcttctttgtctctttatatatatatacacgtaaatatgggtgaccttacatgttttgatcttcatattcatctaccttcggcgaaggaagacatcgaaatggagttcctcgagtactcctcaacgatgctatcatcatgtccagccgctccacgtccactacttcttctactcttaaaactgtttggttcgcttccgtttaatccaaaagttcttgaaccggctcctgtaccggtcccggtacttgtatagccgcctcctctacgaccttggagtccaggccgacccggtttaggcaatcgtctctgttgtgatgttgattggtaggtagtcctctcttgtgatgttgattagtagcttaaatgtaaaaccaaacaattttcgtgggtcaataaaagcaaaaatgaaaaaaaatattcgatctcttagtccggcccatgatcagtttcaggcccaattcaatccgtcgcattattaaaaatctctgaaatcgacttttaacttgtgaaaccgtcacagtcgccgggaaaaaatcacagatttcttcgacgccgccgatg

SEQ ID NO: 10807 - DNA, 3000 bp, Unknown
  misc_feature (1)..( 3000): cDNA_ID_2714219_gDNA_ID_2214450_Annot_ID_182446 3000 nt of promoter + ATG
atcgaaaaaaatcaacaaatagaacggaaccggaaaacgatatcacatagtataagactacatagcttagttttggttttaaagaaaactctgataaaaaaaaaccggtagttcgacttctttgcatgtgaaactaaacttccttagtaataatacttagcttgttcaacttttgttatggtcattaattaattatctctttacttagaaaacaaaaagtcctatagtctgtaattaggttggtgccaagctgttcctctttaggaagatggaacttgaagttgaaattatcgtacctataaaaattattactttgaaagacatattacctaggtttgcctaatacagctccactaaatcagactcgattacgcaaaataaacataaacttcgaaaatacaaattttcttctgttgctaattcatatcaaattatgtattaagatctcaaatataacgaacgatccataaacatataatttaaaaggtcctcttctttgtctctttatatatatatacacgtaaatatgggtgaccttacatgttttgatcttcatattcatctaccttcggcgaaggaagacatcgaaatggagttcctcgagtactcctcaacgatgctatcatcatgtccagccgctccacgtccactacttcttctactcttaaaactgtttggttcgcttccgtttaatccaaaagttcttgaaccggctcctgtaccggtcccggtacttgtatagccgcctcctctacgaccttggagtccaggccgacccggtttaggcaatcgtctctgttgtgatgttgattggtaggtagtcctctcttgtgatgttgattagtagcttaaatgtaaaaccaaacaattttcgtgggtcaataaaagcaaaaatgaaaaaaaatattcgatctcttagtccggcccatgatcagtttcaggcccaattcaatccgtcgcattattaaaaatctctgaaatcgacttttaacttgtgaaaccgtcacagtcgccgggaaaaaatcacagatttcttcgacgccgccgatgaggttccggtacgcaatggtttgttcgtcgaatcagaaccggagcatggaagctcacgctcttcttaagagacaaggactcgacgttgcttcgtacgggactgggtcacatgtaaaactacctggaccatctctgagagagccaaacgtttacgactttggaactccttacaagcagatgttcgatgagctcaggcgcaaagatcctgaactgtatcctcttaatccgttcctttcttttgttgcttacggatcatgatttttcgaatccctaagtttgctttggtcactgaatcagtctcagtctccttctaattcgataatttgcttactttcttagtctccttgaaattgtttcctaattcacatttaagtttcttggtttgatttaaggtattgattctgggaaaaagtatgttttcttctctccaaatgactgaagaaaaagtgtgtgcgttttagtaaatatacgaaatttcttgcttgtagctattgtgaagcatgttcattgggttgtatagggagatttgtaagcttgaagtttgatgcacttaactgttttcatcagatacaagcggaatggtattttgcagatgattaagaggaatttatccgtgaaacttgctcctcaaagatggcaagataatgctggtgatggtgtgtttgatgtggttatgacttttgaagaaaaggttttcgattcagtccttgaaggtaattgaaaaatcctccctattttacagttagatactttgtttgaaaattgcttcatcctgattgctcactacgtacatattgatcacaaactcttataacattggaagaaaaaaatcctggtatcagtagatttgttcatcaacttatcccatttgaagaaaatcgaaatgttgacactttgatcttctacatgcattgtttccgaacaatcttctcatttggtaaattatgttaaactagttaggttagatgtttacatatgtgaattgatgaagtctaagtcatgtgaaactcaaaagttctgcttagtgattgccgtttcctgtaacttagtttacttttttaccttgctgtaattgttagctgaaaacccgattgcaatcatggtttgatagaactgtcggttttcttgctgcgtgaaacattcctgtgtcttaatatctttatctcatcaagttagatttgtccccaatctgcagatctcaacaacagagaacaatcacttacgaaaacaatacttgtgatgaacttggaggttaaagataaccacgaagaagcagctataggtggccgacttgccttggaactctgtcaagagattgaagggaatgaaacatgggaagatacgatcgatgacattgttgcgggttttgaaaaacaacacaggcggaaactggtctacagcatctcattctactgaagataccatcatcagtcgcattaacggtcagattatgtagagtgttcttctgtgaccccagtcttgagatgttgaacaaattatttttagttcatcggttttatatgttttagggttaaatacttgagagtgtagaagaaattgcatgttagaaactgagaattcgtcttccaaacacattctcttgtgttgtttctcattacttgaaagttgaaacagagccttgtcaaaaaaagtaataaaaatataaaagataggtgacacacgacatgtcttaaccaagcattacttcatgtttaatgtcacaatctaagttaacgtgtttatataaaacccaagtcgtgtaccaattgaattaaccctacccctaaaatcctgtacaagtcaattcaatgtttctagttaaatccaaagcccgtgagatcagatatttaaagacacccaatgacgaaaagtctctttaaaattcataaccttgactatataacgtcccacggttctaattgttagtttcagcagactcacaaaataatg

SEQ ID NO: 10808 - DNA, 3000 bp, Unknown
  misc_feature (1)..( 3000): cDNA_ID_3033063_gDNA_ID_2214450_Annot_ID_182445 3000 nt of promoter + ATG
atgtatttaattacgatctcttaagagaggcccatttccgttttaacaaaatcttcttcatccctgatagtgagaatttcaatttcaatgtcgccgatcatgtcgacggtaaatccctgcatctttcttcaagacgcttctcatagttccctattttctcgccattttatgatgaatgatttcatatagtcacctagatctctttgaaaaacctttttttaagacctcgtatgaatctgatagactttatagatcttcgtacatgaatccgatagacatagatcattgttttaattttgaacagtagattttgttctctctttgtgcaacatcacaaaatttaagtttgaaccctagaaaatttaggaagctatatttgttaatagtggttagttatcatacatgtattattgaattaataaagttagagagattaatacaaataataaaggaaagtggtataacttgcaatatataaaattcctaaatacaaggaatctttaatacttttgcaacactaaacacaaattgctagactgcatattatgagcaacctagtttctataatttttcttttatagtaatatacttttctcattgtttgacgaatacttttttgggaactgtgaatttttatatgtttttcttaaaatttatagatttataataaaattttaaaacattaaactatatattttactatatttattatatataatttatctatatattaaaccatattgttttgcctatgacatcatttttttgcacggctctgtatttaagtgatgttaattagagaatgtcagttatatgattggctcgttgagagtggtcagattgctatgaaaatttcgaaatttcgttttgcggctctaaagatcggcttactgtcagcgtcactatttcatatgaaagtcctcatggtgggtttttataggtggataagactttcatgttttctaaataaattttattttgtaaatatatagagttaccaaaatatatgatttgacagcttattagtttttacggtttgtttttcgttgtttgattaggtgattcgttgttcacttacgtgactaatatgattgtttattgataagatttggagatgactcgagctcatataaactaagccattgatgtcgaaaaactgtttaaaaaatttagtcgctaatgtatactcacgcggctgtattgtcccgtacgcggccacttttattttgtattgaagtactaacttacgttttaaaaattagactgaaactcaaactaaaatctgttttgtcccgtacgcggccatttttattttgtattaatgttctaaattacattttaaaaattagactcaaactccaactaaaatctccagccagcatatatatatagaatgttgcttagtcaatagtaacaaaataattgcaaatgtaaaggctgcttccaagaaaaaaaaggcagtcctatatcttttaacttgatatcttacaaagttataaaatggattactcacatcatagtctttgaaaaactaaaattattatgaaaaggtacatattaacacacccaaaaataaaaaaaaataaacgttcttgagttggcaacccctaaaagtggatggcaattcagaaatgggcttttaatgtttagattccataaaaagtgaatagatggttcttattctgtgtatgtgagatatcaatatcatcgtgacaaagactatgtgacaattaccatacaatttatcatggaggcaaagcattacaattataatgctaccaaaaatattttgaagttaaaacaaaaaaaacttattaaagttaattaaaagcaagattttcgacagagactaaacagagtcgattgaagctaaaagcacgacaagttttgagaggatgattgagatttgtaactcacccgacaagaaattacccgaaaaggacaaaccaattcaatgaaccttcgtcgaaatcattcacttgaccctttatatagtatagtttatattaacacataagaacttggataattttagtttcctttaacgcatgacatttctatattaaataaaaactattgttgttttttgttctcctgcttaacttaaaatgacagctattaaattatcaggatatttttggaaaccgatgtaaaccgaaaaaaggttattataagactttctttccttctttcttatttgcttaaaagatatatagttcaattttttgttttcttgcttaaagaaaagatagttcaataaaattgtatctatataaaagggattgctaaatagacatacaccgtatttatcggacgagaccaagaagttcaggttattgcaaactttgcctttttgacataaactttagaaaacaaatctgaacctgtctttttctctgattttcataatttttactaattaggttagagaggaacaaacatgaatccgaattatatagacaatcaatttttcataattaagtatgttgatatgatgatatcaatagtgttaatattcttacaagataaagaaaggaacaaaaattcttcgaagaacggaccggatcgatcgtatactcgtagtgctctctctacaagaagtaatcatgtggcatatggatcacgctttatactagcagttagatctaaaacccaatcgggtgggaagatcggaaccgtccatttgtcaacaaaggaagctttctaaattggagttgacgtcaaaagtctccctatttatgacgccataaatagattattcgcgtggatcagacttcggacttctttggatattgccaggttgtttcctttgtcgttcttcgaactttctttatttttttttatttttttttggtttttgtgagactaaagactaaaactatataaatatcatcgccgtataagattatgtcaaaacattacaaaacctagttttgatctaagcgctctctctctaactctccctctctttctctcacaactcaccagaacaattccatg

SEQ ID NO: 10809 - DNA, 3000 bp, Unknown
  misc_feature (1)..( 3000): cDNA_ID_3033067_gDNA_ID_2214450_Annot_ID_182440 3000 nt of promoter + ATG
aggaaaaaaagttaactgatgaattagaaagttgcagcatcattgggaccagttttgcatttacggccaagagctacccacacgaccaccactacgattttcatgtactgctagtattgatttattagtagtttaatacagctcatttagtcacttgttaaaaaatattatactaatcttagtatgttaatctacacttaacgtgccttcaatacaataaaaagaatataattggataccaaaaattagagaaatggacccagtggctattaacttctcacactggagagagagtgacatcaaactacaaaccaattttattttattttttttccaaaacggaactgaaagttgtttgaaaatccctcattggctcttcttctacatttatatttcttttactatacaatatcttagctctctgatacaactattaaatgcttaatatatgaataatacgtggtttagagtaactaacaaacgtaaataaaataacaatatttctccctactcgtggcaacataagctgaacagagccaagtacaaacaagttgactttctgctacaaactttgactatcccgacaagaaaaaaccttaagattgatcaggaaggatctcatcggttcttctatcttgtctctgaccattcttcttcttcttcttctcaacaacacttctgataatttaacattgcatctcctactcattctcatcgtcttcgtcttcaatcttctacacgaatgtcgcagtgaaattttttgactctttcagcttcttctcgccatctctaatggcgatcccttccttcctctctccaaatttacacttttacccttctaccaaactcgttccgagtcgactcactctttcctcatcctccttcgtttgttgtttatcagtagaccgccaaattaaccattcctccgtctccaacgaaacctccggcttacgagttgtcatatccgccggaggcaccgccggacacatctcttcagccttagcgatcggagacgagctaaaatcagccgacccacttgctcgaatcctcttcatcggattcccaaacagtatggagagcacgacggttccatccgccggattcgatttctcaacaatctccaccgtcggatcatcatcgtcccgaccattcctctgtttcacctctttcctcaaattccctctccgcttgatccaatccaccttcgaatcctacaaaatcctccgcgaactaaaaccacaaatcgtcatcggcaccggaggacacgcctcttttccggtctgtttcgccgccgtgatctcaagaactaaattcgtaatccaagaacaagattcaatccctggaaccactaactggattctgtctttcttcgccgatacaatcttcgctcctttcaactgtacagtcactaacctccccaaacgagtcgccgcgaagtgtgtcgtctacgggaacccgataagacaaacgcttagacgatactcgtcgaaaggagcggcgcgtgtgagcttcttcggacagtgggctggagctgtgtcggaaccgaaagttgtgcttttgcttggtgggtctttaggagccaatgccattaacatagctttgcttaactgttactcgcagttgttgtctgaacatgagaactggttctttgtttggcaaactggtgttgaagcttttgatgaaatggatagtcttgttagaagtcatcctcgtctctttctatctccgtgagttatacaacaacatttttaactgtttagctgcttttgtattgactaataactcaaaatgtgttttattatgtggtataaggtttttgaggtcgataggtgtggcgtatgcggctgcagatttggttatctcgagagctggtgcaatgacttgctcagagattatggctttaggcaaaccttctattctggtatttgaaatctataagctgattcatcgaatttgctaatggagtgtgttgtttcttgttttaaaacattgaatgttcttttgttttgttttttaagataccatcaccgcatagcgatgaaggggatcaagtaaggaatgcttctttaatggcggacattgttggatcaaagttaataacagaagaggagctagatacgatcactcttagagctgccatggaagatattctaggtgactaaaaactctacaaagtagaaaacactcacaaatttcaactctcattatctcattgagttggttccaaatgatagggaatgaagaactgatgatggaaatgagcgagcgggcattcaaagctgcgaaagcggacgctgcatcagatgttgctaaacacattatttctattatcaaatccaaagataagtaggtatgttgtatgaaccgtgttacagattacactagtgttgtgaaacaaagtatgtgtatgattgatgagcctcttagtagattttgaggaaacattcttgattgtgttggctaatttggcctagcaatagagagtgaataaaaaaaaatccttatatttggaaatagttgcgtttcttcttcctgttatctttactacttgtatatgaatcaaaactgatcctttgcatcttcttcttaactcaattatctatccgagtccggaaccttctcagctacgcagagtctctcttgagaatgtaactggatcagtgtatgtaaatgaagttaagctattttaacacctagatcaacaacccaaacattgcgtataagttatctatttcgtggacagttatataaacaaaatgttagttaagtacacgctttggaatcgtaaagatattttatattttggataaaattgcaccgacattttatccaatttcactaatttaagtcattttttctccattttgaaattgaaaatcttaaaccacaaaaattagaaatggagcggaaagcgactgagtaagatctttcaccttctatataaaccttagttctgctccggcgacatcgtcgggataccgctagtgattaacggtggtt

SEQ ID NO: 10810 - DNA, 3000 bp, Unknown
  misc_feature (1)..( 3000): cDNA_ID_2714241_gDNA_ID_2214450_Annot_ID_182439 3000 nt of promoter + ATG
atcatgaggttttcggtaaggaggactctggcttttaggcagaccgagtttcacccaccattcttcattccccgttggccaccaaggcggaggcgtccctttctccaacggatacttcctttgaggaggatcacaatgttgcatcaaagaagataacaaagaccctaaagtagcatcttgcaaatcctggagaacaaactgtgaattcctattcccatcagatttcccaaacgctaaacactcctcttcgtatttagcaatagcagcaggaccgttcttatcaaacttcactttctctttccaccaagctcttatattgtcagaggaaccactcacaggcttgcccttttccggtattataccatagacaaacccgcgaactttgcagacttccataagcttcaacatgtacttaaggataccatcttgagctctagacattttcttcctctgagcttgatcagagattttcttaggtgtctccttcgtttgagctccttgagagccagctttttgtcgctctttgattcttttaagcctgacacgatctttccacatccgtctctcaaggtcgtcagcatcaatctcttcatcactcacatcaatctcagcaacattatcactagctaaatcatcaggctcattctccatcctatccacaataagcaaactctcaaaaattaacagctttctaaagtttttgatttgataaacaaaacaaaatccatatatatcattatcttatgttgtcaatacagaggaaaacccaagtattcattgattcatcagctgattgagattgaactaatgattcatataaaccctaaattcacaagcatgaaagggaaattaatgaaattgaatcaaatgttcttcacctgatgtctgctacggacatagcaagatcgcccatttaaacaaaatcaatcaaaaacctttaacaacgataatctgaagcgccgaaattaaagaaatttagggtttttattctttctcctgtcgttctcaggggaagaagagagtaaaaaatggctgcgaattgtggagaggcaaagttttgatttagtcggaccaaagccaaagtattgttgtggcaataacccaacccccaaaggccaaatttttttttttttttttgttgttgcaaaaaccaagttgttttcttcggtttctgtttttttttttctttaatgtaaaaaaatattttgttactttatatctgttgtcgagtcaatctctctttctgtctctcgttttttttttctcaacacggatttttattggctcaacaaatagaataatagtatttattttgagtaattagttacgaggaataccaatgaagtttattgtatttaactgtccggattagtaaaaaaaactcaattttgccattaacctattcttttccccataaattaaagtcttttgggttttaatttggctttaaataaaaagcacattttcttaacttttttgggtttaaaatttgcataatgctaaatgctaacgtataccactcaatagcaaattgttgtcctacatagtgctaaatgctataactcaagcaaactgttcatcaagtcacttgacttctatcaaaacatgatgcatatggcagatagcacataggtaaacataattaaaattattttgaataaatttctattctaaacttttaattagacacacatttatatttttgtaatgttttttatgtttattttacaaacacactattcattttgaatgttttaatccaattattgtaagcaatctcaaaacaagaatagtttcatgctcattaagagattaagagaaatataaagataaaatttgatagctcatgaatgagttttattgtccaaggaaagaaaagaactttagattgtcaccaaaattagtaagactttgatgcaatcataaaatgggaaaaaaaggagagtagcctctttgacaactctctgagttaatcacattaattcacactataaatataagagattacttgtttagataacctaattacatgggcttctagacaatgataagcctttgaactataaaccatatgaattaaaccttttttatggaccctctaataattattacgttcaactttactcatttatcctagtcattttccacatccgatccaacttaaaaataatggtatcatttttctgaaccaccagtgtataaaggagaaggaaaaaaagttaactgatgaattagaaagttgcagcatcattgggaccagttttgcatttacggccaagagctacccacacgaccaccactacgattttcatgtactgctagtattgatttattagtagtttaatacagctcatttagtcacttgttaaaaaatattatactaatcttagtatgttaatctacacttaacgtgccttcaatacaataaaaagaatataattggataccaaaaattagagaaatggacccagtggctattaacttctcacactggagagagagtgacatcaaactacaaaccaattttattttattttttttccaaaacggaactgaaagttgtttgaaaatccctcattggctcttcttctacatttatatttcttttactatacaatatcttagctctctgatacaactattaaatgcttaatatatgaataatacgtggtttagagtaactaacaaacgtaaataaaataacaatatttctccctactcgtggcaacataagctgaacagagccaagtacaaacaagttgactttctgctacaaactttgactatcccgacaagaaaaaaccttaagattgatcaggaaggatctcatcggttcttctatcttgtctctgaccattcttcttcttcttcttctcaacaacacttctgataatttaacattgcatctcctactcattctcatcgtcttcgtcttcaatcttctacacgaatgtcgcagtgaaattttttgactctttcagcttcttctcgccatctcta

SEQ ID NO: 10811 - DNA, 3000 bp, Unknown
  misc_feature (1)..( 3000): cDNA_ID_3033071_gDNA_ID_2214450_Annot_ID_182438 3000 nt of promoter + ATG
ttctaacaagactatccatttcatcaaaagcttcaacaccagtttgccaaacaaagaaccagttctcatgttcagacaacaactgcgagtaacagttaagcaaagctatgttaatggcattggctcctaaagacccaccaagcaaaagcacaactttcggttccgacacagctccagcccactgtccgaagaagctcacacgcgccgctcctttcgacgagtatcgtctaagcgtttgtcttatcgggttcccgtagacgacacacttcgcggcgactcgtttggggaggttagtgactgtacagttgaaaggagcgaagattgtatcggcgaagaaagacagaatccagttagtggttccagggattgaatcttgttcttggattacgaatttagttcttgagatcacggcggcgaaacagaccggaaaagaggcgtgtcctccggtgccgatgacgatttgtggttttagttcgcggaggattttgtaggattcgaaggtggattggatcaagcggagagggaatttgaggaaagaggtgaaacagaggaatggtcgggacgatgatgatccgacggtggagattgttgagaaatcgaatccggcggatggaaccgtcgtgctctccatactgtttgggaatccgatgaagaggattcgagcaagtgggtcggctgattttagctcgtctccgatcgctaaggctgaagagatgtgtccggcggtgcctccggcggatatgacaactcgtaagccggaggtttcgttggagacggaggaatggttaatttggcggtctactgataaacaacaaacgaaggaggatgaggaaagagtgagtcgactcggaacgagtttggtagaagggtaaaagtgtaaatttggagagaggaaggaagggatcgccattagagatggcgagaagaagctgaaagagtcaaaaaatttcactgcgacattcgtgtagaagattgaagacgaagacgatgagaatgagtaggagatgcaatgttaaattatcagaagtgttgttgagaagaagaagaagaagaatggtcagagacaagatagaagaaccgatgagatccttcctgatcaatcttaaggttttttcttgtcgggatagtcaaagtttgtagcagaaagtcaacttgtttgtacttggctctgttcagcttatgttgccacgagtagggagaaatattgttattttatttacgtttgttagttactctaaaccacgtattattcatatattaagcatttaatagttgtatcagagagctaagatattgtatagtaaaagaaatataaatgtagaagaagagccaatgagggattttcaaacaactttcagttccgttttggaaaaaaaataaaataaaattggtttgtagtttgatgtcactctctctccagtgtgagaagttaatagccactgggtccatttctctaatttttggtatccaattatattctttttattgtattgaaggcacgttaagtgtagattaacatactaagattagtataatattttttaacaagtgactaaatgagctgtattaaactactaataaatcaatactagcagtacatgaaaatcgtagtggtggtcgtgtgggtagctcttggccgtaaatgcaaaactggtcccaatgatgctgcaactttctaattcatcagttaactttttttccttctcctttatacactggtggttcagaaaaatgataccattatttttaagttggatcggatgtggaaaatgactaggataaatgagtaaagttgaacgtaataattattagagggtccataaaaaaggtttaattcatatggtttatagttcaaaggcttatcattgtctagaagcccatgtaattaggttatctaaacaagtaatctcttatatttatagtgtgaattaatgtgattaactcagagagttgtcaaagaggctactctcctttttttcccattttatgattgcatcaaagtcttactaattttggtgacaatctaaagttcttttctttccttggacaataaaactcattcatgagctatcaaattttatctttatatttctcttaatctcttaatgagcatgaaactattcttgttttgagattgcttacaataattggattaaaacattcaaaatgaatagtgtgtttgtaaaataaacataaaaaacattacaaaaatataaatgtgtgtctaattaaaagtttagaatagaaatttattcaaaataattttaattatgtttacctatgtgctatctgccatatgcatcatgttttgatagaagtcaagtgacttgatgaacagtttgcttgagttatagcatttagcactatgtaggacaacaatttgctattgagtggtatacgttagcatttagcattatgcaaattttaaacccaaaaaagttaagaaaatgtgctttttatttaaagccaaattaaaacccaaaagactttaatttatggggaaaagaataggttaatggcaaaattgagttttttttactaatccggacagttaaatacaataaacttcattggtattcctcgtaactaattactcaaaataaatactattattctatttgttgagccaataaaaatccgtgttgagaaaaaaaaaacgagagacagaaagagagattgactcgacaacagatataaagtaacaaaatatttttttacattaaagaaaaaaaaaaacagaaaccgaagaaaacaacttggtttttgcaacaacaaaaaaaaaaaaaaaaatttggcctttgggggttgggttattgccacaacaatactttggctttggtccgactaaatcaaaactttgcctctccacaattcgcagccattttttactctcttcttcccctgagaacgacaggagaaagaataaaaaccctaaatttctttaatttcggcgcttcagattatcgttgttaaaggtttttgattgattttgtttaaatg

SEQ ID NO: 10812 - DNA, 3000 bp, Unknown; identical to SEQ ID NO: 10804
  misc_feature (1)..( 3000): cDNA_ID_2714260_gDNA_ID_2214450_Annot_ID_182432 3000 nt of promoter + ATG

SEQ ID NO: 10813 - DNA, 3000 bp, Unknown; identical to SEQ ID NO: 10803
  misc_feature (1)..( 3000): cDNA_ID_2714264_gDNA_ID_2214450_Annot_ID_182431 3000 nt of promoter + ATG

SEQ ID NO: 10814 - DNA, 3000 bp, Unknown; identical to SEQ ID NO: 10801
  misc_feature (1)..( 3000): cDNA_ID_3433799_gDNA_ID_2214450_Annot_ID_182429 3000 nt of promoter + ATG

SEQ ID NO: 10815 - DNA, 3000 bp, Unknown; identical to SEQ ID NO: 10800
  misc_feature (1)..( 3000): cDNA_ID_4266342_gDNA_ID_2214450_Annot_ID_182425 3000 nt of promoter + ATG

SEQ ID NO: 10816 - DNA, 3000 bp, Unknown
  misc_feature (1)..( 3000): cDNA_ID_2714279_gDNA_ID_2214450_Annot_ID_182424 3000 nt of promoter + ATG
tagcgtttgtagttgcagacggtagtggttggcaaaaaacatttttttatccaaatcttttatttactactaaaatatacataaacaacaaatatattaaaaaatagtatcaaaccctctatatattaacattaattctcaaaatcctaatatttttctccatcaaaatcatatagtcaattcatcaacaatggcaagatacaaactaagtattgtaataatactattgatccaaaagttttgaagtaattcgaaacataatttatttattttgtaattttgtcatattacttgatgttggtttttatgaaccaaaatgcatgaagtaataagcatttaactgataaatttattcgttttgaataattgtgtacagttttatatggtttttattataaattatatttatattattttttattttatcataataatataaacttttcaatcaaatatgaaatatgtatatatatatatatatatatatatatatatattcttttctataaatatgtttacaagtaaaagattcatatttttttctaaaaaataaaaagatataaaatcaaatatatatatatatatatatatatatatatatcttactataaaacgtcgaattatatatatatatatatatatatatatatatacgttctataatatatttacaagtaagagtatcatatacttttctattcataaaagatttataaaatcaaacagatctcctttctataaatccgtatgtgcaatgcatgacacctctataaatcttctttctgtagtctcttaatttttcacgttaatcaatattcactattcagtatacgagtaactaaatttaagagaaaagaaaaaaagaaacaaaaatggccaaggcaacttcttcacttgtcgtccccatcatctttcttgtgatatttgctttaggtatgcatttatctttaatttaatcatagagtaatgagttggcatatgtatccaatattgtagacttgtcattcacgtaactctactgtcatttttagtttcggctagattcattggcaatatatcatattgtatatatctttgttcagtgtattgataactcctaaatcttaatatagcttttgttatctgagtataaacgaaattaattaattttgtttgatatagttgagcagaatacgggatgttttgattatgatgtttaccaaccgtgcgatcattgtcgagaaagatgcctcaaatattatccagttacaagaaaggccatttgtcggaaaaatcattgtgtttgcattggcccttgtccggatgataaagcgattccagatgttaaactcttcaaaaatgtaaaagaacaaatcctaagttgaatgtcaaaatcataatatatctaaaaaactattttcagttgaagctttgattataataaaatttatagaacacaaaatttccagacatatgtttgttattgatgtggtgagcccacaaattttctcacaatttttatttatttaattctactactatcggtattcttaatattctaaaacaataaccaaacagagtattaaatctacttatcataaatatatatttcaaatttttaaatattgtcttatatataaagaagttttctgtaataaatgcattgaattcatgtattggaatattgttctgtcatcaactagattaaaaagctaaaacttataaaatatatgacttacacaacttatttaatttttcttctattgttctaaaaagcggtttagacgctaggtgctcaagctaaacataataaaatatatattagtatattatcccaatttttaaatatgttttattttcatagacatagttataaacatttatttatattttaatataaattattctttagttttggtttacaattttatattgtaattttctaatagatattttatgtaatttttatgtataatatcatacttttagtgttttataattataaataattgaatcacttaaaccgcttatatcacttaaacatcggttaaacgttctcgacgctaggcattggatcaccgcatatataacgccttgcgctttcttttttgaacattgcctataactaaaagatttacattgtgtcgttgttcaacataaattttttcttcatatgagtttttttataccttctatctaacttttttcatttgactcattcaacaaaaagagtgacaacgaattaccaattccatatctaattccatttggatacactttcaataccctacacaagtaatacacacccttcacattaaacccaaagtgagccctcttggtgaagtagagggtctaacattaaacccattttttcaaaactcgaaaataagaatttattttgaaaagacacttttaaaactcacataattaagggtataatagtttcaattaatataaatcatagttggacaattctaataaacaaagatatatatggacaaatcacaaaaaaaaataaaaaaaattcaatgttccccaaaaatacccacaaaaaaggaatatacagaccaaatataaaaaagagggaaaatacagaccaaatataaaaaagaggaaaactacagaccatatacaaaaccaaatacaaaaaaaaaggataaatacagaccaactgccataaaagaagaagagaaaagaagaccaaatacatatccattgcttgactagaggagagagattagctttctcatttacattcatactttaaattcgtgctaattactatataaattcgttgaattgcatttttctccataactagaatacagtgataacatttatgaacaatcaatccagtgaatatgatgaatatttgatatctttgaaagttatcttgtaattataaacctgtataaatacctactctttccctaagatcagatatatcttgtatcaactttcatcttctgatattcaccaaaacttctatccaaaaccaagttcaaaaatatgaattgcctc

SEQ ID NO: 10817 - DNA, 2306 bp, Unknown
  misc_feature (1)..( 2306): cDNA_ID_3033101_gDNA_ID_2214450_Annot_ID_182421 3000 nt of promoter + ATG
gaattcgtatgaactctctttggttagctgtaaatgcattggagcttatgtgagaaacaaaaagaaccagaaccaggtaattggcctcttcatcttttagccaccctttgatggtatctcttataatgtttggactcatatttttcgaaaatttcagatatgctggctttggcagaaagtcagttcggataatgataggggcttccaacgcttcttggacaatgtccagtataagtctagtggtatcttacgctatgagcgtgtctttggagaagggtttgttagcacagggggactcggtatgctctttagtcatcgagtttgtatcaactttgcagtattgatggttctgtttttgaatttaagttatacagaaccattaagtgaagctatcttttcttcttattatacttgtttcttttgatatagagacaacaaaggaattcgtggatatgctggatctgaaacctggccaaaaagttctagacgttgggtgcggaataggaggaggggacttctacatggctgagaactttgacgtggatgttgtgggcattgatctatctgtaaacatgatctcttttgcgcttgaacacgcaataggactcaaatgctctgtagaattcgaagtagctgattgcaccaagaaggagtatcctgataacacctttgatgttatttatagcagagacaccattctacatatccaagtataagcttccgctatttcttcttcccttatgactttaatttggtatccattttgtaatccctggtcttactctcaggacaagccagcattgttcagaagattctacaaatggttgaagccgggagggaaagttctcatcactgattactgcagaagccccaaaaccccatctccagactttgcaatctacatcaagaaacgaggttatgatcttcatgatgtacaagcatacggtcaggtatacagagatagaacccgtctcctcctatacttatttaaaaatcaccaaaagtcatctaaactcatatgattcaacagatgctgagagatgctggtttcgaggaggtaatcgcggaggatagaaccgatcaggtaagaaacgattttctttcgagaatgactcatatgctttaaaaaagatgttgaaaccaatttgctgtttgccttttaatcatcagttcatgaaagtcctgaaacgggaactggatgcagtggagaaggagaaggaagaattcatcagtgacttctcgaaagaggattacgaggatattataggcgggtggaagtcaaagctacttaggagctcaagtggtgagcagaagtggggtttgttcatcgccaagagaaactgattatggcatttactataagttggaaataaatttgggtatgtatgtagatcatcaaaacccagtaccctgctattatctctacaagctatatatatgtggctgtgaggttcctttaatgtctccattttacagcatatccagtttggtatttaatatatgtgatattttgaaatcggtttgatcaagttatacatagaaaagctcgagctcgatcaccattattgaatagaaacaaaaacaatgagccaaagtgatagccctgttattttactagtcgtcagcaactgcgacttgttatattgttcttgatagtcgatgtgttgttgttttggtaatagcttgctacatatttttttatttttttatttgtatgttattcttttttcatttttttttcatgttattacctagttattctataaatcttcttttattgtcttttaatgtttcaatcaaatataaatatatatatatatatatacatacatgtatgtaaaaatattcgtaaacttaaataaataaaatgtacatgtgcatgccaatattacctaggtattattctataaatatttttatttagtctctcaacttttcaataaaatatatatattctactagaaaaacgaattaatttatcaaatatcatatacttttctataaataaaacgatttataaaatcaactataaatattttactataaaaagaattaagttataaaattatatatagagtttctataaaatatatttacaagtaagaaattcatatactattctataaataaaagatttataaaatcaaacagatctcgtttctataagtccgtgtgttcatgacacatctagttattctataaatctcctttctgtagtctcttaatttttcacgtttaccaatatattcactatttagtatacgagtaacgaaatttaagagaaaagaaaaaaagaaaaaaaaatg

SEQ ID NO: 10818 - DNA, 3000 bp, Unknown; identical to SEQ ID NO: 10811
  misc_feature (1)..( 3000): cDNA_ID_2714244_gDNA_ID_2214450_Annot_ID_132920 3000 nt of promoter + ATG

SEQ ID NO: 10819 - DNA, 3000 bp, Unknown; identical to SEQ ID NO: 10810
  misc_feature (1)..( 3000): cDNA_ID_2714241_gDNA_ID_2214450_Annot_ID_132921 3000 nt of promoter + ATG

SEQ ID NO: 10820 - DNA, 3000 bp, Unknown; identical to SEQ ID NO: 10809
  misc_feature (1)..( 3000): cDNA_ID_2714237_gDNA_ID_2214450_Annot_ID_132922 3000 nt of promoter + ATG

SEQ ID NO: 10821 - DNA, 3000 bp, Unknown; identical to SEQ ID NO: 10808
  misc_feature (1)..( 3000): cDNA_ID_2714223_gDNA_ID_2214450_Annot_ID_132927 3000 nt of promoter + ATG

SEQ ID NO: 10822 - DNA, 3000 bp, Unknown; identical to SEQ ID NO: 10807
  misc_feature (1)..( 3000): cDNA_ID_2714219_gDNA_ID_2214450_Annot_ID_132928 3000 nt of promoter + ATG

SEQ ID NO: 10823 - DNA, 3000 bp, Unknown; identical to SEQ ID NO: 10806
  misc_feature (1)..( 3000): cDNA_ID_2714215_gDNA_ID_2214450_Annot_ID_132929 3000 nt of promoter + ATG

SEQ ID NO: 10824 - DNA, 3000 bp, Unknown
  misc_feature (1)..( 3000): cDNA_ID_2714203_gDNA_ID_2214450_Annot_ID_132932 3000 nt of promoter + ATG
atgagtaatgttcgagctctctgattggccagccatccaagaaggacctctgtcttgagccatcagacctgctaattggttattgttgtagtctccacgatattgacctcctccctgaaacaataaacaagattacaagcagtgagacccaaaagcaaaaccaaaaagatgtagagtttccatttagatgatttattaatctaaagcagaacatgattttaacggaatcagaactagaagtctagaaatatgatgatagcttgacaatgaaaaaagatgagaagaattattgccagaagaaatcatttctcatatctgattaagaataacaatgatagatgtttgagagaattctcattaaagggtaatctctactcgttgaaggtgtagtgctcggaagaaagcacatagataaagcaacataatttcatactcagtctgcaaaacatcaaacatatcgcctaaaggtcaaaaagtaagagtatcaatacctgatatgttggctgactaggcagatgtggctgtccctgcgggaattgaggtccaccggaagcagggggtctgttgcctgactgcaaaattggctcaaataacgagttctagtcagtcaaaaacttcataattcacaatgagggaaataaaaggaaaccgacaatagctactcataagtcataactctgactcacatgatacatgggttgagaaagatgctgagtaggtgcgccatggtgctgaaatccagtgtttggaccagtttgagcttgtccatattgatgatgatatggtctagactgttgctgtgccacatgaggacctccaccagagtgcattggttgttgttgcaactgagtggaggaagctggtatatcaagatgatgaaaaggaggttgctgggatgttggatgatgggaagccggaggaggcgcgttttgaacttgagaagactgtggatgagacatagaagtgacagcaggattcagatgtccctgacgctggggatgcgaaaaacgaggctgtgattgagcactatttgcagaaacagaaggcggtggtggaggcataggcattggttgtggtgttgggtgttttcgaatcggggcttgtggctgcatcgtattggctggctcatgtacactgccaccgccttggaaagaagacatatgagcttgaacgtttggctttggcgggatagattgatgagattgttgaggttgttgtacagcttgtggctcaactttcggagtctaatagaaacagatttttgtaaaatttaagatgcttgaaatgaaatctattaacaaaatgacttaagaggacgcaagtacataccacttgaggaggctgaaccattccgagcatgatttgtgcctggcatttcaacaaacatagcatcatcatcaccatatacaaattctgaaatctatttgtaaatagaggcataaacctaaagattgttcatatctggaaactaacacaaaaccctaattgttaacctacctgcttcttcaacaatactaaacccaaactagtccaatcaatttactcaagtaagaagctccaaatcagaattcctcattgcttataagaccacacggattgcagatttagaagatggaaaagattagcgaagtgaagaagaacctggaaaagagccttcgtcaaaagagggttccgaatcagaatctccctcgcttgttgatggttttgatcaatcaacgtctgcacaattagattcgactgatcaaaaaaacagaattcgaaaaaaagaagaagaaatcaattgttctctattcaaatccgtaaaggatagtgttatagctgataatcggaaaagtatagaaaagaaagaagagagaaccttcatttgagacataatatcatagagctgacttttagtcattccggcgagatttgccggtaaacctccgtctccgccgatctgcttacccgccatggttctcgtcggtaatcgctaccgagcttaacctgtgtgttaaagacgcaacacaagagtacttgtgaacaaacctgggccaagtataatacgggcccaattagtataattccggcccatttaaaattctagacttattagtctatggcgcctgtagatcaactctttttttggtcaaaaatttaccatttttctcaaaacaaaacacaacaataaaatatagagatgcattagatatgtacgttaaatatatttatatgaaattattaatatgtttctttacatgtaccatgttaattgtacacgtaacatgcatgtatattgtataatatgtcttttggaaaagcaaaagcttataaacacaagtttacattagagagaagcgtgtgacacggttttggcctcttcactttcttgttgctccagaaatcttctttttatcttgtctccatccataattttcatacgaagatagttttctttatttcatccataatattcaatatatattggattcttgcctttggtaagtcggtaaacatcatcaactttatttttattctttcaggtaaaaatagagtcttccactacattcatcttccacaagttttgctaattttaagttttgggtaagaataactaacccatgtatatttcacaattcattcataacaaatcaaatgattatgagatatacttatgggttatatatctcaagggattcagtgatctttaaacttggcacttggtataatttcagcatgccctttaaagaatgagtaggcgtataatcttgtctcaagaaaattataagaagtccaaatttataaacatgtattgagacaattaaaagattagaattaaaaaaaagaaaaaaaaaagaaaaagagacgcactcaactcaactttctattttttatttttgtaaaactacaaactttgcttttgattttgtagccgaggtagtctctctctctccatttgataggaagaagaagaaagatacaaaaagataaaagaaagagagaaaaagagttttaattaaa

SEQ ID NO: 10825 - DNA, 2016 bp, Unknown
  misc_feature (1)..( 2016): cDNA_ID_2714199_gDNA_ID_2214450_Annot_ID_132933 3000 nt of promoter + ATG
ttctagtcctttaaagaaaggaattgattgtggtgatatagcgacgtgacaatatatacaaatcaagaggttgtgacttcatcgaatttttggcaattttgcagtttacgccaaaagaaacaaggaaacaaacaattttacgccacatgacccacgaacaattgaacatctctctatcataggactcgttcctctgctttacaccaccattttatttatattactttatatggaatttacgcaagttatgtgacatgatatacaaaccttaattatatcaccattcaccaccaagttgaaatctgcacatttttgtgatacatgtgtagaattaataatataacctattgacgaacgagtgaatttcggaagtggaggcacaataggccttgattgatatgagagaccacttgctaacatagatgcgggaaatctttttgctttcatacgtccgattgctctgcgttgaagtgtgatagatcggtacttgaaacagttaaaattatcccaacactaattaataagtattaagtaacaacaataaaaacaaatattcctatattaaagctcgatatgataaataaatgtatcactacaacgttttccttaaatctgaagtattttcttgtctattttgaacgaaattaaagatcaatttaccactactatatttttggttttgttttcataacctatggttttaagtataaagtatgctaactctataatattgtagacggtggaagtaaagtaccacaacacgacgtgtgcccaaatcatacatgatacatattaaaatgttccgttggtcgtcgtaccccaattatatgttacaagttaatcgtttcttaatccaatttataatctgttaaaatactcgttaattttaggcaaggatttgccacgtgtaataaacccgtataaacgattggagaagccaaaaaagacttgttaattactgcgcgtcctcctacattcgcgctctctccctccgtacaacaaacaaaccccaattttttttttcctactctgtatagataatttttaatcattagagaaaaattaatcgtttaattagtttactattatccgctaataataatcaaaagatcaaatcaacccacattcccatcacgtctattttctccgtctctctgttttcttctctcaggttttagacctcctcaacgctcgtttccaagctttcccgataaaaacatcgtcttgattttctaaggtaatgagaacaaagatcgcatctttttttctttctcctcatatctttgttgccatgttgcgattttgctgatcgcgactttgagctatgttttgacttggtttttcaatgttgaatttttttttctcttgttgcaccaatgtacccttctggtaggttcgtctttagttttgtttccttctggctagttttgttttatcaagttttgttcgattgtctcacgttgctgtttttgtcttaatccctcaattcataatgctgtataacggttaaatcatgtgaatttatactgggaactagaaaaaatctcatctttgaatccctagattaatgaaattaatggaaatgtgattgttaggatttagtatcggctttaaatatggaaatatgagaaatttccttataataaattaagaattctcaaattcatcacagtaatccctgactctggttactatgttttattgtcagctaagattttttattacagagtaaagctgattacaatgatgactctgagatagttatgtctagcagtgccatttgatcatgttcttgcacgtctttgcatgtaggaaaagacaaaaagaactaggctttggttttcttttcatctagattgctcttctatgtgtgtgtgtgtgttcttatgaattttgtctaatgctcattttctttccctcaatcaactatgtttcaggagtttttgctaaagaatgcagcagttttggggtttccaggtgtttccataagtttgctttggacctcgaggcgtgatg

SEQ ID NO: 10826 - DNA, 3000 bp, Unknown
  misc_feature (1)..( 3000): cDNA_ID_3038118_gDNA_ID_2214451_Annot_ID_182559 3000 nt of promoter + ATG
tcacatctaaaccctaatggttttttaatgcaaccactatcacaaccgcagtgctcacaagaggacttaaaatgagttctcttgctgcccaggtgtccacaacgggaacagtgaggagatctttttttcatctctgagcggaattcttcaccatcatccccggatttgattccaccaggaactgcaggttgcaacccatttccaatgtcctgtagtctgcacgaaaatatatatcccaacacattcaagaaaatgacaagtcaccaaaaagcagagacaaaaagcttatggattataacctttcaagtacttggtcttcagaaaactcacgaacaatgcgcagtgctttatccacaccaatcccaagaacaccgcctgaatcataatcgtttcccaccaatagagaaatagcaatcaagtgtttccgcttcaaaccgaggccagactcgatatgtgacatatggtagcattcaaaaggttcctgcacacaaggaaattaagatggtaaagagacgataagtgagtcagggtaatactcagttacaaatgaatacttactcttgaattaggcttgatgtctttgatcacgcacatagcaccaaaaaggaaagcatcactatcaggagtaatgcaagcatccacaaaaccttggctgtttaactgtgcacagagagcttcagcctcaccattagctttcagcaccggaataccgagcaattcgagtagctcctagagaaccaaaaaaagtcataagaaaacaatgtgaaacaaaacaagcataaaggtttgaagggaaagccatcttaccacacattccctaacccattcagaaaacagcttgtttctctcaaccgagacaccatctttaatcacaggtagattacaagtatcaattccagaagaacggaaaaacctggagattctcgcctgagatttcaaaggtgatggtgttccatcaaccacaaaaaccgggtacgctccaaactgcaaaaccctaaaccgcattacaatcatctccatagaaaaaaatcaagatttttcaatcaagcgaaaacctaaaaaattcaaaaaaacccgtaatccacagaaaaaaggaacttttttagccaatgccaaaaaaggattaaaggagacgaaattgggaaattcagtagaagcataacaagagagaagaagcgcgcagcaataaaaaaaaaaaaaatgggacctttgagaagaggttgatagtacggaagaaagtgagtcggaggtgaggtttaaggacgaaacccttaacagcggtttcatgctgaacgatccagaaggagagatcaacagcgactcgtttgtttctgagaaaatcaaagccttgttgctgagcatatggtctcagcaaatcccagaaattgcctcccacacccattcaatcaaaatgccgtaatagcctagcggagcggagcggaagatcacaaaccgaaaagcctaaaccagcaaaaggcgaattaaaagaaaaggaagccgaaggatagaatcaatttctgaccgttatgcgagtcttgttggactcgcttgtgttgtgcctatctatttatggcatcgtcacatcacccgccacggttatgggcccaacaattagcccggatgatatctctgtagcccattaagtctattaagaaaaaataaaataaaaaactatttatacagatcgcccaccgtggggctcgaacccacgaccacaaggttaagagccttgcgctctaccaactgagctagacgggctttgttggttaagtattactctattcaattgtctagtagaaaaccagaaaagcattatccaaaaatgtgcaagtatggaccttaattggtgtctcgctgaggcctgcgggtaaaatagtgaaacacacgataaaccatttctagactgtagttatccttttttaaaagggtattgaattaaatgagaagatacgatgaatatctccgaatttcataggagtgaggacatcaaagaaaaaaaaaaaaaaatgtaagtcgtcggcttacgtgttcatacttggcttgaaagccagtacacaaagggattatgagtgaagtgtgaacaagcaatgatttgaatcataggaaatatagaagaaaacttggttatatggtatgagtaatatattaagtcacgccccaattattgttgcgtttgtcccctccctctccatttaatgtccacctacccctaccggcggtggaagctgcctgcattcctcgtccttcttctaaactactacccgttttcttttctttttttcctatttaaaactttcacggcttttttttctttttctttgtatagagtaaagattattgcaaaattcccacgtcttagatgaaaatttgcacctcataagactagacttgttcattacgtgttccatattctggtaggcaaatatttttatcattcaaactcttctataagtgatattaataaaaagcttgtatttgtttgtttttattggtaaatatataaatgaacccacgtcccctaaaggctaaagcaacattcagtaacagacggtcccgcacaagaacctcacaacagcgacagttacaaaacatatcatatatttcatttaaccttttcgtatatattactctttctagtcacattttcctcagctcccactgctcacagtattcacacgtcacatatatatatcttttatgtgttatatacccacagagaccagtcctaagaatcacatgtagatgcatcgctttcttttaatgctcttatttccctttagcgacaaccgtcccatgatgttcttcagatcattcatcgttttcttctttcttatctttttcgcatcaaatgtttcttcccgtaaacaaacctacgtgatccacactgtcacaaccagtaccaaacacatcgtaacttcactttttaattcactccaaacagagaatatcaacgacgatgatttttctctcccggagattcactatatttacgagaatgcc

SEQ ID NO: 10827 - DNA, 3000 bp, Unknown
  misc_feature (1)..( 3000): cDNA_ID_4370972_gDNA_ID_2214451_Annot_ID_182563 3000 nt of promoter + ATG
tccgtctttctgcagcggctgctctcttttccctctgtgctgccattgctctcctcacttcctcctattacaacaagatttacaccaaagacaaagcaaatgttgacatggcttctccttaaatatcagactgagatcagattatacaaattggggtttgtgaagctaaccactttagaaattggcttctccttctccgcctgcgcagcttcggcctgcaaacacagggagggttagataacaagtctctactaatccgagttttgtttgaaaaatagaccctgattcaaaacgttacctgagccttcttttctcgggctttgcgtagtttcttcaactcctttgttcttgctttctgcttggcgtctttttctgcctgaacaacaatcaccgtcacgaatcaagttagtctgatgatggattcagactcccatatgcaaccacatgtctccgaaaatcatataccaaatcatgccagaacaaatatatacgacaccaattaatatagtatttggcagtcatcggattctaacacatgaccacacatacatcattaactccgggatagagctcaacctaaaatcccaatgcgcaatgaaaggactaactgcactagtcctattttgcctcatgcggaatccttaaccaaacttctaaattcaacaaataacaaaccaatgcaagtacctgcttggcagcttgagattcctccatctcttttgtgagcgggctgggtactttagcatcatgccaattccatttttcaaggtttaacgccataaaccgtctgaaagtgtttctcacttccttctcatttgcaagcatgtatggcgttctgcctctttcatccttagcacaaggatccataccctcctccaagaactccataactctttcacaatcacccgatttggcagcttcatgtaaggcagttgacgtaccagtaactccatcctcgatatcctcttctatacgatttggttcctctaagattatgttgctagaagaagtttcatcgggctcttcctttcttgaggttttgccagaatcctcattgtgggtctgcaccactgtattagctttggtgacttctggtcgattaacaaaaatctcctcagttacatgtgcaatctgagtcaactgattatatatacgctgtgattccttgaaggttggccgacggatcgtaaatggaacgtttcgtacagcgcagttttggctgctaaagtacggtttgcctccattgaaaagtaattgcctactgcttgagggagcatggacaaaaacacaagcagcaccatcaaaataaggtttccagctagcaagtagctcttgaatatcctaacaatagagagaaaaatgacaaaaattacacttcaaggctatgaattatctttcctagaggtaaaaaaatatataaacattttttctttatgttttccttcctatgatcctgatcccggttgataatcatcgaggaggcggccaatgtttccacccgtttaagagacctaaatcatgtttacaaaactatacaccacacttccgagttcagaattgcctttacaaatggacagagccgcatatattattataaaaaatcaacgaccttttgtaatctcagctgaaaagagaaggaaacagtagcaaaacatgtccagagacaaaccttttttaaagcaagttcattgtaacgacgaagtgaggctccggcagagtgtatacttctcccgcttgcatcttttgtggactgctttttaccagccttggctcttacaacatatctacacatagggaaagggaattagaggacaaaaagaggcaaaggactgtgaataaagttttatgaactgagaggaaatgagaagagaagtacctgtggaatgtcttatgagccacaaccgactttccattaaagacagtaccggcaaagtggccaccacttgcaagcaacacgacacgcatttgcctatcatccttattctctcgaatcaaatttctcaacctctcagtaacttcattctcgaccaagctaccacaacagtcaacagaaactcctctgtcattctcgaacgaaacactttcagcgtcgtccatgattaagcatttccagatagaaactttgtcaccactttgaagacggaaaaatagtttctttttatcaatacccttttgagcatcaaagtggaaagagggtggtctagtctcagcttcgtcctctgaacctgatatgctagacacgtcatagtcttggaccgactcagatgtcaactcatcaacatcttcctcttttaatatagccttgccagcaacactcagcttgatctacaaatcacagcaaccacattaaggcattggaaaacgaaattgtgacactttttttttccatataattgctcgaataatttagtcggaagagagaaatttgtacgttaaggcgatgaatatcggacttgaagtggtagcgttgatcttgaagagacaggaactcaattttacaagtattacaggtccatctgtccaaaatcacgccgtccttggaactcttatcctcctccgcctcctctggatcgaaagttttgggtggtccgaatgccgattgagtctccgaaggattcgacaaccgacacgagtcaaagaaatccgccgtcaagtcaaatatcgatcgaggctgtttatattctggattaccaatctcggtggtggccgccgcgccggtggtcgccattaattatgaattggacggattgattttcctaacaccggtaccgataccgataagtgtggatttgaaagctttgtgagataaacgattccgttttgttattttcttaaatggatccataatgtcattaaagtggcccatataaggcccaataatacaaggcggcgatgcagaaagatctcgaacgaacaaaagcgccaaaagcatcctagacgcgactgagaaaataaatatagaagaaagcctctctgctcgttttgcgtttccgagcaaca

SEQ ID NO: 10828 - DNA, 3000 bp, Unknown
  misc_feature (1)..( 3000): cDNA_ID_3038102_gDNA_ID_2214451_Annot_ID_182564 3000 nt of promoter + ATG
aattgctcgaataatttagtcggaagagagaaatttgtacgttaaggcgatgaatatcggacttgaagtggtagcgttgatcttgaagagacaggaactcaattttacaagtattacaggtccatctgtccaaaatcacgccgtccttggaactcttatcctcctccgcctcctctggatcgaaagttttgggtggtccgaatgccgattgagtctccgaaggattcgacaaccgacacgagtcaaagaaatccgccgtcaagtcaaatatcgatcgaggctgtttatattctggattaccaatctcggtggtggccgccgcgccggtggtcgccattaattatgaattggacggattgattttcctaacaccggtaccgataccgataagtgtggatttgaaagctttgtgagataaacgattccgttttgttattttcttaaatggatccataatgtcattaaagtggcccatataaggcccaataatacaaggcggcgatgcagaaagatctcgaacgaacaaaagcgccaaaagcatcctagacgcgactgagaaaataaatatagaagaaagcctctctgctcgttttgcgtttccgagcaacaatggtgagtcgtttgtccattgttcgttcgtttgtcctttgttcgttctagtcagttttttttttaatatagttctggcgatatttgtatttatatgttcgagtttcctggttttgattattgcagtcggtaactttgcacacgaacctgggtgacatcaagtgcgaaatcttctgtgacgaggttcccaagagtgctgaggttagttattcactcagctcatgtttctcggtttcgatttgagctgttttctttgaattgtttacaaaatcagtccagttgaggcaaataacaaaacaatattcactaggttatctagtgtccaattagctattacctggtgctgggttcttgtattgtatggatgatttttcttctccttctctggattgtttttaatctttaggcgaaattagggttatatgaatgtcatgattggggaaattatttttccctcaacagtgttggtgtataggttcattatttttcaatgcgtattcattggatcactgagctatttctctctgacaattttcgcaagtttttccatgtatgaagcaccttgacctttagctttgatctttcatattggtgcagaactttttggcgttgtgtgctagtggctactacgatggtactatctttcatagaaatatcaaagggttcatgattcaaggaggagaccccaaggggaccggaaaaggaggaactagcatctggggcaagaaattcaatgatgagatccgagactcccttaaggtatctctattctcatctctgcttatactttccctttatccttcaaactgcatcttcaatgtaatgcaactgtctcatggcctgttggtgtgttacctcttattcagtgtcttcataatccatgttagcatccatccataattatagacttcttttagctcagaaccattattagtcttagaaaaccaaagtggctgagtacactatcctgatctgttccttctgactgtaaggtaaggtatcaatgtgttttagccaggtagtcatatgcatgccattaccctactcataaccgctagtgcaatccctcttgcatttaattccagggaagtagatagatttgagtctgttgcgaatggtcttatctatctctctagttgttcttgataatttaccagattccattctcttatgcagcacaatgcaagagggatgctgtcaatggcaaacagcggtccaaacaccaacggaagccagttcttcataacctatgcaaaacaaccacatctcaatggattatacaccatctttggcaaagtcattcatggcttcgaagtgcttgacattatggaaaaggtaaaccaacctcttaccctcttaaatcacctcgtctttctaagaagagtttgaactcttatgttttcttccttactgtgactgttgttagcctaaatcaagtgtgttaaagaagaatgcttgttagttgttggtgatatgaagcctggaacaggatttattgatctgaattttgtttttagaaaactcatctaatgatatgattgtggcctgttgcagactcaaacaggaccaggagataggccgcttgctgagataaggctaaaccgtgtgacgatccacgccaatccacttgctggttaagtctaatgtggcagaaccgagccaagccaaaagtgttgttctctttatttgtttcgatagagctgacatgtacactcagaaactgaactaagaccactgtttcacccaattaaaaagtttgtactggaggatttaccaattactgtcttcaaaggtgttttgtattatttaaagacaaaaataattttttttgcccaatacttgacgccgtattgcaatctcgccaacaagatttcaaatacacaataatctatctgctgagtgtgtaataataactaataagattcaacgtgggccatcaaattcgaaccaaatcatgtaaatgggctcagccaaacccgacccggatcgaataaaaacggatcccttccactaagccgacccgttcggcgcaattaaagcggccactacctctggctagtagggaccgaaccacactgcgcagtcagcacaaacctgaataagggtaaaaaggtaaaatacggtactctcttttgacaaaatgggacccgttgtaacgcaacgactgtctctgtcttcattcaaatactaaacgcgtgtgggcccgccaacctcctcctcctccatcactgttttttgtttaaacaaaaaaaaaacacaaaatgttaaaagaaaaaaatataacccaaaaattgacgaaacaaaattgagaaacaatacaacaccactctcttcttcttcgtttgaatttgttcttctcttttttgcatagagaagactattgattagaaa

SEQ ID NO: 10829 - DNA, 3000 bp, Unknown
  misc_feature (1)..( 3000): cDNA_ID_3038106_gDNA_ID_2214451_Annot_ID_182562 3000 nt of promoter + ATG
aataaaagtgaagaatcgtctcctaagaagcaattaaagggaaagggatcagcaccccagcaataggaagagagttgcttaactaatacaaagctaaaattgataaattcacggaatcgacagtcagtgaaaactcaaatcagtgataaagaaatgaaaacggacctccattgtctgcggctccgatagaagcagaggagctccgacggggagcaggcgccgaggaaggaatcctggatttgaaagaagacgatctgagattggatgaattagctccagagactggtctcatggatcctctaaccgcaccatttctcgaagaagccatagccattttctaatcaatagtcttctctatgcaaaaaagagaagaacaaattcaaacgaagaagaagagagtggtgttgtattgtttctcaattttgtttcgtcaatttttgggttatatttttttcttttaacattttgtgttttttttttgtttaaacaaaaaacagtgatggaggaggaggaggttggcgggcccacacgcgtttagtatttgaatgaagacagagacagtcgttgcgttacaacgggtcccattttgtcaaaagagagtaccgtattttacctttttacccttattcaggtttgtgctgactgcgcagtgtggttcggtccctactagccagaggtagtggccgctttaattgcgccgaacgggtcggcttagtggaagggatccgtttttattcgatccgggtcgggtttggctgagcccatttacatgatttggttcgaatttgatggcccacgttgaatcttattagttattattacacactcagcagatagattattgtgtatttgaaatcttgttggcgagattgcaatacggcgtcaagtattgggcaaaaaaaattatttttgtctttaaataatacaaaacacctttgaagacagtaattggtaaatcctccagtacaaactttttaattgggtgaaacagtggtcttagttcagtttctgagtgtacatgtcagctctatcgaaacaaataaagagaacaacacttttggcttggctcggttctgccacattagacttaaccagcaagtggattggcgtggatcgtcacacggtttagccttatctcagcaagcggcctatctcctggtcctgtttgagtctgcaacaggccacaatcatatcattagatgagttttctaaaaacaaaattcagatcaataaatcctgttccaggcttcatatcaccaacaactaacaagcattcttctttaacacacttgatttaggctaacaacagtcacagtaaggaagaaaacataagagttcaaactcttcttagaaagacgaggtgatttaagagggtaagaggttggtttaccttttccataatgtcaagcacttcgaagccatgaatgactttgccaaagatggtgtataatccattgagatgtggttgttttgcataggttatgaagaactggcttccgttggtgtttggaccgctgtttgccattgacagcatccctcttgcattgtgctgcataagagaatggaatctggtaaattatcaagaacaactagagagatagataagaccattcgcaacagactcaaatctatctacttccctggaattaaatgcaagagggattgcactagcggttatgagtagggtaatggcatgcatatgactacctggctaaaacacattgataccttaccttacagtcagaaggaacagatcaggatagtgtactcagccactttggttttctaagactaataatggttctgagctaaaagaagtctataattatggatggatgctaacatggattatgaagacactgaataagaggtaacacaccaacaggccatgagacagttgcattacattgaagatgcagtttgaaggataaagggaaagtataagcagagatgagaatagagataccttaagggagtctcggatctcatcattgaatttcttgccccagatgctagttcctccttttccggtccccttggggtctcctccttgaatcatgaaccctttgatatttctatgaaagatagtaccatcgtagtagccactagcacacaacgccaaaaagttctgcaccaatatgaaagatcaaagctaaaggtcaaggtgcttcatacatggaaaaacttgcgaaaattgtcagagagaaatagctcagtgatccaatgaatacgcattgaaaaataatgaacctatacaccaacactgttgagggaaaaataatttccccaatcatgacattcatataaccctaatttcgcctaaagattaaaaacaatccagagaaggagaagaaaaatcatccatacaatacaagaacccagcaccaggtaatagctaattggacactagataacctagtgaatattgttttgttatttgcctcaactggactgattttgtaaacaattcaaagaaaacagctcaaatcgaaaccgagaaacatgagctgagtgaataactaacctcagcactcttgggaacctcgtcacagaagatttcgcacttgatgtcacccaggttcgtgtgcaaagttaccgactgcaataatcaaaaccaggaaactcgaacatataaatacaaatatcgccagaactatattaaaaaaaaaactgactagaacgaacaaaggacaaacgaacgaacaatggacaaacgactcaccattgttgctcggaaacgcaaaacgagcagagaggctttcttctatatttattttctcagtcgcgtctaggatgcttttggcgcttttgttcgttcgagatctttctgcatcgccgccttgtattattgggccttatatgggccactttaatgacattatggatccatttaagaaaataacaaaacggaatcgtttatctcacaaagctttcaaatccacacttatcggtatcggtaccggtgttaggaaaatcaatccgtccaattcataattaatg

SEQ ID NO: 10830 - DNA, 3000 bp, Unknown
  misc_feature (1)..( 3000): cDNA_ID_3038110_gDNA_ID_2214451_Annot_ID_182561 3000 nt of promoter + ATG
atcatagcattcgcttgtcacagatacccttcaacttaatatataaaaagctgattaagtcgtaaaacaacgatttcttggtagatatgagtctatgtagtcatgattattacaaatataaaaacaaatccaatgcataacaataaaacaacgcaaaagaagattctgcttgatcttctttcctgtcctataaagagttgttgctagatgaagaactagagagaaaaagattcagttttaattttccacctataaattgttcaaaacataaacaacaataaacccaaatgacaacgcagatccagaagacccccatgtagaaagcaagtgagttccaagaatatggcgaggaaagaaacttacaattaaagggaagaacagagccttatctttagccactcttgacccgttcgagttcttcttcagctgtttttaactgcaaacgcaatgtgtgtactttcctctccagctcctctacattgctcctgctagtggtaggatggtacggcgtcaagaacttatgtgaaaacgcctttaaggcttcaacccctgtcacctgtgatccaaacatccacaacaagtgtaaatctcaggatgtatattatataaggctttagtttcattttcgtcttgatcatgttccttctcatctatattgaatgtcatgcgttcttacctcttccggaagcagaggaagctttgtgatattaaagtcatcgtatagcatataaaactgatcaagatacttctgttgcatccgcatccttgctctgagcaacttggactccacatctacagaagacaagtgtagataattcgtcaaatttgtatgtaaaacaagttcaaaacgagaagatagacacgacagcaaataaataggcaccttcgtcgtcgtatagtacttggttgatgataatgttatgcgtgtcaatctcaaacttggcgagttcctgaacaagtctctctgtttcatagagagacaagaactcggggatgcagacacaaacgaacgtagtcatatcctacgtaatggagccaaatgtgtcaatttcttatcttaaaatgcagagtttgttagatatgtatcagaattttcactaatgcaaatgaatgctgtcaaaccgtatgctacagaacaatgtgaagaatctaaaactaaacttcacgaacagagttaagaaaacagtcaatgagtactgaaaatagcaaagaacttaaacaattgaaaaaatgttaccgggtctttgaattgccgatttacttgctcaatcacatctttcaagccctcaagtcttcccagcaaagcatcctctccgaactcatcctccatgccaaacatacggctcatctgcattaccaatcagttccatgaaaaatcagccaaagaagaaaccaaagagcaatatctgttgccaagcaaactgaatttgacaagcttaaagacatgcctgagtcatcaagccaccaaatctactcttcaatgacatcaacttcgaaagtcccttttctagtgtggccggaaactgtaacaggcggagagtatgtccagtaggagcagtgtcaaacacaatagtagcataatccattgtttgcaccaacctaaggaaacataaacatatcaaaatttgactgtgataatacatggataaaggcagatgattactagaagaactaaatggctatttacttcaacatctcagcaaaactcatagcctcatcgattccaggaatcgcatttgccaaatcagagaataaaccatccatcccgtctgtaccagccatgtcatcagtttcaacggtaggatctacctcctgagaaaagcaaacaagattcactcactatcaagagggaaggagtgtgaatcgtaaccatttgcttatagtatgtgtatatatatacatatacacacagacacaactaagagcttcaagcttagaagagtagccataaagtcatcatcaagcctgtctattagaggcgacccagaaccacaaaaaacaacttttttttttttttttgaatttggcataactagccatgaattttaactacaatagacaaaaattcgatttgatttggggacatcaaatcttcttcacaatccccttccgtatcaagaatacaaattggcgtccaaattccaaacctaatccccaaaatcagagtgggcatatgataagaaaggcacaaatcaaccgtatttatgcaagtactaaatctgacttcaaaatcaaaattgatccatcaatctgcggtttgaaattcgtgaatcagagaaccctaattcccaatgagattaaaatccaggagcgaaactaccaaattccctctaaaatctagcacgatctagaacaaaatcggagaaagcttaccatggcaaagagattagagaaaccttgaaccaaagtgggagatttagtgaagcgttgctgaaaggcatcactaagattgtgagcaggatcggtggagatgatgagaacggaggatcgaacactggcgagacaaattgcgagaattgaactgcatgtcgtcttcccaacacctcctttacctccgacgaaaacccatttaagagactcttggtccagaatgttctgtactgtcgcctccggcaaatccgccgccattgctaattccttgctcgtctctcttccactagtctcaatctaaagagctccttgttagatatttggcgtacggaagagtttaactgcggcgagagacttttaacgccgcccggttcaatattttggttctcggttttgggatatcacagcagtcttggtttgatttttttggttatcgtttttcacttgttcaatttttctttttttgttaaaaatttaaatttggtgtgtttaagttcataaacgctaaataagcccatacaaaagcccacatagatgaagccattacgacagcgtattgtgagttacgattgaaaacccctctctactcggttaaacccgtcgccggcatattgatcttcgccggaggat

SEQ ID NO: 10831 - DNA, 3000 bp, Unknown
  misc_feature (1)..( 3000): cDNA_ID_3038098_gDNA_ID_2214451_Annot_ID_182565 3000 nt of promoter + ATG
acacgtatctcaactacagggatcttgatatcgggatcaacagccatggcccaaacagttacagagaagctgaggtttacgggagaaagtatttcggagagaattttgatcggttggtcaaagtcaaaacagccgtggatccagaaaactttttcagagatgaacaaagtatacctaccttgcctaccaagccatcctcgagttaggtttggtagcaagagtggggagatcttctcttgctttttttttctttggcaaatgaccaaaatagttttaaatcccaggctgccttgggatcatttttttcctagctaatttattcagaacaaccaagtcagaaaatttgactgcacaaattgcaagaaatacaagaactggcatgcatctatataaaacaagattatacacaacacaacacgtaattttccgtgtttagttttgaataagtctagtcttacaattgcaatttgattcggttcgttctaattaagttggatctaagtatcagcaaattttttggcaatgaaatctgtatacattaaagttcagaacatttaggagtaatatatacgtacaaaatgcaaataagaaaatcagtgctgttttggcggacagaaaaaacaatacgcactgcaagaaagaggcttcaagcatgatgaaaaaagcccacaatgttagaggggttgagactggctagatgaaaactccctaagaagtaattcaacttcttcaacaacaccaagcttcttaaaccactgagccaacacagcagaagcttctttccctaacattatagagtctttctcaagctctaccaagaatcctaacgcttcatttagcttttcttccttctcatatgcagccaatacaagagccacacacttatcagtagctttgattcccgcttttctcatattctcaaacgccaaacgagcattctggctctgacccgagacactgtatgcgtttatgagcagtccacatagctttacatcaggagtaatacctgcaatttgaactgcatcaaaaacccgcttagctccttccgcgtctccgcccatagagtaatctctcaacaatgccttgtaaacctctcttcccgcacatatctcttgggagtccatttctctaagtagagactctcctttctcggggacaccagctctgatgtaggccataatcattgaaccataggatcggtagtctagtggttccccaagcaatttgatctcgttgaaagtttcttcagccaatttatgacagcctgccttgctgtacaactgaaccattgcagtaagggtcacctgatcaataagaaagcctcgatttttcatggaaagaagagttctttcagcgtcttctacttggtttagcttcccataataatggatgatcttggtataatcacgggcattcgcttcaaaggaatcttggagcagcgaaaattcagccacctaaggagatgcaggtaacaagactgaatgatttaaacgtaatcaagaaggtgacaatagataaactcggatagcaaattagcatgagttagatacatatgaaagatcaatcgagcatggaaggaggaaagcaagtaccttgatataaaacggagagtcaagattcttcaactctttaagaatagaaagccagtcagctctaatggggttcatcctcctaagccaagcacccaacaaatcgcaaaagcttcccttttcgggggagaagcaaataatttgccgcataagcgcttgacaacgttttgacatcttaataggaatccgagtgattgcctcgtcttgttcttctgtcagattcagaccaacatcagcccaattaaaactacggctttgctctgcatcttccttctccacaacttcgccaatggccagactcgcattacatttgcaactacagagcctattaagatgggattctacaagtaatgggtttcgtctaaacatgcgatggtaaagcctatgccttgcaataactaatggacatttcaagccgaagctcaacactgcgctgcagctataaattcccattgtatacctcaagaactaaaagagaaaaacctaaatttggcggccgtatgatttcacatgaacctaatctctagaaaacaagtcatgaattcaaaggcctaattgaggatcatacaagtacagaattgagcttctctgatgattacttacaaaaagcagagctcaggagaaactggagataaaggagatgagccaagcaaagttcatagacagagctggtgtggatagattagaatttagagcggtggagatgactctgttagctttctttgctctgctctacttctgtctggcggattagacaacactagagaccacttcactatgggccttttattaatattgggcctccgttacaattatggcccattattccgcaaatgaaattcaatggcgataatgaaattcaaaaactattgttgaaggtgtttttctctttactcgcaaaacaaatttacatatttgttgggaattaatcatgggtgtttttcgatatcactactattaccaaaagcaatttatttaggataaataagctagaaagctcatgaccgggggagtccaccgggacggtcaacagatacagaattcgtcattttgaaaataccaactatgccctcaaatccggagacattaccgccactattcaaggatatataagtcatttcatatagaggagaggacggcgatccaaatctggttctctcggatttttattatattggttacttcactcaagctcaccatttttttttttgtctcgtctgcttcatcttcgtagatgtctgtaattcactgactccctgataagaatactgctttgattggatcgcagaggaggaggcgttgctcttgttgttgttatccgttctctctgggctacatagatagatactcactctcctcttatagatctaaattggtgattcgttgaagtcacggctaccaatctggaatg

SEQ ID NO: 10832 - DNA, 3000 bp, Unknown
  misc_feature (1)..( 3000): cDNA_ID_3038094_gDNA_ID_2214451_Annot_ID_182566 3000 nt of promoter + ATG
cattttctactggatgacttccttcttcaagatttctatcaacaatttccagcatttttgccgaataaggatctggaagacgcaactgcttattcacccagtctcccatagaccttaaaacagcaactaagcatttcatggcttcaagcttcatggctgcttcctgaggtggcaacaaggtagtaactgtaccaggaggcactccttgagcagtcttaaggagaccattgaccatcctaaaaacaaggtcaagaaaaccaatacagaaatgaatgctacttcaaatagttcgcactagttaatgatcgcagctctgataccacaaaataaatagattcagggcgtaaagataagccacaacaagatattagatcatacctctcaaatatattggatgagttgacatcgcaatcatagttgatgaagatatctaccaaaatctgtgaatcaacgcagagcttgtccaagaaccgaagcactatcatcttctgttggaaatcaggttgagcaacattctctaatactcttagaacaatcatagggaagaacaccccaatctctgccttcagcccagcacgaaacctcgaaaccaagctaagtaaaatcgagcaggaaagctggaaaatgatcataagatttgaagcactgttcttcagcaaggagagacacagatactgcttgatggcgcctaagaacctgttccataatgagttgatgccaaattttcagaagaaacaccaaaagctaaattacattctgtccaagcaactatcaagcagaatgttgaaagctgagggaaaaaagactgaatctagagatatgatagtttaatctacctaacgtgggttataataatgcaagaagataaacaaaacaaacctatcgctggttctaaagacagcaccggcattctcaagcagaatcttcaataactcgagagccacaatcttccctctcatcaactctggatcttccttgggaggcgtcttcatggacagcttgcaaagtgccctgaaaaccaagaaggcgtctcttctcagcttattcccaatctgaacttcagaatcatcgtctttctccacttctccatcggccagctctccttttcttccctcgagggccgacttatacatactgatctcccagtacttggcatccaacatatccttatcagtagaatccaacaaatcagtaggattggcagtgccaggcaatgaagtctcgaaggccccgtcatggccgccgaatgtgcccttggcgttagctgaattgaagactccgtcaatgtcctgcataatcttggtaatgaaaccttgaacagactgcgtcgtagatgggtctgattcggatttgtccatgggctccatcagctcggccacgacgatgggctgaatggggacggtggatgaatctgcctccattcttctgaacacgataacagacatctgcacgagcgaggctttagcagtcgcctgattaaccacgtttctgcttcccaagtagataccataacaagtcctgacgatctgtagcaaagaatctccatggatcctcagggaaattgaagttaccgcagtcaagagcgtcttcagcacgagcaactcgagcccttcgtcgtctagctcgtgacatttgcagatggtttcaatgagcttggaaaggagtagcgcctcaggtccgccggtgggatcagcctcaccgcgaacgtagccatgagcaataagcttctggatgcaatcaacggcgggatcgacaatcttgagaacgccggtggaggaggcgttgatgagagggctgaggatgatctcggactcggcgagagagtattcggcggctcctccgtcgtgaagtggtccaggaatggaggatccagattcagagtcggcaacaggagaggaattttcaggggatctaaggcgttcgatgacggatttgcactcgtgggcgagcttggagtgcttacgccaggaggcgttcttaatgaccttgtccaaagcagggataacaactcgacctaagcgggaatcgacttccgtagaagccattccagattggtagccgtgacttcaacgaatcaccaatttagatctataagaggagagtgagtatctatctatgtagcccagagagaacggataacaacaacaagagcaacgcctcctcctctgcgatccaatcaaagcagtattcttatcagggagtcagtgaattacagacatctacgaagatgaagcagacgagacaaaaaaaaaaatggtgagcttgagtgaagtaaccaatataataaaaatccgagagaaccagatttggatcgccgtcctctcctctatatgaaatgacttatatatccttgaatagtggcggtaatgtctccggatttgagggcatagttggtattttcaaaatgacgaattctgtatctgttgaccgtcccggtggactcccccggtcatgagctttctagcttatttatcctaaataaattgcttttggtaatagtagtgatatcgaaaaacacccatgattaattcccaacaaatatgtaaatttgttttgcgagtaaagagaaaaacaccttcaacaatagtttttgaatttcattatcgccattgaatttcatttgcggaataatgggccataattgtaacggaggcccaatattaataaaaggcccatagtgaagtggtctctagtgttgtctaatccgccagacagaagtagagcagagcaaagaaagctaacagagtcatctccaccgctctaaattctaatctatccacaccagctctgtctatgaactttgcttggctcatctcctttatctccagtttctcctgagctctgctttttgtaagtaatcatcagagaagctcaattctgtacttgtatgatcctcaattaggcctttgaattcatgacttgttttctagagattaggttcatgtgaaatcatacggccgccaaatttaggtttttctcttttagttcttgaggtataca

SEQ ID NO: 10833 - DNA, 3 bp, Unknown
  misc_feature (1)..( 3): cDNA_ID_3445881_gDNA_ID_2214452_Annot_ID_182576 3000 nt of promoter + ATG
gaa

SEQ ID NO: 10834 - DNA, 3000 bp, Unknown
  misc_feature (1)..( 3000): cDNA_ID_3038211_gDNA_ID_2214452_Annot_ID_182579 3000 nt of promoter + ATG
cctttttgtgagaacgttcattagagaacatcagtgatttttcaaggatagttggggatgggtgtattattttgtaacaacaaacaagaaagagcatctctaatggtgaaatattcaccaagtgtctcttatcaatattataatattatttaaatataattttgttatttaactaaattttaagtgataaataaaaatgaacaaatcatattaagacattatactaagatatgtggtatttgggattttaaataagattttatatactttaaaataagaaccattcttattctcttgccttttctattattatttttgattaattaatattaaaaactcaccattgaagatgctctaaaacatagtcaacttggttttaaaaaaagaaactaaaaaaaaagataaatgtttatctgttgttgcttgttgtttgatacaacatgtctcctctgatatgagttacttttaatatgcaggaacaagaggattggtagaacgttatatgaaacaagaggtatgaatattatattttcacttttctcactcactacttttctcgtatttcatttattgttttttttgtatgactagaaagtcggaattccaaattaataacatggttttttcaaatgatttgactataccgtaaagcaactcaagtttcaaccatttgttcgaacttgttctcaaaactagtttcaccccgaaaaataatggtttgtaaagatatgggcagagaaagaaaattgaacttggaaagaaattggattagacatcacttaaaaatagtaaatttgtgctaaaagaaatttactgaaaacattgcttaactttcttatttacataacatcctagcattcttcaactaatgataactatccctttatagagaaagaaaataggcaacattatcacaacattgacataacctcatagggtcacggcttcactgctttcacggcttcaaatggattttaaagcctttgtagtattttttttgccaatcagacttttttcactttattttttttggaagtttttaaagcttttttttttctttttcctttatttttctttttgaaagtcacgtaaatgaggcttttaaaacaaattaaaagcttttcgttttcttctctaaacataattaaaagttctctacaaattacatatttcttttttcaaaacgtttttgattaataattattatcaagttactaatttttttttaagatccatttcactaataataattttattttttatcatcaacactaataaagttagatgtcatttcattatcattaataaatttgttgattttatgataagtcaaaaaaatcattcaaaacagttttgagaaaaaaatttagccataagaatcattcaagatgagtattttaattattaatgtgtttggatattaagtgtttggatattaagtgcatgaaacaataaatataaataatgcaatgtttggtcttttaaaaatgaatgaataatatatatttttaaaaatcagtaataaagttttattgttactaataaaaaataacagtcacagcttctacaactttgttttaccaatctgattttaacagccaaagtctttacagctaaattctttgtacctcaaatttttaaagtcaaaccttctaaagccaaaaataacggtcgttaccaatctgttaaaaaaatttaccttctgaattagcataaactgatttcggtataccatgtttcaatttcttctgactgaaaatagaagagatgatattgttattacacatttcacgctgaagagatactaaaaacagttagaaaggcaaaaagagttatgttcgatcgactaattttaaattatgcaagattgggcccaatacaggctagaatttcggtccataattttccaagacatcaagaaactggttcacaagatttgttggcccatttttaattatctactatctttagcctctattatccttgactgaggtatgaagttgcaacataacgatttcgaaacttcttaaaacttttctcataacgcaagctagaaaaggttttttaaaaagtcccccatgtttttagtttcatgcattacatcacatattcacatgtatgtggagagatagataaccaaattgttagataactgcatgttatttaaaattttatgtgttcttttagaaaaagagcaccattttatattttttgcaaattaatcaaaaactttacaacttcttagctattttcataaatttgcatggtcattcaatggtatttactaataataattaaatatgtctgaacgaacatatttttttttgacagttactacagctatttcatattttatcctttttatacaaaaatcacttcactttctaatttaccttgcagaaaatttactacagtacatactaataattttaacaaattttcttaaataaaacatcactacacttacactgattcttgtttttctaatctcattagtaattactcctcattagtctgaatacggttatatatttttgagcacaaatacttttgcccaataaaataaaataaaatggtaagatatttcccaacgcatattttatacaagtgtgtgacccacaacaagacacactacagtgtaaatccaacggctgagatttctcaaattaccatcaaagcttttagggtttggtgaaaccttccatatataaacactgaaacctccaagttgtctttcctctttgcagttttttttcatttgagcttctctctgataaggtcacttcctctgacccttttatctaagctcaacgctgcaactctcgccgtcggttacttccccattttccttccttcttccgattcaaagactcaatttttattctccggcgttgaggattcatctcctaaaaatctctgctttatcttttgatttgagctgatttggagaggagaagaagatagatagataggtaattcggattgatatctcgaaaaatg

SEQ ID NO: 10835 - DNA, 3000 bp, Unknown
  misc_feature (1)..( 3000): cDNA_ID_3038177_gDNA_ID_2214452_Annot_ID_182590 3000 nt of promoter + ATG
ggtacattgggtcggatctcaatgggccgggttcggcttgggctctttactggcctgcccattccaagtcgggagttgagatatcttctgagcgaaggttcggagccaatatctctttagagcggaggagaccgcgtgaggctggtttcacagagcagcgtccaccttccgttctcgacggtggaaggataacgggcccgttgtcttccgagcccactatgacccattaggccgactccaactgagccatcacttttttttggatcatcagggctacaaggtacacaatttacttactcttaagaggaaaaaatctataactcttgtatttacatattcgttttttcagcttggaagtcggaactactaggttatttggatatgaaatcagttaaagactcattgatgtactacgccttcaatacattgttaataatgctattagttttcacatatattggtggctcatttgtacgacaatcataagagagcttcaaaacagaggagaagtgggagaagagataagatcaggtaccaattttctttcaattgttgtttttaagattgaaagttttgcttataagggatcaatggttgctagaatctgttacataaacattgaactatcacgcatacgaatcgttaagtaacttgacttatgttatgtctttgagtgattcctttttataatttacatcaatggcagattcggaggatgatgactagggtttgctagaggtcatggtgaaaaatggttttcagatacctcagaattaatgacactttaagcattgctattactcagatatgtcttctcttttgctctaggttaatgagtaatatatagcaaagaaatctatttttattgtaaatgaaaattaaaccccttttgtatgggtaatgggttaatgtaatttagttgagagtccctgaaaaagaagattgtcttctgtgtgcgtgtgtgtgtttaaactcttttgtactttgagaagaagattaaccaaagtctgagtggattgatcaaaaaccatcaaaccacaataaaaaatcgattaaaccaaattgttgcttgagttgagagttacttttatagtgtctcacatatggcaaatctgaaaatggaaaaaaaaaaaaaaaaacaaagaaacgcgccaggtaggggtcgaacctacgaccttctgcttaggaaacagacgctctatccactgagctacaggcgcttttttgaacaatagttattgttgataatatttaatcgtatgcgactttaggcgcagttgagaaaataaagacataatgtgtgtcacacattcttttacactgtaaccaaattagtacaaagaaacgtattctgtagacaaaaaaaatggcgtggtgcgatattcttgtagtttttagtttgaccgtatcttacaagttcatgtagttttagactttaaaattaaggtaataataatttcattagttaaataacagcctagaaaaagaagataatcaaaaaacaaaaagaagaaaagaatcttctattagattttgggttggctgattttcgagtcataaattatttcgattctcagctttcacccccggacttttgggcccttaaatttccaccatcaattttcatattcctcaaaattacatcatctactttcgaattcatgcttaaacatacatttccaattgaaccattcatttaaccgggattaaccacaaatccgcgtttactgtaccgcgattgtgattaacccgactaatacccagacccgttaagaaaacgacgtcgttttcatttcgtttaactcatcaaaaagagaaagaaaacgacgtcgttttcattcttcttctttaactctcaaatcgatttggtagtcctcttcttttgactttcatctctgtctccatcgtcttctagattgacgtctccatcagacgctatgtcaccatcgtcttctctattctcctctccatcagaagctctgtctccatctatcccgacgtcgtctccctcgattctggtggcttcgtcctcctcgactccgctatcaccactatcacttccatcgtcggcttcaatgtcactctctggaggttcgaaatcggggtcatctggatcgctttggtaaatcaatccttcctcccaccaattcttcatttctccctattcgaaacccaaatcgagacccaaaaattcgaaccgaagaagaaaaccccaaatctccttttgtctttctctctcaagaaccctaatttcacagtgtcgagattaaagaagaacgactaaatcgatttgagagttaaagaagaagaatgaaaacgacgtcgttttctttctctttttgatgagttaaacgaaatgaaacgacgtcgttttcttaacgggtctgggtattagtcgggttaatcgcaatcgcggtacagtaaacgcggatttgtggttaatcccggttaaatgaatggttcaattggaaatgtatgtttaagcatgaatccgaaagtagatgatgtaattttgggaatatgaaagttgatggtggaaatttaagggcccaaaagtccgggggtgaaagctgagaatcgaaatagtttatggctcgaaaatcagccaacccttagattttatgtcgtaataaaagcattatttgaagaaaaaaatcatatcttttggtttttaaaccccttatatagttattagtatgcttctaaggtaagaattgattttttcctatccatcctagagtaagagttgatttcttgttcaatagctagccgttccgttaaaaacaatggaatgaccggtttgggtaaggactaaccgggtttggcaaaccaaatgccgtaattattgcagacgtgtcacaatggaacactcagtggcttcttgattatatttttcgagtttcgaggatcaaacaattcaatcatcatcttctacctctgctccaatttctctgaaaacaagaaaaccttaatcaatcgaaatctcagtgtaactaatca

SEQ ID NO: 10836 - DNA, 3000 bp, Unknown
  misc_feature (1)..( 3000): cDNA_ID_3038163_gDNA_ID_2214452_Annot_ID_182594 3000 nt of promoter + ATG
gttgcatttgttcacactcttcatctgaaatcatctccgagcatcctccgttcgtcagggtttacaaagacggtcgtatcgaacgtctttccggcaccgaaacagtcccggcttctctaaacccacgaaacgacgtcgtttcaaaagacgttgtctactcaccggggcataacctctccgttcgtctctttctccctcacaaatcaacacaactcgccgccggtaacaaactccctctacttatctacttccacggcggagcttggataaacgaatcccctttctccccaatctaccacaatttcctcacggaggtagttaaatccgctaactgcctcgccgtctcggttcaataccgccgtgcaccggaagatccggttccggctgcctatgaagatacatggtctgctattcaatggattttctcacattcctgtggatctggtgaagaagattggattaacaaatacgctgatttcgaaagagtttttctcgccggagatagtgccggtggtaatatatctcatcacatggctatgagagctggtaaagagaagcttaagcctagaatcaaagggactgtgattgtgcatccagcgatttgggggaaagatccggtcgatgagcacgatgtgcaagatagagagatcagagacggagttgcagaagtttgggagaaaattgtgagtccgaatagtgttgatggagcggatgatccgtggtttaatgtggttggatccgggtcgaatttttccgggatgggatgtgacaaggttttggttgaggtggctgggaaagatgtgttttggcggcaaggattagcttacgcggcgaagctaaagaagagtgggtggaaaggagaggtggaggtgattgaggaagaagatgaagagcattgcttccatctcttaaatccaagttctgaaaatgctcccagcttcatgaagagatttgtggagtttatcactggttaacattgttctttgtgtgacacgaataaattttgatgtaacctttgaatttgatttggttctctatataattatggttaaggaattaaatacaggaatgactcggttgtgactatatgagatttgtggtctaatattttattttattttttgttgctgacaaatagtaacacaatttagtttcaaatacgttttatgcatatacatgtatcataacaaacctcaaattgtcattgaattgggttcaaaggaatagatgtacagtttgacaaaaaaaaaaagaaaaggaatagatgtacaatgttattgatctaatttgtggctattagttattacaggctcagaatcaagaaggtaacgactggtgcatgcatatgtatacaagtactcacaagatggattgaggtcgggttattgtctggatacatttgtaataagagtttttggttatacaccatcgggtccacctctagtctgattaatatccaaatatggaaagcaatattggttaagcaacttgtgattttatcattttgctaaaaataactaatgatttgttagcaaaagtaacttatgatcatatcaaatttaaccaaaccagttcatatcaagctgtgtacttgtcagggtttgattggatgaatcagtgtatactcatacatatagtaaactcacatacatattactctgtttctgttcttcactctcttttccaaagaagatggaatctgatctaaccacagagcatcatctaccattcatccgaattcataagaacggccgagtcgagcggcttagcggcaacgacatcaaaccaacgtctttaaacccacaaaacgatgtcgtttcgaaagacgtcatgtactcatcggaccacaacctctccgtccgtatgtttctccccaacaaatctagaaaactcgacaccgccggtaacaaaatacctctactcatctactttcacggcggagcttacatcatacaatctcctttctctccggtttaccataactacctcacggaggttgttataaccgctaactgcctagccgtgtcggttcagtaccgtcttgcgccagagcatccggttccggcggcttacgacgattcatggtctgcgattcagtggatcttttctcattctgatgattggattaatgaatacgctgatttcgacagagtttttatcgccggagatagtgccggagccaatatatcgcatcacatgggaataagagctggtaaggagaagcttagccctacaatcaaagggattgttatggtgcatccaggtttttgggggaaagaaccgatcgacgaacacgatgtacaagacggagaagtcagaaacaagatcgcatatatttgggaaaatatcgttagcccgaatagtgttgatggagtgaatgatccgtggtttaatgttgttggatccggatcggatgtttccgagatgggatgtgaaaaggttttggttgcggttgccggaaaagatgtgttttggcggcaaggattggcttatgcggcgaagctggagaagagtcagtggaaaggaagtgttgaggtgattgaggaagaagaggaaggacactgcttccatctccataaccataattctcaaaatgcttcgaaattgatgcagaagtttttggagtttatcataagttgaatcttgatgctcaagtatggtattagatgacataatccttttatataatcatattgttaactttaataataatttatgattttaatcgtcaaatttcggagagttgaacatacaaataacttatgattttaatctctaattgctgtgaatttgtgtatcaaactcctgtatattcgataaatcattcgtataagattgttcggccatatcaataaccggttaggtccatacacatagatttcgaaatttgcacctccggtttaaattttcgaaccgaaccgctttaaaactcctcgcggtcggattaaactattcgcatccttaagcacagtctttgccggagaaaatattccggtagcc

SEQ ID NO: 10837 - DNA, 3000 bp, Unknown
  misc_feature (1)..( 3000): cDNA_ID_3038195_gDNA_ID_2214452_Annot_ID_182585 3000 nt of promoter + ATG
aattaattaatttcgtctcagataacaaaagctatattaagatttaggagttatcaatacactgaactaagatatatactatatgatatattgccaatgaatgtagccgaaactaaaaatgacagtagagttacgtgaatgacaagtctacaatattggatacatatgccaacttattactgtatgaatatattaaagataaatgcatacctaaagcaaatatcacaagaaagatgatggggacgacaagtgaagaagttgccttggccatttttttttctttcttttcttttctcttaaatttagttactcgtatactgaatagtgaatatagataaacgtgaaaaattaagagactacagaaaggagatttatagaggtgtgtcatgcattgcacatacggatttatagaaaggagatctgtttgattttataaatcttttatgtatagaagagtatatgatactcttacttgtaaatatattatagaacgtatatatatatgataaattaattcgtattatagtaaaatatatatttcattttatatatctttttttttatagaaaagtatatgaatcttttacttgtaaacatatttatagaaaagaatatataatatatatatatatatatatttcatatttgattaaaattttatattattatgataaaataaaataatataaatataatttataataaaaaccatataaaagtttacacaattattcaaaacaaataaatttatcagttaaatgcttattatttcatgcatttggttcataaaaaaccaacatcaagtaatatgacaaaattacaaaaacaatttatgtttcgaattacttcaaaacgttcacattaatagtattattacaatacttagtttgtatcttgccattgttgatgaattgactctatgattttgatggagaaaaatattaggattttagtttatggataaactttttttgaaaaaaaacacaacccgaatctcaaaaatagttttgtcaaaaatcttgagaaaaacgatgagattcgggttcagattttttcaaaaatagttttattcgtgaaagatttaaattcgagcggagattgttccgcccactttaaaaaatattttattttctctaaataattttaaaataaaataattataataaaaatgaaaatttgaaatttttagacaccataaactaatatgttaataaaattattttatccaaaattagaaaattaatgtcatataatctaaaaaattaatagttaattgagatgataagggtaaaattaaaattttatttttgttgtcagatcgtgagtatgaaaataacaatatttaattgtttgaatatttaaattgcacagttttattatttcatgtatttttcatgtatttttcttcttagaaaaaacaattgggtattaaacgtttaaataaaaattagttaaggtttttttttggatttttacccattagaaaactcttccttttcatttatttttacttctagtagtagaggtaatttttcttttttgattaacaaagtcgtgaggtttgttagtagagactagaaagttgttgaatgggtaattgatatgttttgctccacaagaaagcggaagtttttaaaaaaaaagaaacaaaattagcattacaataccaatgattacatatgtaaacaatatttcccggaattagctcgtatgaatctaaattaatattgacaaaaaaaaaaataccaatgatcacatatatgacaaaaagaaagaatgaaggagaactctatcatggtttgatgctcattctatacgctggcccaacggtgacacgaaagtagacaattcttttaaataagttatcaaattataaagaagtagaaatcatcaacataccatttaccaagtgaggagagggcaaaatttccaaatttggaagtgaattgtattaaactcgacgcaaatcttcttaaaagtcttcttcttttgggttgcttggatataatgattattgcttgatgtcaaaattcgcacaccattgggatgatgggacccaaaaagaatcactacccacttctgccgttgtttcaacatcattcatgtataataatcacagtttatcaagcacacaaaatatcttacatgagtaacaacaatatgatattaaaattaatttggcacataatttaatcatttggtgttccgaccgacatgatactatactataattttattcccatttcatttcttatttttttatatgcatagaaaattatttaaatgcaaaataaaattttaaccaaaaacctctagtctagtagtttgttcgattgtatatagagtattttgtcatgtgcatagattaccaccatctacgaacattgttgtggtttgattttctctttgatcgcggtaaacaccaacaatatatgactagacattcataaacttcagatgagttaggatttgattttttagaattttggttttgaaaaaaaattagccaactaaaaatcaaacaaaaatttactgcggttcataagtaaaaaaaaaatcaatttcctttttagtaattttcttggagtcgaattgaagtaaaattgtgcagtttacaacacagaattcgatatttaaaaaatttctgttggcgaattaaaattgaaatactataattatccaaactttcttcggttagttaattaagatcagaaataatgtctaaatggcaaggttaatatggatatttgtatcagatctaatcccatttttaaagaaaacaaacaaggcaaaggacacaatcagcgactaaagctctcacacgttacagcttcttattggttaaaaatgaacgtggttgtcagctaaattaagtgactatgtttaataatcattaaaacgggatatttattagtttattaccaaaaaatgaaagcaaaatatctaaacaataaataaaataaaaaaccataagaggaaaaagcttaaccccttaaaatg

SEQ ID NO: 10838 - DNA, 3000 bp, Unknown
  misc_feature (1)..( 3000): cDNA_ID_3038207_gDNA_ID_2214452_Annot_ID_182582 3000 nt of promoter + ATG
aaaagttttaagaagtttcgaaatcgttatgttgcaacttcatacctcagtcaaggataatagaggctaaagatagtagataattaaaaatgggccaacaaatcttgtgaaccagtttcttgatgtcttggaaaattatggaccgaaattctagcctgtattgggcccaatcttgcataatttaaaattagtcgatcgaacataactctttttgcctttctaactgtttttagtatctcttcagcgtgaaatgtgtaataacaatatcatctcttctattttcagtcagaagaaattgaaacatggtataccgaaatcagtttatgctaattcagaaggtaaatttttttaacagattggtaacgaccgttatttttggctttagaaggtttgactttaaaaatttgaggtacaaagaatttagctgtaaagactttggctgttaaaatcagattggtaaaacaaagttgtagaagctgtgactgttattttttattagtaacaataaaactttattactgatttttaaaaatatatattattcattcatttttaaaagaccaaacattgcattatttatatttattgtttcatgcacttaatatccaaacacttaatatccaaacacattaataattaaaatactcatcttgaatgattcttatggctaaatttttttctcaaaactgttttgaatgatttttttgacttatcataaaatcaacaaatttattaatgataatgaaatgacatctaactttattagtgttgatgataaaaaataaaattattattagtgaaatggatcttaaaaaaaaattagtaacttgataataattattaatcaaaaacgttttgaaaaaagaaatatgtaatttgtagagaacttttaattatgtttagagaagaaaacgaaaagcttttaatttgttttaaaagcctcatttacgtgactttcaaaaagaaaaataaaggaaaaagaaaaaaaaaagctttaaaaacttccaaaaaaaataaagtgaaaaaagtctgattggcaaaaaaaatactacaaaggctttaaaatccatttgaagccgtgaaagcagtgaagccgtgaccctatgaggttatgtcaatgttgtgataatgttgcctattttctttctctataaagggatagttatcattagttgaagaatgctaggatgttatgtaaataagaaagttaagcaatgttttcagtaaatttcttttagcacaaatttactatttttaagtgatgtctaatccaatttctttccaagttcaattttctttctctgcccatatctttacaaaccattatttttcggggtgaaactagttttgagaacaagttcgaacaaatggttgaaacttgagttgctttacggtatagtcaaatcatttgaaaaaaccatgttattaatttggaattccgactttctagtcatacaaaaaaaacaataaatgaaatacgagaaaagtagtgagtgagaaaagtgaaaatataatattcatacctcttgtttcatataacgttctaccaatcctcttgttcctgcatattaaaagtaactcatatcagaggagacatgttgtatcaaacaacaagcaacaacagataaacatttatctttttttttagtttctttttttaaaaccaagttgactatgttttagagcatcttcaatggtgagtttttaatattaattaatcaaaaataataatagaaaaggcaagagaataagaatggttcttattttaaagtatataaaatcttatttaaaatcccaaataccacatatcttagtataatgtcttaatatgatttgttcatttttatttatcacttaaaatttagttaaataacaaaattatatttaaataatattataatattgataagagacacttggtgaatatttcaccattagagatgctctttcttgtttgttgttacaaaataatacacccatccccaactatccttgaaaaatcactgatgttctctaatgaacgttctcacaaaaaggtaaatcatccgtaaatggccaaaaactccacactgataatcattattgataaacttttgctccgttcaattctcttttctaaatatgttatattatatattagtatttatttattaggaggttttgtcggcaacaaaaaaatagacaactctcgtaaataacaaaaataagttttcttatcaaatttagcacacaatcttcaaacttccaaaaataacatgaaattaatattaaaaagactaatataagcatttgattgataattcacacgatttgtgatttaaaatcataattaattttatatatttagataaaaataaattagttattatgtaaaattactaatgctaattttggaaatttgtgaagtttgtgttataattgtccataataaattttttcatgttattttaaagtatttctctataaaaagtaaaggttgggccaggtaaatgtacttattggactcaataaacaactcaaagatgattaaattcatatattttactatgaaatatgttttactataaaaaacagctcaaaatgctacatttcattattcctttctccatttcatttttaaaattcatactactcataaaagttcatagtatgactataagtttatgactagtttaactttcaactatctagctttcatatgattccctagttcaaagttatactactcataaatttagatactcatactatgaaatttttatatagcaaaaaaaaaattacatctcagtttgatatcaataactaaacatacctatgtaaaaacttacatagtctactacccaaaatatcaataattattgtagctcccactacccaaaagacaatgtccattgacttcacaagcttcttagtcttctctatttctatgctctaaaatctccttatatacatagtccccatacttatcctcaaaactcaccacaaaatctcatcaactca

SEQ ID NO: 10839 - DNA, 3000 bp, Unknown
  misc_feature (1)..( 3000): cDNA_ID_3038160_gDNA_ID_2214452_Annot_ID_182595 3000 nt of promoter + ATG
tttgagaaatgaagctatagtaataccaacccaggtaaataaaatgaaaacccttctatatattttgtgtcctttggcgtgtatttctcttcacccgtcttctacttactccacaattctattcttgcctttttgacaggtgaactatgtgggaaaagcgggaaatatatacagcagtggctacaaacttgatgggagttcatatgttatatcaaagcatattagtaacacatggttatgggatcgtgttcgtgtaagtggtggtgcatatggaggttcctgtgattttgattcacattcgggtaaactgtttttcttttccattttgattttgatctgacagagtcttccccaagttgcaaattctgcgtcagacctgacctttggattttctcttgcacaggagtattttcgttcttatcttaccgtgatcccaacctattaaagactctagacatatatgatggaactggggatttcttacgtggcctcgatgtcgatgaagacacccttaccaaagcaattattgggacaattggcgatgtcgattcataccaactccctgatgccaaaggttataccaggtatgatgtttatttatgggttcttctctggtctttgttggctttttttcaaggaatgtaatgaatttcaatctaatttcccatctctatcaacagtttgttgaggcatttacttaatgtaaccgacgaagagaggcaaataaggcgtgaagagatattatctacaaggttaacagcattctctcatttttgctttagcgtatatacaaatcaatttatacaactttttcactttccacataatggtatgccgcggatatcctgtggggatttatgaaatccttggggacaatgttgtgatctgagttttgtagtgttaggagtttaacgacttctttgaatattaccaaatagccagttgcaattcttcgacatagttattatcaaacagataagaaaagtaacttccattttatcctttttcagtttgaaggacttcaaggaattcgcagaggcaatagactctgttagtgataaaggcgttgcagtggccgtggcatcacaagaagacattgatgcagcaaacagagaacgctcaaattttttcgaggtgaagaaagcagctctctgagtctgagaccctcttagaaagtagcttgtcacaatgaggaatgactcttcttaggttcacggtacgacgcatcaaatctctaagctcgtacttatttgtgttttacttcactgtgttttgtatagttatatatgccaacatcatgacttatcacagttgaaatttagcatttttacctgaaaacacaggctttagctactgttgcatttgagttgttacttttttggacaatttttctttcgttttagcctttgctctttaagaactaagaatcctagttctatttatattccattatcgtatcaagataagctctcgaggattttcctgtaccttttaggttataaaaccagtttcgtttgattcacattttgttgaaaatgatgagtcaaaatagacattatattcatcattggctgggatcggatcgaacagtgcctgttcttgttaaaacaaatggctctcagtcatacaaaagatgcatctattattcatcatgtgtcgtgatcttgttattgtcatactatctaatgtgactactcatgcttcatttgtttttgtttgtgtttttgaagtaggtcgtaggtcttaaacatttccaagtgaaattgaaacgcttattcttttaggacattggcatcaagatctctatgttacttttataagtgaattagtctttaaagttactttttattaacattgattcataaagataacttttgtaaattagcccataaacaaagatacttgtattgatgaatcttcttcgtctcatccttttaccattatccttgaaaattctgattacatcattattatggatgaaaattaacgaagagtcttcttttttttcttgtgataaattttaaaattattgaagaagcagaatcggacaattgaagcctagattattttttatttattttttgcaaaatgaagcctagattctaatatttcatattttcgatattgtacatgtgtaactttaaaaaaaaaaaaaaaaaaatcccaagtaaatgcttgttagcacaattattatgtaacggtcaattattgctcattatttcactgccaaaaaataacgaaaatggtcccattttattagaaggaaataaacatgttgtatgtgtaaaattcttaacccatttttggacatgtacagattccatgtaaaagctggattttaagttggttttttgttgttgtcatttaataagtactatttaattgattgtatttatagttctgtctccatgtgaagctgctcataagaaagtgaatgctttagactctaatctatgtgcctagttatatccttaagaagttgatatttagagcttatgatagaaattatgaatcagcaaccatcagaattattttttttgttttgacaaatgtatttacgtgtaaaagaatataagtttaagaaatctatagtagaaagtagattaattaacaaaaattactgtcacaactcacatttctacagcttataggacgacgttttagttttgggttgctttaaaaggaagctaaaaacggcaaaaaagacgcgtcgtttagaatcccgacggcgtctacgctccgtaacgacgccgttacctgcttccccgtgaacgggactcagtttaaaggaccccactcaaaaccggcacaacaacggcccatccgctataggcaaggcccaataattaaatctcagccgttgaattaatcaacggctctagatccttcatcttcctctcccccaaatacccaaaacccttcctctgtttttattaaccagagaaaccccaactttttcataaactctctccagagaaaactataatgagcttgagagaa

SEQ ID NO: 10840 - DNA, 3000 bp, Unknown
  misc_feature (1)..( 3000): cDNA_ID_3038148_gDNA_ID_2214452_Annot_ID_182598 3000 nt of promoter + ATG
ggaagaggaagtagggcttgacaaaagatttggtttttctaaagagtttcacagtagagtagagttaggggaagaaattggacgaggacattttgggtacacttgctctgctaagttcaagaaaggagagctcaaaggtcaagtggttgctgtcaaaatcatcccaaaatcgaaggtaacaaaacttgagtttagtttcttgatcttgatgattgcatactctccattgtagtgttagctgatagaattgaatgtgttttgattcttttttggcagatgacaactgcaattgctatagaagatgtgagaagggaagtgaaaattctacaggctttatctggacataagaatctggtacaattctatgatgcatttgaggacaatgcaaacgtctacattgcaatggagtaagatcattattttatcataaccttaaccatttccttgtttgatgttgaatttagttaggttttagttatgaatttggtaaaaagaacctattgtttcataattggatttaagtagtttgaatttgcaggctatgtgaaggtggtgagcttcttgacagaatactagcaaggtgtgtgtctgtgtgctactaaagagttatcgatacttatggccagagattgttcttattttataaaaagattcatcgtttttttctacaggggagggaaatactcagagaatgacgcaaaaccagtgattatacaaattctgaatgtggtagctttctgtcatttccaaggagttgttcatcgagaccttaaaccagaggtgaggcacaattttgaactggaaagaagattatgttttacttttatgtgtagaatgttttctgatcgctgcttcatcatcagaacttcttgtacacttccaaggaggagaattctcagcttaaagcgatagactttggcttatcagactttgtcagaccaggttcatcatcacacattttactatgtcactatttctccagttctttttcttctggttagtaaactaaaaatggtattttgtgcccctttttttgaaagatgagagactaaacgatatagtgggaagtgcatactatgtagctcccgaagttctacacagatcatatacaacagaagcggatgtgtggagcatcggagtcatagcatacattctactatgtggtagccgtccgttttgggcaagaactgaatccggaatttttagagctgttcttaaagctgacccgagtttcgatgaacctccttggcccttcttgtcttctgacgctaaagactttgttaagcggttattgtttaaggatccccggcgaagaatgtcagcctcccaagccttgagtcagtcatttttaatttcacagctctttatagttttatgtctcctgtcttttggtagtcataaatcaccaaattcagttcctatttacttttttcagtgcatccttggatccgagcttataatacggacatgaatatccctttcgatatcttgatctttaggcagatgaaggcgtacttgcgatcttcttcattacgcaaagctgctttgagggtatgttttaggcattcttttaaagtgtcgaaaagagcattgaagattactttctcactattatgtgctttcttttcacaggcgctatcgaagacgttaatcaaggatgaaattctttacctgaaaactcaattttctcttctcgcaccaaacaaagatggcctaatcacaatggataccattagaatggtttgtgacactataacttcttttatattccttcctcttgagaaaaaaagagaaacaccgtagtaatctaatctgtattgcattttttgtttctgtttaaacaggcacttgcaagcaatgcaacagaagcaatgaaagaatctcggatcccagagtttcttgctttggtaaatgactgtgttctctcggattttgataaatgctttaacaatttggtgttaatgatccttcattgactggctttttacagctaaatggacttcaatacagaggaatggattttgaagagttttgtgcagctgctataaacgttcatcagcacgagtcgcttgattgttgggaacagagcattcgacatgcttatgagcttttcgacaagaatggaaaccgagctattgtcatcgaagaacttgcctctgtaagttaaagcatctgtcttcagcttaaatacaaaaatatcgaaaaacagatcctctaaaacgacatgcttttgaattgcaggaacttggtgttggaccatctataccggtacattcagttctacatgattggatcagacacactgatggaaagcttagcttcttcgggtttgttaaactgttacatggagtctctgttcgagcctcggggaaaactacccggtgaagataacgaaaacaaacatgacctaagcgaaatcgtaaaagaagatgtcaaaacctttactctaaatcttggattggtattggaaatgtaatagttggtcaaagactgtacaacaaatgaaaagtttcttacaagagcaattctaaaaaaaagattgttgtaataatatagtaaccacagatactttgatactctatgtgaagtcaagaaaatgaaaaagaaaattccaaaaagatttgatttttgtctctctttcttcccaatgattatggaatcagcgaaatcttggttatttccggtttgttactgtgctttaatttgtgagatctgagtcggtgtaaccagtgaaaaccggttctagtgatggaaataaattagaatttagaaaacaaaccaaaccgattttcttctcccccaattttatattttgcttctcctctcgagtttgggattcgagtttaaggaattagggtttctaatctctctctctttctctcgagatttttcttcacttagttcttgattctgattaaaagttgatcttatagttccggtaacttcgttttctgggtttaattttcgattcaatcttcatctccttgatccacagccatg

SEQ ID NO: 10841 - DNA, 3000 bp, Unknown
  misc_feature (1)..( 3000): cDNA_ID_3038152_gDNA_ID_2214452_Annot_ID_182597 3000 nt of promoter + ATG
gtgagagtcctcaagcattgcctcgaagatgtagactcaataagctctttgcctgatgtgatcctccaagaaaacctctccttaattccgaccaaattcgccataagaacatcggtcttgtccaaacgatggaggcatgtttggtccgaaacaccttccctcgacttcgatgattgctataaactagatgttgattttatagacaaaaccctagctctctacagggctcgcaagattatgacttttgacctctggatcaccaacggaatcaatcttccttacattgatggatggatcaagttcgccatgtcccgaaacgtggagaatctgtttctgagtttcgattttcggttatatgatgttcctgattacttgtacatcaattcctctgtcaagcaactcgtccttgggacagaatcttctgaattgaatcccagatgctctgtttcttggagttccctcacgaagctttctttatttctctgatgagtccattgctaagattctttctggttgtccgattatcgaaagcttaacattgcatttttgtgatcaactgatggttcttgatctcaccaaatcaccgagtttgaaaatattggaaatccatggtagcatttggggttcggggccaaagcacattgtggcaccgcatatccattctctcacattgaaaacctctcaattctttatctacttttgttgatatctcgtctttaaccgaagctaaagtagacatttgcttttgctcacttaaagagataaaggctaatttccttctcgacacggtgctcaagtgtctttacaagttgcagaatgtagacaagcttacctttggggcaaactttcttaaggtatgtttttcatgttttcaagtgtcatttttcttattgagatttgtttcaaaaaaaaactaattgtctgtactatttgtaagattttatctctggccgagggccgcggtcttccttttccgatgttcaaggctaaagctttgactctcgagacaacgatctctaaatacgttattcctggtatattaagagtgctacaaaattcacctgaactaaagaagctaaccctacacacaatggatcgcgaggctagaactatgtcctttcactttgagtttgtagaatctgagatattgacaatctgtttttacattaacgaaattcttttttgttctagtacagggtgagtatgatcccacgtacttgcgttgcatgaagctggatcattgctcgatctttgcaaagatttcccgtcggaatgtagagtcaaagcatgtggcttcgttcatggaacttatgattaaaaccacaaagaaattagagaagatggtcgtaaggttggaaagttatcttgatggaagaggtttcgaagaattgcttgagatggttccaatgctttctcaaaacaacaatgtctccattgtgcttagctcaaccaagccgagacagagtctttagtcttgaattttattggatattttacataatctcattttaaaacaatagtaggtaaaaacattcaggacatttcttggaaaaactttttttgtttgaattattttcttaaagttaattttaaacttaatatgaggaagaggtagttaagtaatattctagttattaatcctaatccatcaaatattaattcataaggtttgttttcaagtttcaacagatagtttgatatagcattaattatcgcttaacaatgaatgccattacaatatttttgataatcttattttgagtaagagtgtctctcaaattttatttgtttaatattctatctcattcttcaccttagttcctcaagacatgaaacttttcatagattttatgaaatatcaatgatattattttttacttaaaatctaacatttacctccggtgtaaatggttatccattagatgaatgttatgaaaataaattggaggaaaaaatagagatgaaaatgctatagagtggatgaaaacttttcttaaatttctcttctttgttcatcttattaaagatgaaagagattaatactaacagattttaaactttcaatccaaatggtaacattttagatgagtctttttttcatccagttttttcctcgtaatatgtctacaatttcaagaaagcttatcaaacgtttagaatttggcaataatataatttaataattattcctaaacttttcataacatttcttaaatgttgtttacagccaacaaagagtaccttttaaaggtgtcttatgttcatgtttcgggtagattgtatcccaacaaagcttcaaaattgatccgacaaagatggcatcaatttgtttctagccaactctccaaactatcacaaaaatttatagttttcacatctttttaccattgattccttttgcatttaaggatcattataacaccaatcacaaattgttttaatgaaaaaaacagtttatgtcacaagttcccctcttcatagaccacaatgcattgaaacatatggattcactagctaaaagtctcatcatcatatgtctctctattggtttcaatatccatttataatcccaagaaatttatttacccgatttgggaacttaaatcattcatcaactgtcaaaagttgatgtcaacccctaaaaatacggtcgaatcagaaccgtcggatctaaaagtacataacatggcttcacttacgtaactgggccccacgttcccaccacttctctctcagacctaaaagcgaaaccaaagaacaaaaaaaaaaaaaagccttaaaccctccgaatctacacaacacaacactactctcttctctctctctccgcctccatattatcctccaaagaaaccataaaccaaatctaatcctctctctctcggtctcctccattacctaaacaaaccctttccaacacatacatatcgagagagagagagaccgaagtttccgagtctcgtaaccagatcggatccgaaagttccatactttaaaaag

SEQ ID NO: 10842 - DNA, 3000 bp, Unknown; identical to SEQ ID NO: 5784
  misc_feature (1)..( 3000): cDNA_ID_3078455_gDNA_ID_2214452_Annot_ID_182603 3000 nt of promoter + ATG

SEQ ID NO: 10843 - DNA, 3000 bp, Unknown
  misc_feature (1)..( 3000): cDNA_ID_2992296_gDNA_ID_2214452_Annot_ID_182600 3000 nt of promoter + ATG
atcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcagagattatacttagccttgtttttgtaaacggctttttttggttgggtttttatttttcttgaggcattatccaatattcaagtaataattttgatgtttttgtttcataattttgtgtgtttagtttacaaaaagagcataataataggagggacataagcatgtgtttggtcatttattcagattcatagtagagatgctttgaattttttgttcataagctttgaaataatgttcttcaacgctcacctaatcattcggtcgttcgttcaattgactaaaaggtctttagctttgaccgacagatgcgtattacatatggtattattttaaattatgttttttttgggtgaatttataataacaaaaaaaatcaacaagcagaaaagtttgggcattttgggtatatatatatatatatgcctcatgctacccagccggcccacctcatgttttcagcccaatgatacatatgagcaagaaaaaccctgcatagcaaatgattttcatttgcacaaaaaaaaaaaaaaagcaaatgattttcaattttatttttgaaatgaatttgaaaggtttgagactatcgtgaatatatataaaattaaaaaacaacttaaatgaataatcttggaactggaaaacagattaataatgagtttttagtttgaaactacacaaaatagataccttggacttggacagtaaaatatctgatttttttacaaacttcatgacattttccgataattttaccaatattttgccacataattaaaaagacttgtctcaattcgtatcatcagtttttttaaacaactgcacatgtatatcgtttgctacaaattcatagtaatggttcacaaaaatttatagaaatttcagtacttttgttatagatataaattttgaaacgacaaaatgttttgctactttctaccgcaatactgttatctaattgtaattaattatttctaactttgacctaagttataactcaacgacgatactatagtacaagcttattactaaactacaaatttaaacaggggtgtgactctagctagctagtttataataaatgagacgcaatgatggatatgcagctacaagtgggttcataaaatattacatatccactttggttgtggaaactggaaagttatgtaaattttggccaaccaaaggaagcaaagactttgcttctcaactcttcgagtacacttccgagtaagcttccaacatgggcacgtagtggaatatgttgcgcaatcctcttgatgtcataaacataatggacaaaaataatttaaaatttacgtacacatgtttcttaaaactccaaattttatccggaaaaatgaatgttttgaaaagtctaagaacaagtgcgatattatgtgacaaacagaacaaatacaagaacaagagttagatcgtaagtataagttacattttccatcatttggttgtggtttggatgaaatgttctaccgagcataatggcagcgcttgtctaaaggtttcccccaaaatccaaatatcattttaaatcgagagggatcggagtatcatgatcacagttgaatactccttcttttatcaattagacctcgagtaaattataaattccaccatccataagaaggtgataccatctttgggatcgatattatcgacctttagaatccgtttcaagtttggcatatatgatatatagttaaattccaaagtatatttgcaacggaccatctaatgaaatcctcgtttatactatgaagaagttggaaacattacttaacatatgtatgtagacgagagcaataaatttcatcaaagcctacttttctattttggagacaaatttggctgataatctattaatttggcctttgaagtgtttctactttctacgtataagcaaatttcttttaacctccctaaactttctggaagacttaaagtaactaatatcccattcctccttctttggatatttacaaaaatttctttagttcgtctaatttaggattctagacttgtatttgaacaaacccgtagataatttattatttaggatttgaatattgatccgaagccaccccctataaatgatgagtcttgcatgagaactagttcacattgactttgatcagcttggtacgtacctaataacttaaaaagcttgctaattaccttataacttacatccattgaagagataaagggagattgatggcggaatttagaccgatattttctccaatagatcattataaaccggattacatttttgctgtacataggctgcgctaaacaccccaaatgcgcacaacgttatcaataaaaatgaaaaagtaagggcatgagatgattagtttagattatttacatgcactaattctcccactattcaaaacttatgagtatacatttaacatttactaggttttggtttttatttgaatgtttgtatgacgtttacaaggaaaagttcgtatgacttggtataatatatggcattttaattctagataaaatcacatgctcacatgggtaataacaaatcatttattttgccaagtgactgaactatctgacaaaaacctaatattacaaaaacctcaaaatttatcccactatattatcttatttatagtggcattcccactttcttaattatgcatgcatctccgaggcgcacccttgttaaggcaaatatctattttttaaaaatacaccttgtttttggtgtataaatacaagctaaaatcatcatagcaatacactatcaatctacgatcatatatctttcatttcatcatcatggaccacaaaatg

SEQ ID NO: 10844 - DNA, 3000 bp, Unknown
  misc_feature (1)..( 3000): cDNA_ID_3038144_gDNA_ID_2214452_Annot_ID_182599 3000 nt of promoter + ATG
tcgagggatttcgcagtttcaatggttaaaatggggaatatcggagttatgaccggaagtgatggagtaattcgaggaaaatgtggatttccaggttaagttatatatagactcttcacaaaatccaaatcagtctattatatatctagagctaatctagctttaatgaggaatcaaataaaccaaagtctatgaataaaatatgttttatatatatggtgtaaaagcgtccttatgtatcaatatatatatatatggatcccataaacaaaaatacttggacttgtatgtgtgttacgtttgtgtgtaatggaaaatgtatttgtctttgtatttttatattccaaaattaagtcgaactccctcacttgaacgaatataaatattcttagttcttgattggggtttaactaatgatcataattttacatcttcttccgaaaatcatggttctttttgttgatataacatacattttcttaaagtattgaatatactaagtctacataaatatacactatctatcaaaagtcaaaacaaacaaacatcttagcgtgaaaaaagaaaacatcttcgaaatagttaaagtcttaaaaattgcaacaattcttaaatacactaactttttgtttaaaaaaataaaagaagatcttaattcttaatgatgaaaatacatagttgaaagagaaatgatgaaaatacatccatcaagcccaaatacaagcaaaccccatttcatatatttccactttaaattcagacttgatgcatatatttgttaattagaaaaatacgtttgaacatatatacatttatttaaattttgcgaaaaagaagcaaataagcattgaatgatgatatacatccatcaaatccaaatggaagcaaccaactttgtaggtattgtgtttgttgattactgattggaagacataaattttaaaccattaaagtttctccaacgacttcaagaaattatcaagattagagttagtggaagaatgagaaatacttcatactataagctattttaatctattatacatatatagtctaaatacaaaatagtagttaggttacgtacaccatcatgttaaatgcaaaacacaaacagccaatagagaaatatcatataattcatgcaaataaactaaacattatctattccacaaatgagattaattttttatttaaaatatatacatataacaactcgaggtttagttttaagcgaaacgtatatgtgtgaaaattagttaatgaaccttattttttcttcttttatagctggttatttcttaatattcgtgttaataacattagtaaaaacacagtaaagatttttttgtctaatatgataagtaataattaattaacgttacatgtccgagacgaccgcaaatttggggcatacctcttggagcattcgtcattgtctcgttgatgtgttttcatataacgtttggataattttcaatttaatgtcaagacaattttgaatgctagttattctgatctcaaaagaagatgctgaccaagatgtttatctctgatgtcatgccttgcacaatttcaaaccaacctactcctctttctatatatacgtggagccaagtttgtcaatcttatgatttggtggtaccatagagtcgagttggctggttctcgcaaggagtttcaaagagaatttcaacacatggacggttggtgtttcacgatgaactagctcaagtgatcaaatgtgtggttagagtcacactcaaacttgtcttctttttgcataactaaacgagacataagataacttattctttgaactctctcgattgagattggcataacactcattttctaacggcttcttcttttgataatatcaaatacattcttcttcaactatctttccaaacttccagttgaccgaatataacaggaaaggaatgaacgaacacagactcaagcataccacattattgacgtctaatcgacgtaaagattcaccacataattcactccttctcagattctgacacttctcacctttaaaacattatgcaaacatagtttggggattgtcgttagttgactcttagttatttagtatgtcaatttttgtttgttccaaactttcaagaaaaaaaaaatgaatttgatttattttttctatcaaagatattcgtaaataaaacagatatttcttcttctttgtggtaacatattttttgcaaaaaacttttacgaaagaaacttgtaaactctagaagcatataaataaaataaagtatatattggttagaacctaattactaggctaaaaactacaattcattatgatattttttaattccaaatctatacaaaattatttcttacataaatatatatgtagacatgtattcaataattttcatgataaaacataggagtattttttacaactagaaggttacatgtacttaattatccttaattgtacccaccaactgtcaactatatatacatactctattttttttacagcagctataattttctttatttaaattttgtaaaggttctgttacttcattaaattcaatttacacaaacttgtacaaaaaaaaaatgatctcacaaccgttgaaaaaatgacctcatttaaaaaatataacaaaaataaaatatgggacatgaatgacaaacataacagatcggaaatatatttaaaagactgcaataaattaaggtcattaatacgtggccggaagcaactaatttactaaccaatgcacacatctacttgcttcgtcttcttcttccttcttctttctaccaccattttcagattcaaaattcaattctaacagtttcacttcccctgctcctctctctctctctctctcgctctctttctcatgtgatctctctcgctctctctttcttctctaaaagccaaaacttcgatggcattactgtgattttcctcataaagtaagctcctttttttcgccggagattatg

SEQ ID NO: 10845 - DNA, 3000 bp, Unknown; identical to SEQ ID NO: 10515
  misc_feature (1)..( 3000): cDNA_ID_3038276_gDNA_ID_2214454_Annot_ID_182612 3000 nt of promoter + ATG

SEQ ID NO: 10846 - DNA, 3000 bp, Unknown; identical to SEQ ID NO: 10514
  misc_feature (1)..( 3000): cDNA_ID_3036999_gDNA_ID_2214454_Annot_ID_182614 3000 nt of promoter + ATG

SEQ ID NO: 10847 - DNA, 3000 bp, Unknown; identical to SEQ ID NO: 10513
  misc_feature (1)..( 3000): cDNA_ID_3036991_gDNA_ID_2214454_Annot_ID_182616 3000 nt of promoter + ATG

SEQ ID NO: 10848 - DNA, 3000 bp, Unknown; identical to SEQ ID NO: 10512
  misc_feature (1)..( 3000): cDNA_ID_3036987_gDNA_ID_2214454_Annot_ID_182617 3000 nt of promoter + ATG

SEQ ID NO: 10849 - DNA, 3000 bp, Unknown
  misc_feature (1)..( 3000): cDNA_ID_3038268_gDNA_ID_2214454_Annot_ID_182620 3000 nt of promoter + ATG
ttccatcctcatgaatagtgttcaacccgttctctctggtatgtatattagctagttggcgcgagatggttattattacagtatcgaatataaaccgatatttgaaatattatgtgtcttggatcggttttaaccttaacaggagttgccgtcggagctggatggcaaggatatgttacttacgttaaccttgcttgctattaccttgtcggaattcctattggtattatccttggttatgtcgttggtttgcaagtgaaagtaagttttattttctttataattttctccttctttataacggtcttgaaaacaaaaatgtgtgaaagtaaaaaaattaacataaaaaaagttattctctaaattttcttagggcgtatggatcggaatgctctttggaatattcgttcagacttgtgtgcttaccgtcatgactctgagaacagattgggatcaacaggttataaatcgattactatgttttctaatttgttcctagcaagctatgtttttggtgcttattcttataccgtttgttgccaaatatattaggtgtcaacgtcgttgagacgtttaaatcggtgggttgtaccagaatctagagacgtaaaccaagtatcatcagaggaataaattggattctagattgtctttagcaccgtcacattttattcttaaaagctaaaatgtaacttttaggctatgttccaagattgtgaagacaagaatatgacaaatttgggtcgatttgatgtcctcgcaactaacttgtaataagattctaatgtttaaccaaaaaacgaaaacgagatcctaatttttggattaacactagatagtgttacatttagctatgattcatcaaacacaaaattattttggggtttataaccaaaaaaataaaaataaaaataaaaaatttactatttatgtgaaaagaataacaaaaattaaaatatttgggtgaccttctcaaatagtatagaaaatcacaccaattttattttgtactatttgagatattcatggtaagaaaccatagagcgatgctctaaagtctaaatagtgacagtttggttttaaaacatttaaaacaaatttgttgactaatagaactgaatttttttttgtctcatttaacaactgcaattgtaacatatatatatttttaatagaaataaattaacaaactttttttgatgatttatgaaaactatttaatgatataaatgtttggatactaaacttgaattatttctccgtcggctttgtttgaaaatatatagaaaaaacaattaacgggccatgtgcttgttgcaaataatctatttatttttcattttaggaattttgtttctcggcacgagttgggctgattttgataagcccacatgacattgttttagggtttctgtttttcttctttatactttttaaaacgcggccagtgaataattttctaaggtttatgctttaatcaatgagatcagttagagagagagatagagagttttgtacagaaaaactccatagtggttcatattcacaactttatccttcaagtccaaaaaatacaaaataatcttatgaagtccaaaataatacgcaatataatctttttttcactattgtcaaatttaaattttttgataaataatataccaaatcaaagatctctagataaggagttcaactttatcttcagaattctcaaaaactaatgtatgagatcgtgaaaacattctaatatatgtaaaattaaaaaatggactatattgcgtattattttgtatttttaggacgtataggataaaattataaaaatagacgattttaaggttttttttcataaaaccttttttttaatacaagttaaataatttttttgtaaataattttttgttggaatgtcaaatttattcaacaaaagaaaatgattacaaagagttttgaaagctaaaaaatagagaaaataaacgtgaaaagtagaaacaaaaataatggaattggcgccacttacatcattacagaaagttcaaaaggcctaattctgacacaatattattaacgggccatgggcttaatgacaataataaacttttctcacttttgagttttaataagcccacatttgctttagggtttctgcgtctctacctttaaattgcttccgacgattcataaactagggtttctgcctttagccgtcgtgagagagagagcaaatcgaagagagagcaaagagaaaataatatgttgtttgcgtttggtacggtgactcgatctgtggctaattcagtggtggtttgctacggctttctttcgacaatggtgttttctttcgacctaaacttgatagaccgaaccaaactgaaccaatttttatatatatttactcaattaaatcctaaactcctctatttgatctgaacccgatcaacccgaatacataaatatctaatcttatccatctgaaaggatactaaactctctaattcgaattacccgaatccagaaaaagccgaatagcatgcattctattggtacttgattatattaattggcatatatatgacctgttattgccaataatatattttgggtgtttcctgggcttcagttttattgggctaggaatgggtgtacttttaaacccacttctgattagtctcttagtaaaacccacttttaaacccacttctgacccacttctgacgccgtcatttttcttgagaaggagagagagcaccacttccgtcattccagcccaatatttttaacgggccatgggcttattgtaaataatgtatttttctcatttttggttttctttatgggcacgattttagtgggctgaattttgataaaggcccacatatgaaagatatttagggttttttctcttgataccttttaaaacgccgtcgagaaatctccctctagggtttctttgatcaaaccagagagccgtcagggagagcaaaacaaagatcggagaag

SEQ ID NO: 10850 - DNA, 3000 bp, Unknown
  misc_feature (1)..( 3000): cDNA_ID_3038272_gDNA_ID_2214454_Annot_ID_182619 3000 nt of promoter + ATG
tttttttctacaattatttattaaaatttaaatgccaaattggtatcaaccactaatttgggtttaaaaacaaatacatatctttgttggatcagaagaatagttgtggtattgaaccgttggattgaaccagaatgtaaagattaaacgagacttcacaaacagaacaaataatatttgttcgggagaattctctaatctatataacaatatcttaaataatttaatttcttaagtctttctaccaatttttttttttacaaccatatttcattaagaaagttcaaaggactactacagagggaagcccaattactacaatgaaaatacaacctaagttttaagaaaacctagatgctgacacgtgttgaagtcttctgcttcatcaagccacgcatcagttgatcgagcgctgccgtgtttttctcgccaaacatcaccgccttagatcagccaccgtcgatccgtcgtggagcgatgggtggttgcctcctgtctgacgatctcgaacccaagccgtaaacgccgagaacctccagatctatcatatggtatgcttcaagagttctccgagcaaatccaactcctgggaagttccatcacagacaacacctttactgatgcagtcgaaacattgctccaaattcacgaacaaagaaagataatgaagatattactcctcgagatgattgggaggatcggatgaacctcgaggggcagttggacaagagattagtctcgccgtcgcgagaaaacaaaaaccggactactctagtagactgacatccgactagaagtcgaaaacttatttaaatctaatataaatctatatctactaaatcaacagtcactttatcacaaactgcaacattctcctgtttacacgtaagcaaagtcttaatttattgagttttgatttttctgaagcgtaaaacaataattcttttctcattaacataaattattaaagagatttaatccataatttatttctttctttctcgccatcttcatcactatcttccccattccccatatcttgcaacagttattgctaatttatgttgtttcatcttctatgcaattttctaattacgaatctcaaatttttcacattcggatcagttattttcttttccgcctgctttacaccatgacgccatggcagattaacaatccttacattttttttgctgcttgccattctcaaaccaaaattcatctcactctcccttctcattcgaggtcagttatggctgaagaagaggtcaaccacaacgactgtatattcaattaaggtatcaaatttgtaaaatttctgaattattataattttcagttttccatatattgttttggctttcagttttaacatcattttctttatactttgtgaattattacaattttcatctaatcacatctcattgttggctattaatgttgtcaagagaaagtgtttgagaatctgactttaagacgacatgggtttcgttttcaggatcccgtgtgaaacattttcagaaaaataaaactcttacacgatcatgagtcatgactaacccaatgacatgctaaggttatcaattctcaattagttcttcctttattttttatttaaaaaaatagttgatcttatatttttaaactcaaatatagtgctagacaaattgactttttgattttgtgaaatcacagtaaaacaaaaaacgaagccatacaagcacaagatgtactgatatacactagagaaaaccaaaattttttcagttttaaaatggtgatatagatgaacacaagagtcatatatctgaaaagctgagactatacgacaaaggaaaacagaaacagaagaaaaagatatccataaggttgtaaaacatgttttctcatgcaattgaatcttcaatagaattggattgattacaaatttatggaccattggatttttgttatgctagaatctttagaactttggaaatttcgagttatgaggtttagaagttaggcattattgaaattgtacgacgaatagactatatagagaatatatattttattttttattttttgggcaaaaaagaatatgcttttacctgtttttctaaaaaaaagttatcttacacaggacacactaaagataacgctttcaaacaaaagaatttattttttatcaaattatttttgtcccgaacgtagtccaggcttcatactagtaatatttataagtccgaataaatccgaaaataaacccagacgatatagagcctcttctctctgaaaaattagaagagataaaagaaaagaaactctcttgtattttgcaagattttattttcggtttaacggaaatcgcctgctccccaaaaaaaaaagagtttttttaactgaaataagtctttctaccaatcttgttagcagaaaaatgtgacaatagtagtagttcgatacgctcgtgacttgattcttgtctttttatggtttatggtgtagcaaaattaaataattgttagtttttctattttattatataaaacaatatagaatgatttaattattttatttcttagaatgttttataagtttcaactttcaatacatgactatttgtattttataattggttgaatcaaatatcaaataataaatttgtttactaaaacattattatatattttctatattatgaaacataggtaggtttgttagtcaaaataaatggtctataaaatgcaagatatcttagctaggtgtctataaaccactcactgctacttgctgcttggcgtagacggcttttcgtttcccaataaaaatgacgatttttaagcaaacaaaaaaacattaatctataaagacaacaaaaaaaacagagttgttctcataaaccaattcatacacaaacactctagtctcctctctttttctctgccttctctcttttatttattccctccttccctctggtcctccatcagatacaacaacagagactccaag

SEQ ID NO: 10851 - DNA, 3000 bp, Unknown
  misc_feature (1)..( 3000): cDNA_ID_3038253_gDNA_ID_2214454_Annot_ID_182628 3000 nt of promoter + ATG
gagaaacgagtgtaatgtgtacaacaacaaatctttaccagtgaaacctatccatctgtgtgttaagtaagaatggttttgttttgttttttccatatctactacattggcaatcttgatatagccacataaatatttgtgggttaaatatattaaagaagaatatatccactagtagagggtgaggtaagtggtccataggattgtggatttagtgcggatttaaggaaaggtctttggttggatagatttttaagatgtgtgtgtgtgttctaaaactaagggtttaaaatcaagagtgttgtggtgtgagttgacttgtcatgaactctctgacacactggcaaagtgagcccaggttttgctagttgttttgtcgtaagccttgaaattgacattatgatgcatcatggcttctatttaaagggggtcatatagttaatgcaatgatcaaaatagccccgagttagatttttggtgagttagtagtgtaagtaaattctttggattttgactttgtgaggtatttatttatttggctgccactgaaattgtagatatatttgtgagaggaggaatatggattttacgtgggtgtgaaaattcatggaattacaaaaaaaaatatcgctggaccattttaactataaatttgttttgtgaccccgtcaaaatgatgttgactcgttatctttggtaagtcctcgtatgacacaagttgggaaagtaatgagtttgacaacttgttgtgtcctaataagattagatttattggtagagagagacgttgcttttgtgtgtttaagattagtgtgttaatcaaagtcttaatcaaaactccctcatgagatctagatctcttatgtaaaaagagagattcattcagtcagaaatcaaggaaggaaactccgtgagcatgttcttaccacctcgtataattatattcttattatacttgtactaatattaaagttgtataattaggaaaaaaaagaacatatcacatgtaataagtaataaatatagtgaaaaaggagaggcatgtgaaagtggggggaagaagaagagaagacagctgtgtatccgccgctctctctctttctttccccttcaagaaagttctccacttccaccgcccaccttcttcttcttcttcaccttcttctctaaccattattattaattagcatctttcattttgttgttagaaggaaatagtttgttttccttttttgtgtataactagaaatgagcggtgtgtttttgtgtagagtgtgatttggtaatgaaaatgagttttttttttattttgtgtatgtttgtgtaggtgagaggtattaaagagttgtataatgtgatagtatgagtgtctgcatcgatgtcttgagtttgcaactaattttagatatgaggctattcaatttttgattgatcacttatgtctatcttcaccacagctttactatctcaaaaaatgtacttattttcattatttttcacctaattgttataaggtttctttattagtttgttatcttgtacttttgtcgaaaattctggttaccaccaatacataaaatcatcatcttgacttttgttttgattcacatatatatgtgcaaaggaaattaacagtttcatttttaattaaaaaccaaacgagttactaaaaaaaaaagcgatgtcaagctatcaacatttaactaaacgaatgtcttattttttggagaaaaaaataaattcaaagaacatatcaaagatcacttgacgtcacgtttgtttatttatgggattttgcagaccatgcatgttcttgattccaaattatgccaacatacaagaatcacttgtaaaattgtagcgtccaaatgagtctagcaactttgttatcgtgaccaagccatcatatcaattcatgtatgctaaattcgctgcaaattcagtaaaaagtatgtttaaaatgacataaacgaaatctgttatagtgttggtagtgagtgggtttggctttggcttcgcataaactaatgcatgggtcaggttatcgatccgacctgccaagatagttccgagtttaaaattacatggttatgttaattaattatgcactatgtatgattcataaaataatttcactggctttggacttactatttttttcttttcttgacatcactaaaacactattgtttgatatgtttctataaatgtattatttacacaataacaaaaaaaaagagagaaagaaactgttgaattggagaggaaagagagtggggggaaagatgtcaaggctggtccagctcaaatcgggtaaaaactattatcaaattccaattctgtccctccctttccccaaaaatctgattgtcacataccctaccaatcagacaacgccacgtggacaccttagacatgatggtgggagaggacaacaacatgggaggcacatgattttgtgtttattatatttctccaaaacacaatttttacccaaaaacaatttaatcggatcactgagcaatgagatgtttgcggatccaaatttaacttttaaagccttccttactctttgctttataacaataataataatacacataaaattggatttaattaaatagatgtggacctttttttctaaataatataaaagaaggaagaaaataaaataaataaagaaaaagagagagtgaagaaaagtgggtttaacaataatttgctgcaaagttagaagaggcttcagctttattaacttcttgtttgctttcattctctttctctctatctatcatcatcatcctcgtaatcctctcctttctccttcagacccctcctagttgctgtttaaacaaacaaaaaaagactgcttctctttcttatttctctcatcatcatcatcaatggttttatgagatttatatcaaaaaacattgaggagctagagagaaagagagagtgtgtgtgtagaaaaagattgaaacatcatcaagattgatg

SEQ ID NO: 10852 - DNA, 3000 bp, Unknown
  misc_feature (1)..( 3000): cDNA_ID_2994134_gDNA_ID_2214454_Annot_ID_182624 3000 nt of promoter + ATG
aagcttttcagcattgtgtatgaaagtgtttttttggttgatgtttgagtttaggatcacatttttgcatagtgaaatcaaaaggatcatttcagtgattgatttacgtgttcaagtctttgttgtaatcttttatgttgtgattgttgtgcagaaatgtcacgtgaagaagaaggatatcaggaagtttcttgatggtatctatgttagcgagaaaagcaagatcgtagaggaagaatgaatgcccatatcatcgtcttagctcctatttcttgtcttttgaatgttagtttcgttttatggaccaaatccaccggtgttgcaaaactctggctatcccttgttccctttttgtgttcgagattttatttacttatgcacaagttttggagacgagctatcattttcacctttgcttaattaaatcatatcgtgtgaatttgggattgttctggatttggcattgtgggttgtgcattcaaaattgatacttcagtcactaaactaaaatcaatttctcgcaacgctgtgatcaaacataaagataacttgagacaacgaaagcgagctttgcaatttgagaaaagctacgagacgccctgatggtcaggtgatcaatattagtgcagaatgattctgctttccagaagtcctctttcaaccatcgtttatcatattggaagcaccgaggattcatgagacaacttataatttaatcatgaaatgtgatttcgacatcagaaaggactagtatgttaacattgtgctcagtggcggatcaaccatgtttccaggaattgctgatcggataaccaaagagatcacggggttggcacctagcagcaggtggttgcaccacctgagaagaatattggaggatccatcttggcttctcttagcacattccaacaggtaccgtaaactctttaaccgtgtgatgatgattcaagttattcacacaaagtactgatgtttggtgtggatatcaaaggcagattacgagggatcagggccagccatttttcacagaaaatgcttttagacaacctctttatgtagcttgttgattgatgaaattggcttaagattaatatttttagtctttagtcgtggcttgttttaagttttgttcctttatgtttcttcatatgtttgagaaaagcggagatgggtgtgtaactttatccaaatgttcgtcaagttcaagaacagtataattttgaagatttgatataatggttgaaaaggagacttgaagaacaaggtcaaatgtgttttggtaatggttatgttttatatgttttgatcctcagtatcctctctgatcgacacttcaaacattttgtacttattttatctctttgtttattttttatggatcgtcagctaatagagaaccaaagtttgaaaccaaaggtattagagaacaaaccaaaagccaaaaagagagcaaactagagataaatactaaatgtgtcgttattcttcaaaacaaagatggtttcacaagtcttgcagccatacctcattaaggctgacggtatccgaattgtgatggacatgctcgtattcaactaagatttgtgaaaaagtcagattacacaacagttttctaaaaagtgttggactccaccatagtataaccactgtgcaaatcaccatctaccgtcaacaatttcaatgtcttattcactctgaaacgagtagagtttatatagagtgagtgagagagaggtcaatgtagtgtcacttgaaaactgcaatttttactctcgtttttttaccggttttacttgtcttttttactttttatatattatcttctatttattacccattttgatgttgccttattcatggtcaaataatgcacaaccacgagtaataccatcacagtctctttggttttgttacgaattactagtagtatctaatccgtatgtcaatgggttagaagtgataaattccattatgtatatatagtaaatactaaatacaacaatatcactttaaaaaatccaaaactatatatttaaaacggaattctcttgaggaaaaaaataaatggaattctcttttagtgtttgatatatacaaattaataggattggtaataatcccccttgatatgaatacaacagaaaagactaacaatcagtttatcaaactattgtacatttcctctaccaaccaccaaacaagaaggaatcgattcaaaagcagagtaactcatgtcacttagccactaaggtcaccgacgtttcccctcgaaggaatggtaaacaatgcttatcaaacacccacaaaccatctctctagatattcacgtatgtttagataaaagtatctcttgatacatgaatatgtatgtcacgtgtgaagaattcttatgctcagtcgacaaatctagcattggtccggtgggacatgaaaaccctgacattatgctcgacttgtctagaatactatgccccatttattatccttttacatagtactgtatcaattacaaaaatggggataggacaagatcctaattatcaattcctcgagtccaaagttatgggtaccacgtgaattattttacgaattttctttattatcttgacttctttacctgattttttatattttcaactacatggagacatggcaaaacgaaaaatgaggctattcaatctccaactttatctcaaaattttatttttccctctctttaagaccacttctaataataagtgtggttcttggctttttggtaaagaatagacaccaattgtccttttttattacaataaattcggacaaatttgatttcttgtgatggtggatccctttttctcgtgcttcgagctccaataaacttttcttacatttttaatccatttttacgttgatatttttttataaaatttccaccaccttacaaaagattttagctttttgtgttactaattaaaatcagaacaaaagttgcaagtctttcatctctatgcacaa

SEQ ID NO: 10853 - DNA, 3000 bp, Unknown
  misc_feature (1)..( 3000): cDNA_ID_4254732_gDNA_ID_2214454_Annot_ID_182622 3000 nt of promoter + ATG
tacaaatctactatctacgttacaactaaaaaacgtatctatgagtacattaagcctatcagtttcaatccaatcatattttactactgaaatatgttctatgaacacctacaaaatgtatatatgaacacattaagccaattatattcttattttgtttatgtccaactatatgtctcttcatttacacttttgcatagtttcttcaaccactaaatgttttgactcaacaaatattttgaacaaaaaaatatatcatatagcaataattgatgatgtatttacaagaaaactaaattaagtaaaaaaactacttgattagaatgcgtttatgaccaaccaataaactaaaggttgagaaattaaaagaaattaatttgacgtaactaaaaaaataatataaatgagtcttagataattcaaagatagaaatataaatgaaagtaacaatctaaaatacgaccactaaattaaaagtaaatagacaaagaaaaatcatatatcgatcttaccatatacaaattacaaatttgtttcaaatcaacacatatttctaattaaaaaaaaacaaattgaaatatataatgtaaaattttacattaaatcatgacacatgtagtagtctaatttttttagtacaatgatatatgataattaagttttatataattcaaatacaaaaaatcaatacaaataatcttgaaaacaaaaattaaattataaattttaggaagacgatgatttataaatctttaataattcaatgcatgccacgataatgtgataactttgtagctgtgtataagcacacctagagatggagataacacctagagatggagatagagagagagaaagcttcaggaggagatgaagaagatgagaggaggtgcagatttggggatgtttttttctttttttttcggtccaatttttttttttctggatggattgatcaactttacaaaatctctggcaaatatttggtagatttttattttattttcattgctttaacttatgaataaatctatattttgaaaaataaaaagcttgtgtacttctcgaatgtttatggtcttaatattgctgcttgcttcgttttggtcgcatgattttaaatttactaggttataaatccacgcgtaatttttttatcaaaattgattcttaactctattgatttttataatttttaatatggtatatttaaaataaaatgtttactttattagaaattttaatactataatcaataatatatacttttcaccaaattatattacgcgtgggttcaaaaccaagtgttaattactttgaaaagcaaattttatataataaaattttaaagtatgatatactcataacttgatttttttttttttgccggctactcataacttgatttggtgctatttatgacaatttctctaatttattcgacttttgttattttgttctttaaagcaatgataaattattatttggtctggcccggaacggactgctttcaaatggaccgggccgccagcccacatactaactcatttagatataagtttcttctaacctctctttctctaaaaagctgtcggcgagtgggagaagcgcagagagagcaaacaaagagcaaacttgaattatttctccgttggctttgtttgaaaatatataaaaaaaacaattaacgggccatgagcttgttgcaaataatctatttatttttcattttaggatttttgtttctcgacacgagttgagctgattttgataagcccacatgacattgttttagagtttctgtttttcttctttatactttttaaaatgcggccagtgaataattttctaaggtttatgctttaatacaagttaaataatttttttgtaaataattttttgttggaatgtcaaatttattcaacaaaagaaaatgattacaaagagttttgaaaggtaaaaaatggagaaaataaacgtgaaaagtagaaacaaaaatgatgaaattggcgccacttacatcattatagaaagttcaaaaggcctaattctgacacaatattattaacgggtcatgggcttaatgacaataataaacttttctcacttttgagttttaataagcccacatttgctttagggtttctgcgtctctatctttaaattgcttccgacgattcataaactagggtttctgcctttagccgtcgtgagagagagagcaaatcgaagagagagcaaagagaaaataatatgttgtttgcgtttggtacggtgactcgatctgtggctaattcagtggtggtttgctacggctttctttcgacaatggtgttttctttcgacctaaacttgatagaccgaaccaaactgaaccaatttttatatatatttactcaattaaatcctaaactcctctatttgatctgaacccgatcaacccgaatacataaatatctaatcttatccatctgaaaggatactaaactctctaattcgaattacccgaatccagaaaaagccgaatagcatgcattctattggtacttgattatattaattggcatatatatgacctgttattgccaataatatattttgggtgtttcctgggcttcagttttattgggctaggaatgggtgtacttttaaacccacttctgattagtctcttagtaaaacccacttttaaacccacttctgacccacttctgacgccgtcatttttcttgagaaggagagagagcaccacttccgtcattccagcccaatatttttaacgggccatgggcttattgtaaataatgtatttttctcatttttggttttctttatgggcacgattttagtgggctgaattttgataaaggcccacatatgaaagatatttagggttttttctcttgataccttttaaaacgccgtcgagaaatctccctctagggtttctttgatcaaaccagagagccgtcagggagagcaaaacaaagatcggagaag

SEQ ID NO: 10854 - DNA, 3000 bp, Unknown
  misc_feature (1)..( 3000): cDNA_ID_2716702_gDNA_ID_2214456_Annot_ID_132935 3000 nt of promoter + ATG
cacctcttgacgcaagccctgcaccaaaaagcagaagattaactacaatttatcttagctctatttattttatacatcgttataatataatagttagtttgactatgtatacacttagaatgaacaaaggtcaaatttcgtatatatataaagataaaatgaacatacttaagaaaaaaaatgattgacctgagtatcttcaagcgtatcattgtccaaaagattgtctttacagcgatagtacctctcaatggttctgccaactctacagtttataaaacaaaagaaaccacaagatattttaattaataatctgaatttgcttaaattcaaaaccaaagaacgaaaaccttaagttctgtgttaacttttaatgcatgtctaaaggaaattctaattacacaaaaatctctgggaagatatatctgcgtaatggattatagatctacggctacccatgataaaccctaattaatttctctaattagaattagaaagacatatctatttaaagaggcaaaacgtatatatgaggtttcatggatcttaaggacatacacatatcaaagctggtgataacaattaaaacccaaaataaaacaaagaagttttctttcaaaagatttaccggatctaaaagctaaactgacccatatgtccgatggatcctgagagatcgatggatggtgatcaaccttaactagttagggttagaataaaaagacataacctttttcagatacccacaagacagaatttggtttcttgatcttaagaacagacacaaatcaaacatggatgatcttaatcatattacccatgaaaacctaggttttcatcattaggaaaaccgaattaatgatcttgaatgaatggatatacgtacccgacattgctgaactcgtagagcttgccaccggtggagaagattatgagagaaacctctgcatcacaaagaacagagagttcgtaggctttcttgagcaaaccactttttcttttggagaaggttacttgtctagtgatcttgttctcaattctcttcacttccactttgcctcttcccatctctcactcgctctctctcttctttctacgttgtttcttgtctttaatatctctcaatgttggaagtttacatgtacatatcaatcaaaatgaattactttagttctattgctggatatacgtaaaaaaaaaaagcgtatttattaaccctatagtttctctttttcttatcaacctatttcaaccctacatacatagtggaaccgagttttatctcaataggacaatatctcatcataaattacaaagttctcatttcaattaccatgcaagaagaattcactttccgtttattaattatagctagagtgtaaaatggtaatgatcttactgttgtttgacccaaatgaaaattcttttggtatataaaaaattaattgataggaacaaaacgaaaactttctcctacctagaattagaagtatggaaatacagttggaccactggaaaaatcatcattatttcttttaatatcagtatttgatgacatattgttcaaagttcaaactggcactcaagaaaaattgatattcttttttgatatgcaacagttggaccaaacctttttacttaataaagtttacatctattgtgattcttcaaactaacacttatataaaactgttttttttttgttcaatggctatgatttcgtcaaggttaatttgtacatgtaaacaattaaacgttcatccactaaatgttgttcaacctgaaccgatgtggagtcagtaaaaaacatataagacatcgaccctaatgacaaaaaacagagtgtaactatattacgtgtgtgaagtttattactagttcgggaagttttaattggtcaaaaggcgcaggaaggttcatcatttgttgttgaaaagttgcattccttttcaaaagaaaaaaaagtaaggtttttatgaaaaagcctttcaagagaaaacaaattttggttatatcttatttatatggtttgacaactgaatcaaacatttaccaaggttgtatttgatcattattactaaaaataaaatcagctaaaaaaaaaccattactaggtctagttacagtgttacactgtattgtaaatcatttagtaataaaccaaacaaattactatcatcatttttaatttgtgtagtcattacatacatgcaaaattgtaaattaaattataaaatcatgccatactatactgctagatgaaaattgaattgtcatatcaaattaaaaattaatgtattttcatgaaaactggaaaaaaaaaactattaaattagaaaggcgaaattcaacgtgacgcatctatctatataggcttgggcttataatatatacaaaagcccagttaattattaatgggtcgaagtcgaaacttgaaagcaagcagtgtcatcgttctatttatcatcagcccaaaaaaggaagaaaaaacaaatcaattttatgttcgtttggtataatatcgattttaattttaaccaagtaaaccggataggaggagattcgtaaattgtaatcgataaaagagatctgtgtcaaaagtacgcgtgaggttctctcttctctgcaaacaaaaatcctggcgttgatagcgattggttaattgtcggtgaatcaacgtttttctgttacacatatcaatcaatcatcatcctcttcatactctcttcttcttcttcatcgtaatcattagcttcaattccgagttttctcttcgtcgccgttgtgctagagttttgtcagatctcgccgggaaattagcaatggcgttttagtctgtttacctgtgaagcttttgcgtaaacgctggattcttctcaaatctctctcacctgatctcttattagattccgagtatgatttgtttctctccttcattatattcgggttgcttccacgatttcgttgcttgatttagttttttttttgaatttgataggg

SEQ ID NO: 10855 - DNA, 3000 bp, Unknown
  misc_feature (1)..( 3000): cDNA_ID_2716698_gDNA_ID_2214456_Annot_ID_132936 3000 nt of promoter + ATG
atagttttcatcttttgctgtacttgaggcagaatccagcaactcctgatgtcaaatctaataacctgaatgaaaaacgtgacagcatttcaaaaggtagtggcttttaatttaagtggcatctctgatttgacgttttccatctctgattcttctatatattgctgatgcagatagtatccatcagaaagttgagacacctacaaagattcacagaagggtaactattatttattaaagttcaatgtcatgatgcatcaaatactctttagggacttcttgtgtctttagtatttcattatcaacattttttttatccatcttgacatttcagcaactaagagagaaaaggcgtgagatgcgggcaaatgagttagttcagcacaatgatgacacgattttgaaactcgaaaatgctgccattgaacgctctaagtctgttgattctgcagtccttggtaaatacagtatttggagaagagaaaatgagaatgacaactctgattcaaatatacgcttgatgcgggatcaagtaataatggctagagtctatagtgggattgcaaaattgaaaaacaagaacgatttgttacaagaactccaggcccgacttaaggacagccaacgggttttgggggaagcaacatctgatgctgatcttcctcggaggtaaattactccttttggtttctactacttgccttttttcgactgcttgtgtacttcttaaagtaacatgctctctaaattacttttcatatagtgcgcatgagaaactcagagccatgggtcaagtcttggctaaagctaagatgcagttatatgactgcaagctggttactggaaagctgagagcaatgcttcagactgccgacgaacaagtgaggagcttaaagaagcagagtacttttctggctcagttagcagcaaaaaccattccaaatcctatccattgcctatcaatgcgcttgactatcgattactatcttctgtctccggagaaaagaaaattccctcggagtgaaaacctagaaaaccctaatctttatcattatgccctcttttccgacaatgtattagctgcatcagtagttgttaactcaaccatcatgaatgccaaggtaaaatcattagctcttatcacttgattcgtcctaatatctgtatgtttaattttagatacgcattgcagagctgaaattaaaaatgtctttattccctatatgtgcaggatccttctaagcatgtttttcaccttgtcacggataaactcaatttcggagcaatgaacatgtggttcctcctaaacccacccggaaaggcaaccatacatgtggaaaacgtcgatgagtttaagtggctcaattcatcttactgtcctgtccttcgtcagcttgaatctgcagcaatgagagagtactattttaaagcagaccatccaacttcaggctcttcgaatctaaaatacagaaacccaaagtatctatccatgttgaatcacttgagattctacctccctgaggtttatcccaagctgaacaaaatcctcttcctggacgatgacatcattgttcagaaagacttgactccactctgggaagttaacctgaacggcaaagtcaacggtgcagtcgaaacctgtggggaaagtttccacagattcgacaagtatctcaacttttcgaatcctcacattgcgaggaacttcaatccaaatgcttgtggatgggcttatggaatgaacatgttcgacctaaaggaatggaagaagagagacatcactggtatataccacaagtggcaaaacatggtaaataactctttaattctttgcaacaaatagtctaatgatggtttattattttatttattgtggtttgctcattttggcttgtgttgtttagaatgagaacaggacactatggaagctagggacattgccaccaggattaataacattctacggattaacacatcccttaaacaaggcgtggcatgtgctgggacttggatataacccgagtatcgacaagaaggacattgagaatgcagcagtggttcactataacgggaacatgaaaccatggttggagttggcaatgtccaaatatcggccgtattggaccaagtacatcaagtttgatcacccatatcttcgtcgttgcaaccttcatgaataaaatcaaatctttgttagatgatttgaggtaattacttctaatgttctgttgttcccattccattgctctttattccacacattgttaattgtttattcatatcgttttttagtcattcttttcttctcttcttctttcgggttaaaaacacttatgttattttttgagtttttctaatgatagtaatatgtttctggagattctcttgatggtcttgtgaaaaaattgaagaacacatactatctctctatttactatatactgtaagtcaaaataataatccaattttttgttgatgtgtcattaataaataaataactatcattaataattggattggttacacattttaaattttatttatgtttggatatccaatttttttttttccattgctaatttaattgttatcattatgatgttcatattcttttcttgtattggatcatattgtatatctttattttccaattgtaaatattcaaaataatatattttcttggaaaaaaatctattgtggtttctctttttttatataagcaactatttaatggtaatatgacatataataataatttaaaaaattagatagtatttagattttagactattagtggaaaattttacaaaataaataaatcccaactatgatagaaacccaaattgagtgaaaatagaagatgggctttaaatcggaccgacgcttattgcttactaatacaaatcgcccttccttaaggtctgaagacgaaacgaagaacaaacactgaaacaaaagagaaaaatcccaaagctagaaaccctaatcccaaacgaatca

SEQ ID NO: 10856 - DNA, 3000 bp, Unknown
  misc_feature (1)..( 3000): cDNA_ID_2716694_gDNA_ID_2214456_Annot_ID_132937 3000 nt of promoter + ATG
ttcttagatgttaacccagaacttggaaattcctataatgaagtcattgctcctcaagatattgccacctatggtggactctgtgccctggcaagctttgatcgatcagaattgaaggcatgtatcctatttagcatttcttttaactctgccatttttctccaacacttggtctataacttagtctaattttgcagcaaaaagtcattgacaatatcaacttccggaatttcttggagctagtgcctgatgtgagggaacttatcaacgatttctattcaaggttgcatattcttaccaagactctcgtctatttcttgcatagcaccaaattactaaccttgaactaaggattattagtgtgaatacccactaagaccagatttacccaacgaagtccctcataattattatgtcccttgaatccactatttattctaatcactgactctgataaactgaagtagctgttgtgacgttagactctaatcctgtatcgattatgaaggcttccaatgttgccctccaaattcttatctatgttaacaatgcgtaagacatgcaaactcgacccttttagactgtattctcgttgaatctaattattaagtttgcttgttgcagccgctatgcttcctgcctggaatatcttgcaagtctcaaatcgaatctgctgctggacatccatcttcatgatcacgttgacacactatatgatcagataaggaagaaggcactgatccagtacacattgccatttgtctctgttgatttgagcaggatggccgatgcattcaagactagcgtctctggtctagagaaagaacttgaagccttgatcacagacaaccagattcaggtccgtagtgtttcccgaaataactttgttttatgttactgtcattttaaaaaccttaatagaggcaaaatcttttttccatcccggacaggcaaggattgattcacacaacaaaatcctctatgcaagacacgcggatcagaggaatgcaactttccaaaaggtacttcagatgggaaacgaattcgatagagatgtcagggcgatgctgttaagagccaacctcctgaaacatgagtatcatgccagatcggcaaggaaactttgatgacatctgctttgctaaactgagaggtaatggcctattccaagatcataagatatctgttaaaatttaatttggtttagttactggttagctttctatctgaccttctctgttctctagttatcgctttgttttgtcaacttttagtttaagattctttgaattatctatggactttgaatgaaatcccgagtgtgaatctatagacgcatgaatcacactgaaagtgaaatggtcaaagagtacagacataagtacacacacttggtttcatgggccgatatgatttatgatctttgtatgcatgtgggtggtgggatcaaaaatctcatctcccaactaatatccatttcattttgtcaactaaacgtcgtatattatatgatagtttgtggctttgtgcacagttgtcactctatagttgaagacttttttttttcttatctacaagaaataataatcaaaacggttaggtcttttttttataagtagaatctcgaaaattgcaaaaccaagatttgatgtcggcaaacgcatcatgtagactaagtgtgaacttttgattttcttgtgtcaaagaacttttgatattaatcactcgatagctacgtttcatcattattagtttcttctatagaatttttatcactgaatgggatagttcacattatctggtactattatttttactattgcaagtagttcttttctatgcatttctttgaagttgttctctttgtagtttgaggtatcttatatatatatatttctatatgtttgtgtttgccaggaatattcaagggtgttttttcaagattcgaaccaaacgagaaattgggcaagattacttttttgtaagaaccaagtgtttcaatgagtcgatgacatttagagtaagtaaaggttttattctaagatggacagtccattattaatcaactattgaatgatattgccttttaaatgagtcttaggtagcatcgcaataactccatgtttactcaaaactcacaaaccatgaagttaagaatccgccaaatttggaagatgggccaactctaaatttactcaccccaatactccatttattttgggttgcattgatgaaagtaatttgtataattgataggttgtgtatcaaaaaccggatctcattatttgtgatctttgcattagttatttttggagactaataaccatctttctaaactgtgagtaatacaaatataaacaacttcttgttcgctatggaaaataaaacataactctttaggtacgattcacgatgcaaaaacaatagtcatcgtgaataaacatgtccgaaatacatgaattaacaaatgaaacgctcaacaaatgaattgacaaatgaaacgctcaacaaacgaagaatctcacatcccatgatgaaattgggatttacaaataaaaagtagcacaagaagaagggggtagaacagtaattttaaaagaaagacagcgttgattcaccacttgaagtggacttttatagcaaaaagagttgagtaacgtcaaaagagtcaaacccaacttttcaaaggttgtgtaaggctttccatgactccacatcttcttcttttccctttttatccttttctcttctctctcttttattttttcttttgaagtaaattaatttcacgaaacaaatcagagaaccttttatatcttcctttttcgtcgttactatcgtcctttacctttttcatttactgttctctctctctctctatctctatctctatcttctattcatggacatgcaccgaagcgacaaagcttagggcttttctctcatccatggcggatttcttctatcttcattaaatatttccctctttattaaaatctc

SEQ ID NO: 10857 - DNA, 3000 bp, Unknown
  misc_feature (1)..( 3000): cDNA_ID_2716690_gDNA_ID_2214456_Annot_ID_132938 3000 nt of promoter + ATG
tctcatgtcctccactgtttccacttccactaatccatcccgtaagctccctcaaacgctgcgtttctgatttattttgtagaaatatatatttgtttgttgttgttgacgtgattcatatcttatcctaccagaataaataagatttaataaatagtatgaactgttgactgagtcacaaagaaaaagatgatagctgttgattctgtaattatcaaactatatagtttaattaatctttttttggttatattaatgggcacagctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgtaagcattcatatttattacactttctatttgcatgcgtaagtagctaagctaatctccaaattttagtttaggttttggtgaatttagtattttataaacattagatggttttggaaaacttgaaattttagtcggtttagttttttgtttacggttttcaactttttctgatttttttgggttggttttagataaattaaagttaaaccgacttgtgtggacattgaatatttgatctataaacagtgtatgaaaggactttgttgtgttgtgtgaccccaggatggtgttgtcatatgaatcttgtcgcgtgtgattggaaagtgacaaatctagaatttggaagtattgtgtgataaaagtcaatagtaataagacatttttgacctttttctttcctttttggctccgacgttttgaaaaatcctctgtttttttctctctttatttctgcattattggtgtcttttctccgttgtaccccttgagctttttctggcttgtgacggtgacactgtaaaagtctcctcgttcatcatcttttaatttattgtttccccttttgggatttataattttctcttctaccaccaaagtttccatttatttaattttgttttgattttttcatgcaggcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaacgaacctcattttgtgatgaatccgtttttgtgatggttcgggtattgactcgatgaaatttaaaaaaaaaaaaaaaacaaagaatgttgtaatttggatcggttttattttggatcatgtcgatgaaatgtaattgtttcttgtttctcttcttgtaatgactcgataatatcgggacagcattatatgaaacacacaagttttttttaggggagctcaaataattagttataagcaaaaacgtattatcatttttttggttataaatcaaggcaaccagaagcacaatccgtgtttacttttgtggtagtttataatgtgaaaggattggtttggaccgtgtcctttatttaatgttgttccaagtttacagtacttttctcaataagatggaaaaggaacgaacgaagaagagtgaaacacgtgagtgcatgaatttagttgcaatcccttatagttattatatccatgcaatgtagacaactacaacgaaaggctaattgattaggttggtttagagattgtttgataatgctagcctagatccaaaggtcacatcagaagagaccacaggctactaatgggcttttatctaaagcctgtcattaactactctattatggctaccaagtaagtcttctcaaagtgtattgggccaatcattaactaatttattgggctagattttaagtccattggagtatatactattattacaaacgacaataatattattattacaaacgggccgaaagaaaagagtcaaaaggaagagtcaaacttccgaataatccgcgcgcttaacgttcgatcgccaccgttgaatgaacaaacggtcacgatcgtatctaatacagattatttaattccatttttttcttgtggggtgatgatctctgaacagaaattaagggtatgagaatgattgattggtcttggaattgtgtaatagaccaatggcgagaaatgccatctgttcttttttagtttaagctatatccgctccgccgcagagatatatatagatatttctataaatatgtttttgtatatatacacagagagttttgattaaggaagaaaaatccttagatcattttttttttgttatctttgtttcgtttttctggtagaagagagaagaaggagagacgaattggcagctaagcgattctctctctttctctctttctcttctcgtgtaatcttttggtgttcttgaaaccacttttttttttgttaattcctctgtttccttggaattgttttctgcttttttaagaagaaaaaaacg

SEQ ID NO: 10858 - DNA, 3000 bp, Unknown
  misc_feature (1)..( 3000): cDNA_ID_2716686_gDNA_ID_2214456_Annot_ID_132939 3000 nt of promoter + ATG
ttaaaacattggtatatttgaaacaaaagtcttaaaaacacatgaatgaaagcggaatgaataatcttagttattccttatctaaattaaaaacatatacatattcattaactaaataaaatctgacctaccaaaaaaaaaacaaaatcaaatccaatggttttgatgttgggcaagaaacaggaaatctagttacaaaaaagaggttttctttcatatcttattgttgaattagatggcatttaaatcaaaagtttatctcattctaaaagtgttatttgaattcaattctatttatatttgaacagattactttctaaaacacttacttccattctcactatctcttgacttgtccatcttatgaatatacagtttatttggatttttattttctttctaattaatatacttgaatgctttccaaatcaaatgcgtccaacttttttttctattaggattgattgtatattagacacgtagacacacaacttcacacatatatataaagatgatatttacaagtcacatatattacaaaaaccctcatttggtttaagatattaaaagaacttcaaatcctttttttatagataaatatcaatgagaatgcaatttggaccattcaatatattacaaaatttaaattatatatatataaagctctcttattttatttaatttttattgatttttgtaaatatccttcctatgtttatatattttatgattttgtttccattcccatcatctatataactatttatttattgaatttgtctattttttatttttttttcttcatgtatcatactatatatatatatatatatatttaattacttatatatatatatatatataatattcacatatatattatcatcagcatttctgtttttttactctgaaattttaatcaaagatgtctaaatccaccattctcgctattttcatgatcgtcctcgttctaggtttgccttacatttaccattctttaaaacatttaatacattttttttggttttataaatttttttttaaagattatttaaaatatttgttagggaaggtaacgaaagagacgcaaggacaagaaatgtgtcgtgatattttaatgaaagctaagaactgtgatgaaggcacttgtgatactctgtgtaagcaaaaatggaaaggaaatggatcgtgcttcccaaacgtttatacttatagaaaaagttgtctctgcacatttccttgcaaaacttaacttttatagactcaaattctaatttaaaatagtaataaaattatgataataaaactaataataatgataatgataatgataatgataatgataatgataatgataatgacaatgacatgaattaaaactaaacttacacaatgtcttatattattatataaattctgatttcattttcttatttcacatgaactataagctactacttgagcatatgtgcctcacagggatggatcatggatcatggatcatggatataacaattattttacaaaactaaaacattcgtaaatttgaaacaaaaatcttaaaaacatatgaatgaaagcggaatgaataatcttagttattccttatcttatattaaaaatatatacatattcattaactaaatcaaatccaatggttttgatgttgggtcagatacggaaaatcgagttaaaagaaaaaaggttttctatcatatcttattgttgaactacagtagatggcatttgaatcaaaagtttatttcattctaaaagtggtttttgaattcaattctatttatatttgaacagattgctttctaaaacacttactgccatagttcccattcattttctctttacttgtccatcttatgaatgtatagtttatttgatttttattttctttctaattatcatacttgattgctttccaaatcaaatgcgtccaactttttttgctatattagacacgtagacacacaacttcacacatacagtatatatatagagatgatatttacatgtcacatatattacaaataccctcattttgtttaagatattaaaagaacttcaaatccttttctttttccaaccaaatcctattatatcatcaaaaagatgagtaaactcaccaatgttgtcatcttcattgtcttcttcctaggtttgttttacatttccattctctaactatattataaatgaccattaacaaattaatcaaataaattttcacgtttttatgctttgtatattgaaatttgatgtttaaaaatattgttttagggatgatggcgaaagaaacgcaaggacaacatatatgtcatcagattctgttaaacaacaattgtgatggagccacatgcacaagtctctgtgacaagcagttgcaaggaactggccagtgctataaaaccgttgacaaaagatttatttgcctctgcaattatctttgcagaacttgatgatttttttgttttgctttgttcttatctactatataaacgatcatcaacaataaataataaaataaaatagcaaaagtttcttgcaatcttttctaatcttaattacatgcatgtaaaaaattgcatgttaaatgtccatcgatttccagaaactattgtttgtttgttattttactttgaaaaatgcatcactccaaattcaatacatccaacaaaaaaaaaaaatcaaattaaagtcttaaggtttttacttttttttttttattgacactcatccaaatatcaccaattactagcaagcaatagatttaatgatataatcacacttttttttaatcaacttaatctaatgttaaataatttacttttgttattttaatgttgtacaaaactgtgggccggccgtggcaatggcatattcgaaatttggtatttgtcttgtatccgtaaaccttaacaagtgttttattttgttgtcttgtgaaagtgaaagagagagtatatataatttggctctgtcgtaatg

SEQ ID NO: 10859 - DNA, 3000 bp, Unknown
  misc_feature (1)..( 3000): cDNA_ID_2994671_gDNA_ID_2214456_Annot_ID_132942 3000 nt of promoter + ATG
aagttgtgattcttgcatcaccaatgatactcttattcattcaaattataattgatgaaagctctaaacatgaatcatttgtgttcaagtgtttgtcatgtttcaccattactccatatggtcaagtttaagtggatgagttatcatggacacaaactatcattatctacttggatttagcgtgttgatgtttgaaagtaatgtctacagattgttcttgtgttttggagacctatatgattattagtttctacataatgaaatcgtgttggaagctttgataataacatgtccacttagacgtgaccatgtggaaataattgattctcgtatgcaaagtaaaatactcttaacttagaagttcaacgatattatcaatttatcgagccaaaatcatatgataccaaacaagctgatcaaatggatataaaattcaatactggaattggccaatttggtttattcacaacctggtggttcatgaaatcgaaaaataaattatttaagagcaaaaacagaaaacgatagaaaaacgaagaggatgtgaatatgtgatgatattaccatggcagttctttaaatccaacagatcctctcttataaaaatcagattcatattctgaagttggtgatctgaaaaattctccttaatcaaagcagacacggagaaatcgggagatccgattaactggaaaaataaagttgaatctgattgttcaatcaatctctctttttgtagaaagctgatgatttgttgaagaaggaagaaagaaagaagttgatgatttcttctttgcaaacgttcaacaacttttttctctctttaatggcgtaaaaaaaatgtaaattttgaagatttgttttcttgattttttatttttgataaagcgagagaaagagagagaatggatacgaaaaagagagagacaaaatctcaagggtaattttgtctattttctcaccaaaaacaagataaagtgcctaaactcttaaaagtgtctaaaacggaaaaacatttcttaaaagtgcctcatagtgtcacattccctttattttattattattctattcgatttctagttacttcaagatttttccagttgttaatctgaactgaaatttacttcaaaaaaagctgtatttatttagtacgtagagtttttcatgtatgattttagtggagtttattatttacggacaaatctgtaacgtagttaacctatgcgataatcgttatttccttcaattcggtgaggaataacaataaaacatgttcttttatagtggattgcggcataaatgcgatgttagacgttatatttctgtaaattcgacatcatctttttctagcatccttatcttcaaagaatataaagacttaagacctaatctagttgagtaaggtatgagattcgagttttttcttttccaaattttcgtgactactataagtaatattaaattatgaagtgaaattgtaatctatcaaccaaaagcaaagaaagagagggggaaaaaacacaaggaaaaaaatggctcaattggctgctttgtcgggaaagcaagctgatgagtacttgaacgcaaggccgaaatatcctacaatatggtacaaagtgttggctggtcgaaccagcaaccataaggtggcttgggatgttgggaccggcaacggtcaggctgctattggggtttgttttctttctaaaacaatagtgttactttgaaccttttgaagttttgatacatttccttaaaaatacttcaagccacgatcaatttttatgtgaagcctaaatgaactaatcgtacgtgagtcaaatatatattgtgtaattaggtcgctgagtactaccagaaagtggtggcaactgatataaatgaatcacaactccaacgtgcaatgaagcacccaaaagtcacttactatcacactccatcatcaatgtccgacgacgatctagtgactctactcggtggagaaaactccatagatatcataatagccgctcaagctcttcactacttcgacctaaagagattctaccccatagtgaaacgtgttcttcgtaaacaaggcggtatcatcgtagtttgggtttacaacgatctcatcatcaccccaaaggttgattccatcatgaaacgtcttgtggattcaacattaccttacagaaacccgactatgaatttggcgtttgatggttataaaacaatagagtttccttttaaaaacattaggatggggactcaaggaaggcctaaagctcttgacatcccacacatgctttcgctagatggatttctagggttcttaaaatcatggcagcctctagtgaaagcaaaggagcaaggagaggatcttttaacttcttatatgattgatgagtttaaggaagcttggggtgatgatgaacaagtcaaggatgttcactacaaggcatttatgcttgcagggaaactttaggtaattaatatatgttcccctttgagatatatattaactatatgtcatacacgcatgtcatcaatgatcaatcgaattaggattgaaaacttatgtttaacaggtcttgagagcaacctggttgatttaaatgcggatcattactttgtataactttcgtttctgtataaattaatatattaattaatatatttatagcactgtaaatataaagatgttatatataaataaaaggttaatataagcaagatgctcatatctgaaataaatttcttcacaaattgattttcattagttacacttacccaaataacactatttaataaatctaattcaaaaatttaaaatagtgaataaactaattgatcggcataaaaaaaattgtggctatagttttgtacacttcacctaaaaaagttcttacagttttttactgtctaaaaataggaaaaaaataattacaaaagagagaaaagtcaacattacacaaaaaaaaaatcaatttggaaaaaaatcagagtaggttaaaaatg

SEQ ID NO: 10860 - DNA, 3000 bp, Unknown
  misc_feature (1)..( 3000): cDNA_ID_2716667_gDNA_ID_2214456_Annot_ID_132944 3000 nt of promoter + ATG
gaaatataacgtctaacatcgcatttatgccgcaatccactataaaagaacatgttttattgttattcctcaccgaattgaaggaaataacgattatcgcataggttaactacgttacagatttgtccgtaaataataaactccactaaaatcatacatgaaaaactctacgtactaaataaatacagctttttttgaagtaaatttcagttcagattaacaactggaaaaatcttgaagtaactagaaatcgaatagaataataataaaataaagggaatgtgacactatgaggcacttttaagaaatgtttttccgttttagacacttttaagagtttaggcactttatcttgtttttggtgagaaaatagacaaaattacccttgagattttgtctctctctttttcgtatccattctctctctttctctcgctttatcaaaaataaaaaatcaagaaaacaaatcttcaaaatttacattttttttacgccattaaagagagaaaaaagttgttgaacgtttgcaaagaagaaatcatcaacttctttctttcttccttcttcaacaaatcatcagctttctacaaaaagagagattgattgaacaatcagattcaactttatttttccagttaatcggatctcccgatttctccgtgtctgctttgattaaggagaatttttcagatcaccaacttcagaatatgaatctgatttttataagagaggatctgttggatttaaagaactgccatggtaatatcatcacatattcacatcctcttcgtttttctatcgttttctgtttttgctcttaaataatttatttttcgatttcatgaaccaccaggttgtgaataaaccaaattggccaattccagtattgaattttatatccatttgatcagcttgtttggtatcatatgattttggctcgataaattgataatatcgttgaacttctaagttaagagtattttactttgcatacgagaatcaattatttccacatggtcacgtctaagtggacatgttattatcaaagcttccaacacgatttcattatgtagaaactaataatcatataggtctccaaaacacaagaacaatctgtagacattactttcaaacatcaacacgctaaatccaagtagataatgatagtttgtgtccatgataactcatccacttaaacttgaccatatggagtaatggtgaaacatgacaaacacttgaacacaaatgattcatgtttagagctttcatcaattataatttgaatgaataagagtatcattggtgatgcaagaatcacaacttggtcaaaacaaatcataccaacacacaaaagttcatacatcaatgaatatcaccaatttcacgagtagcgtccattttttgttgaccactagttcacttgtttatagacactctcatcgttatgtgggttgatcacttgtttatagacacatatgctgcaaacaaaatacgtggttgtccattacggattgtccaaatgttgtagtccaatagagaacatcaagtactgaatttcaaacaaacggggcagagaagttatctaacattatcatagaattatgaacaagatcaccaaacacttggaagcttttagtaaaccaaaccattaatctttagttttataggagaaataaccacacaaaaatcaagggatgcacttcactcctccatatcaaacctaaagagataaatgtgtctcaatcaaatactatatatgtgtaaattgacgctaatactctccactagcaaaatcaaagtctgaataaatcgttcaaatcaatctaatttcatcataagagttaaggttagtttataccttcaattccaaacaatttcaattccacaatcaatcaaatccacaatctcacaacaatttttcaaatttctgcaacattgaaacttcctgcatctcgtcacatcaaactttccactataccgattctagaaacttccaataacatcaaaaccagactatgacacctcaaaaacacgaagaatcacgaagcaagacaaaagtaaacatgaatggagatgagtaaactcaaatcaccttgagtttatgaacgacgacgacgtcagaagcgccggtgatgttgatcaagcggtcgataacgttctaactcatgtcgccataagaaagaagatatgaagaatcaatttgagcgagaagcttggttcacaacaattgattgattgtgaaattttgtttttggagtgaggaaggagaaaagaaaaaagattttgttttgttgttgtgaaattaccgtgaaccgatggattgaattgggggagatggattgaattggagggggggaagagagagagagatgaattgtatcgagaaagagagagaattataataagaagaattgttagcgtaaatgtaggagagatatagttaaagggcaaatcgagaattttgtctaacaaaagtgtctcataacttaaaaatgcctaaatcgacaaataactttttaaaagtgtctcacaatataatattctctaaaataaattataataacttgtaagtttgtaattaaccatcgcccaaatatgataactatcatcagtaacgttttgttccaaacaaattgcctttattaacgaaaacaaattgcctttattaacgttttgttccaaacaaatataataactttagttatctcaaatatgtgtcaatataatgcaagaaaaagaaaaaaaaactgtaaattatgaaaatcgacgtcacaggtaaatatactaacatgttcaactttaaataatgcaagactaaaacaacggcgtcggattagaagtctaatctcccatgaacatcaatttctgagctacgtggcttcgtttgcctccacatttcttcgtatggtttctgtgcattcactgcatgcgcataagaaaaaaagaaacgccaattattgatattctttgtctaaaacccagaaataaaaaggttcgaaa

SEQ ID NO: 10861 - DNA, 3000 bp, Unknown; identical to SEQ ID NO: 10854
  misc_feature (1)..( 3000): cDNA_ID_2716702_gDNA_ID_2214456_Annot_ID_182640 3000 nt of promoter + ATG

SEQ ID NO: 10862 - DNA, 3000 bp, Unknown
  misc_feature (1)..( 3000): cDNA_ID_2716663_gDNA_ID_2214456_Annot_ID_132945 3000 nt of promoter + ATG
atcgattgatttatttgcagctgggattgaaaaaccataaccactttagaacatctaaatcaagcccctcataattctgtagttacagggataaatctagacatctgaccttagagaaaagtgtgttgaggcagtgaaccttctgtctttcttcgacaaaagcataatattgcgtgacacccataagcgtgagttgatccatgagattgataacatagggcttccggagatgtcgatccttaaaagccttaacagtgacagggaatgtggcggaaaacatcaaaaactgacgattttggggtagaaactgtatcaattcctctagagaaggttggaattctgcagacaaaagcttgtcggcctggagaaatcatttttaaggagtcagaaactttgaagcttatgacacaataaaacaaaataaactcaggtgaatataacaacacacaagaaagatcttcaaaattcaccaaagtaaggggtaaatgactgttaacagtagtaagtataactatgcatatgtatagaggatgataaagtcaaattttgagtctttgacagagaaaactaaagaataaattaagaaaaattccttctagcagtaatcctacagtttgttcatcatcaatttttagcaataaagacatgaggaacatacactgcaggagccataccacaaaacgaagatatacttaagatctagatattaggaaagcaatcaggagctcacctcatccattacaagcatcgcacagtctttcaaaacacagacacccttttttgtaagatccaatattcttccaggagttccaaccagcagatgcacaggttgatgtaatcgcataatatcatctctcagactggtaccgccagtggtgaccataacctggatattcaaatatttggaaagctccttgcaaacttgtgatgtctgaagggccagctctcgcgttggaactagaatcatggctgcatataaaaaatagaacaagtggttcaaggacaaacacaaacagtcaactgatcacttatcaactcaacagggaaaaagaagtataccttgaataacattgttatttgggtcaattttctcgaggactggaatgcagaaggcaccagtctttcctgtaccgtttttagctctagcaagaatatcactaccagttaaagcaattggaatgctctcttcttgaattggagatggcttctcaaaacccttctcatatattccctttaacagatctcttttcagaaagtaatcttcgaattcatttccctttgtagctgtcacatcctgcagacaatatggaagacattgctcaacacgagtttattcaatatcctcaatattcataattcctacacagaaaaactcagaagaaagcagccataccgctgtctgataacgagtatcaggaggtggtagccttaacgtagccttccagtcttgaccactgagagtaacagagaatccatgagcacactaaagagatataacttaacctcaaaataacacatacatctctaacagcacaaatcattactcaatgcaaacaaaatcattcataataattactccagcatcataatttgcaacaagacgtattcaggaacaagaacttacttagcatcgctgctagcttcgggctgggtcgtctgctgaaccacctcattagcgttactagcgtttccaggaagctgagggcgtcttgaccactgttgctgctgctgttgttgttgatgttgttgctggagttgcatctgctgagggttctgagaataaccgcgttgaacatactgctgatcttgaggtggttgttgctgccgatacgactgatgataatctggattcggaggcgcaccacgacccgttccaacacccggtggatatcttcctctgttagtattcatcacaaatctctctcgatctcgaaaactagacacagacaaaccctaaatctaccgaaataccttttacaaaactacaaagaatagaacgaaagagtctgcgataatctggagaaacagaatgcttgtgtaaaacctagggtttaaagaaactgatcgtggaactcagggcaagatcgggaatgttcaaataaaaaaccacaaaaccggtccgccacagaagaacggagaagaaagcgaatcgagagttccgattggaattacaacaatctaaagaagaagaagaagaagaagaacgaaagagagattaagaaaaaatttcgtttgagtgggttgggttacaggaaactagagaaagtgacgaatacactcgccggcgtcttttgttagggcgtcaatggattttctcctctttctttttttcagactctcactatttatcaaaatggccttttatgtttacgttaaataaatacatgacccataagctttatattatttacagtataactcggatttacttttctttcaggtattcaccccatgttgtattgtttttgtcattttagacccccagattctttgccctttgattaatgatatctaacaaaacaaattatgcttatgattattaaaagctatgcttaaaaggcagtcttgtgatgttagattaggtgttacttattttgtataaagatccttataattgtgtatatgaattaataacatcttaaaatcggaggctaactatatataaactttgcacctaatcccttggtttacacgatataatttagaaagcaaaacaaaaataagtgttaaataaaataaaatatagccagaaatagatttagaatgtagaagaacattttaagggctctcctcatttgaatctcaaccatcagaagaaaattttacccctaaaaatctcaatccatgattttgatataataaaaaggcagagagctcatagatgatggcaaaacaaaccttgattcgtgtctaaacgaacaacaaaaagaagaagaaaacttttgatccatcttccaactctttcgtaatttgaaagaagaagaagaagagataccaatg

SEQ ID NO: 10863 - DNA, 3000 bp, Unknown
  misc_feature (1)..( 3000): cDNA_ID_2716659_gDNA_ID_2214456_Annot_ID_132946 3000 nt of promoter + ATG
caattactttcatgatattattagtattgatgatcttctgtgaagtatttaaatgttttcttgttatattcgacatggcaggaaggtttcaagtgggatgaaatcatcacggagacttatgagttaactgaagaatgcatcaagataaactactatggaccaaagagaatgtgtgaggcgtttattcctcttttgaagttatctgattcaccaagaatcgtcaatgtatcatcctccatgggtcaactaaaggtaagtaagaaaagattagatatcaaggaagcttgagagatgtattgttggctaagaaacactatttatgttacaattgattattgtttaccagaatgtactaaacgaatgggcaaaaggaatcctgagcgacgcagagaatctcactgaggaaagaatcgaccaagtgatcaaccaacttctcaatgatttcaaagaaggtacagttaaggaaaaaaactgggctaaatttatgtcggcttatgtggtttcaaaggcaagtttgaatggttacacgagggtcctggcgaagaaacatcccgagtttcgcgtaaacgctgtgtgtcctggatttgttaagacagatatgaacttcaagactggagtcttgtctgtggaagaaggagcttcaagtcctgtgaggttggctttacttccgcatcaagaaactccttctggttgtttctttagtcgcaagcaagtttcagaattctgaatcttcttttgtgtgagaataataagccaaaaatgtagtaatttaatgagaggattatcgtttgaatgtcgaacatatactcttagataaacaaaaacttttatgagatgttttggtaattactcataaacttgaatataattactttacaaacagaataatatatagttccataagaagaaactaaacaaaatttgagtctacttcattgcattagttaagaaattatctctttaacaatttatgattatatatatttcacaaaaggaactcccggatatttcttaggattcatgttcttcagctgctgcatcagaagtttcttcttctgtagggtttgcttcatcttctttgggttcggttttgtcttcctcagccgtcgagcgacggtggttagccgcggcttggaggacatgattgtaattacctttctcaaggaaaagctggctgaagtggaccttacagtaaaggacgccatcgagagcagcatatgaagaatgtgttaatggacaaccactatgtgcacatctgaagcaagtcttgtggtaagattctccttccattgtcatcttctctagaggataaactgttttcttacaagctgcacatttgtcttgtgtgccgctaaagaaggatgataacctgtttggagccttcgtctatgcaaatgatcacaccaagaaatcagattagaaaacaaaaagagaaaacagaggaatgttgatgaattatgtgcttaccgcatcattcgatttctcggtctttccagctgtaaaagaccaagaagagaaagtagcaaagattgttagcttttcaagagaggttaataaaaaacagagcaaagaaaacagaggatttgttagcaacctgtttggaaattcttgctgaaatttccagattctttgaagagctgttcaaaatgggtcttgcaatacaaaactccatccatggatgagtagttacatatctgaaaaggagaagaaagatgttctctttgtgttttttttttcatgagggaacaatggaggaaaaggaagatagatagataccacgagagtgccattgcaatggctgcacctgaagcatgacttgtgataaggcattccttccaaagtcatcaagtccataacgtataccgtcttgtcacacgccttgcatttgtctgttgtccctgtaaacgccgccattggtatctcttcttcttcttctttcaaattacgaaagagttggaagatggatcaaaagttttcttcttctttttgttgttcgtttagacacgaatcaaggtttgttttgccatcatctatgagctctctgcctttttattatatcaaaatcatggattgagatttttaggggtaaaattttcttctgatggttgagattcaaatgaggagagcccttaaaatgttcttctacattctaaatctatttctggctatattttattttatttaacacttatttttgttttgctttctaaattatatcgtgtaaaccaagggattaggtgcaaagtttatatatagttagcctccgattttaagatgttattaattcatatacacaattataaggatctttatacaaaataagtaacacctaatctaacatcacaagactgccttttaagcatagcttttaataatcataagcataatttgttttgttagatatcattaatcaaagggcaaagaatctgggggtctaaaatgacaaaaacaatacaacatggggtgaatacctgaaagaaaagtaaatccgagttatactgtaaataatataaagcttatgggtcatgtatttatttaacgtaaacataaaaggccattttgataaatagtgagagtctgaaaaaaagaaagaggagaaaatccattgacgccctaacaaaagacgccggcgagtgtattcgtcactttctctagtttcctgtaacccaacccactcaaacgaaattttttcttaatctctctttcgttcttcttcttcttcttcttctttagattgttgtaattccaatcggaactctcgattcgctttcttctccgttcttctgtggcggaccggttttgtggttttttatttgaacattcccgatcttgccctgagttccacgatcagtttctttaaaccctaggttttacacaagcattctgtttctccagattatcgcagactctttcgttctattctttgtagttttgtaaaaggtatttcggtagatttagggtttgtctgtgtctagttttcgagatcgagagagatttgtg

SEQ ID NO: 10864 - DNA, 3000 bp, Unknown
  misc_feature (1)..( 3000): cDNA_ID_2716655_gDNA_ID_2214456_Annot_ID_132947 3000 nt of promoter + ATG
aactcacgcttatgggtgtcacgcaatattatgcttttgtcgaagaaagacagaaggttcactgcctcaacacacttttctctaaggtcagatgtctagatttatccctgtaactacagaattatgaggggcttgatttagatgttctaaagtggttatggtttttcaatcccagctgcaaataaatcaatcgataatcttttgcaactctgtcaatcgcgtggagctgttggctaagaaaatcacagaacttggttattcatgcttctacattcatgcaaagatggttcaagaccacaggaacagagtattccacgagttccgcaatggtgcttgcaggaatctcgtttgcactggtaagctttgtgttttttagcatgtactttgaacattgaccaagtgtagattatgatgatgatgatctggcttattggaaaatgactgcagatctgtttactcgaggaattgacattcaagctgtgaatgtcgtgatcaactttgattttcctaggacttctgagtcatatctacacagggttagtcgaaacaaaactggtttgtgatctagtttcttacatgttcattttaactcatgttgcgaaatgttcaggtgggtcgatcaggacggtttggacaccttggattggctgtgaatttggtaacttatgaggaccgtttcaaaatgtatgtcgttccttcttttcaatgttctaaccggtttttctattctgttaaagttttcttagtcatttatcatgttttgaaaacaggtatcagactgagcaagaacttgggaccgaaatcaaaccaattccttctaatatcgatcaagcaatctactgtcagtaaacttgtaactgtgcatgaaacgtgtctccacccaatgagaggtacaagatggttaaaatggtaagagtaagacgaatcctctctcttaggcttaacttgtcaaaacaacatttaaaatcaaaaagctatattgcatgtttaagaccagtgtgcccaatatttcaggtgtttctcaagctcgaggggaggagatgaggcaactagtacttggcggttcatgtaaagactcgttactcagtggtttggttcctaatctctcttaaagacacttgttatctggttctatggaaacctctttacgctgcacttattatgagactccctttgacttggttagtaataaagatagaacgtatgactctcctcttttttattttcgtgttgggctctgtttggaattatgggctttatcctatttaggatctatttatcatgaaagttgcacttcttaatttttgcttccacggaattattttgatttttccaaaatattttcttccacatgcttattattctagtttggtattaagctattttcgtcaaaatgtttgaaccgtaaccaatcttgttttatagtgttatatccattgagaaattatagttttcacgtgtttatttatttatttgggttattaaacataaatcatgtaaatctgaatcctgtggagatctctccctagttgatgaatagatatgatgaatttaattctttcatgaaataaaaatatatgaaacatatgtagcagaaaaagaagcatatctatgaaacaacaaacattcaaaaaaaaaaggaaaacggaaaattattaatatgaaaactacggctttgacttgtagctgactacatttacgacatatatatataaatggaccccactgagtgtctgcaaggtctttacacaacagtatcttcttctgtttctttgactctttgtgatccctaagcctacccataatacgtgtctacattttattggattgtttcgtgactctgtaatcttttttataagaaaacaagtaatagtgaaattgaagtaaatagctcagcacagaaacttcgacaaaaataactcacagattagaaaagaaaatatatgcataaatagccatggttcatttatgaacaatttattcgtttttttagtttataatttcattaaaacatgtttgtcacatcacatttcatgtccttcggctcctactacaacaacaagtcactgtcatctccattacttccacttctgctcctttctttattaacttgttcaaaaacaattctaagataaataacaataaatgttggtctctctttattatttcccggctaaagaaggaggatgtctcgtattatccgccatcaatgctcttttgtttcctgtttcttgcaatttgaatccctgagaatcctagcccacttatttactactttgccttagctgttttcgacatcaaaattttggtcatatgactcatatcaatcttcaaatttgataaaatatgttcccaattcacaaaaacaaaaaagttttcgaaagctcaaaaacctttaccatttcaatagtagataggattcttttagatttgcatttcacgaaaagagaagaaaaaaaatcgaaaaatatttgcaatcatgattttttgtttctgaaggagacctgtagttgctgtcatgaacattaaatacaaatctaataaatgttgtacgaattttgcgtgtaataaatggtcagggccggctcgaagctcgctgatcgtccttttttcgtgtctctatagcaacacacaatcgtatttatttcaaactttttttactttgtttcccatccatcaaatataagtataaaaatgtaaagaatcatcatatatagatcgtaaattcattgcttcctttggctttttatttcatctagacgacgttaaaaccagaccagaccaaatacatttatcatttttcccttttttctaaaattctctctttgattcctatcttcttctctttattttcactttgtgctttctctgtctctcctattatgagtctaaaagtctactagctgttcaatagttttgtctttctgtgtttcttcttcttcaaaaccgaaagaaattcaaaaagagtctttcgctgcttgttagtggggtgaggaacaa

SEQ ID NO: 10865 - DNA, 3000 bp, Unknown
  misc_feature (1)..( 3000): cDNA_ID_1012561_gDNA_ID_2214456_Annot_ID_132948 3000 nt of promoter + ATG
ctctgattggccaataatgttgtaatggcatcattcctcgtatgtagaaatcgtagaatcttggttttacatataatgtcattgagtcacatgccattatgtatttctcgctaaccgaccatgcccatccttctatatatatcttgtatctgttttaattccataaaagaagaatcgaagacttatagtaattaaaaataaaataaaaagtatagtaatactttctttctttttacctatgagtgcactggttctctagatttgagttcttgaatccttcttttgtttctttatcccaatcctttaaaagcaacattattcaaattcagataatctatcacaaaacttatatttatatcataatcttttggaaagtgaaatttgggagaaacctgaatatagagacgagtattccactcttcatgttctgtagcattacacttgagaagatctcctcttccaggatcaacataaggattacctctccaataagcgtacgccacgcggtccttccattgcgtcatactgttcccttcttttattgcctccaacgatttcccccatggttttacgttcacttcagccctggctcattagaagcccaaatattaacaaatcagtaacaacaataagccttttatcatcttattgggctgcttaccagccccaaaaggaccaatcagggaagacaatgtccaagcttgcgtcatctgaacagtaacggaaaactggaggtggttccttctgttgaccaataaagtcaactgatcggacgacgggacgatcatcagcgtcgaacattagctcgagatcaggtaatttaccagggtaccaccgtaacaactgtaagattccccacagagtaaattcatctcttgtttgtattgacttcttatatctcttaacgtacgccttcccgttacggatcaccaatctaaaatgcgccgttctactcgcttcttcgatcatccctctagttatccccgtttgtttccatggccgtagatcttcatggatccaacggaaataagaaggacacgtggatgattttgaactgttgttggggtttaatctcgatttgcggttttgtgagataggagtttgacttgattggttctgtacgaagtcgcatccgtaaggatttggttcttttgtctttgttgttagctttaaacctgcaaaagcattctataaaacaaaacaataagacaaattatgattatgattaacgttaactactgcgatttatattaaagataaaccaagaatgtaaggtgatattaaaacccacgaaatcgagatagcccagtaagtctaagatagcagctgaaatgaatagaacgacgatgaaaacagtagccttcacgatgctttttcgaggaaatgtcaccgttttattatgttggccgtcgttgttattcatcttcatgcttctgttttgtgtttatgttgatgcacgagtttatgtaataaaagattaacgagagagccgagaggatacataaaaggagaatcaacagaaacgcaacacaaaagtatgaagataacaaaaaaaaaaacatgatatgacatcaaactcatatatttattccctaaaacatacaataaagaagtttattgtttataagtaagagatgcatgtgatgtaatacaggtctagagattttgttttatgttaatagtatttgtatagacattttgttttaagtgacgtattatttattagtatttgtttccagtaacattaaatggtattaacatggcacggtctaagaagtcaatattttctaactacctccaactacgagagtggacgtgccaaattgcacttttagttttagtaagtacaacaagatcaataatgtaagatgcacttgataattaggcacattccagtcactaactcttatctttgtccatataagccattttaaattgtttttattgacttctttaaagatagcaaacactagttaaacacacaaatcaaagttttataaggtatgcgatatattaataactgacgctgtgaatgtgattaggccttttctgaagtcatgcttttcccacttagacataacaattttaccttcatccctattcagatggaaacagttggttaagatcggtttacgtccatggtttggattttggaagatatcatatcagtgttggttataggtaggtgttgtgttaagtgttaacatctcccctaatttttttgtaaaatcaaaagagcttcattaaaagttactaacttctatgcttgatgtctagtgagtagtgacttagtttagtaatggaacttaaactatgatatctgtacagttgtactaacgcttccgcatcatatagaatgatagaaaacaaatgtgtatttacggagcgaatctcggagtagtttggatcagtttagtctttttggaaaacaaatcctgtcagatagcttttggatctttcctaaaaacctctaaataaagaatatgaatcgagcccaataaattaggcccatcttatacggcacgtcttatacacgcgctcctacaaacatggataatatccacgcgccaatagagtgcgtggggtcacaacaactcagtatcttatctgtctccagcgtgtcttcctccacgtcacgctttcgtccgacatattattatttaaacagaaaaacaatttactaatgaaaacaaattgacatttgcttacgtggcatatgtttaaccgcattacctgtctgtcggcaagctgaatttttgtgttcggctgcatcgcagttcacgtggatacacaacaaatggatttataaccgtaggatctgatgcctttatatatcaacggataataaaataaggtatttttaaccccaaaaaaacgcggctaatacgtataaacatctttctgttgcttggaaataatatcttcaatttttcatatttcgtttttaatttggttttcttttttcctctctatttcttcggctgagaggcggcgactatg

SEQ ID NO: 10866 - DNA, 3000 bp, Unknown
  misc_feature (1)..( 3000): cDNA_ID_3038306_gDNA_ID_2214456_Annot_ID_132950 3000 nt of promoter + ATG
acgcaagcttggacattgtcttccctgattggtccttttggggctggtaagcagcccaataagatgataaaaggcttattgttgttactgatttgttaatatttgggcttctaatgagccagggctgaagtgaacgtaaaaccatgggggaaatcgttggaggcaataaaagaagggaacagtatgacgcaatggaaggaccgcgtggcgtacgcttattggagaggtaatccttatgttgatcctggaagaggagatcttctcaagtgtaatgctacagaacatgaagagtggaatactcgtctctatattcaggtttctcccaaatttcactttccaaaagattatgatataaatataagttttgtgatagattatctgaatttgaataatgttgcttttaaaggattgggataaagaaacaaaagaaggattcaagaactcaaatctagagaaccagtgcactcataggtaaaaagaaagaaagtattactatactttttattttatttttaattactataagtcttcgattcttcttttatggaattaaaacagatacaagatatatatagaaggatgggcatggtcggttagcgagaaatacataatggcatgtgactcaatgacattatatgtaaaaccaagattctacgatttctacatacgaggaatgatgccattacaacattattggccaatcagagacgattccaagtgtacttctctcaaattcgccgtacattggggcaatacacacgaggacaaggtccatatatctaactaaagatttcttacatctttaatctttacgtctgatttgtatcaatttaaccctgtgtttgttgttgtgtataggctcgtgagataggagaggtaggaagtagatttataagagaggaggtgaatatgcagtatgtgtatgactatatgtttcatttactcaaagagtatgcaacactcttgaaatttaagccggagattccgttagatgcagaggagatcacgccggatagtatggggtgtcccgcgacggaaaggtggagagattttaaggcggagtcaatgattatatctcctagtgaagagtctccttgtgagatgcttcctccttatgatcctctagctttaaaagaggttcttgagagaaaagctaatttaactcgtcaggttgagttgtgggaaaaccaatactttcaaaatcttaccaacaaaccttaaattgttttgttttttccttcttcgttgacgagatcaaccgcaaccaaatagttcagtcgtgggaggatcaatactctcttgatttgacttataaaccttgatttttttttctatcatcattaaccatttgtcgaatatacttttcaaagtatactttgtttatggtcttgttatatgctcatctcattgatccttttaaattagattatcagaagagatatgtaagtctttcgaatacatctacattctagctcgtatataaataagaagaagtgaaaaaaatttaaacgatttttggcatgaagtgattttgttgtcaaagtgaattaaatacagaaatttggagggcactattgttatattaagataaggtgggaactagtcctaaacttggcctatcatggcaaacctttttttctaatatcctgccaatctttttgaccaattgaatattctttttctttcttagaaatttcttaatcattcatctcatctcaactagaaagttttttttttcaaaagtaacttataatttctttcattgttggtaattttgtgagatcactcgggctccataagtctgtttcattgacaaaaagaaacaactgtaagaatattttctcccaaaattaataaattaattaacatggaatatatatacgtaggtgggttgacttgacttagttaggctttggctatggttctccttaaagcctttataaaataagccagcactaattaaatatcagtcatgatctttttaaaacacatgctgaaaattgtttttttttaaaaatcaaacatataattgtactaatttagacctccaaacccttaaatcaacccattttctacctcataaaagagatccatgataagtgagctctgcttcatctctttctagttcttgtgttcttgttgtgttttgtccgatgagagagaacacacaagtggctcaattcacagaagatcatcaccagagacatcaaaccccaataacttgtttaagctctaaactagcaaagatatggacattgttcaccaccaaaatcttcatcttcgtcctcttcatcatcctccttagtgcttctgtctcttggatgtatgcggtatatatttttctctttctcttgatccaccagtcatatctatatataaacctctttcttttggcttgatgataaattatacatataacaatatctcatacgacacgttaaagagaattatatattgtaaccagtgtgtgtttgtttgttttctctactctttaacccatttaaataatttcatattttgctacttatatacttgtattccgaagttggatcttaaattattttacgtggtgtcgttaaaaagtttgttttaggtgagaataaattccaagtgacatcaatattcacaagaaacaccaaaaaaagcactcccacaaaaacaacaacaactacagatatccccaagatcgccatcaagatcccattaaactgcacatcactcaacagcaacacaacacaaacatgtccttcaaattacccaaccaagttcgaaccagcgatctcttcctcggagacatgtcctgactacttcaagtggatccaccgagacttaaaggtatggcaaaagacagggatcacaagggaaacactagagagagcaagaccaaatgctcacttcaggatagtgataaagtcagggagattgtacgttcatcaatacgagaaagcatttcagacaagagatgtgttcacaatctggggaatacttcagcttctaagg

SEQ ID NO: 10867 - DNA, 3000 bp, Unknown
  misc_feature (1)..( 3000): cDNA_ID_2716632_gDNA_ID_2214456_Annot_ID_132954 3000 nt of promoter + ATG
gaattgcccaaatgaagctgccaacaatgaccttttaaggaggcaaacacacatagttaagcataagaaatctaaattcatctaaggaatttgataacaagcgtaagctcacctggacttggcttgctgctattagaggacctccaattccaccaccaatgacacgaccatcggggctagcaagtgagaccgctagacttccagtgcggtttgggtagtcattgtcagttgtgttcagataagaagttgagagagatatgagctcgaatagaccctataagtttcaaagtatacaccaaaataagtaatgtttttgtcttctaaaagataataaaatgtgagtgatgattcaataaaacctcgtatataatagttccatgagaaggtgctggctgaagaagagttgcagtagagacagcaccacttgcggataagacacatatcgctcgtggaccttgatgcgagaacgatataacctttgaagcaatgtcctgaaagcaacaccgagagtatggttatctcaagaactagaggcaagattacaaagaaaaaaaagaacagatttattcaagaggagacagaagaaacatacttcaccaatggaaactacgattacatgcggtgtgaagctcatcccagttgatgaaggcatcatttcaccttacaaaaaagaatcaaatgtcttcagaaaaatcacagctaattgtaatcagggagaaacagagcaataacaaagtttaagagaaaggccaaggaataataaaagaataaatattgaattcaacaatttgacattataaaattccacagctttaattaatccttaacagttcgaattagcttataataaacttcccaccaatgtcctcatttgaaaaactatatcatcaattaagctcaaaacttcccaccatattcagagccaatgtccttgtcggaaaataaaactcataagttagagattagggatattaccaatggaagatagccgttgcttcttgccggagccaggaggtcttccacggccacgtttgttagagttcggggaaacgttggagatagaaggagacaatgccaacgaaacagaaccaccatcttgtccatattttctaggccgtcctctcttccgcttcacagacgtgtcacctgaaggaggagcaaccaaagctcccgccgccgccgctgacgaatcagccggagaagagtcaacgggtaaaggaggagacacgaatccagtagagacacctccagggtttggatttgggtttgggtttgacccaaaaggagagatggaattggtgaaatgatgaaatccttgtgatccgtgaaacgttggttgagtttgaggaggaggaggaccagaaccggggattcctctttggatatagtaagaacccgacccggataacgccattgcgtctcttcgatccatagcttaaccaaaaagactctgactttaacttagtaaaattcgatggggaccctaaatggctaacttataggaggagggataagaagagaacaaaatcagaatctaaaagggttcgatagacttcaagagcaagataacaacatgcaaccgaaaatctctgaaaacttatcaaaacacacaaactttcatttcacctaattgttttttatgtagctttagtatcaagctatgagaaaatctcaagatgaaattagatccaaaagagaaaaggaaagaactttaattttcttcatctcttcttctctgtttcattctctcaccaaaagcaaagaaatgaagtgtgaataagctttctcatccatcaatcaacaatggtgaagaaaaaaaaaagttttctagggttctctctctttctttcttcagagtgtatgtgatgttgctttttttcttttactgggtgacagagggaaaacagaaacaaacaaaaaaagatcctttctccaagcatttactgtggattacaatacaatgggatgatgaggcaggatttcaaaattcgaaattaaatttgaagtctctgacttttgactgtgatataagctctctctctatctctctaatagacttctttctagcatctagcaatttgtaggagggatccatccatccatcatcatcatcatctttgtgtggctcattctcaacgctatagattaggtgcgtgtatcaaacgaagcattgggaatgagagagtgaatctcacgcttctgatgtcgagagtgagagaatagtgatgtgatctagtcaagactttctttgttcctcactggcttccacttcatcataagctttcaaaatttatgaatcccccaatctatctttagactctattttaccataaatacttgagactaatgattatatattggcattaagagacatataacatgaatataaattcccattttgtggagtaaatattgttcttgtctctgttctgttcactttaaatcttcatttttctctacaaacaataatcattaggacccaagagtttatcaacaatacagaatctgaacgtttagtactcatgtcatgtgaagtgaagtgaagaagatcaacaagaacattaattgtttgctataatcttctatgggccggataggaataattaggcccagtatctaacacatcaaacaaaaacacatcgaagtcgaatcgtcggtgggataattaggcccagtatattcaaacaaaataacatttaacagatccaagtccaatgttgtcgtggaacgaacgtcgtttagaataattaagcccagtatttaacatatcaaagcccaatgttgtcctaaaacgacgacgtttgaatgtggaacgtaaacaatcctggaacaaccgtttcaactacctttttcctatcacttgttttttcacctctcgaagtcctccgatttgctacccttacgcagcctcatgtgtcaaccaccatttctcttcttcatcttcgtctctatcaaaccctaaacctaaaaccccttattttcccgccaatgtatcaatcc

SEQ ID NO: 10868 - DNA, 3000 bp, Unknown
  misc_feature (1)..( 3000): cDNA_ID_2716620_gDNA_ID_2214456_Annot_ID_132957 3000 nt of promoter + ATG
aacatttgagagggggaggaggtatttatagcctccaaactacaaaatatctaaaatattttaatcctaagtctagagagttcttacataagatctagattacattattcaaattatctagattattctattagagtatctagatttttatgtttaaggaggtggaagatgattctagaaaatttctagaatcttttaaggaggtggaaatgatgatatttctagagaaaactctagaacttggatttggccataattaattattggataattgatccaataattaaacttgattcaaaatcaagtttaactttcaacatcgtatagaagatacaacactttataccagttgataggtaaacgtttgtatatcttccttttgtatatgtttatgttgtatatataatatgcagattcaactttttacacttttacataagtcatagtttgggtcaggaagccagttataccatatttgctttatttagaatccatttactatctcttgaaactaattctttagccttgttgtaatgttgttattgcacctaaatgaataagaatatgaaactcatctaagataattggcaaaactgctcatgaaaagaagagttttaaaaagctacaaaacttgagccaaaagcaaccatgactcagaagtgtatgtctattattcatctacaatctcggaaactaaaaattaccaaaaatcttatatagaactcatattaccaaaaattaaaaaggatataaataaactagggttttgaggggtggtacaaattcgttagctctattgtagtttgcttattaaatatcagacacaattcccaaagtctgattgctcgtgaaattttataaatagcaaagtatttgagcttaaaacaaccatgtcttacaagtgtatgaaataaaagacgaataccatcactagaacataaaagtaatctgagaaaataataaacgggctatgttatacgagcccaaaatcctgaaaactttgacacaagcttcacatcctccaaatgggtacaaggttaacatcctctaaatggtcaagaaaggtgtaagctttgtgactctgaaaagtttccattcctttgattttaactatagtgatagtgttcctatcgggattgtaatagagaaggtagaaaaagtcggatatagtgtttggggacaacacaatttcacctttacgagtcgttccaacgaaacataacttggtctcttcatatacattcctccacggaggaggcaaaacgtagatatgacttgaccattcgtgtttctccgcgtcttcaagaacccatagttgaataccggtgcatacgttgttaggcatgttgggctgaagcttagctaatttacccttgtagtttactagaattgaattcagccgccttcccaagtacaatatttccatgtcatgaccagcaactttcttgatatatttgaatttgtcagatccaaactcaaagcatactacatcaggatacctgtcgtcagaaacaccatggacaatggctaagtaatacaaaacaccattgatgcataccccatcatattgagaaaagccattagtatgctccacaggaacaggataatgtagtatgtcacattcgatcattttccttgacggtttcttcccggtttctaacgtgtgaacttgatgctcttcagaatcagctcgtcctatacatgaacgcgtcatgcataatactttgaaatttttgtcgatcggatcaaaccccaaaaagcttatcactcctttcctccttgttttcactttacgtaagaccacggattcccctgtgctagggttacatatcaatggctcagtaaccgtcgttccctttgtagttcgttgatgtaaaccacataaccagccacgaacaggacgacaaatattagagggacagctaatcgggaaactcatatgcaaatttgcggctataggagacagatcttgaggatgtggtgatgagaagaagaacgtttcgcagtcttttaggcatgtaaacaagatcttcggacgagacgaagatatggtcaagtaggactcggtgaaatgctgacctcgcaatgtggactgccatagcttcgatacgtaacgaaatctagctatagacttgacaggcaatctcaagagtatctcgattacgagatcgaacgggatccgttcggatttctcttcttctttcttttgattcgaacaagatcgtttcttgcgccgtgtcatcatggtggaggcggcttctcttaaaaccctaatgactttttttctcccttccgtctgattaaacctaataataatcataacgcttaaaacgtgtctctcaagatcctgggtctttctgatttaaatgagaatataaatgcctacatgtataaaattaatagtatgagggtatggctgcaaaataattaaaaaatgagctgacgattcaaaacgatgccgttgtggtttcttagaagaaagtgatcgtcttcttcttcgccgggaagctcacaaacggaatatactctactgttccttgcgacgtgccctgaaggtaacttcttctagattcctctcaatttctcatcttatttcttactttttcctcagtctcgtttcttctgagacgatttaagatctgtttcgattctgattttatttatttatttattgctggagttgtagatctgattgtatgtgtagtggatttgatgtaattgctgacgggtttgatcagtggactgtgagagttaaataatttggtttgacattggatctgtacttgttggaattcgatctgtttcttcatctttgaatgtttgatttgttgttatggcaatgctcttgtttatcttcaaatatcttgattaatgctgctcttgatcacaaaggccacttatgtgaattgctactttaagttagtatagggattagccatatctgagccagtgtttgtctctcttttggtcatgaacaggattttgtagaatcaattcaca

SEQ ID NO: 10869 - DNA, 3000 bp, Unknown; identical to SEQ ID NO: 10868
  misc_feature (1)..( 3000): cDNA_ID_2716620_gDNA_ID_2214456_Annot_ID_182666 3000 nt of promoter + ATG

SEQ ID NO: 10870 - DNA, 3000 bp, Unknown
  misc_feature (1)..( 3000): cDNA_ID_3038306_gDNA_ID_2214456_Annot_ID_182659 3000 nt of promoter + ATG
ttttttgttatcttcatacttttgtgttgcgtttctgttgattctccttttatgtatcctctcggctctctcgttaatcttttattacataaactcgtgcatcaacataaacacaaaacagaagcatgaagatgaataacaacgacggccaacataataaaacggtgacatttcctcgaaaaagcatcgtgaaggctactgttttcatcgtcgttctattcatttcagctgctatcttagacttactgggctatctcgatttcgtgggttttaatatcaccttacattcttggtttatctttaatataaatcgcagtagttaacgttaatcataatcataatttgtcttattgttttgttttatagaatgcttttgcaggtttaaagctaacaacaaagacaaaagaaccaaatccttacggatgcgacttcgtacagaaccaatcaagtcaaactcctatctcacaaaaccgcaaatcgagattaaaccccaacaacagttcaaaatcatccacgtgtccttcttatttccgttggatccatgaagatctacggccatggaaacaaacggggataactagagggatgatcgaagaagcgagtagaacggcgcattttagattggtgatccgtaacgggaaggcgtacgttaagagatataagaagtcaatacaaacaagagatgaatttactctgtggggaatcttacagttgttacggtggtaccctggtaaattacctgatctcgagctaatgttcgacgctgatgatcgtcccgtcgtccgatcagttgactttattggtcaacagaaggaaccacctccagttttccgttactgttcagatgacgcaagcttggacattgtcttccctgattggtccttttggggctggtaagcagcccaataagatgataaaaggcttattgttgttactgatttgttaatatttgggcttctaatgagccagggctgaagtgaacgtaaaaccatgggggaaatcgttggaggcaataaaagaagggaacagtatgacgcaatggaaggaccgcgtggcgtacgcttattggagaggtaatccttatgttgatcctggaagaggagatcttctcaagtgtaatgctacagaacatgaagagtggaatactcgtctctatattcaggtttctcccaaatttcactttccaaaagattatgatataaatataagttttgtgatagattatctgaatttgaataatgttgcttttaaaggattgggataaagaaacaaaagaaggattcaagaactcaaatctagagaaccagtgcactcataggtaaaaagaaagaaagtattactatactttttattttatttttaattactataagtcttcgattcttcttttatggaattaaaacagatacaagatatatatagaaggatgggcatggtcggttagcgagaaatacataatggcatgtgactcaatgacattatatgtaaaaccaagattctacgatttctacatacgaggaatgatgccattacaacattattggccaatcagagacgattccaagtgtacttctctcaaattcgccgtacattggggcaatacacacgaggacaaggtccatatatctaactaaagatttcttacatctttaatctttacgtctgatttgtatcaatttaaccctgtgtttgttgttgtgtataggctcgtgagataggagaggtaggaagtagatttataagagaggaggtgaatatgcagtatgtgtatgactatatgtttcatttactcaaagagtatgcaacactcttgaaatttaagccggagattccgttagatgcagaggagatcacgccggatagtatggggtgtcccgcgacggaaaggtggagagattttaaggcggagtcaatgattatatctcctagtgaagagtctccttgtgagatgcttcctccttatgatcctctagctttaaaagaggttcttgagagaaaagctaatttaactcgtcaggttgagttgtgggaaaaccaatactttcaaaatcttaccaacaaaccttaaattgttttgttttttccttcttcgttgacgagatcaaccgcaaccaaatagttcagtcgtgggaggatcaatactctcttgatttgacttataaaccttgatttttttttctatcatcattaaccatttgtcgaatatacttttcaaagtatactttgtttatggtcttgttatatgctcatctcattgatccttttaaattagattatcagaagagatatgtaagtctttcgaatacatctacattctagctcgtatataaataagaagaagtgaaaaaaatttaaacgatttttggcatgaagtgattttgttgtcaaagtgaattaaatacagaaatttggagggcactattgttatattaagataaggtgggaactagtcctaaacttggcctatcatggcaaacctttttttctaatatcctgccaatctttttgaccaattgaatattctttttctttcttagaaatttcttaatcattcatctcatctcaactagaaagttttttttttcaaaagtaacttataatttctttcattgttggtaattttgtgagatcactcgggctccataagtctgtttcattgacaaaaagaaacaactgtaagaatattttctcccaaaattaataaattaattaacatggaatatatatacgtaggtgggttgacttgacttagttaggctttggctatggttctccttaaagcctttataaaataagccagcactaattaaatatcagtcatgatctttttaaaacacatgctgaaaattgtttttttttaaaaatcaaacatataattgtactaatttagacctccaaacccttaaatcaacccattttctacctcataaaagagatccatgataagtgagctctgcttcatctctttctagttcttgtgttcttgttgtgttttgtccg

SEQ ID NO: 10871 - DNA, 3000 bp, Unknown; identical to SEQ ID NO: 10865
  misc_feature (1)..( 3000): cDNA_ID_1012561_gDNA_ID_2214456_Annot_ID_182657 3000 nt of promoter + ATG

SEQ ID NO: 10872 - DNA, 3000 bp, Unknown; identical to SEQ ID NO: 10864
  misc_feature (1)..( 3000): cDNA_ID_2716655_gDNA_ID_2214456_Annot_ID_182655 3000 nt of promoter + ATG

SEQ ID NO: 10873 - DNA, 3000 bp, Unknown; identical to SEQ ID NO: 10862
  misc_feature (1)..( 3000): cDNA_ID_2716663_gDNA_ID_2214456_Annot_ID_182653 3000 nt of promoter + ATG

SEQ ID NO: 10874 - DNA, 3000 bp, Unknown; identical to SEQ ID NO: 10859
  misc_feature (1)..( 3000): cDNA_ID_3038325_gDNA_ID_2214456_Annot_ID_182650 3000 nt of promoter + ATG

SEQ ID NO: 10875 - DNA, 3000 bp, Unknown; identical to SEQ ID NO: 10857
  misc_feature (1)..( 3000): cDNA_ID_2716690_gDNA_ID_2214456_Annot_ID_182643 3000 nt of promoter + ATG

SEQ ID NO: 10876 - DNA, 3000 bp, Unknown; identical to SEQ ID NO: 10856
  misc_feature (1)..( 3000): cDNA_ID_2716694_gDNA_ID_2214456_Annot_ID_182642 3000 nt of promoter + ATG

SEQ ID NO: 10877 - DNA, 3000 bp, Unknown; identical to SEQ ID NO: 9616
  misc_feature (1)..( 3000): cDNA_ID_2184267_gDNA_ID_2214456_Annot_ID_182672 3000 nt of promoter + ATG

SEQ ID NO: 10878 - DNA, 3000 bp, Unknown; identical to SEQ ID NO: 9616
  misc_feature (1)..( 3000): cDNA_ID_2184267_gDNA_ID_2214456_Annot_ID_132962 3000 nt of promoter + ATG

SEQ ID NO: 10879 - DNA, 3000 bp, Unknown
  misc_feature (1)..( 3000): cDNA_ID_3038417_gDNA_ID_2214458_Annot_ID_182684 3000 nt of promoter + ATG
tcctagctaagtaagctctactatatatagctcatttcattcatttgtaagttacagaaaaaagagaagagaaatagaaagcaataagaaaactcttgtttcgagttttattctctctagtcttcattattctttcttactttaatcctttataacatattatcagcacgagtataatatacgtcggttatgtatcaccgagtataataagatatcttgaaccacaaactggtgatttgtttacggtacgttttgccgattgccattttaatgaagatgaattcctagctttaggggggaggaattcatcaaatgcatatgcataaagatatagaatggtgcacaccatctttaaaatattttgatccccccacgaagtatcgtgagctggaagtacaaaagattgtacatttacaaagtatggcaaatcaattaccagattcgttcaccgatacaagaaaggtgacaaagtcatatatccccgctgcaaatgccccatcaagagttgaaattcctagtgagctggaattagatgggagcaaaattaatgaacctaaggttcaattaaagcgtgggaggcctattgactcaaaagataaaaatccccaaaagaaaaagaaattgggagaagaaaatgaaaaggttcttcaagaagaaccaagtcctcgggacgatagagaaaagtatgagatttctattaactatgcccatgatgatatcatatgggatagagatgatattgatgatgataatggaatattctccttttctttatctaaagagatcgatcaagagaatgatgatccagatccaaagacattatccgagtgcccgaaaaggccggattgagagaaatggaaaaatgccatgcaagttgagttgcactcccttaataaaagaaatgtctttggacgtattgtcactgcatctgagagtgtaaaacctgttggatacaagtgggtattcgtgcgaaaaagaaatgaaaaagatgagatcacacgatataaagctcgacttgttgcacaagttttctctcaaagaccaggagttgattatgaagaaacatattctcgggtcatggatgcaattacattcaggtacttaatgagcctttcggtatctaataatttagatatgtaccttatggatgtagtgacagcttatttatatggatctcttgataatgatatatatatatgaaaatctcggaaggattaaaacttcctgaggcattagactcatcaaagtctaaagatatatatgtggtcaaattacagcgatcactttacggattgaaacaatccagatgcatgtggtataatcgtttaagcgattatctacttaagaaagggtatgtgaataataaaatctgcccttgcgtcttcatttagaaatccccttcgggatttgtgctcattgttgtttatgttgatgacctaaatataattggaactccaaaggagattgatgatgcacgaactcatatgaaagaagagtttgaaatgaaagatcttggaaagacaaaattttgtctcgggctccaaattgagcatttccaagatggtatatttgtgcatcaatccaattatacaaaaaagattttaaagcgctttaatatggataaagcgaatcctttaagtactccaatggtcaatagatctttaaatgttgaaaatgatccatttagaccttgtgaggataacgaagattttctgggtcccaaagtaccttatatgagtgctatcggtggacttatgtatcttgcaaattgtactagaccagatattgcttttgctactaatttgcttgcaaggtacaattcatcccctacacgaaggcattggaatgggataaaacacatcttttgttatcttcaaggtactattgattttggattatattatcctagaaaccccgagtttggtatagagaatgtgtttggcttagatccatgactaatcatattcaagaagcaagtggattagtcatcaaaagagagccaacaaggatatatgaagataatgatgcatgtgttgctcaaatcaaagaaggttatatcaagagcgacagaacgaagcatatccctccacgattcttctcctacactcaaaaactcgagaagaacaaggaagtagaagtgcaatacgttcgttcaagtgacaatgcagcagatctattcataaaggcgcttccaacttctacatttagaaagcatgttcaaagcattggaatgcgtcatctacgagacctgtgaagtgtcttcgagggggagttcacgtcactgtactcttttttccttgtcatggtttttatcccaatgggtttttccatgataatgtttttaacgaggcagtacgtaactcatcaaaagtgatggatactcaagggggagtgttattaaccggataagtatggatgtgattattcatcactcatctctatccctaatatatggattatgtttatccattacttcttctctaagatatggatgatgtttatccattatttcttctctaagatatggatgatgtttatcaattacttcttcgctaagtaagctctactatatatagctcatttcattcatttgtaagttacagagaaaacacagagaaaatagaagagaaagagaaagcaataagaaaactcttgtttcgagttttattctctctagtcttcattattttttcttactttaatcttttataacactaatggtgttgtttaaaataaaatttgttatgttttattattgttatatgatgtaatgtttttttaatgtgtaatgagtgtttaatttaaataatatcatattttatagaaattttgcaaaactataatatgtggagttaaattttaaattctattaataaaaagtattattatataaaatagaaatgtaatatttctaagaatgtttcttttaagagtagaaaatagagagatacattggaaataaatcctcttctaaaatagtgttactctaaggtctagatg

SEQ ID NO: 10880 - DNA, 3000 bp, Unknown; identical to SEQ ID NO: 7187
  misc_feature (1)..( 3000): cDNA_ID_1816958_gDNA_ID_2214458_Annot_ID_182714 3000 nt of promoter + ATG

SEQ ID NO: 10881 - DNA, 3000 bp, Unknown; identical to SEQ ID NO: 7185
  misc_feature (1)..( 3000): cDNA_ID_2174764_gDNA_ID_2214458_Annot_ID_182710 3000 nt of promoter + ATG

SEQ ID NO: 10882 - DNA, 3000 bp, Unknown; identical to SEQ ID NO: 7186
  misc_feature (1)..( 3000): cDNA_ID_3038365_gDNA_ID_2214458_Annot_ID_182711 3000 nt of promoter + ATG

SEQ ID NO: 10883 - DNA, 3000 bp, Unknown; identical to SEQ ID NO: 7188
  misc_feature (1)..( 3000): cDNA_ID_3038361_gDNA_ID_2214458_Annot_ID_182716 3000 nt of promoter + ATG

SEQ ID NO: 10884 - DNA, 3000 bp, Unknown
  misc_feature (1)..( 3000): cDNA_ID_2716736_gDNA_ID_2214460_Annot_ID_132965 3000 nt of promoter + ATG
ccaccacacaaagacgcatgagcacaaaagcggaagaagacataagctcattattgtgagtagaaggagaaagtgtcaagtgattgaagtattgaacatatattaaaaaaaaataagagaaaattcttttttaaaaaatgtttgcagaagagtgggtgaaaatttgagtcagaacttagaagaaatgagaccgacaaaaatctaattttttgagtaaaacaatgaaggaaatatgagtctgatgaactctgacacaacttttgtttattatttggttgcaatgaaataaattggggttaacgtgcaattcaagcaatctctcagtgataatgtattcaactattcatatactacagtcttctccacgaactatccacaaacattaccatatatataatataatatatacacccacccacacatatggacttctgctcccccattaaaaaagtatctaatcaagttttcagttttatatcagtttttagtttggacaaacaagattttatagataggttacatccattgaaagaggagttgattacacaagataataacaaagccataacaattttatatcgttttgggttgggaaataatctataaaaaaaaccaaatagaaaagctgttacagttttgcttaagttgggcttcttaacaaacaaaatctataatatgaaagtttttttaaagatcagtttatgtttagcttctttcggtttatagatgtagatattttctagcataaacattagactaatgtgagctatgcctatgagtttctcgtaattattcgcaattctttttttatcatccctttattagtctctatatcttcatttctttctttctttctttttttttctcttcatttcacattatatgaagatgttttctaacataaaaacttaaaattacataatccgaattagattgctacgagctatgcattttcttgtgatatttcacaattctttttagtaaaaatgtctcattcagtgctaaatcacctctaggttttttcctctttttttgaataccaattcacctatacgttagttgtcataaatacgtcttttctaacgttggagactaattggagtagttaaattaaatgactcgaactactactactatagagaatactagttacttaggtataataacatattatatatttctatcgaactgaaaataattgaataagttatagtatatccaaaagaaaaatagctttcagagtatccgacacccacgtgcaaggggaatgaataaagtcataataaatatttttctctttaagactcccacattcattcgcatcattatcacttttttttattcaccattttttcaatgaattgcattattgtatatttacttgaatacttccacacattagtttactaggttatgttataatataacaaacacatacagttaatcgacaatgtgtaaggataaattattgagctaaatttattcatcaatgtatgagttttttctgtcagactgtttaataagattgacttatgatatgaataaatgactgatgggtcgaaaccagaataaaaagctattttaattatgattgcactaactttaacgtgtcctttatttctataaaagataaagaataaataatcaagaaaaaagtccttaacagaaaaaaaaaaaaaaagagaaaaagaagtgagagacagcgaagaaaagaaaagctggtaacctcatgggatgttttggctttgctcaattatttcgaacttttgatatgattttgttccattccttttcattaatcggatgtgaaagctatctacttcgtttattgtataaagtgatgaagaattcttacaatctgaatgtgaaaagtaaacagttctttggctatcaggatttggagcagcgtttaatgcggcatggaaacggtgaacatccgtgatcactttaaaaaaaactatggcatacacaaaacttctgttttaaaaataagcgtataattggcaatgacagaatttagcaaaaaatgatgatgatacaaattaatggtgattgtgtgacgaaatttgacaaattagttaagagaataaatgataacaaagatgaccgaactaaagatttagttaattaaagataactcaaaattattgaataacatgcatgcgatttctctggttcacatattcttgaataagattacaaaaaaaaaaaaaactaatagaacaaatggataattaattatctgacgatttaacaagaactatattaataaaggttatcaaaagaataatgttttgactcgtaaaattaaactagtcatatgtgagctattttgaaatattcaaagatttacctagaataagaatttattgagaattatttcacaaacttaagttgtgatattggtttgttcgtcgcgttttttgtttcaaccaaatttcacccatttaacctgattaaactattatatactataaatgtgaattttcttatattttggttaacaaattatattatattatatgggttaaaacttgtgtaataacgtagcgataccactaacataaaacaaaatattaattttagctagtgtaacaacagtttcaataatattttccctttgatgtaactaagcatataattttagcaactataacaacagaaaattctatccgaatagcaaaaagaattattgaagttgatgtcattaatgttaacacagtctaaattaaaaattattttcataatttattattttttcacttaatgttttttcctcttgtcccctataggcgttagttactagtattaattgtccactcgtcgcggaaatgtaacacacattcctcgctctctctctctctcaaatcacttgcaaagacaaagatcttccacttcctcttcttcttcctcttcctttttgcctttctctgtctccctctagagtctcttctatataaatatcactagatttagtgtttgatcaaatcacattcaaca

SEQ ID NO: 10885 - DNA, 2096 bp, Unknown
  misc_feature (1)..( 2096): cDNA_ID_2716713_gDNA_ID_2214460_Annot_ID_182731 3000 nt of promoter + ATG
ttcttcaagaactagcataggttgctagctagatcaatgggtcctaaaccttcttaatgggcttataaatcccaactgttacaccgacatatttacgagttttgtggaaggcttagctaattacattttttttctttcacatgttagctatttaactaattaattatgcacctctccatcgttatccattaaacgtcaaagacaaaaaatacttggacacacgtaagagagagacacatatatctgctcaaatgagtcattacaccttattttattatactttttcttaactgtcttgttcctttttttagtcttcaaattatcaactttgtttctttgatcagctttgtcatcttgaaattatcaacgttttgactaaatttaaagaacagttgtgttcgttcgtgccattcttttgaatgcttatacgtacatttcttcttgaaaagactttgaatccaagaacccgtgaggaagtaatcccagtgaagagaagacgacaaagaaaaaggttaggcacattttcccatatttttcctcaaagaggagacattatttatctttgtatgggttttcttgataaagattagatattgaaggaatctttttttcattttgtgtcttttaggagcctataaagatccaaagcttcccttgtctttagttctcatcaaaaaaattgaaaaacgtttggagttattgagagagagagagatagagaaagatgttggaaggcaaagcaatggtggaagattcagacatgccagtgaagatgcagatgcaagctatggcatttgcttctcaagctcttgacctttttgatgtctttgactgtaaatccattgctggtcacatcaagaaggtattagtaatgattttcttcaattctatttataagtcataaatacatcattatcatctatatataactacttggttaattttgtttgttctataatgaattttcaggagtttgatgagagatatgggagtggatggcaatgtgtggtgggatcaaattttgggtgtttcttcacacattctaaagggacttttatctattttcaattggagacacttaagttcctcatctttaaaggcgcttctactccttaattacactaccctaatcatggggatgtttttttttcctttttcttttgcttctatgaaaatctgagaaaaaaaaatcttgctaagactatcaagatctttagctttgtttgaattctaagtttgtaaataggcccaagctaagagaggaagttgatttcaatgatgtaagatttttcatttttacaagtgtttgcttttgtgatcaataaaagtgaaatgcagaagattttttatatttatattcttttagttgagatgcaaacaattataattgcccagccacaaatagagaatttcttagactgacttagactaatctatcattagcataatataaatttattttaaacttttactttgatagaaattcagagagaggtcaaaattgaggaaaacattatcatccataatccttaatttagttgagaaactgagatttttttaatacaacaagacataaacaaaaatgatattacagataatgtcagtaacatgtcctccctacatctcaatgtttgatttaaagaaaaagattgagattttttttatgtgtgtggagaaattcaactttcaaataacgtgcagcccacattccaccaagtatcaatttataaatagtaaaacatttcaagaaaattaaaaatatcctcttatttttttcccctgaagaatctgaccaaattcactacttgtttatggttatggacaacgaatcataatagttactaaaataatcaggttaaaactaaaaccattaacagaagtcaaatgatggtgttctgtatttgctaagtctgaaattaaaatcaaacaccgttttttggttaattaagtttgttttttcttcatgatctcctaaaactcctctttattacacgaagaggagaacaaatggagattaaaaagaattttcaaatcatagaaatcttttcattttttttattgttttgattaactagtaattaatggtaaaagcaatg

SEQ ID NO: 10886 - DNA, 3000 bp, Unknown
  misc_feature (1)..( 3000): cDNA_ID_4254434_gDNA_ID_2214460_Annot_ID_182730 3000 nt of promoter + ATG
aggaaaaagaatcataagagtcagaattaattaattacctgatggtaaattcctgcccagaagagaatcagagcagtataggttgtgaagaaagcaagactaggaatatcaagcaagatatgttgcataatctacaagataataatccaagttttgcaaatttagaaaggctgacatagaaatgtttcaagtgtttaaatttgtttttggatcatagagtttttttttaagtttataccaattttcaatgaaaaagtagaaaccatcctacatatatgggattctccttaaactttctgttattatccatgaatgttttactttaattaaacatcaacatttttgctatatgagagtaaagttttgtgtgggaaaaaaaaaagagagcaaagtttggtaaaatattattttttcatccctagctattacttcttttgtattacatatcaatgttttgtattatttgtaaaaactctgttagttattctttttcagatcttattgatacaatttaggtattcattttagtaatataaacacacataaaaaaaaaatcacatcaatcaatttttcatttaaagcaagtataaatgtattaactaaaagcagaactaaaaaagttacgaatcaaatttagtaaaaaagaaaagaaatcatactcaagcgcaaaaaaaaaacagaaataaaatcataattccaaatctaaatttttttagttttcgacgaaattgagagatttgtttttaataactggataaataatcttaaatattcaaaagttaagatcaaaatcagtttaaactttaaagactacaaactttcaagagagccttaaactaaaaatgatgatgaagacccttgaacctgtgaatgcatgttaagcacattccgcctgaagacaaatacaacagccctatagcatatatctatagatcatcttaaaaacattacttcttcttcttcttcttcttcttcttcttcttcttcttcttcttgatgaatgattcctctctttttagggttattatttaaagccaaggactaattgtgatttgtgaatccaaatgtttagttctgaaacctcacctaatgtctcgaattcagagtgcatatgatacttattggtttcaactgttttccctatcctccatgtctgttttaaatgtggccttcttaaattgtaggtgatggaaaagaatattgaacctattagtgagaagaaagacatgcacacaggagatgtggcttctccaagtctgaaggaaaattcttcgcagcttgagagtaccagggacctaattatggttgccgcaaatactaatttatggagggagagcttgtttggttctgctaaggtgacacctagttatttcttttggttggtgctctaattattcccatcatcatgcagaagattgaatagttttatcaagctgttacgttccagtccagcaagaaccatagtttatgcaaacaagatttataaaagaaccttaatcattgattttagggtttatgtaccagaaaactgaaaacaaaacaaaagccagaatcgtgaaatagaaaaagggcttttggatttgagaaataacaaatttgttgaagctctgaacttgaaaaattatggcttttgatatgcggaaacaataaaattgaaaccctgatttaaaacgtataatcataaaagagaatctttgaaattagaaaagattgattttgctcacaaccaaaaaccaacaataaagtatttacaggtttcaaatgcatgacattattggactagaaacaacaaccaccctgtcatgtaattttacaaacttgcaaacaaatcatcttccaaagatgaagtattatcacacacacaaggttcactggccaagtatatccgctactgatttcttgacaattttcgaaagctcctgtctgaaaaaataaacaaagacttaggttaaacaaaaacaccagcattcgatttcataaccgcatttaaagaaaaaaaaattacctgtccggtttgaacaagagatatcgatatgtgaaccactgcagaaatggagatatcaaatgctagaagaatcaaggatcataacatttatacttattgagatgataccaagccttattacttaccgtggagaacaagataccaactagttcgaatccgctcgagataacgggcaatttgtcgattgcctaacgaagaaaaagaacaagtctttgtcatcaagtctcacaaaattaagcacaacaaaagataaaagttttgagtcttttcattactataccgtgatgagattcaatgatgcccaaagagctacaataccagcaaaacccaaaccaataagacctaacctatcttcagacttatcccactgcaataatttacaaatttaaaaaatgtccaaatcaaaactaaggcatatatgtaactgagaacagagtctaatgtagggtttatagagatttagggactcacaacattctgaatcgtactaacaacgtcgagatcagtcgatgaatctgagctttctccactagctttcaccatcagactgatgctgctagggtttcgagtaagagataatggagaaagatcattcgtacctcgagttagagaaaatgggagtttttgaatcgatgtgagattggattttctctgtgtgagtaacaatggcgaaggcaaagttgcagaaattgaagccattctttaaaaaaataaaaagaacagaacaaaaaaattgaaactttagagattttgattcgattttggagacagagacgaagaaatttttggttatggattagagatagccttatctttttataatccacgtggcatttcctaagtggcatatcaaatctcaaagatgacaacccaattcgccacgtggcagaacaagatctatcaaatgagtgaagaagattctccactatacaaattacatcaatccactcacttactttggcaacaaacaaacaacaacaaagagagaaattaac

SEQ ID NO: 10887 - DNA, 3000 bp, Unknown
  misc_feature (1)..( 3000): cDNA_ID_2716724_gDNA_ID_2214460_Annot_ID_132968 3000 nt of promoter + ATG
cattccaacctgcaattataaacaaaagttttacacaatttcaaaatttataaatacatatcatttttgattattaagaaatttctctgtgtttggttaatattatcaatagattcgaaaacagattaatatatcatatagttgtgatggatctacaaattgaaaaccatgcatttctatgcacatatgtttatactcaaatcttgttatataactatgatcggagttcatgcatgtttatactataaaaatcataaatgatataaccaaatagttttccggtaatcgattaaactcaccacacttgaacacttatatcaaataaaattcctggaccataaatatagatttgtatctgacgttttgagttagtacctagagaaggatcaagattcctaatcttgagctctctgtattcttgacaaagagagcaacaagggcataggacatgactggcacaatctgaatatggagcttccacaagattaaattttctcctcattttttctctatactttgatcccatcacccagtgagagcataaagccggcatcatcaataagtacatgaaagttccaagaggacaagctgcataaacaacgcaatatttgctattaaaaacatcatatttaatgaagaatctgatttcggtttcaaattgtgtaaagcagaacatactcatctctccttcatccatcacttctgctatttgtccaaatgttacacaaggtacaattgtggtcaaaacggctgcacaacaaagtttttaaagattagtgagtcaattaaattatgaatctcttgcaagaaatataaatatctataatctcgtttaaaagtgtatttgggatacaataccattggcttggtctgcttgacaatcaaacaaaccagtgctccatggcctcccaacagataggttaacattagcttgctgataattcggcggcgcgaattgactcacgggaactctggttcgctggttcggtgtaccgggttgctgaaccggtaaaccgttgtttgaatcctcctcggatggagtagtgacacgacccattggttgatatgttaagtgtagcaagctagttttgacgtgaagggttgatttataggagaatttgagaaggagaaggattctatatttccttaagccatgaaattaatcaaataatattcaatagaaaaattgagtttttcttttgatttaacgaataaacttctatgctgaaaagaaagaagaaattttgaatgacgtagttcacatttaagttttgacttttcaacggtcgatatgtttaaagtcaatggatacccataataatactgagtaaaggtctcaatcaaagtcaacgtctcgaacctatccttttgataatttattttctaaaacaagttgcaaggaaaaacaaattaattagattcattagtatactcatcaatacatagtatatatatatatatatatatatatatatataatattttggtacaagtagtgttttggatagataccaattttttttttttatatagaaaaatatctatttttgtcaacactcaaaatttaatcggaaacttatgaattccattttggatgttctggatataaaatatctatttttgccaatagggattgaccattccactttgtcaacttctttccttgtaattgcagcaagtgtttaaacttataatcaaattaagtatgaggagaagatacatgaaaatcgtatatagagaagagaaatgtcaatattttatacatcttcacaaataaatagactataacaacttttatttttatcaaatattacaaagatgccattattatcatctaatgtttttcttttagtaggttaagtttgattaccataattgtatattttaagatataattaagatatatatttacatatattattgtgggggtgatttccaacatgattaattataagatatcatacatcacctacatgaccattataagatatcatacatcacctacatgactaacataaatcaaatttagacagggctatcttggtagatccggcctttaacacaaagttacaaacaaagacattggggtagcaatatttaaaatttgtatcataattggttaaaaaacctaaaagacatgaagaaattatgtcaaaacagatggggtcaatcaattaattaaccgcattagacttgaaaaaattgtgtcaaacagatttattcaaaagcatgtaaatggagattagaccatcaagatttaaagcttagattattgaagctaacatccaaatgagatagaaagcttgagattcttcagagaaattatgggattaaactggtctaaggatcattaactttcgtgtacacgtcgttttggtggcaggtttctcaaggtgggcagaaccagagaaacggtaatatctctaccaactgtaattgagcaacaagattaggtttcaagcagaaacaatggtttgattatgtatgagacagatgttcatgatcaatttttatgattagtttaagagagagcttaccaggtaatatatgagattaaggattggatgatccatcatatcatgggtttcttcctcgtagaaagcagcgaagcatatctaaaccatattaaatgaataaacctttggttagttgtccagtctaaaatttaaaccaagaaggtaaggattaatagatatcaagataaacatgtgtatgtgtgtgtgtctctaccaagatacaacggatgaggaaacatgtaaagcaaattgttgtcacataaccaaccatacataagagagaaagagtgtgaagagtcaagaagcgtcatattgtaaatattgattggttatgattttgtacaatttgatgtttcacctctttcatcttttttgctatgccctttaaattctactagaaaccgatccaacattaggctgccaaaagatagacataatacaaggataagaaatcaagctcttttttgataaaccaatgcatgcc

SEQ ID NO: 10888 - DNA, 3000 bp, Unknown; identical to SEQ ID NO: 10886
  misc_feature (1)..( 3000): cDNA_ID_4254434_gDNA_ID_2214460_Annot_ID_132971 3000 nt of promoter + ATG

SEQ ID NO: 10889 - DNA, 2096 bp, Unknown; identical to SEQ ID NO: 10885
  misc_feature (1)..( 2096): cDNA_ID_2716713_gDNA_ID_2214460_Annot_ID_132972 3000 nt of promoter + ATG

SEQ ID NO: 10890 - DNA, 3000 bp, Unknown; identical to SEQ ID NO: 10884
  misc_feature (1)..( 3000): cDNA_ID_2716736_gDNA_ID_2214460_Annot_ID_182724 3000 nt of promoter + ATG

SEQ ID NO: 10891 - DNA, 3000 bp, Unknown; identical to SEQ ID NO: 7401
  misc_feature (1)..( 3000): cDNA_ID_1817544_gDNA_ID_2214460_Annot_ID_182719 3000 nt of promoter + ATG

SEQ ID NO: 10892 - DNA, 3000 bp, Unknown
  misc_feature (1)..( 3000): cDNA_ID_2716786_gDNA_ID_2214461_Annot_ID_132974 3000 nt of promoter + ATG
agaagagctggctatgtggccatgtgcttggtgcttcaatttccttataaactactcacttctaatggaaaaatggctcagaagaatatcaactaaaagtagataagatatattgtctttaagctacatacaagttacaacgatccatttattagtgatagcgttatcattttatttttatactattgtaaatttactagtaaactataaatgttatatacggaatgaacgtttagatatctaatatatttcctcaaagataaacactttcaaagagatatatccatggaactgggtattatatttgtatatacgaactttactaataagtaataagtatatttttataatcgatatatacgtaggctatagtgggaaatataaaattctgggcataaatatggctactaaaattttaacattaaacaatgtacacgaaattgtttagaattgttatgtatgctgtaagttccaacgaaaaatacaaaactatgagcaagataatatatataaataaaagaaacgatgatatatcatttgtaagcataagtatacatattacttttctcttttagtgttatattagtgtaaataaaatatagtgagaaaagggaaaagagagaggggatgcatgtgactggcacgacatgaaggatagtggttcgatgtttggactttgtttaagtgttagcaaacgatctttcgttgccatttcacgttgccacatatatttttattaccttttcattatttttaatttattttgtcaacggtcgaattacggtattttatgtacacatatatgaatatatgataataccaaaaactcaagttggactttgggaccgactttcgtgagggatcttcctattgagtgaccacttctaaattgaaatcataaattctattaccaaaaaggtcgagactaatgcttagattggtagatgcatacatatttcccttgatatgacatttaaactctcaatccggcttgattagctcgagtgaaagagtatcaatatatagtttagttatatattttaaaaaatgttcttgattatattttatgaaaaatggatgttttcttatgaaagttttagtttcaaattttgtttgccttatctttgttactcggtatatatattcaaagcgtgtaattacatagattgataccttgatcgtttggataggttaaatatgtgtgtgaatgtgcttagccttgatcgtttggatatgttgttgtatttgcgttaataaagtagttaaaaaaaatctatataacaagagaaaaaatgtaggttctttgagtagatttgtgaaattattttccgattgtattgttcaccaaatgatcctccactttatttgttcaagtaaatgatcattctgctaactataaacaaaaaagaaatgttcatgggataatatctcttgtcgaaaaaacaataaaaaattatatgaaaactattttttttaaaatcctattatgtaaaatattgtttattgtttaaatagaaacgctaatgtcaaacgctaaattagcattcttttaactttgtttcacacaaattaaaagaaaatactgatttttgtgagttcagttttttttttttttaaacattaaagaaacggtaacagtgtttggaccaaaccaaaaattggaacgggacagtttttccaataactttttgtgctactgttcaatgtagatgggcttttaaatgtaaggcactattgagtctggcgttttcaaagcccagtaggagagatgtgtgatactttttagtttttaaagaaaggaaaaagggcttttgagctgctagatagagaaaagtaatcgatataaagacgtttgactcagaaaattgcatataaaagttttgaagctttgcttggaggaaaagcaacaattcgtctttttggagatgagaattgacttcacaacgcatttcattgacttttcgttgtaatttgtaaactaacccttacgcaatttacttgcaacattcttataattaacaaatatcctattcatatcccttcaagccttttctctctttataatttttttgattatttccagaaacttgtgcggaaagtacgttttcaagtttgatatcttcacatactttttttttaaaatatgaatgaagaaccgtacgttgtgatctatatattgtaggttaaattattgtgatccgagtaagttatatcgtcacttatcaagaatttttggtccacataatttgttcaaatggatagaaagttcatctaataatatcgagttaaaccatttacgaaaactgatgttgttcaaatttctatgaatttcggaaatcgttgggtgtcggcatattatcgatttcatatttgaaaatataaatatatcgtcaattataaaatttgaaacattataacggatatgaaaaagatgatctgacataaacttttggaattaattactatgctagaaaattctatgagattagtagatagataacttggaagaagaaaaagggaaaattagaaaatgcagcagaccaaagtagtgataggtggtgcacacgtttttggtgttgacctacgacaacgacaacgacagacaaaaatttatcatcatacaaaacctttctttgtctttatctcattttgttttcttaatatcctctgtttcttcttctaattttctctgtttttattccttctacttctgagatccataaagattcatctcttattacttcatcggaaaagaaacctcgatttcagttttcttgatctctctaatggggaattgcttggactcttctgcaagagtaggtaatagagaaagcacttttggaggtaagaatcaaaaccacacttctcttctcgaatttcgccttttgagaattatgatggatatttgatagttgatactaggtttctttaattctctttaattatataaagcttctatcaaaattttcatttaattcccaactaaagtttctacttatg

SEQ ID NO: 10893 - DNA, 3000 bp, Unknown
  misc_feature (1)..( 3000): cDNA_ID_2716778_gDNA_ID_2214461_Annot_ID_132976 3000 nt of promoter + ATG
aaggaaaaaaccaaacaaaactactatttgattaaccccacataagagctgttctatcttgtctctccctcctttcctcttccattcctttccataatcaatctttctttttattttattttattattttcttaatttctcttcccaacatcccttgtgccgtattcatcgatgatgtttactctaacatcatcaaccacataattattaacattttaacgttcattttcactttcgattagactactattcattactttgagactacttatccgtctctaactgacatttcacgcatcacatcgtgccgttctgcaatcaaaacttttgtatcaaagtacttttacttatccatgcatacatatagcttcacaaatacccgaatatttattgaatgagtatgatttaatttttattttgtatggaatgtgaatgacccaaaaagttatttttttttttggtaaggaaagagaaattaaagaagttataaacaatctggtttttagaagacgagtaaaaattgttaatttcaactaattatttttagtactcaagtatatattatatttattggcaaaacataaaagatgtaaacatctagatacattttaatccattcgaagaacttaacaaaaaaaaatttcatacattatattacattcggtgtggtacagatcgcacggtcaatcaatctaaagatcacttgcggtgattgagcgacgttgtatgattttatccatacttcatattgtttactgttatgatccattcttcacaagattgactagacgcgatatatgtgcactcttatcatcaagaagtgaaatatagcgtatgattagatatgtgaatttaaaggctagtcttacaagttgctagcgaatttggaaaacttgtatagtcgtttttttttttcggtatgatcacccaactttgacgtatctatttcagacactataaaagcatatgtttcgattactgtttatccaaatggaaatgtctcgcccaaaacctcaacatgaaagtcaggaaagtccaacaacgtagttttcaagaagtcacaatatgtccctcctctcgtgtcacaccactcctagtcctagcgaactagctgcatagtgtaaaatactttatatatgaaaaacttagacataaatatatatatacgtgtgcgtgtgtgatgcatgtttattgttttttattcaggcctatatgcattctacatgttttagatcaagatggtgatacagagacactactaatacaaacacttgcataaatcctctatgattatgtcattcgtattcattattttaaaaagaaaatttacgtcaatacttgaaatacattaattgatatatgttttcctagttttggagaaaagggtggtgttcatatgttgcaaaacacaaacatgtaaatacagcaaagaagacatagtggacccatgacaagaaataaggcccaaaagttgggctaatttcagccatcacgacaaaggctacttctcatttcgacatccatattattctattcttgtacacttctctttcattcactcgtcattaatatgccttcaatctaatatatttaaggacacaattatacacacgtccatatataaacttatattgttgccttgttggatatatataaaagttattgtaattagtagttactagttagagtaattttcaggtctaatagtgatgagattaacgtattttcttctttaaatttcagttatttgcaaataatgtcactgctcgatttcctggaataaaggagctaataagagtatcatgttctccttcatgttaccatttcacgtttgcacgttttttttttttttattatgaacaagattacgatcacacgttcggtttgttgtttagtcgttccaagtgtataggagttttatccacacaaaaaaaattttgataggaatgtgtaattccataaagatttccatcgttacacactaaagttttatcttacgcgccacgccgtttgtggagtaaccgagtaactaatttactactagtcttgatgttggtaggattaaataaaagaatcatggagataggatacgattgtgtttgaataattcaatatgtttatatctggaaagatctacaaatttgatatgatcactaagattgtgggaatttattcaaatccaaaacacatagttacaaatcatatacaaatatggaaaataaataatgtctaataacatttgtgtaacatcatctttaatgcgagtcatttagaaatgtaactttttttctttctgatatgtttatttctggaaatatatacaaaattgacctgatcactaagattgtgggaataattccaaaccaatatagaaagtgataatttattaaaaactgaacatttgtgtaatctttttttttttttttttaatgtaatgtcaaattatattcaaaaaaaacatatacttttttacaacttgtgcttcatgtgtaagaaagggagagtgctaaaaaaaattctgaaattgtccaaaaatgattagatctttcgtagagtcgatgttgactaccccgggaatgaacccatttgtgtaatcttttaacatttattaaaaacaaatcatagatagctaagattgtgggaagaattccaaacgaaattaaattcacactaacacatttactaaaatcatagatagatatagaaagaaaaaacttttctactaatttttttgacatttgtgtactcattatagcgagagaaagagatgggcctcaaaacttttattaggcccaaacgttttaaattcattataaaaataaaacaattccacgaaaatttcgaaacccatcactttggcgcttatgtgacgcgcttatttcgccctcaatctcagattatttagtcctcacactcgtcacacccccgcttcctagggtttcatttcgtctctttatcttccttcgtctctttagcttccttcgattctctgactcaatc

SEQ ID NO: 10894 - DNA, 3000 bp, Unknown
  misc_feature (1)..( 3000): cDNA_ID_4254736_gDNA_ID_2214461_Annot_ID_132978 3000 nt of promoter + ATG
gtacatatgttcttgagttgtatatttaacgctttgttttggttttcattttgtagaattcaacaggggatgaggcatacaatgacaatggtttggtgcctcgaacaattcgtcttcttaaagacaaatatcctgatcttgtaagatccgtaatcccagttttgttaattataccaggagatgaaaaattggttaatttgcaattgtgactaatgttctcctctgttgctagattatctacactgatgtggctttggatccttactcatctgatggtcacgatgggatagttagagaggatggtaagtatttatacccaacttccatctataacgttttaactggagctttgatacaattttatctctgtaggtgtaattatgaatgacgaaacagtacaccagctctgtaaacaagctgtttcccaggtaatttttttcgatatcaaagagttaaaatgtctgaaactttttcttaccaatgaggttgatttcttcttctctctctctttccaggctcgagctggtgctgacgtagttagtccgagtgacatgatggatgggcgagtaggtgcaatccgctcagctcttgatgctgaaggatttcaaaacgtctccatcatgtcatacacagccaagtaagtaatcatacatttattttctggaagcatgttcttgtttgttctgtctaattgaatgaatcttcggccaacaggtatgcaagttcgttttacggtcctttccgtgaagccctggactcaaacccgcgtttcggagacaagaaaacgtaaatcccatcaaccctcatcgatactgaatttgcatttcttctgctaacactaacagttacaaactgacgttttgaactacaggtatcagatgaacccagcaaactacagagaggcattgattgaggcacgtgaagacgaggctgaaggagcagacattctcctggtaagtcttttatcatcctttagcaaaacatattatagagtttggtaatataactggagtgttttgttacaggtgaagccaggtcttccatatttggacatcatacggcttttgagggacaagtctccattaccgattgctgcataccaagtactttccttatactctacttctaaaacttattgaataacattcccaggatgtttttgttgatttcaaactctttatgaattttcaggtttctggagagtactcgatgatcaaagcagggggagtcctgaaaatgatcgatgaagagaaagtgatgatggagtcactgatgtgtttacgcagagctggagcggacatcatcctcacgtacttcgctcttcaagctgctacttgtttgtgcggcgagaagcggtagaatagacaacaagactgtgttttaaactgtttgagtatatctgttttaaatcatttgagactattgtgattttgccttgttctgatcccattcttttagtgtcgtgcatatgtgatcttgtgttttgtaatatggattatgatgagtccctagacttcaaaatttggaggccatgatctgagtttctgaatgtggttcttgtagattccattgatattttgcagaccaattatttggttctctgtttttttaacacacacatgacacataacaacattctttatgaaacaaagattactcattactgtctataagagaacaaactgataacatatttctttttgatgtggatggaattgttaactctctagaagaacacgggaagaacacccaaaatttggctacaaagtttgttaacatattgatcttttgttcttctttgactttgactataaatattaaggcctggaccgagcatctaataataatatctaaatgggccttttttgggtaagcaattacgtatgctaaatttagggtttgtttttgccgcacctgtaaaataacttcacagcttctcatttgtaaattctagggttttgcaaaaccaacaccgaacggatccaacacgatgggacgaagtaagtcaatcttcttttcttaccaacaatctcaattcgaattcttagaaatcgattcatttttggtagaaccgtgtttttgcttaaatctgtgttcataagatttcaaattatgtcgatcaaggtttttgtgtgtgaacgccattgatttcaacatagccagttttcaatttatcatttctaaatgtgaaatggtgaatcgattgggttttggtagaatcgtgttttgtcattatgtgattcatatgaatttgctaggttttggatcagtgtatgaatcgccatttattcaactttgcgatcttcaatttatcatgtcaaatgtgtagaatgttgtttttccgattttctgttgagaacattttaggtttcttttgtgtgtggacgcctttgattaaacaattccgatgtcaaatgtgtaggacctgcgagatgttaccgtcagtaatgtctgattgactattttatgacgaaactcgtctacagcctccattaacgtaggtatggctatattgtcttccactagactaatgcatggtcaaaatgatagagacgtttgaccaactccgaaacatacacaatccaaacaaaatcaaaaaagaaaaatctccggacctgatcctattcctaattcagtccgtctttatcattttgcaaagatcatcggatcactctttgttataaccgtggatcaattgtcaaccacaaaactgtttttccttcacgtttccaaattagttagcaactctctaagtttaattaagagagatttggcctcattaaccatagatattagaatggatccagtaagtacatgaaactcgaaggtatgggccattatgggcctgaaccaaaaatgaaagagctgggataactgacctttctttttgacatttgagcatcgagcctcacagtgcaagagttctattatagaactcctatactaaaaccgatcaagaggcaaatctcccaactcttccaacttccaaggctcgatatg

SEQ ID NO: 10895 - DNA, 3000 bp, Unknown; identical to SEQ ID NO: 10893
  misc_feature (1)..( 3000): cDNA_ID_2716778_gDNA_ID_2214461_Annot_ID_182774 3000 nt of promoter + ATG

SEQ ID NO: 10896 - DNA, 3000 bp, Unknown
  misc_feature (1)..( 3000): cDNA_ID_2716770_gDNA_ID_2214461_Annot_ID_132979 3000 nt of promoter + ATG
ctgtgaattggctagactgaaagtactctggatccatatatcccaccgtacctgaaactaccgttgtcaagtgggtatgatccactgtcaccgttcttgacgttccaaaatcagacaccttggctcgatatttctcatccaacattatgtttgtagacttgacgtctctgtgatagattggagacgatgcagacgagtgcaagtatgagagagctcctgcaatatctatagcaatgcggagacgtatattccaagtagccataatgttttcatcaaactcatcatgaagatgttcgaaaaggttaccattaggaataaactcgtagacgagaacagggacttttgtctcaaggcaacatcccaagagtttcacgatgttcctgtggttgatctgtgaaagaatgacaacctcattgatgaactcttctagcttgtcttcgtccacgactttggacttttttactgcaacgattcttccatcgacaagcattcccttgtacactgtaccttgaccaccctggccaagtattctgtttgaactgaagttttcagtagctttctccaactctcgcgaactgaacactattgtcttttcgaccatgcctactgttgaaatcaattgttgttgcaacaatagaccaccattacgcttgaagaacttcttcttttggtttaacttcctttgctttttaataaatttgtataacaagtatattccaacaacaaagatcaatgagccaaaactagcaccaagccctgcaaacacagacttgatcatcattgttgaatattaaaaaaataactaatgttgggcatcaccattgtaaaagagctttaaatggacatgcgcgtgtatttggatttttggcataaaaattcccacgacttacctatagcaagtggccgatgattgttgtacacacatttaaagtgtccttgcaaattgacacatttgttggtcccacagtaagtcatgccctcttcttctttacattcattgatatctgaatttccaaatataaagagattgtaatcaaacaaatgaacgattttttcatatgcttactttgatcatggccatataaaagttgaataaaaactttaactataaacacaataattactaacctttgcatccgcctaaacggtatgggttgccttggaaacccctagtgcatgagcatcttgcatagcttagataagcattgtcatcgcatatacaacttgttatgttaattcttctctgggtactagtgtatctttcattgttgtactcttttacactatagcatcccagagactttataaacgaatgattcgtcgtatggataaaccatcctagctcgaccgtactgtatcctctagcatgaagcttttgcggatcagatttattagacaaatattctgccttgtttgtcaagaaggcaactttgcaccctctcgttatggtgttttctattgtgacaccaacaatctgttgaatactaccgccgcgcatgtatgcattgcagcatccaataccattgcagcttgtttcatccataatgctttcatccatactgctgtcctcattacaattcttctcgtagccattgtaattctgacaatttagtactgcaagataatctttgatatgcgtatggggttttgtgctgcagcttgatgtgcattgcactatgcttggcttcacatttgtcagcgatgccgtgttgttgcaaccaaccgctaccagttcattgtgctggctaacataaaaaggggtacccgtcaaattcaaaagtgatccaagctcttctccattgcttgagcactcctttgaggctattgggtttttaatgttaacggactggtatggattgttatatctagaacccctgccttcagtcggaagagagatacccacaacttccttgttgatcacggaaagataagggacgagctttccagaagtagaggtattacaagtaatttcgtaccacttctccagataacaaccctttcccattccaaaggggtacgggatcttgattcctccacagtcgggttgacataaggaaactgtgcgatccgcagaatctagaataaaacagagttgcaaagagaagagaatccaaagagaaaaactattataagaactcatgtttatgatttgctcaagagaacttgttctttcctgaatatttttgttttgtaaagcagacaattttttgtacgaagaggtagattagaaagattccgtttccttggacagaaattaagtctcaagtcttcgtcttttgtcttttatcttttgtctttctcaatcaagactagtaagaaatgcctttatggctatatgtgttcgtaggcctactgaaacaatctcgcttcttccatcttttgaattttcttcctccattatttgcaagataaatttaaaaaaaaaaaaaaaaagagtaccgatataaagttgtagaccgttttagagaatttaaaattttgtaactggacaatactttagaatgcccagtttcatctaattaatacaggcccattaaaactctatcaagcccagttccaaaaccatcaacacttaaaatttcccagttctcaaactcgtagataaagcgcgtgaacatcagtctctatcttctttgtcaatgtcaaaatcggcgatcatccaaagttatcatctttctcataaacccaatttttttcccagtcttccttaatcccaacaacttcttaacaattcaaggtttgaataacacaactttactctgtttctctttgctttctgtgttttcattttgaacaaaacagctttaatcttcttcttcttcatttttcacctaaatcttgctttgtttagtcaatatacgatctaaagtctgtaactttcaattcaaacctgcattcttagtcacgggtacatctaagaaacctcaatttcgaaattcaatatcacaatttgcttataaaatcctcaatgtgttcctgtgtgtgtgttgcagattcatg

SEQ ID NO: 10897 - DNA, 3000 bp, Unknown
  misc_feature (1)..( 3000): cDNA_ID_2716766_gDNA_ID_2214461_Annot_ID_132980 3000 nt of promoter + ATG
tatgttttgctaaaggatgataaaagacttaccaggagaatgtctgctccttcagcctcgtcttcacgtgcctcaatcaatgcctctctgtagtttgctgggttcatctgatacctgtagttcaaaacgtcagtttgtaactgttagtgttagcagaagaaatgcaaattcagtatcgatgagggttgatgggatttacgttttcttgtctccgaaacgcgggtttgagtccagggcttcacggaaaggaccgtaaaacgaacttgcatacctgttggccgaagattcattcaattagacagaacaaacaagaacatgcttccagaaaataaatgtatgattacttacttggctgtgtatgacatgatggagacgttttgaaatccttcagcatcaagagctgagcggattgcacctactcgcccatccatcatgtcactcggactaactacgtcagcaccagctcgagcctggaaagagagagagaagaagaaatcaacctcattggtaagaaaaagtttcagacattttaactctttgatatcgaaaaaaattacctgggaaacagcttgtttacagagctggtgtactgtttcgtcattcataattacacctacagagataaaattgtatcaaagctccagttaaaacgttatagatggaagttgggtataaatacttaccatcctctctaactatcccatcgtgaccatcagatgagtaaggatccaaagccacatcagtgtagataatctagcaacagaggagaacattagtcacaattgcaaattaaccaatttttcatctcctggtataattaacaaaactgggattacggatcttacaagatcaggatatttgtctttaagaagacgaattgttcgaggcaccaaaccattgtcattgtatgcctcatcccctgttgaattctacaaaatgaaaaccaaaacaaagcgttaaatatacaactcaagaacatatgtacacaaatagaagagaagtgtgaaacaccttcaaagcctcaggaactttagggaacaaaacgatactgtttaccccaacagctcgagcctttgcaacctgtttgcatataaaatcatgttattgtaacacagcggcaacagatacaggaatcatcatatcaaaacataaagccaaacctcttgtacaagaccatgcctccagccaagtctgtagcaaccgggcatagctccaataggcgtgtcttcctcacctgccacactccaaaaccttataatgtttcttaaagacaagagagagagccattgaatgtcagaatacaaaagaaaataacaaccttcatgaatgaaaagtggatatacaaaatttgcaggggagatatcagtttcctgaaaggcagctctagtaacaggggaagcgcggttacgacgtgggcgtcggcttagattctgaaagcattcagtaacaataagccacttataagcttcaaccttacagctaaacattagattctgaaagcatgaagtaacagtaagccatttaaaagtttcaaccttgcagctaaacatcagattatgaaagcataagtaacagtaagccatttaaaagttttaaccttgcagctaaacattagattatgaaagcataagtaacagtatgccacttaaaagtttcaaccttgcagctacttattgttcactatacggagatacagagatagctaatacacaagagtgatgaaatcaattaaagaagtatagattgattcaaattatgttcttagataatagcaaaatcatctatacaatgcaactagagcaaattcacaatgaaagtaagagacttggatactcacaagaggcttaattatcggtgtcccaaccggagcagccggtttaggtggaaccggaggagcttcaggaacatttccagcagcaacggcagcttcacactcagcatcactcattccaagcttcttagcatgtccattgccggattcactagctcttacgacaagattacgacgttgactagttgcaatgcgagaagaagcaacactcactttactcacattcgatctcagaccaatatagcttttgcaatcgattcctctagtcgaaggaaagctgcaagaagcattaaagatgggtgtagtagccatgaatctgcaacacacacacaggaacacattgaggattttataagcaaattgtgatattgaatttcgaaattgaggtttcttagatgtacccgtgactaagaatgcaggtttgaattgaaagttacagactttagatcgtatattgactaaacaaagcaagatttaggtgaaaaatgaagaagaagaagattaaagctgttttgttcaaaatgaaaacacagaaagcaaagagaaacagagtaaagttgtgttattcaaaccttgaattgttaagaagttgttgggattaaggaagactgggaaaaaaattgggtttatgagaaagatgataactttggatgatcgccgattttgacattgacaaagaagatagagactgatgttcacgcgctttatctacgagtttgagaactgggaaattttaagtgttgatggttttggaactgggcttgatagagttttaatgggcctgtattaattagatgaaactgggcattctaaagtattgtccagttacaaaattttaaattctctaaaacggtctacaactttatatcggtactctttttttttttttttttaaatttatcttgcaaataatggaggaagaaaattcaaaagatggaagaagcgagattgtttcagtaggcctacgaacacatatagccataaaggcatttcttactagtcttgattgagaaagacaaaagataaaagacaaaagacgaagacttgagacttaatttctgtccaaggaaacggaatctttctaatctacctcttcgtacaaaaaattgtctgctttacaaaacaaaaatattcaggaaagaacaagttctcttgagcaaatcataaac

SEQ ID NO: 10898 - DNA, 3000 bp, Unknown
  misc_feature (1)..( 3000): cDNA_ID_2716764_gDNA_ID_2214461_Annot_ID_132982 3000 nt of promoter + ATG
ggttctttgtttttgatctggaaaagattagatgatcatcattccatcacttgcttatctattttgtttaatcattcttcttcttcactataatcattctatatatttctggaagatatcatgataaagaagatatatttatctataatcacaaaatgttttgaaccttttcatttatgaaagaaaaagaactaattagatgatacttttctaagttccagcccagtttggatagtgaatatattttctccatccccattgattggtattgatgggctagatatatgacatgggatctcataaggcctatttattaaatgttttgtaaggcccacgtattgggctaagagaaaaaaaaaagagagtactcaagtataggtttgtgtttttcaaggcaaaagtcaaagtattgtctagagacactggcacttgatagattagacgcataatgtattcaacataatcaatttagaataaaaattacaaaatgtagtatagtaaagagttatactaatagtttttttttagaagtatataagaccaattaaaggaaataaatcgcaattaatattctacttttgtttagtaaggaaataaaattatcgacagtaatgagtaaaattttcggtacctcttcatccatttttctttttacctaaaatttgaaagtaaaaaaaaagaaaagaagcgagtggtcataaaagtccaagaagtctctgtaagtgaaacctggcctccacttttgtttttccacttctacggtaagtgaaagagagagagagagaggaaaaaaaaggggaaagcttaagatattggagagtaacaatgccttcaaattcaggagatgataatgttcttcaagttctcataaagaactttgatgtccttgctctgtaaatctctctccctctctgcctcttctttaatttctctttacagatcctatcttgatattttgtgtgtgtgttaattagatcctatctagtttctttagttttattgctaactgggtttagctacattgtctacttagattcttgaaaatgaaaccctctttagattagtactaattttttggagtttttgtttttgaacggaatcttgaaagttgaaacttacaacatttttgcttttgcagcccattggttacactcgtctatcctctgtaagtaaaaccaatctctctcatatatacatttgtgtgttaaatctgttgcatcagttgatagagattttattgtaagcaaaactcacatttttaggccaatctttagttcagattcatatgaacattagaaatttttgtggaaaaagaatcaaaaacttaaccttttgaaacatttgatcctctgtcattaaggaataattaaaaaagagtacgaatcttgacttagatagatgcacgtatatccacacacacccacttagaatccaagacacgaggcattacacttttgtatgtattcaattatttattacaaaaaaatatgagaaaactaattatgtttgtgaaaaaaatgaacagatatgcatcagtgaaagcaatagagacaagatcattaccagaagatgaacaatggcttacttactgggttctttacgcacttatctctctctttgaactcactttctccaaacctctcgagtggttagtgaattcattaacacttttaatatcttcttaacatgtattcatcataatattagtttttgtttttgttatcataaggtttcctatatggccatacatgaagttgtttgggatctgttggttagtgttaccacaattcaatggagcagaacatatctacaaacatttcattagaccattctacagagatcctcaaagagctaccaccaaaatttggtatgttcctcacaagaaattcaatttcttccctaaacgcgacgacgacgacattctcactgctgctgaaaaatacatggaacaacacggtaccgaagcgtttgagcgaatgatcgttaaggtaagtaaaattcacattgacatttacataatcattttcatatgtaatgtacatttggtaatgaatgttgtgttttgtgaatgcagaaggatagttatgaaagaggtaggagtagtagaggaatcaataatcacatgatctttgatgatgactataggtactaataagttcttaaaccggtttaattagctactttcagtttataagtttgctatgtgacaatatattgtctgtttctatggttgttataatttgcgtggattatgtataagcccttatttaggactgcttatttttgtgaaaaatcaaataaacattttctctcctttgcgtgtgtaagcaaacttaaagtcaaaattagtgggccaagctctgtccagttttacacttagatgattagactattcaattatttaacgagttgggcttgtaacaaaatgggccgggcttagataattattaatgatatgcgaattttgaaaggagctaatgatgaaataaaaatttgaataaacgggagcgaagcagaagcgtaggttctcaaatcacgaatagcctctcgaatcatcgccggcgatcgacgttggtactgcttctacgtccggcgaggatattttctggattctgttctttcgctattgatcaatcatagagattcttcattgaggtttttcagattgattaggatttgcttcgtcttcgatttaatcataatcacgaggatttgaaaaatattggtgaacaacgatttggtgaagaagaattggagtataaattgtttgtttctgaggattcttcagagtgtattttcttgttgtttggttaatgtgcattttggagttgagagtttgggggattttgaaatcttagattttgaaggaggaagctaaagtagtagaatgggttagataagaattaggaatatgattggaaagacattcgagtgatgttaaacgatttggttgagaaatatgattcgaaagggaattagctctttgcagcagcttcaatg

SEQ ID NO: 10899 - DNA, 3000 bp, Unknown
  misc_feature (1)..( 3000): cDNA_ID_1034424_gDNA_ID_2214461_Annot_ID_132983 3000 nt of promoter + ATG
gggaaccataacaacaaccagcaaaaccgtgacggagatcatcatcacaaccatcaagaagatggaagcaccagtcatcattcctaggcaaacatacacaaacaaatatattctgtgagatttatttttctttttttgtcctttcgtttgtttgtttgttcttaacaagcgtgttttttttgcattgcttctttttcatatatttttatttatttctaaattctaatattctacggatttcatcttgtttatttttctgattaatgtattgagtaagtaattaagaacctgataatcgatatgttttagtttgtggtttttgcatgcaaggctttggttttattattctagagatttttgcttgaagtagttgtcttgtgaaatgttttcctcattactattgagtgtgagagttttctaatacttgattagggtttttgaacaatttttatatatgtatattaattcagtacggattatcaataaattatttcgcatgccaaattattatcttccacttcgttcatggttacattgtctcgaagaagctacatcttatgcattgtgagcaattattcaggttctagctatctcttttaatatgttaatttctttgcatgattaacatcttactcctgactggtctattggtgactatgctaagataatgtagatatatatagtaacaaaatcatataggtcaaagcattaagtgtgattgttttggttaattataagtgtgttgacgaggggatgcattgtagatatgatgccatattaatgccagtaggtttatgcgcatggtggtttggatacgttcaatttatagccgttgcaaaaattgaaggcatttaattttgctaatgatattaccaaaattatttgattatgaatcaaaagatacaaggagaattatcaaaaaaaaaatatataggtccattatccgtataaggtagctaagaacttaattagtctggtgctatgtttgaagactcacgtacgatttacaatctctggatctatgaaactcatcaccaagcaggaacctgtatttatacgtcaatatttgtgaattttcggatacccaaaaaataccaagaatatatatttcattttctgctgaaaatcagagaaaaatgtgttttaaaaacaatgtctataaacaaatttatagattgaagttagaactaaaaacttttgatggttatagatttcagcttgatcatttatttctgaagtgttttcgttggatgaaacatagattatatatgtctataattaattgagacatatacattgatgatatacaaaataaccaggaatttttcgttatacagaaaaatacacaagtctatgtaacatgcgtaataaccatatggtccatatcgctgcattttgtgtcggtctacattattggatttattttagtataatgtatgtgatacgttcttaccatgcatgggtatacatagagaaaggtgtataaatcaacgagcatgggaattatgacgttaataattctaaaataatgcacacacatcctgttaatataaacaatataaattatatatcagtttattatggaaataatacttgaaacttctatagatcggtgtgaaccattccttgacatcataggcatgtcggttatataacctcatccatatgttctatcaattaatcaaatatggtaattaaagaaagtcaaatattgtgacatacatgcatttttttttactaacggttgatatcaagcatttatagacgaacgtctatttgatgatctcaataatcatatcaattggcggctaaactaaactagatttcacgatgacaaaagtaaaatgtatatatagacactaaaacacagatgatgtcatgaatcttttttgatatttgtatattattgtttacgtattactttctagataaacaataagatacgagtcatgaccgatcattgtttctatgtcggcgttttattttatagtaaaaagaaatctgcaacaaaaggaaagggcacaacaagtagatcaagtagtagtaatctggcattactcaataggtccaaaaggaattaaaatgttcactaaagtatgcttaaaatatagatgtatggatctacgtagttataagtagttaagtaccattatagaagagtgtattcatgtgggttctttgtttttgatctggaaaagattagatgatcatcattccatcacttgcttatctattttgtttaatcattcttcttcttcactataatcattctatatatttctggaagatatcatgataaagaagatatatttatctataatcacaaaatgttttgaaccttttcatttatgaaagaaaaagaactaattagatgatacttttctaagttccagcccagtttggatagtgaatatattttctccatccccattgattggtattgatgggctagatatatgacatgggatctcataaggcctatttattaaatgttttgtaaggcccacgtattgggctaagagaaaaaaaaaagagagtactcaagtataggtttgtgtttttcaaggcaaaagtcaaagtattgtctagagacactggcacttgatagattagacgcataatgtattcaacataatcaatttagaataaaaattacaaaatgtagtatagtaaagagttatactaatagtttttttttagaagtatataagaccaattaaaggaaataaatcgcaattaatattctacttttgtttagtaaggaaataaaattatcgacagtaatgagtaaaattttcggtacctcttcatccatttttctttttacctaaaatttgaaagtaaaaaaaaagaaaagaagcgagtggtcataaaagtccaagaagtctctgtaagtgaaacctggcctccacttttgtttttccacttctacggtaagtgaaagagagagagagagaggaaaaaaaaggggaaagcttaagatattggagagtaacaatg

SEQ ID NO: 10900 - DNA, 3000 bp, Unknown
  misc_feature (1)..( 3000): cDNA_ID_2716758_gDNA_ID_2214461_Annot_ID_132986 3000 nt of promoter + ATG
aatattacatatgtgtatagtttttggtcatcgcaaaatctttaacaatattaaaatacatgacttcaaaacttttatctaaatagaaagacaaaaaaatcaatttatcaagtttattaatttatcgagtattaattttatagacgtttcattcggatgtttatagtcgatattgttggtctcaatagagtcagaggattgagattctcaaactgctcatgcattcttctgctagagagaagtctcaggacattgctatggcgcatgagtctttatgttttgttgtgtgtacatcagttaatgccataaatcatatgtttaaaagacttgtcaacagcaacggaagcatttgcctcgacattttgaaagagcaatggagtcctgcacttaccatatctaaggggaaatatataagcgagaagtttgaagaatttgtagctacgtattgtggaaaaacttcatgatccagccacacttgttctatattatctcctaaactgcattcactaaaatgtaacagaagatgatgccattgactcctacaacgcaaaatacaggaagcaaatgaaacaggagatggagtcattgattcctacaatggcaggaaatgggaaagtggagaacgttgcctaccaactagcaagactcattcacttattgaacaaatgaaacagtggattgcagtcttgcaattaagataaaggccaaatggcattttacataatggaaataagatcatgttgagaaagttccaactactaaacctaacaggaccaaaagaataactacaaatctttaacaaagcaaacttcttgcagccttaggttacaccaaattggcaggggcttgaatcgtcttctcatttcgcatagactcaagctgaggaaccgaaaagattccagtcattgactttgaatgtagagagtgattgtttaatgatatcacacattggcatttttccagattgtgaagctgggacagctaaaccagatcccacagcatccgcgctttcgctcagaggactgcacaataatacgcaaacaccttagatgaaaagacatgtggtacaacaacaacaacaataaccatattttgatattcaagttctgtatcaaaacgatgcatatctatattcaactgcttgcaatataactgagtgactcaactttgtgggacttactttatcaggataggttcataggcagtcactaagacatctgtatcaactcccttaagacgaatatttgccacatatacctgcagaatcatataaaccagttggtgtctcaagtaacaaacccctttagaataaatagagagacagaacaaggagaagcttcatactctcactaggttttgtgcttctcttccctgtcttcctttggatatagcctgtaatgatccttgttaaggagaaaacaaatagaaaggaaaattatgagcaaagacatcatatgtttatggacattaccatctctccaatagcagttgtcgcaacagcagagatgtttctgaaagacagtccaggcgcctcaatgacctctgattgctcaatcaactgaaaattacacagcaacattactagattgtcttcttcatatatatcatcaatcttggtaaagattaaccaaaaacacaccagtattagttctatttcgactagtttcagagactgaatccacaataaccaaaaaacagcctcactagtatcatcacaggcaaaaaggttccaactttgggaaatctatacacgttaaactctatgtttgtactcaagatactagatgtattctagagaaataacaacactagttcttaaagttggtttgtctaccataagaagagttctagtgtagtagtggtattacctgaaatccttcagcatcttgctcactcgcaagatcattaaggaaccaagaggcactgccaatgtcaccaacctcagccttgaaatccaacaactcaaaaatcaaactctcatctcttgaaggatccacaaacacttcctgtgaaaaccaaacaatcaaacacaaatacagagtaaactagagattcttctacacatgtacttacaaacaatgccactgagaatagaaccaccaaacctgatgatctggaacttgtcggatattactcacatcctgaagattcacaataaggaagaaatgaggaaaccagtgaatttcaattaagcagcgaaaagggttttattgaaagaacctgaaatctttgagggaagacggtggaaatagcgccaccaaacaaaggcctcaccgaacataactcaacagacatgttttgctacattcaaaaaacaaaatcctcaaaaaactaaactttgccagaaaaaaaaaatgcactcacaaacataacagaatcgattagggattaaagagaagagagaagagtaccaaattgatcgattgatgtatctggggaagtaaaagagaagaacaaaagtagcagagaaatcaaaaagttggagtttagtatttatatgaaagtcagaatcgaaagaagcgttgctttgacgtcccaacaagtagctttaacttaacgcaaacaattaaaaaaacaaacgattagcgttcttcaatcaacaatgtctgcactctgcaaattcacgattgagaagaatgagaattaccaagcgacatcgtttaaattaataccgtagttttttttaacaaaagcccaggcccatctgttttatctagcccattttaaacaaatagagataatcaaaaccactgggataataataagatttaattttttttcttccgctatcatcatcaatcatcatcatcatcgtcttcaagacttcaaccttcaaattcttcatcacaaaccctaacctccaatttctgattctacgattgatctaaggttttaatcaattcttctatcatcatgatttattcctcgaattttttccgattttcctttgaactgattttgtggtctctcttactttttggttcagtttcattttcaaca

SEQ ID NO: 10901 - DNA, 3000 bp, Unknown
  misc_feature (1)..( 3000): cDNA_ID_2716747_gDNA_ID_2214461_Annot_ID_132990 3000 nt of promoter + ATG
aatatctagttatctatcattcttaaccatttatctctcatggttaagaatctcttctattttatagaaacataaaatataagagattgccttcattcaattagtattatcggtagtaaaacttcggatactgattttttttttgattaattcattaattatgagagctagtaaagatgaattttatacattcgtcacatatgtttaaacttatacggcgtcgtttcaaagacgacatgaaactaaaacgaggaacaaaacaaccaatcacgccatcgctaacagtaataataatcaaacacggtaagtacgagattcttcttagcgaatcaaccgttaaaaatcacatcaaaagtatatacgatcgagattccgccacgtagataactcactgtagatctaaccacactggataattagatatttttttcttttttcttttcaatgagtacagttcagccacgtctgtctctcagaccaaaacgcaagtatcgtcctttgttttgtttctttcttcatcgttgatttgtcaactcaacaacgcccaaaccctaaaacaatccccaatcatcgtttcaataatcaaatttccccaattgaagaataaagatcaaaactttggaagttttcctgtgaaaataatctatcctttttgcatcatttgcgttttggttgatgaagaggatctgaagaagctgagatttaggaatgatgatgggttttgctgtatcggatgaattgttgggtactgttgctccgattgtggtgtactggttgtattctgggatttatgtagcgctctcctctttagagagttatagattgcattcaaaggttgaagaagaagagaagaatcttgtatcgaaatcttctgttgtgaaaggtgttcttgttcaacaggttgttcaagctgttgtcgctatccttttgttcacggtaccgtttttctcttttcccatttttgagttgttttgcttttgtgaaattgaagtgaaaagttaggtaaaacatattggggaattttgatatctgacgctgactttttatgtgtggaattggatggttaagatttttgtttttaaaaaggttaactttttgggttgatgttgtctttcgacccataaagagaaatgggttatgtattaatgatcttaaagttggatcatatattgactgttctaacaatagttaagagctttagaggaaagtatcaatagggattgttctgtgatttggcaatagggtttagacttggcagaccttattaggctgctctagaattcaaccaaggactctatcttaggctccgttggtcctctgttccttacttgtgttagattcagagaggactggttcttatcagcttatctgatgagaaaaccaacaaacatagtaaaccttgctaattgtgatctttaagcttaagcaagttcttttgttgaactggaatgttgttttgttgaactggaatgactacatcatcggttcttttgttgaactggaatgaagcggcatcatcggttcttggtttgaattcgtctgatcctgagtacttgtaatgtatggatttgcttagacatgccgctgatagaattgactcatcaatatcatggaatatcttcttttctgtttgtactagtttttgcttttaaccttcttctaatatgcttcttcattgtctatacaggtgacgggaagtgatgccgaagcagacaaagcgcaacagttttccttcttggtcctagcaagacagtttgtgactgccatgatagtcctcgacacatggcaatacttcatgcatcgatatatgcatcagaacaagttcttatacaaacatatccactctcaacaccaccgtcttatcgtcccttatgcatatggagctttatacaaccatccagtggaaggtcttctcttggatacaattggaggcgccttatctttcctagtctctggtatgtctccaagaacttccatcttcttcttctctttcgccacgatcaaaaccgtggacgaccattgcggtctctggctacctggaaacttattccatatggtcttcaagaacaactcggcttaccacgatatccatcatcagctctatggaaccaaatacaatttctctcagcctttctttgtcatgtgggatcggattcttggaacttacatgccttactcgcttgagaaaagagaagatggaggattcgaagctcgcccgactaaagaattcaaagacgattaagattttggagtttggatatatgttatgtatctgccctgaggttggagaaatggatgatactttgtgttattggaggtgtagttttaaaatcagaaacagaactggtttttttgcgttttgcgtttcttctcaagagcgaatttagcttggagtttgagatttgtatataaacattattgagttgttgttctactttcggtttttgttttgcatgtaatattactacaacaaacatgttttttttataatctatccatctacgaggccattcttgaaagattttgtgttgattttgttttataatttcttcacattcacattttagtattggatattcttagaagtattgtagtgcaagatgaaatattacagatttaataatcctccagatgtttgattaccacatggagcaattctttgctactcgttagtagtgtctagactaaataaaacagtacctgcgaagccttttgcttgtcccacaagaaacacaaccacatcagatctcaaagttgttcaacaactacatgtttacatgatctcttcatcaaactcatcgtttcaaattataatgcgttttcttttatgttcttatttctctaaagcccataaggcccgttatacaaatacaatgcgatttatactataaaacgatgtcgtattaactgtagactcgtttttttcttgtacaactgtcgattcgatactctcttaagtttttgagggtttcttatcgattcgatattttttttcttttc

SEQ ID NO: 10902 - DNA, 3000 bp, Unknown
  misc_feature (1)..( 3000): cDNA_ID_1029485_gDNA_ID_2214461_Annot_ID_132991 3000 nt of promoter + ATG
ccttgaagacgttttgtgtactattatgttaacgcgttgaaattaacgatgatgggtattgttacgacgaagacgaagacttatacaactactaacttcgatttctccaataaaggttttggtgttggtggtttgaaacagtttgtgtacggaaacactttcattgttctcgatgctttctgggtttctttctctaatctcttcaggtaaacgtttttgcttcttctttattattctttgttctctgtttttttgagttcttattggttaatgggtttgtttttatttagagttaatccagacaaagagacaagcttggtcttgttcgagaaacagaacacaaaagattcctctgtttttggagatcatcaagatcaaaaccaaatttgtggaacacaagacgatgatcagatggaaagctctctggtttcgattagcaagagatgcgagttttattccgacaacaaaagtatcgttggttttgtagaagaacctaaagcgtttagctttaagtttcatgagtattctgctattactgttcaggaggaggagaagaagaagatggtgagtttctctgatgaaaaaacgagttccatggttttggagaaatcagaatcagatggttttatgaaggaacacgtgaaagaagagatgttggtttatgagttcatgagttgtggtgttttaaaagagtcattggttcacgagaatcttgttggtggtgaagacaacttgtttgatgatgatgatgggtttatagaactaaacccaagtttacagatttcaaactttgcttatggagaagaagaagaagaagagtttatacacagagaagaagagatgaaaatgggctttgatgaacaagaagaggtatatgatgagtttgatgatggttcagattcagatgatgatgagtttgagcatagtgatgtgattgagaagttgaaaacagaattaaggactgcaaggacaggaggattgtgcactattcttgaggaatcagagactccattacaagagctgaaaccactcaagattgaaccaaaaccagatcaacacaaagacagaattgctgaaattcacaaggtttacaagaactacgcggttaaaatgcgaaaactcgatgtcatcgattctcaaacaatgcattccatcagtaagtcaatctattctcaattcaattttcaatcaatgttcttagcagactattacatcattagcaatgacgtatctacagagtcttaaatttttgtctgattccagcttttactttgattgtgaggacatattgttgaagaatgtctctttccttcttaaatgttttctcaactactcaaaagtgttagttgagtatatagttaacatttttggatttgatttaacaggtttgctaaagctaaaagattcatctaaacctagtagaaacactgataaaccgcctaaatcgtctctgcatcagaatatatggccattcaagaaacatacgcttgaatgtgacccgagtgagagacttgtgaaagaagcaagcagagactttgagactgtctatgtaggccaagtttgtctctcgtgggagatgcttcgatggcaatacgacaaagtcttggaatttgattcacaggttactacttatcaatacaacttagtagctggagagtttcagttattccaagttctgcttcaacggtttgtggagaatgaaccgtttcagaactcctctagagttgagacttacttaaagaaccgtcgccatttccagaatttccttcagattccacttgttagaggtaacaaaacatgttttcattattctttatagtatatactgaacctttcttgctaataccataatctgcaaagttttcagatgaccgttcttcgaagaagaaatgtagatatgaaggagaattcgcggtaaagactgaaatgttgagagagattatccgagagtcgatgagtgttttctgggagtttctttgtgcagacaaagacgagtttacttcaatgatgaaagtttctcaccaaactcaagtctctccacaggattctttagaccttgagctcttgacagatatcagaactcatctccaaaaggtatttaaaaacttcaaattcttgctctcattttgtcagattacatcaatgtttaacaattcactcaagaacctgttcttggcctaatgtagaaagagaagaagctaaaggaaatacaaagaagccaaagctgtatagtgaagaagttaaagaagaatgaatcaaagagtagtattggtgtgaaggatgaattactaatagctaaaattgaactgagactggtttcaagagtgatgtacatgtcgaaacttactactgagaagttacattggtgtcaggagaaacttgaaaagatcagcttcaacggtcggaagattcatatggaaccatatttctcgttgttaccttgttgagccatctctgcgtatagattagatcatagatgttggaacaatatggcttcatcagatccaggaagatgtctttttgttgttgttcatatcttcctgagaacaatagtatatctaatgaatgatatgtggtagcttagcgtttttctttctcctctaatcaccacaacatctggaatcacctcgaagaacattttgagaactagaagtaaagttgattaacatttggtacatgaacacaaatcttcttgaacgttgttgaactagtgattactgattaatgaataattaaagaaaagacaaacgttcgaaagatgggcctttgggccaagtcatatttggattattatgtaagcattaacaagcccataaaatgtcgtccattgatgatcataagtcaatatgtaatctgaaccgtccgatctagggctttaggtgttgaagtgaaaaaagaccctatataaagataatatagcttataaagtctcttctctgctccgtcaagctgaggaggataaaaaccctagggtgagtgagacagagagaagcgaaaatg

SEQ ID NO: 10903 - DNA, 3000 bp, Unknown
  misc_feature (1)..( 3000): cDNA_ID_2711074_gDNA_ID_2214461_Annot_ID_182788 3000 nt of promoter + ATG
ccggagacaaagtattttaccatgtatgtacgaagtaacgaagcccaagccttaacaaaaggccggtacgaatatccatgccagatagatcaatgtatgcaaaagctctatgtagatacgagtaactgcatgcaatgattaatgatcaatatatggtacacaaattgtttaacatgcatttggcggataaaataatttacattatagatcggtatatgtgtttatggttggatgattgaattttttgtatgctactaattaagattccgattggacaatattccaatacctagctaatatcgattttagatgttagtggtccgattaattgatgatgtagatatcaaattcttatatcagtggatcaaaaatatgatacacgaagacatgttacataatgatgaaaaaagtagcaacggataatccccataccaacagtatgtaacatgtcttcgtgtatcacattttttagatgatatttcaaaaaaaaaggtttttattagttagatgttttcttttgttggaatatgcaaagaggaaagcaatgtaaaaaattccattatagctaaagcccattgtagtttttgatttttgagactagacccaataacacactaaaggacactaatcgaaccaagtatcttagggatccgttaagtctttcaccaaccggagacttggtcaagtataagtataaccgttgaagcataccataatccaagtcaaagatcagaatccttcagtggggatcttgcatccaaaatcgatatgtatagtcacggtggcaattttgagccaagccagagacgaagcagctcaggaaaactcatcatgctttactttggattggtaaggacactgataagttgatcaccacatggaacatctttatcatctatctagtgtgtatttatgttagataaatgattatcaagagaggtcttcttgggttgggagatgtataaggtagtgattaagatgtatataaacacatttaaatgagtcaaatggttaaataagtcaattttttgtttgaagtaaaataaaataaataagtttcttttataaagtaaacaaaatcattttaccttctttacaatttataagataaaacatgcaccaatcaccatttattaaatctagtttccattttacctacattaaaagaggatgggatacgtcagcatcaatgtctggtccaaatttattgagacacgtgtagccttgcatctctattgcacgttgaaaatgaaacgaaaatgataattaatttgcttaacacctaaaagaaaaggactaataaacgatcgcactcgaaattaaaaaggaattttcaatttcaacgtaacacgagcatctgccaaatgctctcgtataatagtcaatcaattttgtttttggaccgtgacttggccatgtttggacggtcgaagaccaaaatctctcacgcgactatctacaattctacatgttacccaaactcattaatacacctataaggctacaagtgttcaccagcagctacacataacatgaaactgctgatatttttcgttggtcgcccccccataggcatgtatgtccgggctcgaccgtgacccgatcatacctttacttgatctatatcttccaacttttctaaatagttatgaaacgctaattatctttactattacaactactttttttttgtgatataactataaatatcattaaaaatgaaaagtttagggattacaaaatgtaacacctataactttttaagtcaaaaaacaaggctacaaatatttatgaagacaccaaagtgaaatcacctaatccaaagttgcattaaatttctaaaatgcttcatttgtcttcgaggactgattacagttatgatatctttatccatcagctcaaaagtggtatggtgagacgagactgtgagattgtgaagaacattattccactgcttccaaatgtgataaattgtagtttgagatgttcgaactacccatttaaataataaataataaattctttaaaactactcaaatccgaattttactcgtttaataaattatcctattttaataacaaattaccatcatcatatctcttatttgcatttcacaaacattattttttaattctaaaatctatatacttttaccagcttggtatccgatattatcctatttttggcttgttcacccaaatgtacaatctgcaactttagaaaagaaattaggtttaaagatgatattcatgaaagaaaatctcatatgtgaccaaagaaaacaatttaagaaaatcttagattatgactttagaaagatgatattgtttcttttctgacaaaaaaccaaaagagatgattttattaaataacagttgaaactccaagagaaaaagggcaagtgaaccaatgaatgttttgaagcaaagtgacaaatggagaagaacccgaaaagcaatgtaaagtttgactcttgagttctcccacgtcgaaccatgtccgttctccgataaaaaaaaagagtaagtttcattacagttattcgaataattttaattcaaatcctaatgtatttgatattaatattcatttttttcccaagaaaacaaaaaactttattctcttcttccttttggacatcttaagcacaaggcaaaaaaacattcaaatcagaaagaaaaaaaagaagagaaaaattacaaaattgaatgagaaagcgaaatgtcacatatatataaagaagagttgtgtaagagtgaaataatttcccatccacaaatctcgcacctgattccataaattgatcagtttttctttctttctttcaacgcatatctagtgactctgtaacactttctatgtccgaattcgtcttctccaatagtaagagattttgacaattttcttgggggagaaaaaatcataaaaacactaatcatgtgtacccttgaagacgttttgtgtactattatgttaacgcgttgaaattaacgatgatg

SEQ ID NO: 10904 - DNA, 3000 bp, Unknown; identical to SEQ ID NO: 10902
  misc_feature (1)..( 3000): cDNA_ID_1029485_gDNA_ID_2214461_Annot_ID_182787 3000 nt of promoter + ATG

SEQ ID NO: 10905 - DNA, 3000 bp, Unknown; identical to SEQ ID NO: 10901
  misc_feature (1)..( 3000): cDNA_ID_2716747_gDNA_ID_2214461_Annot_ID_182786 3000 nt of promoter + ATG

SEQ ID NO: 10906 - DNA, 3000 bp, Unknown
  misc_feature (1)..( 3000): cDNA_ID_3038487_gDNA_ID_2214461_Annot_ID_182782 3000 nt of promoter + ATG
gattgaatacatatatccactatggagaataatctaaattaagtttctgtaaaataatgcgaacaaaagctaagaattaggatgatatttgattacgcgcagtaatgtttgaaatagggttcgtgattgatggtggtaaattagattcaatcaaaagatgaaaaaaaaagaagagaaattgagaaaagattaaataatttgacttgactagatgaggggtccataagggagggatgaggctatggtcactgtctttagagagtgaatgatgcagaggacacgcacgtggagtctgtttcatcccactgtccacttttatttatttactctccattttcttctactgagtatatttttttttatatatgataaaatttgtattttacaaccttaaaagtatatttagacagatagatcatagattgatgtatataataacagaaaaccttgatcatccagaaatgacccacaagacgagactagtactaaattgttgtctttctaacatttattatatcaccacatgttaatttgtaatatatttaaattgtctacaactaaacgaaggttatgggttttgttttggttaaaatgttattgaattataggagtgcgatcaatataaaataacataatgtagacctaaatccgtttttaaattgtttagagttgttcatggactaattaccaggatgtttttttttggtcggaactaattaccaggatgttgggatcgaagtatagttgttagtacgtaaaacttgtggtcctaaacctttttagggggcaaagtgtgattgattcttgtttgaagaggaaaaatagggagtcatatgtacataaatagatacgccagtggagaaaatgactgataataattaatgagtgattaattagtcggctgactttcttattcataatatcttctgatcatatttgtgaatcgtaattgttttgctttttagatttgtcaaatatgcacaacaccttttaactatcaattcgttttcttttctgtttagtctttgatatatagttttcttgatattttgattggtttactaattactacaagcaggccgatacttttagttatttatattttacgagggaaaattatggtcaatgaacatattctagttaaaacataaaaagatatcacatatataagtaattaaaatataaaattttgtcatttgtaaatatgtttgggcgaaaatgtttggacatcccataggttttatgtggctatgcgtaaagtttctaatagttagactaatcaacgttcctaagagatcatcagaactagttacaccttacacgtaacgttaatgattcgtctaaactaagagacgataattagccacaatagaaaatactatattttgatttttgagaagttttatcttcataaagcttagacatttgaaaaagaatagtaagattataacaaatatattttacaattttcaatatatactaagaaagatgaatttgcctaaactcaaaattaatatgtgtaagaatttttataattggttttctccatttcttttaacaaaatcatatgtatattcaaatatactacctggcaattattatatgcatgcttatgttggtttatgtaataacttggatttattttgttacactcaatttctataaaacacaaatttgagatttttaaaaaatatttatttaaaatatcttcataataattcgaatttacttttatattatttttttcttttgtattctctaattcaattatatttttaacgttaccatatatatatatatatatatatatatatatatattacgctggtcctaattagtagtataatctatgtaacaccgtatattttgattctttgaacagcttatatgaataatcatcacataagaaggagccttcttcatcactattcactacatataaaaattcgtttcagaaaaaaaagatcaatgttctgtccacatcagagtatcaaaataattttctaaatttagtgctacatcttttaacgacaattgtatgtcaatgagataactccaatggtggaaacaaaagagaagcattacaaatttgcttttatatatctataaagcactgtaactatggttttataaataataatatcaaactggtaactcattcaagagtcacagaggagaaaaaacaatccatctgtttcataaaaaaagcagttggattctattatatcatgtggatctcgtgaactaccatagagccatggattaatcactgtcattctgtcaataataattctatctatttattattctgttgtcacatatgtacaaaatatatgtaaacttctcagttctgtctgaatcgctgaaattttcgctaaatgtgcaattaatttcccgatcgcttgaagttaacagttacgacgagaaactgacgtcactttttaattattgtaaagaatgaaaaagagtgttcgtatagggtaattgtattattgtaaaaaactatgtatccaaacacaataaatacacgaacaacatttattttcactcactttgatcactgtacgtaataaggaaaaacattttatttgaatgaatatttgtacagattggagaaccacgtaagcccatctcttttatttccaaaaataacgaaaaattctcaaagggaatagtttataatgtaaataaaattccaaaaataaaacacaaaagatataaagcagcaagagaaaaaaaaagtccatgctttcatattcattgctttaatctctctctctctctcagacatagacacagctaagcttcccatctgaaaggagtttcatgtcctaaggaccatattataacctctctatctctctctaagtatcagcaaaaaaacagagatttatagagagagaaaaaaactatggctcacataaagatctaacagagacagtagtatagtcccacttccccaccaccaaagcttcgatcatcatcatcatcatcatcatg

SEQ ID NO: 10907 - DNA, 3000 bp, Unknown; identical to SEQ ID NO: 10899
  misc_feature (1)..( 3000): cDNA_ID_1034424_gDNA_ID_2214461_Annot_ID_182780 3000 nt of promoter + ATG

SEQ ID NO: 10908 - DNA, 3000 bp, Unknown; identical to SEQ ID NO: 10896
  misc_feature (1)..( 3000): cDNA_ID_2994682_gDNA_ID_2214461_Annot_ID_182776 3000 nt of promoter + ATG

SEQ ID NO: 10909 - DNA, 3000 bp, Unknown; identical to SEQ ID NO: 10903
  misc_feature (1)..( 3000): cDNA_ID_2711074_gDNA_ID_2214461_Annot_ID_132992 3000 nt of promoter + ATG

SEQ ID NO: 10910 - DNA, 2532 bp, Unknown
  misc_feature (1)..( 2532): cDNA_ID_2716839_gDNA_ID_2214462_Annot_ID_132994 3000 nt of promoter + ATG
aagcttatgtattgtcctattagctccattgttgcgtgtattaatgtgagtttggagattgatgatcatggagttcgacgtttggttcttagcactgatcagtctttcgttgttaagtttcagaaggcttatgattcaaactccaactgtaatcttaagtctaactcgagaatgttcctttttctctaagtgttaaattttggtaaattgttatgcttgagagttgagacaatgccaagtttgtgatgtaaccaacggtttctatgaaataaaacgtagttattgtgtgttttataatctaatgaattatcttaacacttaagtaacaactaacaatgtactatactactatgaataacctagaaaataattctttgtgggttaattaatattttataaaatgttggggtaatttagagaaaacatggaaatatatactatttattgataactccaaaactatgctatatttcactttggtgcccctcgtttgtgagagtatgtttggtccgtcgatgcacatggaagcagcagagatagtccattcggcggcgcgttttgaagctgagaaaatgggcaaggaggatgaggcggtggaggagatacgacgtatgagtggttacggcggagatgtgatagtagtaggtgggtttccggcgtcggagtcggaatctgaatctgaatccgatttggcggcggcggagattatggttatatgggctattcaagggccaacttcttttgctccaaacacactcgttgctcaatcttctcttgagctgcgtctcgacgcttgtggccactcactctctattctccagtcgccatgttcattggtaactccttagcttctctgtttcagtgtcaaatttctcgcttttagggtttattgcaatcaagtttgcgtctttcggatccttaacgagtttgtgtatatgtgtcttgcggctatcatcaaacctacattgggatgttgttagaacatgtttactgatacattcagcttttgttaagtggatttagcttaacattgaagaaagtgataaactttgattcttcttgggttgaacatgaagcgtgttagaactatctgatggttgtttgtttttgtactgtgaagaacacgcctggagtaaccgggtcagtgatgtgggacagtggagtggtgctagggaagttcttagaacattctgttgactctaaggttctttctcttgaaggcaagaaaatcgtcgagttgggttctggctgtggcttagttgggtgagcaaaaaccgctgatatttctcttctgagaattactattaacgtgtaaaacatttagttagtttcttctttcagttgtatagcagcacttttgggaggcaatgctgtcctcactgatcttccagatagactgaggctactcaaaaagaacatccaaaccaatttgcaccgtgggaacacgcgtggatctgctattgtgcaggaacttgtttggggagatgaccctgatccagatttgatcgaaccattccctgattacggtaatcatctcggtttcattttttctccttttgccttgtacataccattctcacaccttttatttgctatgtacttgtagtattaggctcagatgttatatacagcgaagaagctgttcaccatttggtaaaaacgcttttgcaactttgcagcgatcaaactacaatcttcctatcaggagaactacgaaatggttaatcattttctttttgtggttttcaatcatcttatataacaagaacacaatgtctaattttgcttgctcgttctttctgtcagatgctgttcttgagtacttcttagaaaccgcactgaaagattttgcgatcgggcgtgtggaacaaacacaatggcatccagattatcgcagccatcgagtagtgctttacgttcttgaaaagaagtcgaagagatgcctcgctgatgaatcttcgcttaatcaatcttgttagccattgaggtattgtttgtttacacttgacaactgaagtagatggccctaagcgggaagtatagttctggcctgatccttccttgcatatttgcatacatctagcttatagagtgttacagatatactaatttttattttaaccttgttttaaagtgatcttgaagaatatctaagaaacaaatgtactcttcttctttacgtttaacttttttttgctgttgtaaaaaatggattcagatcattgaagatatctggtctgcgttttaagtcagacacaattatagagcaaaattaaaattttatgtattgtttctcactaaaatgtttaaattaaaatataggaataattgtctttttatgatcgcgtgaagtgaggacgattgtttagtaattttatacaaggttgcgacattttaatattttgatccattaaaaaaatataccaaaaccgaaagataagagagttttgatagacgacttttttgtgtataaaagatgcagtaattgttgtccttaatgacattgctaatcagaaactgaaataggaaatg

SEQ ID NO: 10911 - DNA, 3000 bp, Unknown
  misc_feature (1)..( 3000): cDNA_ID_2716835_gDNA_ID_2214462_Annot_ID_132995 3000 nt of promoter + ATG
ccctttgagctcgaaaccgggtttgttttcaatctcttcgtttaattaaattggtgttcttagtttggagataatttaaaatccgtcagatactgtttcttgtgaatgaaggtatattggtgttggtgaggaagaggaggtgcaactgttctactacttcatcaagtctgagaggaacccaaaagaagaccctcttcttctctggctaactggaggacctggctgctctgccatctctggccttctttatcagaatggtgagatcgaaaacatggataaactccttcttctgcgtctctggttactgtctgtaaccctatatatgtaaaatataaccagggcctctggctatgaagctcgatgtttacaatggaactctcccttctttggtctctactacatattcttggacaaaggtaatacaaaaaagtgtgtagtcttgatataaccatcagcaaaacccaatgatcatttcttgatcacttctctcagacttcgagcatgatattcttggaccagcccgttggaactggcttctcctattcaagaacgcaactttttaataaacctagtgatacaggagaagccaaacggatccatgagtttcttcaaaaggtaaaataatgacaaacttaattgtctcttgaagccaaacggttcttagtaggagccttttcctattgttgttgtttgtgcagtggctaggcaagcatcaagagttttcctccaaccctttctatgttggcggagattcctattccggtctggttgttccagctaccgttcaagaaatttcaaaaggtatatgtatgttttatgatatcaatcccctaagcccttttctcaaataccattattgtaacagaagaaacatgatggtgatgcaggaaattgtcaatgctgcaatcgtccaataaatcttcagggctatgtgctcggtaacccgttaacagactgtgtatatgattgtaactaccgcgttccatttgctcataaaatggcactgatctctgatgaactctacgaggtatatacgatgacattttgttttttttcttgtcctcacaatgaaaagctgttcaaaaacactatgttgttcccagtcgttgaagagaacctgcagaggagaatatgtaaatgttcatccacatgacacagaatgcttgaaattcgttgaagaatttaacaaggttaaacactagagctgatttcgtgttgtggatctgccttaaattaataaataaagattcatcactaaattcagaccttgtgtggttatttttatagttaacaaacagagtatgcgaacgacatatattacattcatgttgcgaaactgaaactccaagttgctatgtaagtaatccatatatcttgccctctcttatctgttaaaccctttgagaatatatctatcatacacggttgcttttgcagtcttataggtttatgctaactacctactgggccaatgacgaaaccgtacgcaaagctcttcaaatcaataaggtaataatttattttaaggttcttggtaaaagcacagtgtcattattataggaggatctacgattgcaggagagtataggggaatggacacgatgttatcgcggtattccttacaatcatgacattaaaagtagcgtaccttaccatatgaataacagcatcgatggttatcgttctctcatctacaggtcagagtttataacccttttgctgatcttttgtccctatcaagattcaagactattgttaaactgtaaggtttttggtgcatagtggtgatcatgatatccaagtacctttccttgggactcaagcttggataagatcgctcaactattctatcattgatgactggaggccatggatgatcaaagatcaaatcgctgggtatatacgggtttttttttttttaaaacgggttctcttattcttttgttttatgagattcgctttgaagtttattcttgatacttaactggcagatacacaacgagttatgtcaataaaatgacatttgctactgtcacagtaaatctttcttcttctttttttttttttttttttttttttttttttttttaattttcttttaatccatctgccatttttattaacttgtattgagttgtgggtgttgattatagggaggtgggcacacagcagagtttacaccaaaggaaacctttatgatgttccaaaggtggatcaatggccaacctctgtgaaagaagagagtgacttttacgtacaacggacaagagattgtgtgtgattctagtaacacattttccaaatcaatgctgcctctcggcccaagtttctcatagagacaaatcaaaatgatgtggattcatcatttctaacatcgactctatgaaactgctttagctatttctcgatatttcagttgtttcttccagatacaagtgaggttcctttaataaacaatggtgaaggaaaatcgcagattttaaaagttttaacgaataccaaagtagtaaatcgaatgtctaacacgttaagcttgaaatgaaatgggtgctataaaataattaagtaaatctcttaaaaccacacgagtccaaaacaataatattagtggattggttaattggtctatttttgtgtggacctttttttttttttgttttttggtgctttaaaaaatggattcagaatttcagatcattgaagatactctggtttgcgttttgaatcagatacaattatagagcaaaagattaatagtataattatatttctatgatcgcaaaatgcgaggacgattatttagtaattttatataatactcaataattttatagtccgtttatcattgacaattcattgttaatttgttatacagggtgtaaggataaaggttgcaagattttatccattagaaaactgtgacaatgtgcgactttttttgggttcaagtataaagatgttgtctttaaagacattgctaatcagaatctgaaatacgaa

SEQ ID NO: 10912 - DNA, 3000 bp, Unknown
  misc_feature (1)..( 3000): cDNA_ID_2716823_gDNA_ID_2214462_Annot_ID_132998 3000 nt of promoter + ATG
ttatctacgaggtgggagaatcaagattgcgagattttccaattaaaaattgcaacaaggtttggtcatgtagccaaaattgaaagatagttggtaggcgactttttttttgttttagtataaaaatgtaattattgtccttaaaaggcattattgctacattgctaatcagaaactgaaaaaaacaaaaaacaaatggctagcaactacgttttctctgttctgaggtcgctgcttctgttaattcacactgtattcttaggtcagcaccatgttagttctgccacaattatcaagtctcttcctggttttgaaggccctcttccctttgagctcgaaaccgggtttgctttggatgtcttcgttttattaaatccgtgttctgaatctgagtttggagataatgtaaaaaaattaggttactgtttcttgtgaatgaaggtatattggtgttggtgaggaagaggaagtgcaactattctactacttcataaagtctgagaggaacccaaaagaagaccctcttcttctctggctaagtggaggacctggctgctcttccatctctggccttctttttgagaatggtaaaattgaaaaaatcgataaacttgttcttttgcgtctctgattactcgttgtaactcgatatatgtctatataagcagggcctctggctatgaagcttgatgtttacaatggaactcttccttctttggtctctactacatattcatggacaaaggtaatacaaaagtgtctagtgatacgactatcaacaaaacccgattgatcatcattttcctcaggcctcgagcatgatattcttggatcagcccgttggagctggcttctcctactcaagaactcaacttttaaataaacctagtgattcaggagaagccaaacggattcatgagtttctgcaaaaggtaaattaatgataaacttaattgcctcttgaagccaaacggttcttagtaggagcctttttcttttttttgttgttgtggtgtagtggctaggcaagcatcaagagttttcctccaatcctttctatgttggaggagattcttactctggtatggttgttccggctaccgttcaagaaatctcaaaaggtatatatatatatatatatatgattttatgatatcaatccccaagaccttttctcagtcttttattataacaaaaggtatatatatatatatggttttatgatgatgattgcaggaaattatgaatgctgcaatcctccaataaatcttcagggctatgtgctcggtaacccgttaacagactttgtatatgattacaactcccgcattccatttgctcatggaatggcactaatctctgatgaactcttcgaggtatgaagtatgacatttgcttttgtttcgtgtcaccccaatgaaaagcggttcaaaacaaaactttttgtccgcagtcattgaagaaaacctgcaaaggagactatagaaatgttcatccacgtaatacagaatgcttgaaattcattgaagaatttaataaggttacacactcaaagctgatgttgtttgtgccgtacgtaaataaatattcatccctaaattcatacctttttgtgattatctttatttagtgtacaaacagcatatgtcaacgacgtataatagatccattttgtgaaactgaaactccaaattgctatgtaagtaattcatacaacttattcttgccctctgttaaaccatttgagaaaaatatatgtatacaaggttgcttttgcagatttaccgttttttgctagctgcctattgggccaatgacgaaaccgtacgcaaagctcttcaaatcaagaaggtaacaatttattttaattttcttggtaagggaacaatgtttcttggtaagagaacaatgtcattcttataggaggatctatgattgcaggagactataggggaatgggtacgatgtcattatggtattccttacaattatgacattaaaagtagcataccttaccatatgaataacagcatcaatggttatcgttcactaatctacaggtttagagtttataacccttctgtccctaccaagattctagtcttttgttaaactttgtgcggtttttggtgaatagtggtgatcacgatttcgaagtacccttccttggaacccaagcttggataagatctctcaactattcagtcatcgatgattggaggccatggatgatcaaagatcaaattgctgggtatatataaaccgaatttgttcttccgttttatgagattcactttgaaatgtattcttgattcttacttgaatggcagatacacaaggacttatgccaataaaatgacatttgctactatcagagtaaagtctttcttcttcttttttttatccgctccaatatttttttattgcggttttctaacttgtactgagatgtgggttttgattgtagggaggtgggcacacaatagagtttaaaccagaggaagcctctatcatgtttcaaagatggatcaaaggccaacctctgtaaaagaggggagtaacgtcctttacgtataaaggaaaagaaaagtatgattctagtaacacatccaaaaatatatacataaggacccttggccttataagtgaatagaatttagggttaagttaaactcataatttgtaagcaaaatgtgtgttgctctattcaacaagcttggtacagttgcattttaccttcttttttgtcaacaagcttgttttccatttgtttgaagcaaaagttaatttacatgtattgttattaataagtgtcactaaagatatttaaattatatttttaatgataaaattatatgttggtagaggacaaggttggtcatgtagccaatatttaaagatagacttggtagacgactttttttagattttagacttttagtagaaaaatgcaatagttgtccttataggcattattgctaatcagaaacaaacaaaaaa

SEQ ID NO: 10913 - DNA, 3000 bp, Unknown
  misc_feature (1)..( 3000): cDNA_ID_2990347_gDNA_ID_2214462_Annot_ID_133003 3000 nt of promoter + ATG
tctcttgtgttcatttatttgttgatttttatttaacaattaggttgtaatacctttaatgtcaagagattgtgaaccaagtgatagtgtttttatatttttttatagaaagatataggcttgcctaactttaacagagcatttggagtgttcccacaactcgtcatccactaattattgatcaagtactacatatcccaaattctttattattgtggaaaataattgataagaagacaaatataaatggatttaagtaacgattggatgatcatttggtatggtagtatattgcatttatgtcgtgtcattactagttcttccactagtgagtgtatattcggtcttcctcatttttatgcttctttcatctaattgatgaaagacagactaaattcttttctttcttatgtcactttgcaacataatgtgatgtggttcactaacactcggatgtacataggtatgcttagcattagctattatagtataatacatatatggatatgtgcgtgtatgttcggactgaattaaagatttactcgttatttttgtgaaattctggttgacatatatagtttcgtaattacacttctacgatacccttagttccatatatggcgaaccgaacataatttattaatatttgttcttttttatcagccaaatactcttatttcaataatcgggtaaatgctttaccaaagtctagactaatttccagaattaatggaagattaacgtcgttcttttattttgggattcataacacatatagtggccaagattgagatcgcactaaaatggtttgaacaatagtctctccttctttcaggaagaatggagaacacttcgatcattgaatcgctattcttcgttacaccgatttgaattgattattttatgtttgcatatatatctcgacagaaacatccaaatcttgtattcaaaatgatatcaggaatttgttttctcaatttttgttgcctcctaacacttataattccacgatttatagtatatacaaaagacttcgaaaactatagacatgtacataacagtcccatggaatcaaaagtagaatatgccatatatcccatagacataaacactttaattctcatctgtccacgatatataaacgaataacaaattcacacgcaaattgtcaccacatacgagaaaaacacatgaaaaaggagctttggctacgcatattcctcctaaaaaaaggtatatcttaatcaagaaaaaagtttatagatgattatactaacgtagacgataatactagacggacgtaatcacaagtactaacattttcaccctcgagatcatattactatattccaaattgaaattttatataagaagttccggctaattaacaccattaacacaaacaaataatattcacgtgacgaagattcatgaacgatatgttgctttccagatggagtaataagtccaaatatatatatttgttagtgatgtttgtgtttgtgtaatgttttgtatacaacaaacaaggatgattctatcacggaaaacgaccttcggaaattttttgtattgatcgatagcatgcaaaaacttacataggtatagtcatatagagcctagacctaggtttgaaaaggaaaatgaattttcacattctagagaataggaaaaacttaattaagaaaggaagatagagataggtacatcaaatatacgaaaatatattacgtaccaatagaccccccacatcacgtaatgtcctaatcctactattaatcccactttcttcatgggctcttgggatgatcgcacctctttaattaactaatctttaataatgccattatgcaacaactttttgataattggataacctaaatcgaaaacttaagtagttgcagagtctgtgaaaaccgaataaaattgagttctaaaagttatgctagctaagttttacaagtaaatatttctatttgcaactttttctcagatttgtttgttccatttttcattattactcagattgatagtttttttctgttcattatctctctatatggaataatagttattaaacgccaaaaaacggatcaactataattttggcttagatttctcatttactttttttaggtaaagaaatctagtactacacacataatcgctgaaccgtacatgtatattgtaaagagtgtgtatgcagtatgccatacgtaacactcaagtacttacggatgaatatacgttcacttaattacaacgggtttcttgcaaattataaactcaaatttcatgtttttattcggccaaaaacccgcaaaacgaaccaaactttggaaatcacgatcgatcgaaataatatttgacaagtatcaagccacatgcattggttacacatcatattattcaatttgtaattttagctatgtgttgtcctcatgcatcataaattttttttttctctttctcgtcacgcatcatgcattctaaccgtaacctttgtcgtttattttctttttccaatatatttaaaattagtgggaactaaaagagttacgtttgttgcaaaaagaaaaatgagttacatttgtagacaaaaagatgaaagagaagtatagacaaataaaacaagaaggaaaaagagagagttgcatttttgttaatgtcacgaatcaaaagtaattcttcttttcaagataattgaatttagagttgtaaatgatcatgagaacttaatgaacgtgtaccaatcaaacgcaacagataatatagacaacacaatataagaaagttaaattgtttatacgaaaattttaatgactcggtatgcacaattgctttttgattagtttattagagagagtgagaaattggatgcaaaacactcctcgaccatgtgtatatataccatcgctaacttaagacatatatcaatcaatcccacaaacctaaattgaaaacaaatatatttccacctgaaacaacataaacagaatg

SEQ ID NO: 10914 - DNA, 3000 bp, Unknown
  misc_feature (1)..( 3000): cDNA_ID_2716804_gDNA_ID_2214462_Annot_ID_133005 3000 nt of promoter + ATG
agatgagtgcgtatggctttggcacacaggttgatttaaacaatggcgaaaccgttatgcagtactacgtcccgtacctatccgctatccaaatccacactaacaaacccgccttgctttccaggttacgtttcccacttgattctgtgacattttagtctgttgtgatgaaagtttgactatggaagtattagaacatctcttgatggtttgttcttgggtgttgcaggaaccagaatgaggtggctgaatctgagagtagcgagggttggagcgatagtgagagtgaaaagttgttgtcaaggtcaatgagcaatgattcaagcaaaacatgggatgctgtctctgaagattcggttttcgatccggatggttcaccgttgctgaaagatagacttggtaaccttgactttaagtacattgaaagagatcctccgcacaagcggattcccttaaccgacaaggttctcttctctcctttcattttcatttcttagtaacctcattctcagttttgaaacgaaagtaacgttcttggttcttgttcagataaacgtattggtggagaaatatccgggactcatgaccttaaggagtgtcgacatgtctcctgcaagttggatggctgttgcgtggtaagtagttctttgttaagttaacaaaacccttcctgtttggttaactgctagaaatagtgattgagtgatggtttgatgaattaggtacccgatataccacatcccaacctgcaggaacgagaaagatttgacgacaggcttcctaacttatcatactctatcttcgtcttttcaaggtacgtatgatcacttcgaattcattgctcagtaacaagcaccattttctggttttattaatggtgttaaaaatgctgcagataatgtggtggaaggagatcaaagcaacaacaatgaagaaacagagttttgtgaagattccgtaataaacaagagaatgccattgcctccgtttggtgtaacaacttacaaaatgcaaggagatctttgggggaagacggggtttgaccaggaccggttgctttatcttcaaagcgctgcggattcatggctgaaacagctcaatgttgatcaccatgactataacttcttccttaactcgagcttctaaagatcaatcgggtcgttcgtatgtttatccttctccaaaccttaaacaaaaaaaaaagacctcataaccctttttctttgttgttttcaagctccttttgtttctctgtgttttttgttctttttgtttttgtctggctcgttgtgttgttttaggtagcaaccgccatcgcggagttttttctccttttgcaagccaatcatggaagtttctaagaagaaaacagagcttttttttctttttttttaacggtgttgagaaaacaagaaagttgttttcttttcttgggtgagagatcatgtaaattgaccttgaacagaggactctgttttgtacttttctgtctaaaatatataaaaaaatctgtctttcttgtatgtcggtatgagtggaagaagaagactgtttttgatagatttgatatgtcctttcgtttcttttcaagattttttagtgttgaatatgatgacgatgttgtcatacaatatttacttagtaacagttgttgcatacttttttttctatgttctttataatttaatttaaattgtttctatgttcttttcgaagcttaaaagaattgtgcaatcccaaactgaaacagtcaaacttactagttcaacaaaattgttttgctatatcgggctgatatttactgtcgaacacaggtaaaaaagtatttattttatttttttgttgaacacaggtaggtatatgcctacatggtatacaaataatatagacagtttcataacatttacaattgtaacatactgtttttacaatttttgttgtcgttttcttatttatcgtattaaaattgatcttatcctgaattttaaaatttagataactgacaaacgaaaagattaatgctaattgtatatgaaatgaaatgtattgttgtacattttaaattatatagacaatttaatgatatttacaatcacaaccgatcgttttgtcaatttttgttgtcgttgtattatttattgcatttatatcgatcgaaccctaaattttacatgtaattcacttacaatcaaaaataattaatgctaactttatatgaaattacatgtagtaaatttaaaattatattgacaatttcttctttgcatttttgttggcattttcttatttattgcattcaaatcgattaaaccctgaaatttaacatgtagatcattaacaatcaaacataattaatggtaacattaacatgtagtaaatttaaaatacaatacacaatattttgatataattttgagtttaaccaaattatccaacctataaaaacacatgcaatggattcttgaaatctttatgtctttagcgatttgaaatgaatttatgtagattttcatgtgtacacacaataagtaataaaatctaaattatcatctacttaaaataaaaacataaaatttaatcataaaatcaatactaaatatatcaaatcagtaaacaaaaaatcctatttcatattaatatgttaagaaataaacttttatgattttttttttccaaccactacatttatggttgtttttcaaatgttttcttatgattttctgagtcaatttttcgctttttgttagctggatactctctcttctgataatggtcttttgtttttcaaaaaaaaaaaaaataataattcttttttgagcaaattatttggttggaaattgcaaagtttatcaatcaaattaatctcatcctccttcttcttcttcttcttccaagtgacatgaactatacaacattacgcgttttcttctcttattgattccttcgtaagaaatcttctccactagttgaccaatcgagagacttgtggtcttcccggag

SEQ ID NO: 10915 - DNA, 3000 bp, Unknown
  misc_feature (1)..( 3000): cDNA_ID_2716798_gDNA_ID_2214462_Annot_ID_133007 3000 nt of promoter + ATG
ggttaaagttgtggatgtttggagagatggagtgggctgggatttacagaggcttacgccgtatatcacagaaggtatgaagctcaagttactatctttggtggtggataatgtgacaggggctagggatcgtttgtcttggggagggtgttccaatggtaaatttacagtcaagtcagcttattcttttttaagcttggactggagttcgaagcagcagatggcgcgttttttctctagaatttggcgtgttgtagctcatgaaagagttcgagtgttcatatggttggctgcaaatcaggtgttgatgacgaatgttgagagacacagacggcacttatgtgattcgagcttatgttcagtatgcaagagtggggaggagacaattctacacattttacgggactgtccggcgatggcgggaatttggacccgcttgttaccagcacggagactctcttctttcttttcgaaatcgctgttagaatggatctatgcaaatttaggagaggagatagagattaatggttgtccatgggcggtcactttttcgcaggccatatggtgggggtggaaatggcgttgcggtaacatctttggcgagaacaggaagtgtcgggatcgggttcgttttattaaggatcgtgcgttggatgtttagaaggcgcatgtgcacaaaatgggagtgacgacgcggacagctagggaggagagattgattgcgtggtctccgccaagggtgggttggtttaagctcaatactgatggggcttcgcgtggtaacccgggactagctacagtaggtggagtagttcgagacggggatggaaattggtgttatgggttttcgttgaatattgggatttgttcggctccgcttgcggaactatggggagcatattacggtttaaatatcgcttgggagcgcggtgtcacacagttggagatggagattgattcggagatggtagtgggttttcttcggacagggattgatgattcgcatccgctgtccttcctggtgcggttgtgccatggcttactttcaaaggactggtcagtccggatttcgcatgtttatagagaagctaatcatctcgcggatgggttagctaactatgcttttcttttaccgttaggttttcatttgtttaattctactccagatagtgttatgtcgattgttcacgacaatgtagcggggtctgcgtacccccggaacgttcaagtgtaattttttttagtttttcagttttaataaaaatgggggttcgcccccctcttctaccaaaaaaaaatacaaagccaggaacagttttggttttgatcatacacaacgagaaacaagacttgtaagaattttccattgtacttaagaggctattactgtgtatcaagagctagatcacgccaagtttcagcatctgcttgctgagtttcctgatctgaaacaatcacaatgtgagggattatattagtcaagctgcttatatgaagattcataggtatcttggaagtgaaagttgttaaatctcagaaaccctctgaaacaaagctcaaatttgagctttactatgtttgaaacatacacaaaaagtgacgtatgtgtctccattactttccttatgacatttcaaggtctcaatatgggtgtttaacatcttggatcagaaatgcatcaccagtgtggattcacagctagcagttttaagaaaagactatattccaaagaatttagaccttaagaatcataaagctatgtaaactgtaaagcaaagcaaagaaaaaaacaaagagccatactggtttcttcagtatcatcagttttaacagcaagcactggaggcaatggaagatctgcaacaataatctcttatgaaatagaaaataggagaaacacaatgatcttgaggtataatgtaggaggaaaaagggttaccatcatcaggcaaagtgtccctcatccactcttcgtccacaatgtctataagcataccaagacttacttccgccatattcgaaaaactggagcttggaaatcccacaaattactgatgaaatcatccaataagtaaacatatatacaaatatcagacaaatggtgaagaaatttggattgttgaagtaaaaagtcaatttctttacaataggaaaacattgaacagaattgggacttctgatatccaaaattttgaattttgagaaagtgacagtatataacagacagaataaagctcaataacctatatatgaatatctaaaacaatctacaggtagtttcgccggagattatgaaaaagagagtagggattcattgagaaattacgtcgagcagttggtgaactatctagtaaagagaccaaatacgaaatcgtaccacaactcaaagccgactctttataaacagatatgattctctaaggaaaaaaacctaatttgaatcgaattagcaagagattcacctggtagaaacaatgcagccgtactccacacagagaactaaaaacctctagcttataaaaaaagctgattttttttctctttggttataaatatacagtaaccttctggtttacctagagtattcaaaaggctgatgaaatttaagttagggtatctctttatacggttcagagcttaagccggccactacagcgaccgacttctctcgccgtcgattaccggatcgtctccgttattgcgtgcttcatttaggtgctttcttcttcttcttctccagtttcagattttcctgttcttgcatttcacctttgagaaattgtgatataaaagttgtttactttacttcaatccagtaaagtaatttggtgattatcgtttcctctaccgcgatcactgtgtaattgatgatgagggttttatacgttcagtacaaatttgagagcttttatgttgacttcaatttgtaaccagtgtatcaattctgggattttaattttcatcattgcattatatattaggtgtatcaagtaagcaatg

SEQ ID NO: 10916 - DNA, 3000 bp, Unknown
  misc_feature (1)..( 3000): cDNA_ID_1989675_gDNA_ID_2214462_Annot_ID_133010 3000 nt of promoter + ATG
aaattaaactaacacctttctaaattgaaaccattgtcacataacacatggctaacttgaaattcttgctgtgcttgttcttgatctgcgtttccttatcgcgttcatcagcgtctcgaccgatgttcccaaacgcagacgggattaaacgagggcgtatgatgatagaagcagaggaagtgttgaaagcgagtatggagaagctaatggagagaggttttaatgagtccatgagactcagtcctggaggtcccgatcctcgccatcactaagtcttattctcgtagttttgaattcgaggatgtatattttgttcttgatcgagaaccggtttagaagaaaacatatcgatcctctttgtttgttttttttgccttgtttgttcgttcggtgtaaccaatatattgatgtatctgtttcgttacacatttatgatttgtgcatgctttacgtaccttatacattccactatatagtagtctagtagagaggaggactttgcatataaattgttatataacaagaaagggtaaagaaatatagtatgataagggaggattgaattaatttaatttatcctgttttttcagtctctaatggctcgtgtagaaaagtatatattatatatggactcttttgcctcatcgtccaccaatgaaatatcacataaagagagaacgatagtgattgaagtttttcaaaaagaaaaaaaaaacaggggaaaacagagagaattatactttttaagagcgaagcaacgtcttcaaatcttcaatttttcagagatcaaacccttgaaatgctgctctttacgaaactcattttccaaaatctctttttcatcactttcgttacaaattcacaaaaagttacaagtcgtgacaagcttgagcttaagtatgtgtatgaatagtgtgaccaaattgttttgcaagagatcaagtaacttgttacaaaagaaatgattcaacgtaacttacaaaactataccaatttaccaaatcagttatctgtggaaagagggtacctacagtacctctcatttttcatacacataaagaatctctcataagccgaagccatttgagtcgctgtaaacatcgaaagagcgtatcccttacaagctattcctttcatctccaaaaccctaggcccatctcttacaacagaatccaaagtctcaacaagagatctcacgtttggagaaaatgtgtacccaaaacgctcgtccacaaccactgtcccaacaatgcttggataattaggtgccacgacaggtttcccacactgcatcgcctcaatgatcgtcaaatcaagcccctgtggtctcaacgtcggattcacaaacacatctaaagcgttgtagaaaccagagagctcctctggctctaaagctcctaaaaccctaacgttttcgcctaattccgcgtatcttttgccccaaggaccagatccagccacaagcaaatagactttcgggtgcattttaacgagcaaagcaaacgcttcatatagaagtggatgtcctttgtctctcaccaaacgtccagacacacccatcacaatatatgtcccattgtcaggaataccgtgtttcgccctgaacctagctccagattcaggagaatacacgaacttggtttggtcaacaccgttgactataacgtgaacttttctcttaggaagttgatagatgttaactagtacctcgcgcgcgctgttgctaatgcaaatatgctgtttatattttgggaagaatctgatttcatcgacgagtctaggcatcgtttgttgaagatcagagctaggacgatcattggaaagttcttgaaaaagatttgaatgcataatctcgtaccagattccgtgccatgtcacagctatgtcaccattaggcaccattttgactcgccaatgaggcagagaaacactctcagtgtgaacataatcaaaggaatgatgatctagactgttgattttatggaagatctcaaaagctcgagagtggttaagtgagccgtgttcgtttggagcaaagtagacatggagatctcctttgttgtagtactcttctcggttacttctgtcggaagaaaccgtgaagacgtgaatctcgtgacctcttgaggcgagagaagtgtagagtgtgtaagcatgacgctccattcctccggggatcgaaccaacaggccatgacttgcagaagacagcgagtttgagcttctccgagattggtccaagtgagagtttgttccaagggaatgtcaggtctcgaagatctcctgcgaaaggaggattttccggtgaagaagtcaccggagagtaatcaaactgtgagaagaaaatgtagtaagaagaacaaaagatgaatgctaaggtaatgattgttgtgaatctgaatgaaaatgaagtggaagaagaagaagaaagagttgttcttgaagaatggttcttgaaggccattgttttggtttatttgatttttgtgaattgagtgcaactattgatgttgattctttgcttaaatttcggatctttctcgagttattatatcaaagttcatttctcaatgacattgcacatggcttagctaatttttatatggtttttacattcaattgaaagtcaaatctctcttaaccaactgagatttgtaactaaaccgggatatcacacctaattagttttcccggtttgatattttgttttgtacacgtaggcgtgtgattactccgtcacactttacacatgtgtaattcccctaatttatcgggtttctttaggcgcgtgagataatgcgcgtgtgtctacgctattcttgcgacgctgtgcttcctagggtttcgtcgttgcaaacacagtcaatgttcatgaaccacggatcctaatctccccgatcttcgattcattgtttcagaaatccccaattactgtctctgtgcgtaaaatctctagagaaaccttaaaattttccgttcagagaaattgtcaacgaaggta

SEQ ID NO: 10917 - DNA, 3000 bp, Unknown
  misc_feature (1)..( 3000): cDNA_ID_2175085_gDNA_ID_2214462_Annot_ID_182819 3000 nt of promoter + ATG
cttctacactatcctcgcctgaaaaaacccaagagtttccagcagaagatttctgagaggttaaactgttactgatccaagactcatcatccgtaattattggtttttcatcaccaagagtagtgtctgatgtcagattagcatcacaatgctcttcgagcaatggagacttagagagtatttcttcttcagaaaatttctgaggggttaaagtgttagtgattagagactcatcatcggtaactattggtccttcaccaccaagagtactggttgatgtcagattagcatcacaatgctcttcgagcaatggagacttagagagtatttcttcgtcagacaaggaggattcaactctaacttcttgtacactttcctcgcctggaaagacagaagagttttcagcagaaaatttctgaggtgttaaagtgttagtgatctgagactcatcatcggtaactattggttcttcaccaccaagagtactggttgacgtcagattagcatcacaaagctcttcaagcaacggagatgtggagagtgtttcttcaccatccaaggaggaggctgatgaattctctccgtgagctatattctccactaaaatgtcaccttgaactcgttcctcaacccgaacatgtcctaaaatgtcaaagttctgacatggcggtgaatcagaaggactattacaacttggtgaattagaaagacttttagtgatatgcgactctttatcagtaactattggttcttcatcaccaacactagcggctgatgtcagattagcatcatgatactcttcaagcaatggggatgtagagagtctttctccatcaggaaatatctgagactcttcatcagaaactaattgttcttcatcactaagagtagtggttgatgtcatataagcatcacagtactcttcatgcagtggagatgtagattctatttctccatcagacgaagaggaagctgatgaattatcctcaaaactatctctttgaactacattctctttcaaaatatcgccttgaactcgtttctcaaccaaaacatgtcctggaatgtcaaagttctgatgtgacggtggatcagaaggactttcacttcgcggtgaagcaacacgatcatgacgtccttgtacattagaagaatggtcctctgcaacttcctttgattcacctctaacatattcgaatctcggaggttcacttgatttcaaacaaagcgtgctctgtgccaacataagaaaaccatcactcattctctctattctttagacattattagctaaaattgataatgacaatcaaacaatggactaacctgagaagtgaaagagtcaacctcaacaagcaaattttccaacttgttgtagattttactaaaccatgctcgtcctttagattctggtcccatgatggctcacgctatacgaaaattatgcagcaaaaatataaactttggttaggcaatatcatcagaataataaagagttgaaaaatatcatgttattccaaacttgatcgcaataagaagatgaaagtttcaaacaacaaaaacaggtcctcactaagaaacagctcaaaaatcctgaaaattttgccatcatcactaatcactaggtctagattttatcgaaactcagatgcttaatcggaaaagatgaataatttagaaaaactgtactatacagctatctcaaatttgtgacccgagcacgaagatcgctgaaaaagagaaactcatagacgcatcgaattacataaaaaaacgagactttgagatgaaaaacagagaaagtaatcaaaaggagataaaccctgaaattcaaagtaaacatagatgagaaaaacaaggaaagagagaagaatttacctgagaaagtaagaaggaaagtacaacagaggaagaaacgagaaaaaggcctcaacataatcatcatacaacaataaataaatactaaagagcttatttaagatttttttttatttttttattttttattttttgagaaaaggattctaatttaggattacaaccagatccataataaaaattcaatttagagaattaaaaaaagaaaaaaagaaaaaagtagtgttattggtttgtgatttaaatagtgatttaatgactttaaatgttactagaatctattgttattcaataataaaagttaattaagagtttggtgttattagtttgtgatttgtaaaaaatctttataactctaggttattggatttagaatttgataaagttgttgaaaaaaaaaactttgggttattcaactaaaacaacataattttttttattattaataaactaaattattatattattaatttataattttatacattttcgtcataaaaatatcgtcaaaatagagaaattattcgtgaaactttacaaaattacgaaaaaaactaattaacaaaattatataatactctctaccaatttctcttcatttatttactttatatgattttaaatcatcaaaattctttttaaactagaatccaataccagcccaaagttacatatagattccgggcttttattgggctacctatctaaagttaacgggcttataaaatttagtaggcccaatagaaataaagtagtccgaatgggtcatgaatcatgcacgccacaagtgaccaaaacatgatcatgtgtacgcatacgttttgaagaagaatgatccaaaataagaagacgtggattatgccacgtggaggggaatggcacaaaagaggcatgggtctgacgataaatctacctcggggagtgtgcatctggatgatccctctccatcattctttccatcccaaattctttatcttattttaattttgttgaaattccattcacattttatgatgtctcatgtatatatatgcaactctctcaacaaacacataatataaatatatttacctacatcagattcttcatacacattgtaatcaatagaccatagagatttac

SEQ ID NO: 10918 - DNA, 2596 bp, Unknown
  misc_feature (1)..( 2596): cDNA_ID_1989677_gDNA_ID_2214462_Annot_ID_182817 3000 nt of promoter + ATG
cttctacctttttccctcaatttaataaaaaaagatttatacttttctcccaaagataggattttgaagaagaagagccatttgttctcgtctgatagtggctaattctgtggttcttgaagtcaaaagatagttttggccccacttgttactacttgcatgtttgtatctgtctgaaactatagcaattccaatttgtaagaatggatataagttttttgtttggtggattttggatcaaagctttagttagtcattagaaggtacattatgaataaggcagcagttaatctacatgcattggtagtttggtacgtaactcattttgtaatcatcattaattattcattatcattggttatatgacaatatatttccacttaattacacatatattttatggtttcccattagaacaatagacaataatatagagacttcgagtcttcgacgagatcgagatgagaagagagtcactcgagactaatggatcaagagaaccaattaacgagctcgtccgcgtggctgccagctggaggaggaggcacatcttgcatcactttctcttgtccctttggatagtatattcccgtaccttcatgtggcacccaactactcgccggcgacgacgtttctccggcgccgtagaagcctctcatcgtcttcacctcctctccggagctagagccctcagtcttcaccgtatccctcactatatcatgcgaggcactcttcttgtgaattgatttcctaagcatcggcctatatatatgcaaattgcatgtgttaatgatatataacatgatacataattaaacgatcataacaaccaaaagtgtatgatctaagaatcaatatgaatagagagaaaattagcatggtttatgcgtaaagattgacatgcacgaaacaaataatgcatatgctcaacactaaatttaaggtaaacttacttgacgaacatggtgttcatggtttgtgccccacgagaagagaaggtagaagtcgccatgtaaatctctatggtctattgattacaatgtgtatgaagaatctgatgtaggtaaatatatttatattatgtgtttgttgagagagttgcatatatatacatgagacatcataaaatgtgaatggaatttcaacaaaattaaaataagataaagaatttgggatggaaagaatgatggagagggatcatccagatgcacactccccgaggtagatttatcgtcagacccatgcctcttttgtgccattcccctccacgtggcataatccacgtcttcttattttggatcattcttcttcaaaacgtatgcgtacacatgatcatgttttggtcacttgtggcgtgcatgattcatgacccattcggactactttatttctattgggcctactaaattttataagcccgttaactttagataggtagcccaataaaagcccggaatctatatgtaactttgggctggtattggattctagtttaaaaagaattttgatgatttaaaatcatataaagtaaataaatgaagagaaattggtagagagtattatataattttgttaattagtttttttcgtaattttgtaaagtttcacgaataatttctctattttgacgatatttttatgacgaaaatgtataaaattataaattaataatataataatttagtttattaataataaaaaaaattatgttgttttagttgaataacccaaagttttttttttcaacaactttatcaaattctaaatccaataacctagagttataaagattttttacaaatcacaaactaataacaccaaactcttaattaacttttattattgaataacaatagattctagtaacatttaaagtcattaaatcactatttaaatcacaaaccaataacactacttttttctttttttctttttttaattctctaaattgaatttttattatggatctggttgtaatcctaaattagaatccttttctcaaaaaataaaaaataaaaaaataaaaaaaaatcttaaataagctctttagtatttatttattgttgtatgatgattatgttgaggcctttttctcgtttcttcctctgttgtactttccttcttactttctcaggtaaattcttctctctttccttgtttttctcatctatgtttactttgaatttcagggtttatctccttttgattactttctctgtttttcatctcaaagtctcgtttttttatgtaattcgatgcgtctatgagtttctctttttcagcgatcttcgtgctcgggtcacaaatttgagatagctgtatagtacagtttttctaaattattcatcttttccgattaagcatctgagtttcgataaaatctagacctagtgattagtgatgatggcaaaattttcaggatttttgagctgtttcttagtgaggacctgtttttgttgtttgaaactttcatcttcttattgcgatcaagtttggaataacatgatatttttcaactctttattattctgatgatattgcctaaccaaagtttatatttttgctgcataattttcgtatagcgtgagccatcatg

SEQ ID NO: 10919 - DNA, 3000 bp, Unknown
  misc_feature (1)..( 3000): cDNA_ID_3038527_gDNA_ID_2214462_Annot_ID_182813 3000 nt of promoter + ATG
ttcgattcaaattaggtttttttccttagagaatcatatctgtttataaagagtcggctttgagttgtggtacgatttcgtatttggtctctttactagatagttcaccaactgctcgacgtaatttctcaatgaatccctactctctttttcataatctccggcgaaactacctgtagattgttttagatattcatatataggttattgagctttattctgtctgttatatactgtcactttctcaaaattcaaaattttggatatcagaagtcccaattctgttcaatgttttcctattgtaaagaaattgactttttacttcaacaatccaaatttcttcaccatttgtctgatatttgtatatatgtttacttattggatgatttcatcagtaatttgtgggatttccaagctccagtttttcgaatatggcggaagtaagtcttggtatgcttatagacattgtggacgaagagtggatgagggacactttgcctgatgatggtaaccctttttcctcctacattatacctcaagatcattgtgtttctcctattttctatttcataagagattattgttgcagatcttccattgcctccagtgcttgctgttaaaactgatgatactgaagaaaccagtatggctctttgtttttttctttgctttgctttacagtttacatagctttatgattcttaaggtctaaattctttggaatatagtcttttcttaaaactgctagctgtgaatccacactggtgatgcatttctgatccaagatgttaaacacccatattgagaccttgaaatgtcataaggaaagtaatggagacacatacgtcactttttgtgtatgtttcaaacatagtaaagctcaaatttgagctttgtttcagagggtttctgagatttaacaactttcacttccaagatacctatgaatcttcatataagcagcttgactaatataatccctcacattgtgattgtttcagatcaggaaactcagcaagcagatgctgaaacttggcgtgatctagctcttgatacacagtaatagcctcttaagtacaatggaaaattcttacaagtcttgtttctcgttgtgtatgatcaaaaccaaaactgttcctggctttgtatttttttttggtagaagaggggggcgaacccccatttttattaaaactgaaaaactaaaaaaaattacacttgaacgttccgggggtacgcagaccccgctacattgtcgtgaacaatcgacataacactatctggagtagaattaaacaaatgaaaacctaacggtaaaagaaaagcatagttagctaacccatccgcgagatgattagcttctctataaacatgcgaaatccggactgaccagtcctttgaaagtaagccatggcacaaccgcaccaggaaggacagcggatgcgaatcatcaatccctgtccgaagaaaacccactaccatctccgaatcaatctccatctccaactgtgtgacaccgcgctcccaagcgatatttaaaccgtaatatgctccccatagttccgcaagcggagccgaacaaatcccaatattcaacgaaaacccataacaccaatttccatccccgtctcgaactactccacctactgtagctagtcccgggttaccacgcgaagccccatcagtattgagcttaaaccaacccacccttggcggagaccacgcaatcaatctctcctccctagctgtccgcgtcgtcactcccattttgtgcacatgcgccttctaaacatccaacgcacgatccttaataaaacgaacccgatcccgacacttcctgttctcgccaaagatgttaccgcaacgccatttccacccccaccatatggcctgcgaaaaagtgaccgcccatggacaaccattaatctctatctcctctcctaaatttgcatagatccattctaacagcgatttcgaaaagaaagaagagagtctccgtgctggtaacaagcgggtccaaattcccgccatcgccggacagtcccgtaaaatgtgtagaattgtctcctccccactcttgcatactgaacataagctcgaatcacataagtgccgtctgtgtctctcaacattcgtcatcaacacctgatttgcagccaaccatatgaacactcgaactctttcatgagctacaacacgccaaattctagagaaaaaacgcgccatctgctgcttcgaactccagtccaagcttaaaaaagaataagctgacttgactgtaaatttaccattggaacaccctccccaagacaaacgatccctagcccctgtcacattatccaccaccaaagatagtaacttgagcttcataccttctgtgatatacggcgtaagcctctgtaaatcccagcccactccatctctccaaacatccacaactttaaccgcctcccagttcgccggtaattcgcatgttaccacctcacataacggggtctgcgacatccacctatctttccagaagaggatatcaacaccatcccctagaacccagctcaaacccgagaaaaccacctccttcagacccacgacaacgctcctccatgtagaagaccatgtacctttagacaccatccacgctctgttatgaatatcaccgacacggtacttgcttctcaagattttcgaccatagactcacatcatcatgaagtaaacgccacccaattttcgagagaagagccgtattcatctgtgtagagcaccagatgcctaaccctccatcctgttttggcaagcacacacgatcccatgcaataagatgttcctggctttgtatgatgaagacataattgctactctacttaatattaaaaaaaaccttggtggcataaattttaagaatttgtcgctgacgtgtctcgtgatgattcgtccacgtggttggcaaacggctcctatttaaaatctcaaaaccaaaaaaaaaaatcaagcgaggaat

SEQ ID NO: 10920 - DNA, 3000 bp, Unknown; identical to SEQ ID NO: 10914
  misc_feature (1)..( 3000): cDNA_ID_2716804_gDNA_ID_2214462_Annot_ID_182808 3000 nt of promoter + ATG

SEQ ID NO: 10921 - DNA, 3000 bp, Unknown; identical to SEQ ID NO: 10913
  misc_feature (1)..( 3000): cDNA_ID_2990347_gDNA_ID_2214462_Annot_ID_182805 3000 nt of promoter + ATG

SEQ ID NO: 10922 - DNA, 3000 bp, Unknown
  misc_feature (1)..( 3000): cDNA_ID_2114009_gDNA_ID_2214462_Annot_ID_182803 3000 nt of promoter + ATG
cttcgtggttgctggtccaaagccagaagggttcggacaagattcgttgaagagtttcttcaagatcgagaaatctggagaggatgcttacaagtttgtgttctgtcctcggacttgcgactctggcaatccaaaatgcagcgatgtcgggatattcatagatgaacttggcgttcgtcgtttggctttaagcgataagccgttcttggttatgttcaaaaaagctaatgtgaccgaagtttcgtccaagactatgtgagaggacaactctcgatcttttactttgactactcataataaaacctctatgttttttttttgataaaacacccgctctctgttttcttgaaaactacaaattgaataaaagctagtgaagcacatgcctatttattaaatcttcatcttctctcaatcttaatgcccgatataaatcaaagggatagagtggacgtccatttaaataaaaccagctaacaatacaagcccctaattattgttgtgtatttaataagaaaaaggaagcttttaaacagtacccgttctctagagaattctgatgatggtagtgatatagaaaatgataaaaataattaatactctagtctctagattgactaataactaatgttttcatttagtctaatgactttagttcagtttctctttacataatctaattgatttttttatatatttaaattctcttattctttaatttgaattttatttttgtttatataatagcaaaagtgactgaatcaatttacaaaatgatatttaggtaatttaaaaaacttttgaaaaattgaatctatgaaaggttagtttgcaaaaattctgcgtagaaatttatagaaaaatattatttttgtcctcaatgcatggaatcagttaagggataattttatgcaaaacaaagaaaggcttatgaaaatgtgtggcgttgcaaaatttttactagaacaaaagcaaagttgtggaaaacattgcgaaacgtgaggaacacactaatgttcaggtacgaaccggaatctttcggtttacctaatatgttatcaaaacagctactcaaagatgggcctgttttgggccaacgagatttgtttcagtcgatatcaacacaaattagtaaattaaagttctacgttttatcggtgaaagtcaacggtttcacagatccctggacctaaacagtttttttaaaaggtataaatttttttgctgaccaatatcgtcttcttcccgatctctcagcttcttccatttacaattctaccctttgcctcttggaacctttgaacgaaaatggcggaaacgatcggctcaggtacatctttcttttacttcttcacctttctcaattgaatctttcgtatgtcaacatgcgaatgttctggaactaaaaatgtatggacgatatcgattgattttgtatagtgattgattttagatatcgtcaaaacctttagtctttaatttcgcagcgtttttataattgtgcagaggtttcgtccatgtctgacaaatctgccaaaatcttcgtcgcgggtcatcgtggtttggttggatctgccattgtccgcaagcttcaggaacaaggtttcaccaatctcgttcttaaaacacacgccgagcttgatctcactcgtcaagccgatgttgaatccttcttttctcaagagaagccagtttatgtaatcctagcagcagctaaagttggtggtattcacgctaacaacacctatcctgctgatttcattggtgtcaatctccagattcagaccaatgtgatccactctgcatatgagcacggtgtgaagaagcttctcttccttggatcatcctgcatttaccctaaatttgctcctcagccaattcctgagtctgctttgttaacagcatcgcttgaaccaactaatgagtggtatgctattgctaagatcgctgggattaagacttgtcaggcttataggattcagcacggatgggatgcaatctctggcatgcctactaatctctatggtcctaatgacaatttccacccggagaattctcatgtgcttcctgctcttatgaggaggttccacgaggcgaaagtgaatggagcggaggaagttgtggtgtggggtacaggtagtccgttgagggagttcttgcatgttgatgatttggctgatgcttgtgttttcttgctggatcgatacagcgggttggagcatgttaacattggaagtggtcaagaagtgactattagagagttggctgagttggtgaaagaggttgttggttttgaagggaagcttggatgggattgcactaagccagatggcacaccgaggaaacttatggacagctcaaagctcgcgtctttgggttggacacctaaggtttctcttagagatggtctgagccaaacttatgattggtatttgaagaatgtttgcaaccgataagttaatggtttctcttctcatatatacacaactattgagtctcaggtaaatcagcttatcaccacattgtgatttaaacctttctttgagattcgagaattgcttttttttttatcaaaattgattcatttagagataagacttgcttctttatacaacattgtctgaggaattttaattttggatctccgagtatggtctattattagctctcttctatacaaattatcaaaacagttgtaagaagtttcaagaaaaacatttgatatctcactaatttggctatccttgcaagttgcaacgctaaaatgacaaataatgaattctcggcccaatgggcttacacaagccttgttaaagatagcgtgaacaaaacgcggctcactagccctaacctgtctctctttcgcttaccttcttcttcgtcttcgttggctcagtcacttgacttcacggccccgctcaagctctgacacgaaactcatttcaaattaatttaataaaaccttaatcacaaaaggggcaaaagcaatcgccggcgatt

SEQ ID NO: 10923 - DNA, 3000 bp, Unknown
  misc_feature (1)..( 3000): cDNA_ID_3038551_gDNA_ID_2214462_Annot_ID_182802 3000 nt of promoter + ATG
gttgggtcgttgctatatggttgacggctatatttgggtttattttgaaaagattatttgtttgtatgtttttatgttagaagatatttttttttctttaagtcgaagggctatttagcaaaaaacctatgaaaaacaaactaacaattatcgagaggtgtttggaaagaaatgatcagaaatttgtctttctctctttcttttgtactttatagatagaaacattttaacaactgcatatataaaagtcaatgatccaaaggcaaaatttctacaaatggtaaaacgtcgtcatttatgcagatatggtaaagtgaaactgttgcagaaaactgagtaaatcaatattagaagaatgttcatgtttatttttgtaatgaagataaatctacgactctatgtcttaagccttttaacaaaaaaaaaaaaaaaaagagagagataagtctatgattttgtgcttttggatctcttgggctactctaatagaaaacagattttttgtaggatcgcattatcgagaaattaaagttggcaatattgagaaagaaattttcatcacttgaagcacatactgacatctactcattaaattaaaagttttataattcccaacaaagatgatcatgcacatggcaaattgaatttatatatgaatatttgcctagagagaaagataaatacatgacatgtaaggattaggatcggatcaaagtctatgatctattacgtgtccattaattaggttggttaagtcaaattgaactgcaatagacactcaaaaagcataaacaaatcttggtttgcattctttgcaaattttctatatctgaaaacgttattgaaaccattgagcgaaacataattgttttaagaaattcgagttgtaatttgtcaggaacggagaaaattgaaaacatgctaaatcaaactagaatagcagcaaattttaatccaaaatccacacgtcaggacacagtgatctcgactcttaagttaatagcttccaccttcagattagtcaaacactttgaaaaaaactgagcttaaccaaaatatataaatcaaagaaacgtgtgtagaatgttcgtagatatgatcatgatcatcttctcaatgtgtagtatgcttaaattcatataaatattgagagtttaaagttcacaagctaagcatacactagctatcaagccgcctcacctactctccaatatccattggaataatcatacttacgtgtttataaataagtattacatcaacccatatcttcttcatccacaaataaccattggctataattatgacaaaaactaccaaaaccatgaatcctaagttttacttggttcttgccttaaccgcggttctggcctcaaacgcatatggtgcggttgtagacatcgatggaaacgccatgttccacgaaagttactacgttctccctgtcatccgtggccgaggcggaggcctgactctagcaggccgcggtgggcagccatgtccttacgatatcgtgcaggaatcttcagaagttgatgagggcattcccgtaaaattctcaaactggaggcttaaggttgcgttcgttcccgaatcacagaacctcaacatcgaaacagacgtcggagccacgatctgcatccagtcaacctactggcgggtcggtgagtttgaccacgagaggaagcagtacttcgtggttgctggtccaaagccagaagggttcggacaagattcgttgaagagtttcttcaagatcgagaaatctggagaggatgcttacaagtttgtgttctgtcctcggacttgcgactctggcaatccaaaatgcagcgatgtcgggatattcatagatgaacttggcgttcgtcgtttggctttaagcgataagccgttcttggttatgttcaaaaaagctaatgtgaccgaagtttcgtccaagactatgtgagaggacaactctcgatcttttactttgactactcataataaaacctctatgttttttttttgataaaacacccgctctctgttttcttgaaaactacaaattgaataaaagctagtgaagcacatgcctatttattaaatcttcatcttctctcaatcttaatgcccgatataaatcaaagggatagagtggacgtccatttaaataaaaccagctaacaatacaagcccctaattattgttgtgtatttaataagaaaaaggaagcttttaaacagtacccgttctctagagaattctgatgatggtagtgatatagaaaatgataaaaataattaatactctagtctctagattgactaataactaatgttttcatttagtctaatgactttagttcagtttctctttacataatctaattgatttttttatatatttaaattctcttattctttaatttgaattttatttttgtttatataatagcaaaagtgactgaatcaatttacaaaatgatatttaggtaatttaaaaaacttttgaaaaattgaatctatgaaaggttagtttgcaaaaattctgcgtagaaatttatagaaaaatattatttttgtcctcaatgcatggaatcagttaagggataattttatgcaaaacaaagaaaggcttatgaaaatgtgtggcgttgcaaaatttttactagaacaaaagcaaagttgtggaaaacattgcgaaacgtgaggaacacactaatgttcaggtacgaaccggaatctttcggtttacctaatatgttatcaaaacagctactcaaagatgggcctgttttgggccaacgagatttgtttcagtcgatatcaacacaaattagtaaattaaagttctacgttttatcggtgaaagtcaacggtttcacagatccctggacctaaacagtttttttaaaaggtataaatttttttgctgaccaatatcgtcttcttcccgatctctcagcttcttccatttacaattctaccctttgcctcttggaacctttgaacgaaa

SEQ ID NO: 10924 - DNA, 2532 bp, Unknown; identical to SEQ ID NO: 10910
  misc_feature (1)..( 2532): cDNA_ID_3038558_gDNA_ID_2214462_Annot_ID_182798 3000 nt of promoter + ATG

SEQ ID NO: 10925 - DNA, 2596 bp, Unknown; identical to SEQ ID NO: 10918
  misc_feature (1)..( 2596): cDNA_ID_1989677_gDNA_ID_2214462_Annot_ID_133012 3000 nt of promoter + ATG

SEQ ID NO: 10926 - DNA, 3000 bp, Unknown; identical to SEQ ID NO: 10917
  misc_feature (1)..( 3000): cDNA_ID_2175085_gDNA_ID_2214462_Annot_ID_133013 3000 nt of promoter + ATG

SEQ ID NO: 10927 - DNA, 3000 bp, Unknown
  misc_feature (1)..( 3000): cDNA_ID_2180565_gDNA_ID_2214466_Annot_ID_133014 3000 nt of promoter + ATG
tgtagcgattatctgttcaagcttttgttgatcggtgactcctctgttggaaaatcgtgtcttcttctccgattcgctgtgagtttgacttgattttgattcttaattgattccgtcgtcgagaattagctcgtgttaggtttcttcttttgtactgtttcgtgattttgggatttgttgctatttctaggatgatgcttacattgacagctacataagcaccattggtgttgacttcgtaagttcattctttgaccttgtttacatacatgatcgagattgttttatcccaaacttacttataatgtggttggttttgcagaaaattaggacgattgagcaggatgggaagacgattaagctgcaaattgtgagttttcaattatataatatgttttggatgattgtgtttactcaattttactgttgctgctctcttttagtgggatactgctggacaggagcgtttcaggaccatcactagcagctattacagaggagctcatggaatcattgtgagcaatctttatattcgctttcttacttgcttttttttggcttacctagactagtgttatgtccctatttccatttctcattttaagtggtttagtctgagattggtattgtaatgttggaatatgaatcattttaatgttgtaatccaccctttaagtgatgaaccttaatgatgataattgcaacagattgtttatgactgtactgagatggaaagcttcaacaatgtgaagcagtggttgagtgagatcgatagatatgccaatgagagtgtttgcaagcttttaatcggtaacaagaatgatatggttgaaagcaaagttgtttccaccgaaactggaagggtaagctcacatccctagttaagttcccagcaatttttccatttatgattttgcttctatcttatgcataacatcctttgcatggtactttcccctttcctcatttgatcatttcatggtttcgcatatctttaaccatgtgatgatattacaaccattgagattgttataccagaatttacggctatgaatgtagatgatctctgaccaaattcccaaagctagatgatctgaatccaccgagtagaaattgcttatttttgcagcagctgttactcctgatacaactgtgaattggttttcttacatttcatctactcaaaatcactgcaggccttagcagatgagcttggaattccctttcttgagaccagtgccaaggattctattaacgttgaacaggcattcttaactattgctggcgagataaaaaagaagtatgttcactatctttaatctttcgccataattttttctgcgaagatttaacatagattaggtttagtaaacttgttctattactatattccttgatcaccattatatacatcaaatcattctctgtgtttttttctgctgcaaagcatcttgattctccactgttttcatgaaataaactattcatgtaaagtttcaaatccgaagtgtgctattctagacttgatgactaatggaaagcaaatcaacaaactaactgctgtatccttgtagcttcctcaagcttgtgtacttaacttctgttgatagattttccatatggttgatatcttgtatcgacatttgctgattcagtctagtttatgtaacatggagaattgagtctaatcatatcgtaactcattttctttgcagaatgggaagccaaacgaatgcaaacaagacatctggtcctggaactgtccaaatgaaaggtcagccaatccaacagaacaatggcggttgctgcggtcagtagtttaaaaaatgttttaatcaaaactatctgagactctttttttacttcctttttaactaagtgttgtgaaaaccaatggctgtttaaaacaactaagaaatgtaatattccatgtcgctgtgtcttgaataagctatggtgttagttgcaagatacttctctttaatatagttcagtcttgactttgaccacacagggatatgcaagcaactcatggttttgaattttgattgtgtatatatattaaaaatagtgatagatattcgttgctgtataggctggaccatgttcattaccatagatatttaaaacttgcagctaagtccatagaatgaggaaaagcaaaaacaacatatgagagataaatctcaataatgtaaatgctgaattatatatacttcaaagatacgagtccaaatcaaattcttccattttcttacgctaaagtatacggatttccaaaagaagatttgttctatttcgtttacaacgcaattctagtttataataactcatcatatactcatgtggtttcaaaataccccaaatgcatgtttttctagaaacaatcagttttctgattttgatgaaatcaatcatacctagattcattcatttactcccacaattttagaagaaaatctcattcctgcacatccttatttaaaaaataaaataaatcaaaagtgatcttatttgtttgtgtttaagttttataaattcatttttttttgtttgaatgataaaaagacagacaggaaagatctcatgacaacgacagttaaccgacctggtccctctaaaataaagtctgacacagactctcaaactttgtcaaatccaattcttattattattggtaatgagactttttcttcacattctccagatatgtatattcccgagaaaatgagggaaagtatcttctaatcgggaaaaacatctccacgttccttgcccgtctcgtaggttacgcatcagcagctgggttttgtctggcaaaactataaccaaaagcttcctttcttataaattgccttacgttttaaggtgttctcttctcacttcttccccatgattcatcttgactccacaaattcagggcaatctttgattctctttggtctttgatttgaggattaatttgttttctaaaggtgtctgctgattcaattgagtatg

SEQ ID NO: 10928 - DNA, 3000 bp, Unknown
  misc_feature (1)..( 3000): cDNA_ID_2685834_gDNA_ID_2214466_Annot_ID_133015 3000 nt of promoter + ATG
tgattcggcaagaaatctatcaaactatcgtgagtgtaattgatttgcttattttaacagagagagaaatgtttgcgaagacaaatagacgtcgtttattggcttttttagtggctacctctctcagcttccatctctggggtaatgttgagtttttttgctgttttgtggtaaagagcaaaaaaaaaacaaattcgttgtaatttttttttcaaacatcagaatttaccaagaagaaaaatgctcggcgtgaagaaaagaatgaggtaatcaattgtttattattggttttcaacatttggaagatttaatggagttgaaataccaaaaaacttaaatagagaaacttatacatttgtgctttctctgatttgcaggcgaagaaggtgcagcaggtggatctggaagaattaaaataagaaaagattatgtttgatgcagtgaacaaaacgaatgttaatgtgtttagttactttatgttggattccctttgtgtttaaatccaacataactaaatgatatattcatagcagaggaactatcttgctccagatatatagaattagtttactaattgtaaggagacacatttcattggaaagaaatggggacaagtaatgttccaattcctcatcatcacccaacatgttgccatatttagatccgagtatgttttttgacgcatcactttggcatatcatttctttatccacccccatttagattctattaaaggaatctccaatggctgaaacttcagagatggtaaaactaagttttgagacttttgatacctgaagatgtttgtctacctccacaaaaaagtttggatttgtctttcgcacattttcttaaatacggtttcactattataatgatataaattgataggccttggtgaaataaatcactaaaaatattgtaataattaacatatactgtactatgttttcgagtattatttagatttgcaacgcacaaaaagaaattagttgataacttaatctagtcttctgaatcttctcggttaatgtcatcgaggattacaatgagagaaactataaaagcaaagtcaacattcggatagacagtaaccgaaaaattactcttcccaattaatatgctttgtgccgtatgtttcttgtgcatctgaaaaaaacaacaaaacaacaacaatgactcaattaacacgatcatataactagctagtccggtttatacaatttacagacaatttgatcagtgtaattacctgagcaacaatggcatcagatttgccggcgtagacgacacaagaccggtcgatccaacttcctttaacatggaagtcgcaaatcttcatttctttattatgagccaaaaagatgtctagttttggcttcattatttgaatcattgaagatcgtttcaatgtgtataatagatcactttggtctgtactcttccctctatatactagccacctatcatgcaagctcaccttctacaatttttatgttataagaaaaaaaagttgtggatcagattttattggatgatctatgacgatttaacatactcgaatgagtgatgatgattttgatattatttacaattagttgatagacgtattgaaaaagtgtacctccatgcaagttataagagcatgtttgtgtatatatgatttgcataatgaaattttttttttgtatcaccatgaaaaaattgtgcctctccatgcaagttataaagaattgtagttgatagacgtatacttacattttctctcaaagtcaagattggagtatcgtatgcgtccaataaaatccttttgtcgctgatgctaaacaaaggttccttgactttgaaaaggagattgccgttaacgtccgtgacggcgaagttaccatcggttaaagtcatcaccttccgtacgattcccaactcgatagggtacggtgcacagaaattagggctaacgatcgccatctttttgaagatctctctctgttttttttttctcttttacgattcttgtataaggtggagatttgtgttcgtttctcaatctttttagttatttataattaggatattccaagtattgtgtgaaacaaatcttcgtgtttttaattttgtgtttttggctatatatgttttgtttatttttagaacttatcttattttaaatctgctagccaagttgcaagctgcaaacacgttagcgttactacactttttttttttggttatataaaaaaaaatagtttgatggaaaaaaaatattataaattgaggaaatatcttcttttttgccagaaaaggaaattagaagaaacgtaaaattagaaggtaacttttggtaggattaatatgacttaattaaaaatgatatgaatggagtatgaaaaagagaatgattttgttgataaaatatactgtcatataaaattggaaaatccatgcatattcaatcaaagtttttcttttctttttcaatatacctttttaatccgctttaaatacttcattatatttaattcctcacatcttgatcacggattataaatcaaatttatgtaaaattatcttctctaaaaaaataaaaataaaaattgagacatatacatgagtaataaaatccaaacctttaataacagggccaggacgttaacgacggttaagttagatagacaagattttgagctcggcccatttatcaaaaagcccaaataagaagacacacacacgtaaagaaatcagtgagacaaggtcaaagcttctttattgtctcgggaaaaacaacaaggaattaaacaaatattaaaaaaactgggaacaaaaaaatccagtagaagtcgtggggttcaatgttcatgtaaattgattgacacgccccctaaacccaaacctctctttttttttgtttcttatattatagagaaaaagagctttttcccggaaagttgttctcatcttggaaaatcaaatctcggaaacgcagtcttcagctaaatcatg

SEQ ID NO: 10929 - DNA, 3000 bp, Unknown
  misc_feature (1)..( 3000): cDNA_ID_2716933_gDNA_ID_2214466_Annot_ID_133018 3000 nt of promoter + ATG
tcagtttgtctccaagatttgactctggtgattatgttccacgtaaaactgcttatataagtctttgaaacataaagcaagagtcttgtgacaattcataaacacaaacataggttctgccaaaataattctacaggaatgcaaacagaaaagagactaaagattaaaaatctaagcaaggactatcttaaattattttgttgacttaaacacaatttaaatctctcaaccttaatcatccagctgactctaaaccaaactataaaccaccataactcgagattttttgccaccgatatacgattttaaaaggaaatttgtatatacctcgtcgctccaacgtcgccggagccgtggtctccagtgagctatgcatcttactattcgcagcaatagattttggatttagattgcgtctgagagatggagagaaatcgaaggatatcagtttaaatttgaaggaaaacgaagtagatggtaatggtggcccaatctcatgtatttataggcccaaattttaagaaatatttattattttcttctttttttgtttcaataatatatattacctgtttcgacgaaaaaaaataaaaatatttattacctttgatatatgtatgttttagaaaatatattaatttcttttggattcatttcctttaaagaatttgtatattcattcatcactatccattaaagagtaaaagttaaatattatagtaactggatttttcttctatcaaagtgttacttataaaattcttttttttttaattaaatataatccaatttttttctcattttgtctatttaatcctactatattatttgggaagtacattttaaatgtaaccttaatttttgtaattaattacataggtgtgccattaaaaataaaatttcaaagagtaaattaattcatctctttaaggattaaaaagtcaaatactaatttaattaatttaatttaattagaaaaacgaaatacattattaatttctaaaaaagtaaccaatcaaaatcaacatattagatttgatatctaaattatcatattaattttttattaattattatacttcacttctcatctttatatgattctatttttccgaaacaaataatatcatcatatcatcggtatatcaaaaaaaattagaattattttgcatataccatgatttgaatttttaaaaacgaatataaactgttttatacatgaaaaaatattataacgggttaaaaatagatttaagaaaactttcgactgagtaacgggtcataatttgtatatttattcaatttcatacatattattttgaaaatttataatcttatatactacaataattaataacatattagatatttttaatgtgtatgatgtgattcaatctttaatacaagctataaaatcttagaattgacaggtttagatcgatattaatacaagatggtatgctatagatgaaactctaaaattaacaattaaaatacaagtgtataatcttaaacactaaacaatataaacaatatcaacaaaatatataatactcgcagtgtactatacatttaaaatcaaataaaataatatcatatatttataaatcatctttacaaaaaaagtttttaatttaactaaaatataaacctacccgcggtataccgcgggttaatatctagtacctagtataaatcaatttgattgctacttagtgctaatattaaaggaaaatgaagtttcactttatttcaagggatccacttgacattttgctttatgtaaatttttatttaaattatacatatttaacattataattaattgaattttagagatctagtttattgtgtgataaagaataaagtttagtgctaatttataaaataataatttataaagtcatgacatgtataaaaagaaaaaaaatctttcactattgtggctccatttggaattttgttttagttagattttatacactaattgcaaaagtaacacctaatttttttttttacaaaactcgtttttggaccaaattttaatcggataaaacggatgaccatgcgtaatgcaaagataccgtatgttcctttagtgtgaagcataactatgaccagtgaccaccacatttagtggcatgaaccatgttgtcccataaataatcatgtaaagtgaaactaattttttggataaataataataagtgcaagaagaaaggtaagtaagtttcaattaaagaatcatgagacaaaaacacatggtctacagattccaacacatgcaaccaaaattgaagtaatttatttttgtctaattgataaacaaaagtaaaagaaaaagacaaaaaacggaatttgttaacgccgttaagcagccgcttcccccacccgtgacgttgaggatatgatcaaatcaaagaattcaatataaaccggatttattaaaccacggttcaattagtccacgcattggtttaacgccggtttggttcgttctatccgtcagccactgggctctatcgttagagaaagagagagagggacagatctgtgaagttgggatctttctttttcactttcttcgttgtctctctctgtctacacgcttgtgcttgtgttgtgtttgtgcgccactttctatctctactgttttcttctctcgtcacggcttaacttttgcaatcttttagctgaagctaatttcaacaagttgttatttttgctttcaattttcttactttttgatctctcttttccacgaaacctcttataatagatttctcatttctgggtctaaaatctactttctatttttgggcattgatttttattcttagataaactagattgaaggcaaagaaaccatttttttttttttttttttctagattctctctaggtttccctaaatttctcaactactcctaaagagttttgttacgtttctgtgtgattctcctttttttcttgacgactccaaatttcgtttttgcgtaa

SEQ ID NO: 10930 - DNA, 3000 bp, Unknown
  misc_feature (1)..( 3000): cDNA_ID_3055875_gDNA_ID_2214466_Annot_ID_133020 3000 nt of promoter + ATG
aagctgattcaacaacaacaacaacccaagcaagaatccaattcacatagagcttaactgcaatcgcaatcgagataatcgttactagggttacgaaaccttggaaatacgaagaggcgtaatcgaattctacaccgggaatggtctcaataagcttaaccaacaagaaagctaaaatccctggaatcagaaaaccccctaaaactataagattcgatgaggtcaaagtagcgagaagaggtaaaaacgaagcgaagctcgatttcactgcagagttcaatttcacaggtctaccatagaatccttgaaacacactataagcgattgatccaatagctaagagattgaagacggtgataacaacgatgtaaccgattacaagtaagaccgttgttttggtatcgatgtcatcatcgttgttgttgtggagtccgccgcggaggagagagacggtgttgtgagaagcggatgattgatcggtgatgagaaggaagacggaagggtaaactgtgatggagaagcagagagggaggaggaagagaacggagagagctaggaagtgacgtgagtgtgcgttgatgattcgttttgattctgataagattatccagagattcaatggaggaggagatagagatggagttggagtcgccattgaagcgtaagttagtagaagaagaattttttttttttttttttgtttcgtcaaagaagaattttctttttagaacagggagtatatgatatatctgagagtattctgactatttaattcatgaaaaagttaaacgcccaagtaataaaatacaatatatagcaaaaatcatacggaagaaataatacaaagaaagcaggtgaaaaaataatacaaaattacaagagtagcaacacacaaaggagaaagaaagtcatcagaagatgttcttgaatgggttggttagtgagtcctttagattggagtagaggccatagagcgagtactgcttcagatttgcaacctcataccacgaattcaacgcggtgtagtgcttatccgtgcccgaaaacgccaattggatccccaagctacaatctacttgtcctccttggttcttgcagttttgcggcttgatcgcacattcttctttgttgaggcacacgaatttcgaatctccagaacacttcgagcatccgtctttcttccagaacatgttctcaagccttcctttctggaactcaagaacctagaattcacccaagatatatgacgattacataactaataagagatggaaactttctataagaaaaatgaaaatgaaggttgatatgagcttatccaattacaagggtgaagcttgtcacgatgtgattgctgtctgcaaccataattgggagtgatcttgcagcgtattttgcaccagcgaatgctaccatatatcccttggaagcatcctggaatcacaaagtatcatcagacaaacaaataatttgataggctaacacattcatgacctctacttccgaggataaacaaaaatcgtatagtaatgttcgggagaaactgtgacgaagctactactaaaatcactttttccagaggtatctacactgaaagtctaatgatatacacattacaagttaacctgatttccacctacttcgtcagaaaccaaactcttaatctataggaatctaacatggcaagtctctgttttgaacctttcatctcactgaaacaaatgcagaaaggaaccagatcgtccaagaacagagcttaaaacctaaaccttcgttacctacgggaaaattgaatctaccaatccaagtaatctcgacaattagcttagaattccagagctaacattctaagccaggatttagacaagtcaactaatctgggcatatgattccgatctatactaaatttccttaagagtgacctaatccattctaatctgatcaaaaacctgcaatcgaaaccctaattcaccaagataaaccagagatgagaacgaaccgggcggaaactggaggaactagaggtattgatggtaaggagtgtgatctcatcgactttaggtctgaacacggcgacctcagagtttccgttgagcgagagatggcgatgatcgcagggagagtactgaacggatttggatcgatttgtactgaagaaagaatctttcgcagcgaaggcaatgccgaaagtgaatccatcgccgatcgcaacagtagaatctgaacaaggcgagtagacttgattattgtcgccggcctccgtcaatgatgacgtcagcaccgccgcgaagaggcaacagagaagaaagaatctagccatctgtcagaaaagctcccttcaaaattttcgaaaactccgattcaaggacatgtcttcaaatatcattaatcaaataagcctttaaatatttgggcctgacttcatgcggcccaaaacaaaatatgcttttttaattatataaaaatatacttagaggcactaatttagatattattgaaacctgaataatttctttagatttttcatatttttaaaactcttgatttcgtgttggataagagaagtagattcgttgaattagggatttgttttttattttccaaaaacaatgttcaattatgtgctgtattataaaaatagcgtcaaatctgagctggcaaatacaattattattttggtgccaagtgggtaacttgaattgaaatcgttaaacaaatcccacctaacagtttgttcactgctaatcctatgtcattaaccacaccgtaacagattaattacgaaatctgaaccgtttattttaagtaatcatggacccacgttaatgaacggataagatcaatccgacatttcttgcgatttgagaatcccgattccgcatttctgtctttgtctcttgcttgtttagtctctcctctcctcctcgtcctcaatcatcatcatctgagaattcgcagcttttgcttcttcgatagaaaatctaattatcatcaatcatg

SEQ ID NO: 10931 - DNA, 3000 bp, Unknown
  misc_feature (1)..( 3000): cDNA_ID_2716924_gDNA_ID_2214466_Annot_ID_133022 3000 nt of promoter + ATG
cgtggatgtaatgatgtactattggttaaagtaggctcagctttaaggttgcaactagaactaaccacagctctataaaacctaatcaataattcattactttgttttttctataaatggggggattcatgaatggtccagaatgagaattttcaaagggtttttgatcaacaattatgtatagcaggagagtgtattttatacaaaataaatgagagtggttccatggtatagaacaagatggtgtatcccgtcgagcaaatcagctctacatgtcggccacggaggatccaaatccaatatcaaatgagaacttgatgcaagttaactccttcttgcgtccatcaagcatcttcatttttagtgagtatgaaccctatgagaaagaaaaggattagactggtccttccttagatgcagaaacacaaaacgaaagtttggtatgacaaacatataactatagaaaccataaccagcaaatcttgacaacaagaaggttaaacttcttcactttagccgcttaatagacataatacttccacatggaactcataatatgctatcgaaaccaagttaaacctcttctcagtctatttcagttatccaactaaacagattcgattacactaggcaatttgttatgactgcaatagaattacatcaacttcaaatgagcataatgcatcatcatgtcattatatccaaaatgcttcgtattaatcaacaaaacccgcatagataagtagaaaaaacttacaggaggggtatatccgggaagaacttgcgagtgcgctaccaagaaatctccaatggccacaggacaacttgtctcatcacaaagatcatgtgtctcagaatgaatatgccatccaaagtaggaaacttcgatcaccaacttgccgctcgagatctcagtgtcttcatataaaacaaacccaaataaaaaaacccatcataccagtaaacccattacatacatcaaatgcaaaactataaacacaagtaatagcctcataggtaaatttgagtatacctgtgttagcagaaattctgaaagtagctggctcgcctctagctataggataaggagttatatcaactccttgtacttttacttcatactcttcgttattatctgcaaccaaacaatcaaaagttccccacaaatcgaattcattataacgcaacaagaggtcaaaatcaacattggatctttctatctaaatcttatcgcaaaattatagctaactcaatcaaaatactacaaggaaacaattggaaatcatgaatcaagttaggctttttgggaatcgaaagacgaaacataccgcagtagtgaacatcggtggctgcaacaatcgttgaaaccaagagaaaataagagatagcgagagatgagaatcccgtgaacttagacatgattgatgataattagattttctatcgaagaagcaaaagctgcgaattctcagatgatgatgattgaggacgaggaggagaggagagactaaacaagcaagagacaaagacagaaatgcggaatcgggattctcaaatcgcaagaaatgtcggattgatcttatccgttcattaacgtgggtccatgattacttaaaataaacggttcagatttcgtaattaatctgttacggtgtggttaatgacataggattagcagtgaacaaactgttaggtgggatttgtttaacgatttcaattcaagttacccacttggcaccaaaataataattgtatttgccagctcagatttgacgctatttttataatacagcacataattgaacattgtttttggaaaataaaaaacaaatccctaattcaacgaatctacttctcttatccaacacgaaatcaagagttttaaaaatatgaaaaatctaaagaaattattcaggtttcaataatatctaaattagtgcctctaagtatatttttatataattaaaaaagcatattttgttttgggccgcatgaagtcaggcccaaatatttaaaggcttatttgattaatgatatttgaagacatgtccttgaatcggagttttcgaaaattttgaagggagcttttctgacagatggctagattctttcttctctgttgcctcttcgcggcggtgctgacgtcatcattgacggaggccggcgacaataatcaagtctactcgccttgttcagattctactgttgcgatcggcgatggattcactttcggcattgccttcgctgcgaaagattctttcttcagtacaaatcgatccaaatccgttcagtactctccctgcgatcatcgccatctctcgctcaacggaaactctgaggtcgccgtgttcagacctaaagtcgatgagatcacactccttaccatcaatacctctagttcctccagtttccgcccggttcgttctcatctctggtttatcttggtgaattagggtttcgattgcaggtttttgatcagattagaatggattaggtcactcttaaggaaatttagtatagatcggaatcatatgcccagattagttgacttgtctaaatcctggcttagaatgttagctctggaattctaagctaattgtcgagattacttggattggtagattcaattttcccgtaggtaacgaaggtttaggttttaagctctgttcttggacgatctggttcctttctgcatttgtttcagtgagatgaaaggttcaaaacagagacttgccatgttagattcctatagattaagagtttggtttctgacgaagtaggtggaaatcaggttaacttgtaatgtgtatatcattagactttcagtgtagatacctctggaaaaagtgattttagtagtagcttcgtcacagtttctcccgaacattactatacgatttttgtttatcctcggaagtagaggtcatgaatgtgttagcctatcaaattatttgtttgtctgatgatactttgtgattccaggatgcttccaagggatat

SEQ ID NO: 10932 - DNA, 3000 bp, Unknown
  misc_feature (1)..( 3000): cDNA_ID_2716902_gDNA_ID_2214466_Annot_ID_182848 3000 nt of promoter + ATG
cggccactgaacttcttcgtccataaacaccctgaaacacctcatagccatttcttccatatttcatttcattagttgatactaacaacctacgattaaccactttcccaggggtttcgttctcgtcgtatttacggagttctagtgatggtaacattacaggtaacgtcttgtttatattctggtctgaaggaactgataagacttttgactctgaatttgttttctcgttttcctctcctaatcctccactaggatctgacttcttctctacctgctcatttttagtaccatcctctcctgatgctgagacacgaggagctgaatttttatctctcttcttctcatttacaataccatccaaacctttgtctttcgaaaacctcaggaagacacagaccacaacaacaagaagacccacaagagagatggccaataaccacattgatgaaaaaaaaagcttggtctcttgaagaatacaaagtttttgctatttgattctcttgctctgtttgttcttgtgtagtgatttatgctgtgaccccctctctgtttttatagccgagagatgacttctctgctctgctttttcctttacgtcaacatcttcttcatccaaccccacacgcttaagagcttgatttatccatttttggatagagcttttgcagttttctgtcaccatcacattcgctctagctttttgttgattgagtaaggaggagtcttgtgtatgtggaacgatttagaattatttttactatacaaagaatatacaagaagtggtttctagtagcacacacgtttaagaattcaaatccaactaattttttggttttagcttgctttggttgtccttttctagtgctcattgagtaaggaggagtcatgtgtatgtgggatcaatttagaaatacttttactaatccgagttagagtgaaatgaagacattaaacaaaaacacttggtagtctctaaagcttttttgctgattgggtgatggacgtgtcatgatgtgtatgtgcaacgatttagaattttcttttgctaatctgagtaagagtgaaatcaagacgtttaagtaaaacacttgggagtctctaaagcttttttgctgatggacgtgtatgtgcaacgatttagaattttcttttgttaatctgagtaagagtgaaatcaaaacgtttaagtaaaacacttgggagtctctaaagcttttttgctgatggaagtgtatatgcaacgatttagaattttcttttgctaatctgacagagtgaaacgaagacgttcatgaaaacaccaggagataatgaggtggcagatagggccatttttgttggttgtgtaaaattatttatactagtgtcaaaatgggtttcttttaatactctaatttgctaattgttaatacttattaggagattgataaatattttttaatttagaagttacatatctttactaattgatatttttgataattgatatattttatactagttttataaaatgatatattccggactacatatttctgataattgatattttttaaagttaattattatttttattcaaaaaagtttctaattatgtgacaaaaatatgtggtgttgtactgaatactctctaattaaaagctagcctatatggtattgttataagttgtgtgtacacataaataaatataatatatatagtaactttttaatctatctatatcttgtaattccctttattttctcgccgtctccattcaattttattcctttcatctttttaattttattttattaactatgcatttgaattttgtttttcaattttttgtagtactcttctctgttttagatttcagtattttttttttatgctaagatatattttctgctcttctgagatttgataatctatcattttaattatttacagtttgatgacatatcttaacataaaatatgttattttttgtgagatatcttgagatatgttattggacctcgtaactttgtcaaatgttttggctttttgctatgaaatggaaattaaaagtaaaaaatgtcaccaactgttttaaccgctaatattaataaaatgataaaattttggcaatgtcctattaaattttttatctaacaaataataatacataaatttaataaaattgaataacttaagaaattaaaataatcattgagatacaaaattgaaacactagatttaaattctaaattctttcaaattcaaaaccaagccttcttctttttagcatcctattaatataacatggaaaaagctgaactgaacataatatgctaatatagaacagtaaagtctgttattctattttgtattaatactgtactggtttctgtaaaagtatatatcaaccttgagaaagagtagagcttaacgaaaataagtaaaaataaagcctggtgaaaaagaaaagaaaagaaagaagtaaaaataaagcccatgaggttaatgacgggaaacgacgtagaaagtggaggtcaggcaataaaagcatttccatcgtgatcagatgagaggaaaagtatgagagaaatagaaacggcacactacaaaaataagtacttcaaatctctatatacaaaactcctttgacatatgttttttaatgactggttcatcatttttcattgatttaaaattttaaataaattatattaaaatattatacttaaaagactcaatgagtttctcattgataaagatgctttaaggggtgttttttaaaaatgtaaatctttattaattaaagaaacatacaaagtaaaccatcattaatgagttttgtagtttttcaaaaaattatactatattgaatagttacatgtgattaggagattgaaaaaaatacaaatgaactaaatcacctattggaaaaacaaaacgtgttttttttttaatcactgtggcaatttcgtagtttgataaagaaaggtcttctttaaaagcagggcgagaga

SEQ ID NO: 10933 - DNA, 3000 bp, Unknown
  misc_feature (1)..( 3000): cDNA_ID_2716918_gDNA_ID_2214466_Annot_ID_182843 3000 nt of promoter + ATG
tgttcttctggtaaacccgagcggtttgtagctggtcagttccgcctctgataaaggagctagctcgacccacatgactctcgatgtcatcaagctgagctccctggtgctctaccagcacggccatgtctagaaacacctggtgaagctccctgagattcttctcaatgtctttaaccgcatcatgcctttcttgaatctcgttaatggtgtctaacacccttcctcttccttgttcttgtattgctttctgcaagaatctctcactctctcctgcaacaaaaacagtatcaatgtcgcaccaccactcatgtaacaacatgtctaagtatccagagatcaattccagctctaacagctaggaactagcacaacataagatatacaaatccattttcatagtctaaacgcaaaatctgaagttactgttcttcacaaccacaacactgtatactaagaagcctggaatcagtgttcggaaaccaattggtcatcatatgttaacctagatgatgattctacttgaatctggaagtgatttgaatggaagattaaactaaccagtggaaatcagtcgatctagggttcgttcatccggattctcgccggtgacggtgaagtacctcctctgtacagtttctctatactcggacgagataagctccctcaatcggttgaaactatccatagagtccatcaatttcttcctgagaccattgaggacagaggtcctggttcgatcggaggaagaaccaggtccacagccagggagactccgattagcagcattggcacgatctagcgcctcgagtttaactttaatcatcttcgccttcttcaacgcgactccaacgtcaccgtccattttagaccggagatctttaacggctttagcattgtgaagcgtcttgctctgctcgtgacatgaagagagtgtttcgttgagccgatctagctcctttagctcttctttcacagattcaacatcttcgaagaacttgtcgaggttcacaccaccggttgatcccgcgggattcgccatctgaactccgtcgccaccgccggcaacgtctcggcgaggggatggttctccgctgcggaagcgagagaatgagctggaaaacaaatcgttcatttaaaattcgaaaaatagagaaatctagagagagatttcagatcggaatgaatcaacgggaagacttaaagaatggaaaaatgagaagaagtcgtacagattcaagtaggcggttttattgaaaagtccaaaaggaggattatgaggtaagagaggaagaagtcaaacaagtaagtctctattggttgacttggaagcttctgagaaagtaacaatggcggagaagggaaggtgaagttgaaagcgaaaccgtgtgcccttgtcccgtacgtgtaagtatatacggtaacagatcccaaaatcatatataaattggagaaagaaaaaaacattcgtaatttgaatgatttttaaaattttattttgtcggctttggatactttaagtttatcatccaaaggatacattagcccatacgaaacacttattgataaattgacttcagcagaaaacatttaaaaaaacaaaaatgttactgtatatcaaattaatttacataatttagaatcgtccatcgaaccaaatttaaagaagcccaccaaatccttgcttttctccgttaaagggccaagcctaaacccatagcccagtctttgagcaccggaaagcaattgtaatacttcgattgttcgatttgtaagatatacaacatcctaacaaccatacaccgatatacataaagaacaagtcaaatgttcaatatgaacaaccatataaaaatagaatcactttcctccctaatctataggatacccatatgttgtataaatcgttgattccaagtttcctatttaaagatctcaaacaaacaaaaaatatacaacatttttgcaaaactaattgttcctgatttgagatattttgtcatcagctggtaggttaataaatcagacatgaagatcatcccattgatgtccattgccttggtcatattcatgacgtcatttccggctcccatcaaagtagccggtggtgtgggtaattgtgaaaaggacatgcaatggtgcatagacaaaactgaattctttactcacggttacatttatgagcgttgttgttataatatgataatgaaaaaaaaatgtatgtgtttgtttctcaagtcccccaagctaaagatagctgctcgcaacgttaacaatgcgtgtggtcgtggtggtcttccaaaggatgcattctctgagttcaagtgttaaatatatagatacataaaagtaaataattaacaacaataaagcaaacatatttttgatcagatttgtactatgtagtttaatggtttgtactttgtagtcgttatgtttaataacttgtcaattgtccttatagttttgatagaagttagaacacataatatataagaacaattgtctagagagactaatgactaattaaactttgatttatcatgtagcttagttacaaacaacaagtattgcttcaaaaagtataatccttttgagttcctcccaaaagagccacctccattgccatcctttccacattagagtttaccaaattctaaattaacagagcaaaagtgaaaaatcaacaaatatatgcgtcgaaagccaatttttacataattttgtgtctgcataatttaactccattaaaaaagcatggagaaacttttaaataatttaattatgactttctaagtggggtccagaccataaaacgctgcgttttaagtgaaattatcggttcaaccggccggtccggttctaagaacatcggtcgatctagttgctcctatatgaacaacagaagacctaaaccctaactccccccctctctctctctctctgctccatttctctcactttcttcacatctctgaagctcttcgtcacgcatctaca

SEQ ID NO: 10934 - DNA, 3000 bp, Unknown
  misc_feature (1)..( 3000): cDNA_ID_1014176_gDNA_ID_2214466_Annot_ID_182840 3000 nt of promoter + ATG
aatgtttttttgaaagctacaccatcaacgaggaaagagtctcgcatattgccaccaggaacctgcagagcaaaccttgacattagcttagatgcatcattaacttggcttcacagtatagacacaaatagaaatgtgtttaccttcttgatcccaatcagatttagcctgtcgtcattcccaatggccataacagcatcaacaaccattgtagcaaaaaactccttttctccaccgataagcttagatgagagagtcgtagcagcacatttagccaataaacctttcttttcctctacactcttcccctcaatgctaacagcgagttctttaaccttggcaattgcctacatcaataattaatagtgagtaaggcaacaaaagaaccaataaatcaaaaagacttgtaattatactaacgagaaaaaattacaaaccaaagtgcttgcagtgcggtaactcctaattagattctgagcgtgaacaccatcctcaataaatggcttcgcttccttcaaaaactctgctgcaagaagaaccactgtagttgtcccatcacccacctaaccaaacaacaacaacaacagaagattcagtgttcatgaactcagtcactcattctaagatctgaatactagatcgcacttaatataaacactagagatctaatatggaatcgctaattagctcaagatcagtccaattacgattttttcgaaaactcagattgggaattaaaaaattgaaataaaacaaagacctcggagtcttgggatttggcgatatcgacgaggatcttagcagcaggatgaacaatgtcgaggagcttcatgatggtagcaccatcgttagaaatggtgacggatcctttatcgtcgtgaatgagtttgtccatccctcgtggcccgagcgtggttcgaactacatctccaacagcagtgcaagcgttgatgttgcttactagttgcgctttgccctgagatgtgtccgtcccttccttcagcagtatgatctgcggttgctgctcatcaaaccaaaaccaaagtagtggcacgttagtcagtttatagcacagagagtgagatagagagagaaagtgtgtgtagatgcgacttaccatcatcgatgccattgtagatgcgtgacgaagagcttcagagatgtgaagaaagtgagagaaatggagcagagagagagagagagggggggagttagggtttaggtcttctgttgttcatataggagcaactagatcgaccgatgttcttagaaccggaccggccggttgaaccgataatttcacttaaaacgcagcgttttatggtctggaccccacttagaaagtcataattaaattatttaaaagtttctccatgcttttttaatggagttaaattatgcagacacaaaattatgtaaaaattggctttcgacgcatatatttgttgatttttcacttttgctctgttaatttagaatttggtaaactctaatgtggaaaggatggcaatggaggtggctcttttgggaggaactcaaaaggattatactttttgaagcaatacttgttgtttgtaactaagctacatgataaatcaaagtttaattagtcattagtctctctagacaattgttcttatatattatgtgttctaacttctatcaaaactataaggacaattgacaagttattaaacataacgactacaaagtacaaaccattaaactacatagtacaaatctgatcaaaaatatgtttgctttattgttgttaattatttacttttatgtatctatatatttaacacttgaactcagagaatgcatcctttggaagaccaccacgaccacacgcattgttaacgttgcgagcagctatctttagcttgggggacttgagaaacaaacacatacatttttttttcattatcatattataacaacaacgctcataaatgtaaccgtgagtaaagaattcagttttgtctatgcaccattgcatgtccttttcacaattacccacaccaccggctactttgatgggagccggaaatgacgtcatgaatatgaccaaggcaatggacatcaatgggatgatcttcatgtctgatttattaacctaccagctgatgacaaaatatctcaaatcaggaacaattagttttgcaaaaatgttgtatattttttgtttgtttgagatctttaaataggaaacttggaatcaacgatttatacaacatatgggtatcctatagattagggaggaaagtgattctatttttatatggttgttcatattgaacatttgacttgttctttatgtatatcggtgtatggttgttaggatgttgtatatcttacaaatcgaacaatcgaagtattacaattgctttccggtgctcaaagactgggctatgggtttaggcttggccctttaacggagaaaagcaaggatttggtgggcttctttaaatttggttcgatggacgattctaaattatgtaaattaatttgatatacagtaacatttttgtttttttaaatgttttctgctgaagtcaatttatcaataagtgtttcgtatgggctaatgtatcctttggatgataaacttaaagtatccaaagccgacaaaataaaattttaaaaatcattcaaattacgaatgtttttttctttctccaatttatatatgattttgggatctgttaccgtatatacttacacgtacgggacaagggcacacggtttcgctttcaacttcaccttcccttctccgccattgttactttctcagaagcttccaagtcaaccaatagagacttacttgtttgacttcttcctctcttacctcataatcctccttttggacttttcaataaaaccgcctacttgaatctgtacgacttcttctcatttttccattctttaagtcttcccgttgattcattccgatctgaaatctctctctagatttctctatttttcgaattttaaatg

SEQ ID NO: 10935 - DNA, 3000 bp, Unknown; identical to SEQ ID NO: 10931
  misc_feature (1)..( 3000): cDNA_ID_1688917_gDNA_ID_2214466_Annot_ID_182838 3000 nt of promoter + ATG

SEQ ID NO: 10936 - DNA, 3000 bp, Unknown; identical to SEQ ID NO: 10930
  misc_feature (1)..( 3000): cDNA_ID_3055875_gDNA_ID_2214466_Annot_ID_182836 3000 nt of promoter + ATG

SEQ ID NO: 10937 - DNA, 3000 bp, Unknown; identical to SEQ ID NO: 10929
  misc_feature (1)..( 3000): cDNA_ID_2716933_gDNA_ID_2214466_Annot_ID_182833 3000 nt of promoter + ATG

SEQ ID NO: 10938 - DNA, 3000 bp, Unknown; identical to SEQ ID NO: 10928
  misc_feature (1)..( 3000): cDNA_ID_2685834_gDNA_ID_2214466_Annot_ID_182828 3000 nt of promoter + ATG

SEQ ID NO: 10939 - DNA, 3000 bp, Unknown; identical to SEQ ID NO: 10927
  misc_feature (1)..( 3000): cDNA_ID_3038783_gDNA_ID_2214466_Annot_ID_182827 3000 nt of promoter + ATG

SEQ ID NO: 10940 - DNA, 3000 bp, Unknown
  misc_feature (1)..( 3000): cDNA_ID_3038736_gDNA_ID_2214466_Annot_ID_182857 3000 nt of promoter + ATG
tttcagttgatttctttgtctcttcatccccctctttgtccatgactattcttgatggagcttcggttttggtttcagtcgatttctttgtctcttcatcaatcatttcattggcttcaatctctaaacctctgattgtttcatatgttcttgtgtcttttgtctctacactatcctcctcctctctagcctcatccatgaccacaacttctggagctttggtttcggttctctctgataaatcatctgcagagttgttgtctccttctttgatgaactcgcctatttctaaaagcttctgcgcttttaattcgccttcttcattaacattgtctgctatctcagcttctgaaactttctttgcagcttctttcaccattgcagcatctacttcttttgaaaccaatttatcttccggagcttctctcgcggtttgctccaatgtaacagcttttaagttactcgtctctggtttttctttaatctcagcttcttctaaggctttcttttctgtattttcaggtttatcggattccgagtcagtaacaatctttggtttgatttctaaaggccccagctttccatcaatttccttgaccagatttgttagtgatcttgcattacgagcttcagataacctagtagacaactgcaacataccacaaaaagttttaagcaaaaagtcatgttttgcgctcaaagcagtttagctcagaaaggttgaaatggagaaaaatgtatttgctgatatttcacctgctgtatctgttcagctcggggtttgagatcatccagagatgcttccttgtaaatactccgaagaatgtacatcaaatgagagctaacattatccaaatgatgttgttggacctcacattgatgtacatcagagagacaaccaacagaatgaaatggacagttgacaagtttcataggacatacggttatacaatgcctatccatatcacgtctcatgatactctctgagcagttctgctcacacggaatgatcttgaacgggcaaacagaatcgtgattctccatctgattcgcacaaaacaccgcagtacaaccctcattctcacagttcattgttctatacccacaattcatggcgtgctcggcgagttctccttcggtttggaatttcatctcacaatgtgcactgcttttaaaatcaacgtttttaagcaaagtctgagcgataccttctctatgatcagtcaaccaaaacccgcttatctccatctcttgcgcgaaatcatcgatattatcttctctcctttcgctaagcatccaacccgaaacccggctgaacaaattccgcttagaagtggcgaaatcatcgatgaaatcagatataatgtcaaaaggatcatgagaagcttcaatctcagaacctccttgaagaacaatgtgttcagccacaaaggtttcgcttctacgagtcaagtactctatcatttcttttcgaatgtcagcagcaacagaaccaggactcctgaagatatctccggtagtgttatcgacacaagcagtggctaaaccagggagaaaaacctgagcaatcttgtgaactacttgtgtatcgtaaagatcacagtgaaaggaaggtcctccttctttctgatcttcaatactctcaagatccgacacaggaggatccattgcctgtatatcaaaaatcgtctgcagaaacacacacaaattgaatagccaaatatcatcactagatcagattaaaaaaaatgcaaagcattgaaataagacacaaactccataaacaccattaatcaaaatctctactttttttttcttctggaatcgctagatcagtagaatcctaaaatccgatcaacagccaatgatcacgatccgtaaattgacaaattattaacgaaagtttcagaattgagtcaaattacaagcaaaaagttcaactgttggattgataaagaaatgtcaaaacaaaaaaacgagaattaccctagaaagaaatcgtgtcctaaacagacaatgacaaatcggagaaaggaactaacgaaagcctgtaaggaaatctgacggtgagatcaaaatggaacaagaatggaatgagagaaagagagagagagagaagcacctctctggttttggcgcaataaacgggtctctttttctcttttaccacaacttcgtcgcctcttctattaaaaacggactctctcctcctttatttttatttttttataactggtttctttcctacaacatttttgtagttagtactgtacagtgattattagtgattttacaagcccaataaactatttagaactaaacaaatctaatggaattttaataacattttttttcttatctaatcaccaacccaatgaagaaacaaatttaccctttaaattttttcatgtcacaaagacacttcattattaattatccacaattatactactacacatcaaatacaatcaagaataacaaacataattaccaattaaaaaaaaacaattttctcttgcgcattttccaaattagcaaatcctttatgttgtttttttgaaacatttttaactagcaaatcggtcttatgactagtgactaaaaaagttaaattccaatagatctttgaaactgtttaatatatcatcgaacaatactaacaatagaatagatgatgaatatattattaaattatcaaacttagatataaatctaaattataacacgttacaatactaatacaaaccactatatgatagtatattttttggaacatacaaatcatcgtatattttcaccaatttttttgtagggtttatgttaataagtaataactgattttttaacgattgttatatggatttaactgtttttttttttcttatgataaaaaatgaaacagtgtcactgtaagatttgggtcccttttttaatttcacaagacggagaggaaattaaagaaggaaaagcacgacctttgccgacttccttctgttaatc

SEQ ID NO: 10941 - DNA, 3000 bp, Unknown
  misc_feature (1)..( 3000): cDNA_ID_2716879_gDNA_ID_2214466_Annot_ID_182856 3000 nt of promoter + ATG
tgaagcacatgctccaaatagtaccagatattgcttgaatagagctaccattccctccgtcttcagaaggataagaaatcctctaaaataaaagaaattaaatataatgttagccactttatcaatatcaatcatgccacaacaaaaggtaaacctcccgtctactgaagttacaagatgatccgaagttggtggcagaaatcaatacctgatgaataatatcacccatagacgatgttgagagggaaaacagagcaaaacggtcatgatacgcactgacagcaagaaagagaccactgcaaaatgcattacaggagtcaaaattactggttgctattcaagatacaaaaaatgtaagctttaacattaaggtgtggcttagaaacatgaacgctccaattcaattctctcaacaatcgaatagtgagtacttgggcaaaggccaaaacatacaaaagaaaaaagaaacagctagcaattatggttattttaaaagtagtatctaagtcatcaataggataatgaagtaacaaaatcatggtttttgaaaacttgcctggaatctattgtgagcattcttccgagttgaatccttgagttacctggagtagaaagttgaacatgttgtattggcgagaacctacaccaaacagcagtgaaatgagcaacggtgacattaggtttccgggataaataagagtacatgggatctaaacctgtgcatttcattgctaaatgagagaaatgagagctttccagaatcagaaagaacagccagaaggtcttttcccatctgcaaaagataacagatggttgacatatcaaatcatatagatctgcattcctgttactaacaaaacaaaaagcttggttgtcaccaatttaaaaaaaatctttgccggagtaaaatacctgatcaatcaaatacagtataccgtgcttaaatggaaaatgcttacctgcaaactattcgaataaagcttgctactctgaggtatgacagccaaatccttaattgttccaaatacatactgttcacacaccgattcaacaatcccgtcttcaccaataaccaccaattctatgcaggtctcctggtaagacaaaagaaattccatttctagttactgctaaaacaacaaaagcacacactacagacctaagcatttctcactgtatttctgctctacagactctaaatccatttgaaataagcttttataacaacatcctgatgcaactaccatacccacaaaaaaaagtatacaactttttactctttcaacaatgccctcaacataaaaaacagcaagcaagtgaaacaagtgcagatagcatatcaactccacaaaatcccaatccctaaaggagagatatttaacaaaaaaaaaagcagttcccacaagacaaatcagaatccagaatcgaaaagtagagatcagaggaagaagaaggaactgagaccttgccgaaaactatgtcgcgggaggaaggggagcggaagtagccataagcaacctggagaacgacgctggggcggaggatgcacttagctaggtagtgatccccagcagaggaaggggaagaggaaggaggaggcgtaggagccgccgtggcaggtgatgattgagactgagcggaagattcatcctccggagccgccatgattaacagaaggaagtcggcaaaggtcgtgcttttccttctttaatttcctctccgtcttgtgaaattaaaaaagggacccaaatcttacagtgacactgtttcattttttatcataagaaaaaaaaaaacagttaaatccatataacaatcgttaaaaaatcagttattacttattaacataaaccctacaaaaaaattggtgaaaatatacgatgatttgtatgttccaaaaaatatactatcatatagtggtttgtattagtattgtaacgtgttataatttagatttatatctaagtttgataatttaataatatattcatcatctattctattgttagtattgttcgatgatatattaaacagtttcaaagatctattggaatttaacttttttagtcactagtcataagaccgatttgctagttaaaaatgtttcaaaaaaacaacataaaggatttgctaatttggaaaatgcgcaagagaaaattgtttttttttaattggtaattatgtttgttattcttgattgtatttgatgtgtagtagtataattgtggataattaataatgaagtgtctttgtgacatgaaaaaatttaaagggtaaatttgtttcttcattgggttggtgattagataagaaaaaaaatgttattaaaattccattagatttgtttagttctaaatagtttattgggcttgtaaaatcactaataatcactgtacagtactaactacaaaaatgttgtaggaaagaaaccagttataaaaaaataaaaataaaggaggagagagtccgtttttaatagaagaggcgacgaagttgtggtaaaagagaaaaagagacccgtttattgcgccaaaaccagagaggtgcttctctctctctctctttctctcattccattcttgttccattttgatctcaccgtcagatttccttacaggctttcgttagttcctttctccgatttgtcattgtctgtttaggacacgatttctttctagggtaattctcgtttttttgttttgacatttctttatcaatccaacagttgaactttttgcttgtaatttgactcaattctgaaactttcgttaataatttgtcaatttacggatcgtgatcattggctgttgatcggattttaggattctactgatctagcgattccagaagaaaaaaaaagtagagattttgattaatggtgtttatggagtttgtgtcttatttcaatgctttgcattttttttaatctgatctagtgatgatatttggctattcaatttgtgtgtgtttctgcagacgatttttgatatacaggcaatg

SEQ ID NO: 10942 - DNA, 3000 bp, Unknown
  misc_feature (1)..( 3000): cDNA_ID_3038740_gDNA_ID_2214466_Annot_ID_182855 3000 nt of promoter + ATG
ataattgtggataattaataatgaagtgtctttgtgacatgaaaaaatttaaagggtaaatttgtttcttcattgggttggtgattagataagaaaaaaaatgttattaaaattccattagatttgtttagttctaaatagtttattgggcttgtaaaatcactaataatcactgtacagtactaactacaaaaatgttgtaggaaagaaaccagttataaaaaaataaaaataaaggaggagagagtccgtttttaatagaagaggcgacgaagttgtggtaaaagagaaaaagagacccgtttattgcgccaaaaccagagaggtgcttctctctctctctctttctctcattccattcttgttccattttgatctcaccgtcagatttccttacaggctttcgttagttcctttctccgatttgtcattgtctgtttaggacacgatttctttctagggtaattctcgtttttttgttttgacatttctttatcaatccaacagttgaactttttgcttgtaatttgactcaattctgaaactttcgttaataatttgtcaatttacggatcgtgatcattggctgttgatcggattttaggattctactgatctagcgattccagaagaaaaaaaaagtagagattttgattaatggtgtttatggagtttgtgtcttatttcaatgctttgcattttttttaatctgatctagtgatgatatttggctattcaatttgtgtgtgtttctgcagacgatttttgatatacaggcaatggatcctcctgtgtcggatcttgagagtattgaagatcagaaagaaggaggaccttcctttcactgtgatctttacgatacacaagtagttcacaagattgctcaggtttttctccctggtttagccactgcttgtgtcgataacactaccggagatatcttcaggagtcctggttctgttgctgctgacattcgaaaagaaatgatagagtacttgactcgtagaagcgaaacctttgtggctgaacacattgttcttcaaggaggttctgagattgaagcttctcatgatccttttgacattatatctgatttcatcgatgatttcgccacttctaagcggaatttgttcagccgggtttcgggttggatgcttagcgaaaggagagaagataatatcgatgatttcgcgcaagagatggagataagcgggttttggttgactgatcatagagaaggtatcgctcagactttgcttaaaaacgttgattttaaaagcagtgcacattgtgagatgaaattccaaaccgaaggagaactcgccgagcacgccatgaattgtgggtatagaacaatgaactgtgagaatgagggttgtactgcggtgttttgtgcgaatcagatggagaatcacgattctgtttgcccgttcaagatcattccgtgtgagcagaactgctcagagagtatcatgagacgtgatatggataggcattgtataaccgtatgtcctatgaaacttgtcaactgtccatttcattctgttggttgtctctctgatgtacatcaatgtgaggtccaacaacatcatttggataatgttagctctcatttgatgtacattcttcggagtatttacaaggaagcatctctggatgatctcaaaccccgagctgaacagatacagcaggtgaaatatcagcaaatacatttttctccatttcaacctttctgagctaaactgctttgagcgcaaaacatgactttttgcttaaaactttttgtggtatgttgcagttgtctactaggttatctgaagctcgtaatgcaagatcactaacaaatctggtcaaggaaattgatggaaagctggggcctttagaaatcaaaccaaagattgttactgactcggaatccgataaacctgaaaatacagaaaagaaagccttagaagaagctgagattaaagaaaaaccagagacgagtaacttaaaagctgttacattggagcaaaccgcgagagaagctccggaagataaattggtttcaaaagaagtagatgctgcaatggtgaaagaagctgcaaagaaagtttcagaagctgagatagcagacaatgttaatgaagaaggcgaattaaaagcgcagaagcttttagaaataggcgagttcatcaaagaaggagacaacaactctgcagatgatttatcagagagaaccgaaaccaaagctccagaagttgtggtcatggatgaggctagagaggaggaggatagtgtagagacaaaagacacaagaacatatgaaacaatcagaggtttagagattgaagccaatgaaatgattgatgaagagacaaagaaatcgactgaaaccaaaaccgaagctccatcaagaatagtcatggacaaagagggggatgaagagacaaagaaatcaactgaaacagaaaccgaagctccatcgagaatagtcatggagacagagaaggatgaagagactatgaactctagggctcgtgcttcggatgaagctgaagcactgtcaaagagctctcaaggtttttctacggtgcaagctgaaaccgtaccccatatgtcttaacatcttttgttgagacagttcaaactcttgaagctagcatggagtgtatgttttcttttcatttaaccaaagattgtttcttttgtctgtctgaaaatatttgagtcatcaaatgtatccaattttgtattgcttaatcaattgattggttttttgccgtaattcatcaattcattatgattgtcctatgtgtccaattctgattaagcttttcaaaccggaatcaagatctcacccaaaaaaaaattaatttattaattaaccgggtttggtctatgtatattcttcttccgaaccggaaagaggattggacacaaacacaagtcaaacaaatttcgttgtgcaaacgaaagtaagcagagcaaagagtttttgtgtggctagtggcatcaatg

SEQ ID NO: 10943 - DNA, 3000 bp, Unknown
  misc_feature (1)..( 3000): cDNA_ID_4361228_gDNA_ID_2214466_Annot_ID_182853 3000 nt of promoter + ATG
caaatcttaaaagattttctttccaatggataatttgattgaccaattaattctatttatttttggttaatttagtttttattttttggcaccatattcaaatatcaagtaattagatttatattttcggttattatgcaggctgttgaaataggcaagaggttagccgagaaacactttatccaccatgtctttgggtacgtacatatatataaatcgtgtcctttttttctttggtttacataattgaatattcttgatttagtgaaatgttcataaactgtatgtttgttgaatagagagaacgagtttgaagatggaaatcattactaccgtttcctagagcacgagccgtttgtttcaaaatgttacaattttagaggttctaccaacgacatggagccccaaagtgcagccattgttgggcagaagctattcaaaatcatgacagctattctcgagtcttattcttccaatgaccacactagtgttgattacatgagaatcagccagagtgaagaattccgaaggtagaatttggactcaagagtgcttaaacggattttagtctaggaatgcttactttagttctatcgacattaatttggttatgctttaattgtgtataaacgaaggtacttgaatttggctcaagacttccaccgtttgaatcttgtggaactctcaacggaagagaagttagcattttttttgaatttgtacaacgcaatggtgattcatgctttgatcagtatcggacgtcccgaggggttgatcgcaagaaggtcattctttacggattttcagtatgttgtaggaggctactcttattcacttagctccatccgaaatgacatccttcgtcgcggtcgaaaaccctcttatccatttatcaggccaccttttaataacggcaagacacggcatgaggtaattttagcgttccatgtttgtttgtattttactcatatcggtgattttcggattatcctatagttttaattctatggtttaatgtcagcttggtcttctaaaactgaatccattagtacattttggcttatgcgatgggaccaaatcaagtcctgtggtgaggtttttcacaccgcaaggagtcgaagctgagctcaaacgagcagctagagagttttttcaaaatggtggaattgaggttgtcttggacaagaggaccatacatctatcaagaatcatcaagtggtaatcaattctctttacaataatgtctacattgaaatttataaatagtgagacctaatgagacttatatgagtcattttggttattagtctaatgagctaagaaaggatatacattgatgtgtatatgtttgttgcggtaggtacaaagaggatttcagtgaagagaagaaaatgttgaagtggataatgggttatatagattcaaatgatgcaggtcttttaacccatctgcttggtgatggaggtggttcttttaacatcgtttaccaagattatgattggtctaccaacaattgaaatttaacaacaactcttctttttggtggtatattgacattaaactattggtccataaattttatgttaaaagtcatctatttgttattcatgagatttattcatgaatcacaggtatagtactactatctgaatcccggattttggatctttactctataagaatcgaagacaatagatgatgaaagaaaacttaattactactattcactattttaaagacaaacaaattcaaattaatatgcatatatagaatcgtacgcctttggtgtgttcctaatatacacacaacttattatttggaacaaaaaaaaaaataatcatttaactaaaatactatccggataatgtcatatatatgaattatcattcatctatgaatatatgtcaatttattcttacgtggttgaagtagaagcctcttctttttggagaaatgagtagaagctttttatgttatcataacatcatcgtcttacttttctccttttctttctttttcttcacatttttactttctttggtatcgaaaccttaaactttcaagctaattccgagaaatgaaattttatactaaaaacgtccatgattcaagattattacaagaaaaattgacatgaattatcgttttgctctggtaacaaaatcactacgtacttaaagcaaatttgaaatatcatttctgtcttctgatgacaataagttaacggtttggtagaactttttgtagggaaacttgtgaagatagagttagcttttagatgcaggtaacgtataaacttatttgaacggttagattgagaaacgaacaaaatacattggatgcaatatcttcctttgtactttgcaagtgttgtatataaagaaaaaaaaagtgttgtatataagtaactcatattctgatattccccacttccatttcttataaacaacataatttgagtataatcttcattttaattatatatcaaacaatagaaccttaagtttttgattataatctctgcctaatcggcagctaaactcatataacccattgtttagcccagttatataactttggaagttgcataatcagcttaactattttctactacaaaaaactaaacatttttctttttgagctcatcaaattcaactaaaattgtctctcagcttcttttttcccttttcctttatagtgagtggcgttttaaaactaaaagcaaacggatcaagatagagaaagccacgatcaaagcaaaaccataagcaaacaaacaccaaaccactaaaagaataccgcacacaacttctttctatcacatgaatctccttttaacaaataaaataataataaagtaaggattatgcatatcttattgcacgtggccggtgccctttgagacgtatcaccctctacatgcaatataaaaagcattgcaaatgaaccaaagtttgatcacatccatcacttataactaaaaacacaaatcaagataaa

SEQ ID NO: 10944 - DNA, 3000 bp, Unknown
  misc_feature (1)..( 3000): cDNA_ID_2716895_gDNA_ID_2214466_Annot_ID_182850 3000 nt of promoter + ATG
aaaaagatttggtccggtcggagagagatctgaacgaaagaaagtcatcgtcactcccagaaagaaagaaactcaaaggtatgagaagactatccgactcgtagctgcttctggatacgaattgtttctccactatctcaatttgtctccgtctgctaagaaaataaaacaatttgtaattctagggtttgatcctctctctttcaatcgtccctaatttactggtagtttggattgtaatatcttaatcccgcggattatactaagattacaagttcgagaattgattcattcactgcaaatttccttcgtttgctttgatttcttggaaacttctgataacaaatcgtttctgagaacatgtttttcttcttcttgtgattgtgtctttcaaagcatacttctccaattctctttggtttcttccttgtgatttttgaataaattgtgttattttggtttccttttagcttgatgttgttgttttgaaatctcaggttacaatggcgaagctaaggcctagacagttggaactgagcaagactgttccttccaagttgggttttgatggagaagaagacgcttgggtctttgttaaaaagcagaaaatcttcattgtcttgccttctcttccacttcctcaacaacagcatttcactttggagaaacctgcaatatctcctcaattagaagctgggtttagagaaagcatggaggttacgcaagatagtacctttgttcacactgtggtgccttctcttcctctgcctgaaactcctcaatcacaagctgagttaagagacgctcttgcggatacacactttaccactcctgttcccactgtggtggtacctgctcttcctctacctgaacaattcattttgcacaagcctgaaacttctcattcgcaagttcagttcagagattgtattgcgaatacgcataaaactactcctcttcacacagtggtgcattctcttccggtaactgaacattccactttgcagaagcctacatcttcccagtcacaagttgagttaagagagtctattgcggatactcatggaactactcctcttcaaacagagatttcttctcttccattacctcaacacttcgttttgcagaagcccgcaacttctcaatcacaagcggatacacacgaaactactcttcttcacacaatactgccttctcttcctgtacctgaactatgtactttgcagaagcctgcaacttctcaatcacaagctgagttaagagcgaatacgcgcaaagctactcttgttcacgcagcagcgatgccttctcttcctgtacctgaacattacagtctacagaagccttcaacttctcaatcacaagctgagttaagagcgaagacgcgcaaagctactcttgttcacgcagcagcgataccttctcttcctgtacctgaacattacagtctactcaagccttcaacttctcaatcacaagctgaggtaagaacgttgacacacaaagctacccatgttcacacagcgatgccttccctttctgtaactgaacattgcactttgcagaagcctgcaacttctcaatcgcaagctgaaactagtcgtgttcaaactgtggaacctgaggcctgtcctgatttcacctcagtagacaaaccggagatagttatgagtcgcagtctcacaaccaggaaagctccagcaccaaagagatcactgcaagaaagtaggaagaatcaggatagaagagtggagatccacaggaggcgtgcgggtcacaagcccataaggtttccaagagtgatgtgtagctctgttgttatggataatgagaagctgagagtgttgaatctggagaagaaggttgagaaagcgggagggttgaacgaatgggttggatctataggattagggagagagtttgagaggatgttgagaggacagaggatgagtaagtttcagatggcgaatttgacaatggagaagcttaagcagatgggtgctttagccgttgggccaagaagaaagcttatacatgcaataggttgtgtctatcacccacattgtctacgtgcttcctttaactgagaactatctgttagagtttagttgaggccaataaaacttagcttacgctttattgatgttcaactagtattgttttggttattgatactctttggaccatatatgtaaaacagagcaacaatccactgtttgatgtgatcattgcatcgtgctattttgtatttgactatttggggatcagtcgtctattagcgttgcacatgcaatatcattatattgcttcttcttctttttttcaatcactaaaggatctagaaccagaaacaaaaagtccaaaattcaggttaatcattatagttttgctaattggaaacgtatgcaatgactaaacataaaatttatagtagaaacactagaaccctaattcttcaatttcaacataaatctttcaatttgagtggaatcattcaaaacttgattcccctaacttgaaagtaattatttgaatgtaagaattaaaaaaagcgtattttgtaaagtatcacgactaaaacatgctagttgagttaaaccttcataaaaaatgaaacatattatttgagtttcgagaaagaaaaaaaaaaaacattttatttgagttgtcgcagacacgatcacgatgtaccctatatatagttccaattagcattatttatcccatcaacaacaactattatgtcagaaatattgaattagtaaaagaaacaaatcttatctgggccatccatttgcacacagaccaatggacgtagagcgtggtaggcacgagccagatgtgaggtaccttgaggtgccacgtcacattgaggaatctttggcggggtttcattgtttacctataaaaatggcggccgcaaagtttcgtacgtctccgatgtttcaatcgtgaaatcgaaacaaacaaaataattaaaaaaagaaataagaggaggcg

SEQ ID NO: 10945 - DNA, 3000 bp, Unknown; identical to SEQ ID NO: 10934
  misc_feature (1)..( 3000): cDNA_ID_1014176_gDNA_ID_2214466_Annot_ID_133024 3000 nt of promoter + ATG

SEQ ID NO: 10946 - DNA, 3000 bp, Unknown; identical to SEQ ID NO: 10933
  misc_feature (1)..( 3000): cDNA_ID_2716918_gDNA_ID_2214466_Annot_ID_133025 3000 nt of promoter + ATG

SEQ ID NO: 10947 - DNA, 3000 bp, Unknown
  misc_feature (1)..( 3000): cDNA_ID_1375432_gDNA_ID_2214466_Annot_ID_133026 3000 nt of promoter + ATG
tccgatgatttaggggttagtgcgatttaggtctcttcctgtaatttttcgcgattctctgtataatttgtgtggttggtgtgaggagaatcttggaattgggaatggaatctccgatcaaatgttgcgactgtggatgcgattgttgttcttcctcccctggttcatggattcgatctgtgaagaagagaagacacgacgaattacagaccgagaaacgattctcgataccggagctggacgacctagacatgttctctaatcctagagtccaaattgagaacgaatgtgaattactacgcgagactgttagcaatcaacagcaaacgattcaggatttgtatcatgagcttgagcaagagcgtattgcttcatcaactgctgcagatgaaacagtaaagatgattcagacgttggagcgtgaaaaagcaaaaatcgacttggaactgaaacagcttcagcgtagtgttgacgaaacattgaattatgaaaaccaagagattgaggcattggaaaatatggtttatcaaagggatcagacgattcaggctcttacgtttgaaactcaggcttataagcacagaatgatgagttttgggctaaccgaagcagaagctgatggtgagaggagcttgcttagtcgtaacccgagcatgatcgactttagttctgaatatgactgccctacacaagattaccctcctcttaaatgcaatattaatgagaaccaagaccctcttgaggctgatatctatgttgcagatgatgagaactatccaccagctgattctcctcatgggagagtacatttaaagactttggatcgaagactcagccagatggagacgaatcctagctttactcagttgaatagagggagggatgtttcagagaaggggatggttggtgagagtcctaggcgtcaaagacattttaggaggatttcccctactggttcatcaagttcacacttgggagcatctaaagaactaagacctgatgtttttgttgattccccgaggtcccaaagctacagctctaagaaaatggaagatgtctcgtatacagagaataataatgctaaagatgacttgtcggaaataggagatgacatgagtgatagagtttataccattgattctgttcatcacagcagtgtggctcatagtggcggtgtagcggagcagaagattgaggatggtgcttctgatggcaatgttgttttcccgagagaacacacggatcttggtgatcctgatataacgaaactctacatgaggcttcaagcactggaggctgacagggaatcaatgaaacatgcgcttctctctatgaggactgaaaaggctcaaatggtactgttgaaagaaattgctcaacacttgtcaaaggaagttgtccctcaacggagattgcctctacgtaaagcatctattgctgggccattgacttttacgccggtctttaaggtgattgtcatgtttctgtatgatcacaaagcaacttcgtctaaagctgtctcttgttttctactgttctcactctaacttgtttctgtaattttgattcttattcctctgcagtggatcacatcttttgtttcctggaaaagaaaggctcgtcgaagcaagtaagtaacctgtaacaaattttggttactctatgcttcacatacctatcacaagagaaagatctgtgaatctctttgagaaataactattgtcatccattttcaaaccggtgctctcttgcactataatctcgtccttaatattcgaaaaacaaggcaatgtttcacatgatagtttagaaattactgttggattttagggagctgcttatgaaacttatgctggtctctgttccaatgcaaatacgcagatacatgtatgggatgtcaggaaacaacatcggcttgcaaatgcttctagaaaaagtccctcggtcaaggaaatggcgatgtcttaggagcacgcaagtgtgaaacagatccaatcctttcaagccaacaaaatcactctcctgactctagattcgaagcacataatgtcaaatactgatgtgggattggcgaggtaacatttgtcggcctttcttcaacttgaattggattctcgttcttgggttgcagagaaaatgtatttgctgtgcgattttcaatctgttttcctcaatattttaactgttgtataaaagaattgggttgaagaatgatataactcagaggctatacaatctttgtatggtttctaacatgaattgtttcattcatggattcttttttcttttttttatcaatattttggagatggattcatcacataaataagtgaaggaaaatgtaaaatgttcccgtttcaaacctcatttcccacacttgggaaaaggaaaataaaaatatttgttgtcagcattcctcctatatatttgttgaccttaaaatgaaacaaaagaaattttccatgaaatataatagaatgttctgtttgctgaccatgagttgaatagagttaacaaaaagaaaaaaaagtttgtaatcgaccatggacatattttggaaggatcaaaattcagaccatgttctaaagccgagttgctgctgagagtaaaaaacaatatatagatttaacatatttgctctagtctcttgttcaaaaaaagatggtctagaaatcttcgatattgaatttttcgattaccaaaaataaaaataattaggaggggacttacataaaattgttattttattcagtatacgtgaagagtgatttcatttcattgacaaataaacagacacgtgtcatgttttgatagtgaatatttctttgtctaaaaaacatatgttagtggaattcaaaagcgaagaccaattaagtaaacggagccgccatttcttacttccaccacatgtttctcttcttcttcatctttactattattctagatcatcattatatgaatatatatacgtacacaaaatcatacgtttttccacaaatg

SEQ ID NO: 10948 - DNA, 3000 bp, Unknown
  misc_feature (1)..( 3000): cDNA_ID_2716914_gDNA_ID_2214466_Annot_ID_133027 3000 nt of promoter + ATG
ttagataaaaaattatatcaatttataaaaaatcaccttaattttttagataaaaaattatatcaattataaaaaatgtaacctaaagtacatttaaaaaaaatatataaaacatggtgaaaaacaacaaaaaatcatctatggttattcgaacatggggcgattgaaaagttccttatggtgtttcgccactaaagaattagtattttcaaaatatcaccttatgttttgctatataatatctgtcctaaagcttaggttttacttgccttatggtaggttgtttgtttccactaaaaaaatgaaatatggacctctcatttattagagttaaaacaaactctcattttttacttacacaaatacgaataaataccttttgcgtttttttgaaatacaacatcttaactatcgtttacctaaaccgtttattacaaatctctctgagattacagaaaacataaaagtttaattttttctattaaaatatataattaaatgtttcaacgaataaatacctcggcgttttgaattcgcctcaccggcaccactccattcatcctccacataagcagcgaccaactgatccgcctgtttttgttcaactttcttccatccatggtggacatcggagttacatttagaggtttcaaagctattgtaatccacatattccatcggatcattagtgagtgttaataggtttgtgaatcttttttattctgtttttgtgtttgtatttaaatggagttttaatgaattaaaatattacatcgaatatgttgttattcaattaggattttaaaaagttagtgaaagtgtgatgttattgatttaagatttatagaaagaatttaatattttcataaatctgaaattattgaatttattcttttataaagtcaattaaagttttgtgttattcatttaaaacaaaagaatttatgattgttaataaattaaaatataattttattgttgattagtatagaacatatataactaataatataataatttaattcatcaacaatcatagattttttttgttttaattcaataacacaaaacttttattgattttataaaattatgaatccaataacttcatatttatgaagactttagattacttttacaaatcttaaactaatcagaaaaattgattgaatcactaaaattctatttaacttacaaactaataacatccctttactttctataatttattagagtcatcaaaattctttgtaaaataagaatctgtaataccctctaaacttttctaaagtttgtcactctttccttgatttttcgacaatcttctaccccggttttaaaagaagtaaactaataccaaagtagacttttttttatcccaaactacgaaattatcacattgatgaaaaagacacaccgttttattttattttgttttccgattgataatttagttcattagtatttttttcaatctcctaatcacatgtgactattcaatatatagttaaaaaaaaattaaaaactacaaaacctcttgatgaggtgcaaaacatatactttttgatgctatttgaaaaactacaaaacctcattctagaaaaagctctttctctaaaaatatttcttctcggttgtcgatgtcacgtcgaccaacaagaatttccccaatgggtaaattaacttttaaaaaaaaactcgtccaatttttctccttcaccacaatctcctaaaaactcgttcggctcttttgccacaaagaaacaaatcagggatacaatgagctctaaacttcataatttttctttcgtttccatttctcatacctataattctaaaatatatgaaaaaattattataaaatatattaatatatcaaattttggactaaataaaatttaacccatgatataaaacggggcatgatctagtactacattatttttaaaaatatgaccatagtcaatgtattataattactcaaatcaacacactcaatatgaaactacacaaatccttttcttcataaatacaatctgacagaagttcattaaatcctaaattcgtgacttgtcttacattttgcaacaaatcaaccatatataaacacaaaagtacaaattgcaaatacaaaaaacaattaaaagaaaacttttttgctgaattcgaacaagaaagttgacttcacaaaatttgctggttgtattggtctattggatatgggccttaaaagaacatttgaaattatgaacccgagatattttttttgatttttgaggtcatgccgccatgtactttgttcgtaggttattgacttatgacacctcactcaatcaaatatcagccgttgatctttagccaatacctcatcttgacgttcattcaggatcgtctcctcgtttataccaaaaatagtctccctgacaaccatcatcgggaacaggagacagagtctgacagacagaagagagactccatgagaatccttctcctccgtttattatagacaaaaaaaaataaaaatccagatgaataaaacagatttttagggtttccaaaaatcaaacaattatcaaaacctttttttcaatacatacaatttgaattcattctctacaattacgaaaattccttaataccttttttgtcctcttttttttgtttgtttacgcgatagaaaaaacgtttctcgttctgtttctctgtttcgtggacgggagacaaaattctctccaatttctgggtcgccaaggggtaagtaaggtttcatcaatttgcgttttcggatttttgttttctctcttgatccagattctgaaattgagttttactgtgttgtttccgcagaattggcttcagctggattttttttttttttttttcctgagaagcttccgatgatttaggggttagtgcgatttaggtctcttcctgtaatttttcgcgattctctgtataatttgtgtggttggtgtgaggagaatcttggaattgggaatg

SEQ ID NO: 10949 - DNA, 3000 bp, Unknown; identical to SEQ ID NO: 10932
  misc_feature (1)..( 3000): cDNA_ID_2716902_gDNA_ID_2214466_Annot_ID_133030 3000 nt of promoter + ATG

SEQ ID NO: 10950 - DNA, 3000 bp, Unknown; identical to SEQ ID NO: 10944
  misc_feature (1)..( 3000): cDNA_ID_2716895_gDNA_ID_2214466_Annot_ID_133032 3000 nt of promoter + ATG

SEQ ID NO: 10951 - DNA, 3000 bp, Unknown
  misc_feature (1)..( 3000): cDNA_ID_2716891_gDNA_ID_2214466_Annot_ID_133033 3000 nt of promoter + ATG
gttttgaatatcacacgtaccttcttcctcccgcaatccaagtaatcaatgagaatctcgaccatctcggcgccggagaaacagttcttaacaatcttcatcttcatcaaacgatccttaatcggtagcttctgtctcaaaaccctaacgaatctcatcatctcatcaacaacaacaacaacatccttattattactctcttcgtcgaatccatacatcaccggcaacggtgcatcgccgcaacacttctccttcaaaaactccttaaccctccgatcaaattcaccactgtttctcagagaattcaacgccattaatcctccgaagtgtttctcgttgaagaaaatctgaggaacttgagaactccctgttctttcaaccagctctttctctcttgacgaatacacgtcgatgttgatctccgagaaatcaaatcctcgttcccggagaaacaatctgacggcggttgaatctcggcagttagatctggagaagaaagttatacgacctttgatttcttcttcgtttttcatcttcacgagaactttcactccagagattttgaactcggtcacgtcatcgatcgagtcgtcgtcatcgtcgttctctagcaaaaccgagatgcgtttcgaaatcgcgttcccgctttggcgtatgaatttcatcaaatcgccggtgaatttctctttcggatgcaataattcttctaaagagacacgacggccacgtggcggttcaagtttcggtagctgaggatgtggtgggagataaggatcatcgattgagatttctttcatcggactttgagagacggcttcaggaatgggtgtggcgggatgtacgtgatcactgatgggatttgaatttgaatatggaggtgaaacaatatccgaagagatagtgtaacttttgccgtttgttactttctcagattttctcggattttgacaattgtttttactttcctcaaacctcattgaggtttttttctagatatgagaagttcatctctggaagagttctttgtacctaaaacaaaacgttgaaatgagagatatatagaaacagatttcaactagttaggaaagaattgaagataagcaattttggtaagtgtacaatttaattagataatgcattagtccacagtcaacttacaattataactcagttataaacttgtcaaatttaagcttcatatatactaaaatcataatgtttattttcatatgagaaatgaaccaaaccaaatgaaattatccaaatcaagattgaaccatatgttaaaaccagttatctctagcttgtacaaaagaaaaaaaaaaatacaaaaacaaagtcagaaccgaaatatatacaatcaaacaaaccacatagaaagaaaacctcgatagcaattttaaatttccctagcattttcttcatttttgttggatttaaaactctgattgttctaaactcagcccaacacttccataactatgatcacataaggacgtgtttgttttaaaaagggcctgttaaggaagagccaaataaatatgtaggaatatgcttaatcaagctatgtttacctggtagtagggtacccccatgaaataatagcattgtctttctcaacaatgatcatacaaaaaaacatatgataacatctcgacgaatgaaaatgtttattgtacacgatgtacattcgaaacatcgctgaagttaaggtctacggcaataatagtccatataaaacaacacactggaaataaatatccatgaccagacaataagcatatatatcgatttcatcatcatcactttgagaaaatgaagacaactgaaatgtaattaaggatgattgatataaagaagaagaagataaataataacaacgttgtatagtcttgtagaccttcacctttgtagagagacgagtgcaatggatatttacagacactctatatgaaaaacatcttgcaaattgaaagaaaaacaaaagaaaaaaacgaaacatcttgaaaagtgataaccgacatgtttttttttttttttttcatacgaccataccatagagcaagctaccccatttttctaaaatacataaagctaccatatattagagatgttattttatataaaataacattttataatgatgtggtataaaataacatctctaatatatggcagctttatttattttataaatgaaaccaaattatgttactttttgttcatttcattttgagtgaatccctcaaatactgtttactatttttatttttaaatctgtaataaagatcattgcagattttaacaaaaaaaaatcattgtagcaaattaatgttaattacatactgtacttgtcaaaaaagtgcaaaacttataaatgaaggtggataagtattgttctactatttttagtatacattattcacatttaaagtaatgtgacaacaatatattacaaaatctaagcattaacttctgtatgaaatttcctaaaatttatgaaatttgcattttcatttacattatttaaacttttaggatagtaatatagaaaaaaagttcaaaacaaacttaaggacatttcgaagcagagtagagaagccaaaaagttcaccgaagacgtcccacaccgtcacggtcacagtcacgtgtaatacacgtggagagttttaattggtgacagcatctgaagagtcgtatatgtcgcattctcattagcctgtcacgtttctcagacgaacactcagggaaacatataaatctgaatccaaatagtaattggaattacaatagaaacccttaatttagtgaaaatatcgtaattatcctatcgaaaagtgagaaagagtaagcagagaaataagcgattgatctctccttctgcaagttctctatttcttccctcacttcttcttcttcttctcccctttcattgttctctctgttcggcgctctcttctacttctctcgatccgaccgtgaatcactatcggagcaatg

SEQ ID NO: 10952 - DNA, 3000 bp, Unknown; identical to SEQ ID NO: 10943
  misc_feature (1)..( 3000): cDNA_ID_2716883_gDNA_ID_2214466_Annot_ID_133035 3000 nt of promoter + ATG

SEQ ID NO: 10953 - DNA, 3000 bp, Unknown; identical to SEQ ID NO: 10941
  misc_feature (1)..( 3000): cDNA_ID_2716879_gDNA_ID_2214466_Annot_ID_133037 3000 nt of promoter + ATG

SEQ ID NO: 10954 - DNA, 3000 bp, Unknown; identical to SEQ ID NO: 10940
  misc_feature (1)..( 3000): cDNA_ID_2716875_gDNA_ID_2214466_Annot_ID_133038 3000 nt of promoter + ATG

SEQ ID NO: 10955 - DNA, 3000 bp, Unknown
  misc_feature (1)..( 3000): cDNA_ID_2716978_gDNA_ID_2214467_Annot_ID_133040 3000 nt of promoter + ATG
atgtgtacacaataagaggctagacactatcgatgaactgtgaatatatgttatgctctagttatgttgtataatgatcactttaactagcagaccaaaactttttgaggtgtatagcaaacatgaagacaagtagatccataaattatagtttcccacaaaattcgatgagaccatgcatagggggtttggtacgacgaatatcttttgatgtgtattatatatgacaagtagatctcagtttttttcttttcctattaagttgttttacaaaattaattagtactcagcatctagtactagcaacattttacaatatgttccaagtggatgatcacgcattaattactccgagtaattaatgcatgtgaatcagaatttgtgtatacgcaccaagcagatgcaaagctgatttgaaacatcagaggtgtgatatacaagaacttcgtcttgtttaccttacttgaagaatcacattcataatcctcaagatatatatcttacaagaatttttcttatgaaagtttttttttatgtaatagattgttccctattgtccatactttatcatgacgacacaccctacaaccatacgcatttttattttccaatctctactttcccatatgaagaaatcaagaatgagataaatcatatagttgacacactattggaacgaatataaaaatgaaattaaaatagaggatctatatataacgtaagcatgtaaaaagttatgacataatttaattgagaaaaaggtcgaaaaaggagctgacctgcagacgtaatctgtcgacaaatatcaatctatatatattgagtctttgatcaccacatgtggtcctaaatttcgaaccaacgcatagaaatgaattagaaagtatagcatatagcaacctttggccgctccaaacgatcatgctttacttttttgattgtgtcctattacctaaagatgcttttactatataattgagttttacaattattaagtgaataccgacaagcgacacaagcaaattaaagtataagaattttatatgagaaactaatttgacttttgttgtacgtagcacacaagaccatgatgcaccaagaaaaagaaaaaaaaaacagagtgaaacttgaatcgttatccatcaatattagttatttgtttcaactaatggaggatctaaaggcacataatacgtcataccacttgaaatttagtggagactgaaaacttaagcattacgttttgatgtttgtaccaaactaccaatagtgttgttataaaatgagagtatgcatctttaatgtagatgtgttggcatatttgaaagcgttttttcaacactttccagagatccaatttcattcggattctatgattcttgatttcgtccgattacttattcgaaaagaattttgtgaaacaaatgtatcgtaaaatttaatcccaaaatttgttgaatgctatatggaatctaaaacacatgatgtgaaaccaaagtgtacatctcatggctcaaaatggtttgcataagcaaaaatcatctttttgactaagttagtggagcctttatgagccactccttaaacttttaaatcgagcttatatattataagcaatgcttacacatgttaaggaaccattggttaacatagttcaaaaaatttactagacaaagaataaaaataaagaattttatgtattggccacatagagttattgtttgtctcccattgcttttgttgacgcatgacatccacatgaaaatatcattctcatccaaaactgttgtctcactcacatatcatccaagcaaactataactttcacaaaggagatgtcaatttacatgaaaaaggcttttatttaaggtgaagtgcggataagaatagtgattcaaacgaacaaacacagtcatggatcgatctattccattactagaacaaggatctttaattataacccattcaatctaaagttattattagccaacacagtagtcaaaaaatagggaagataaagcaacattcagtttcctatacacacaaaattttactagataacaagagtcgatcgacaataacatggacaaacgtacatctacaagtgggacaatgaacgatttgaatcatacgtacatatacacccattgtaattcacgactgaaagaaatgggacaaagaatctctaggcaacactatctcccaacagcaaacaaattactatttccgagaagaacaaaaaatgtgactcacactcacttaaggttttgaaattacaagattttagaaattggaatggacatgtatatgtattgtcggtgtgttgtcttataacctcttaatgggaatcggattcaaaacaaaccctctcattccacgtttgtcaagcacgtgcttcttcaagaatttgaaattttggtttaacggtacactcgatttgatcagaacgagacaattaattacaattaaatacaaatttagttactgtcggtagttttttttttccgaatgcttcctgtcgcatatattgttttggttctatgaactcttattagcatataccagaatctgttgaaccatacaaatttactatattttctcggtgactctctatatagcagcaaaccattagcgagactagattatgaaccttctaaacattaactaaaatactcagtttcaagcccaatcaatatcaatatatagcccgcagatgccgatcaaatgggcctgtccaacggcccattaataaaacgggggttaaaaatgtaaatacaagaagatagatgtttggtgagtcctaaaaatcgtaaaccagatttccaaatttctctccgtctcatctttgtctcggtctctctctcgagtgtgtgtgtgtctaaaggcaaagagagagatttgagaaaactgaattacaaaaaaaaaaaaaaaagacaacgaaaaaaaagacatcaaatttgcgaaagttgaaatcgaaaacggtgaatacaagttcccgcc

SEQ ID NO: 10956 - DNA, 3000 bp, Unknown
  misc_feature (1)..( 3000): cDNA_ID_2716970_gDNA_ID_2214467_Annot_ID_133042 3000 nt of promoter + ATG
gaacgcaagcaacacaaagacatcaacgagcaaaaaagtgatagaatctatccaaactgtgagtgatgggacgagcgaggaggatgaagaagagcaagaagaagaaagagcgaaggagatgagtggaaaacagagagtggacaagtctgaagaggaagaagaagaaggtgaagaagagaatgatggaaaggcaatattcaagtggaatactcataagaagaaaaggtctagatactcttttacgtgttcttcgtctgactctagagctcaaagttccaatggaagtagacgaaaatgaagaaggtgaggtgagatctgagtttgactttggtctcttcttctacgtgtttgtgtgtcttcttgccaatgtaacttatcccaatctaacatgtaatagtaatacatgtattttaattggtctctggttaagtttagctttttgttgttgttttaaggtactactaccaatgtatatgtttcttatgtagaatgatttattcgggattgaaaaacccttttcacctaaaagaaaacatacagcatgtaataatttgttcagaagatctaagagaccaattcattttttgagctactctaaatgtgcccttgccaaaatagcatccaaaccactgtctatgagtacaatacaaactaataaaagataaatacactcacaaattcatcttcatcattctctcttaaatcatcatcatcatccacattatatacgttcttatccaaaggtccaagtaactttggacaattcgtgaatatcactttgatttcctcaatgcctttaagagagatcatatttccatcaatgttcaacatcttgaaacttcctttcttgacaacaacacgagccaagcgcaatgctccttctcttctcaagtcattgtagctcatatcaacatattctaactcccaatcttccatactctttacaatctcaacacatccctcatcttttagatcattttcagacaaattcaactttttcagatgtctctttgctgccaaacaaactgcgatagctgtagccgcctcataagttatgttatttccagccatttctataacttgaagagatggagcggagttcttgagagcgtttactaaagctatagcacctccattctctagatttgtataacttagattaattacagtcaagaaactgaagcttgaaaatggtttgctcatagaaactccaacttttatatgagtacaagtctcgaatgcagtctcctctatagtatcctcattggttaagctagtgtccaccatattcaccaggagctcctttatttttttctcccaagtgaaccagaagcccaattcttatagttaaccatagataaatacagtttctattttgaataataataacagaggtgttataggaccatagaacctaaactccaacaaaatctgttgttatttattattgaatttaaaatcttcaagatattgacaagatatgtctaaaaatttgtatcattggttgaaatgtgtaagccatcttaaagagtttaattgatcccattagtagatattttactcaatatgttatgaaaagaatgataggtaattaaatcagaggaattgtataaaatccacttaaaatcaaattacataaggaaactttcgatataaaacaaagtttcctaaaacagtatgatttcatatctatctgtaggtcgggctcttgtatcaaacttaatataaacaaatgggcctcttatcccagtggtgaacaccaaatataatcttctgatgaacaccaaatatttttcactaaatccgatttcattctttgtaaacgaatttgtatttcaacatgttactattttgttctgtagagtttatcaagctaatgtttttttttttatgtagacgcctaatttattaaataaacgttatcttagcatcaacatcctcttattacgtacagctctactcatcctaaatattcattgagatggatgttttccgtattttaacgatagtttacaaaataagtaatattttagagactttttggaccgttgtggtaggccacaaagtaaacgtgtatgagctttgaacaaaatgcaaagagataccaatgttatattttattaatgcgagcacatgaaatgaaatcttgtgattcaccacgagcacgcttagcatccgaaagctttaatgcaatttttcattgaagaagcaaagaaaagtgaggaaacgtaaacactacttaaaaagagcctccaaataatatgaagtttaagatataataattaaagttattaatgttaattagaacaggtttggttatgtagggtttgatgtttgatctcgatccataggtgtgatttttagttcatgatggaccaaaagatttcatcgaggaaatagtgttagaaaaacccacatatatataaaataatatcgtcatatatgtatcaatccattgattggtttcacattatctaccaataaaatgtgaaaaaaatattaggaaatcgaaagattagaattcatatactaaaggttgaaaaatgaaaatagtaaagcttagattgatcttttcaaaccgcatatcaaaaggggtttttcaaccaccattaggtaaattaccgaatcaacaacataccaaaattacataaatcataatatcacattctgatactttgtggaagaaattacaaatgtaataatgttttcgtttgaggaaattgaacgaagacaaaagaaccgggccggtcataattccactttaccaatgtagaccgcaacagaaataacggaataagataataattttttgtcgtcttagaaaaaataaacaaaagagacaaaacaagttcatcatcagctacctctctgacctgttcctctaattctctcattcttcaaattctctggagctggagggtcaacccacccccctccttcttccaacctaaacctctcttttatgctaacttcttctctaccaccgtcgtctccgccgcc

SEQ ID NO: 10957 - DNA, 3000 bp, Unknown
  misc_feature (1)..( 3000): cDNA_ID_3038809_gDNA_ID_2214467_Annot_ID_182879 3000 nt of promoter + ATG
cacacaaaaataaaaagccattacatttcaatcaagaagatatcatattacgagtccaaaagtacctgcagacagctttaaaattatactcatttctttaaaatatatctatttatgtataaatggaaattgtgtttttgtctactatttgacaatataagatactaatagcaaactattgggtatggacaaacaaacagacaataataatttaaatggggtatatattgaaataatatggtataagaaaaattaaatccaagtaatatacttggaagcacgttgagctgtgcgggtttcttggtgttggaccactcgttttggttctagttttctttcttcctttttttttggtatgtcaacgttttggttctatagtttagtctgattattttatcggagtatttactttgaaaagtattatttattatcaactacgagttgcttttttcgttttttttttacgtgaagagtaaaaaattattactaaattttgttaagattagaatttacgatttggtgttaatcttattttcaggttttctgatatatatatacctatgcaatcataactagaagaataagaatcaatagctaaatagatatttgtgtcaattattcctaagttcaaaacttttttttttatagttcaaaacctatcaaaaacatattccctaaacaatgataaacgaaacaaaccaactaaagtaaaccgaaccaagatcttgttagcttgattctatcatcagtttctctaatccgtgactgttgtctgaagaggcaaataactctagactcctcctttagcctcagtttgctgcttctccgcaacagcctttgataatccaaacatatatcttgaaaaaccaaaatatattactattaacaaagtcataagtagtggttcagtgatcaagatctattatgagtttagtaaataatgaagaaagataaccttcttaatggttttgttgaaacagttcttgtgatcatccatttcttaacctcgtctacaactgcacattaccaaattcgaattcgaattgaaaccatgttttttataaaaaaattcgaattacaacatagcgaatataatagtaaaacaaacaatttaattaaacatattttttcttttatgtaatccatttaaatgttcaattgaatcccagtagtcattttccacaagaacaagaattagaggaccaaaagatgatatgcattccatggtgtctcaaaacaaatgggcctttagttataatgcccacttgtctctcctacaatatatgggcagcacagaacattagcaagtggccgcttaacattaaaagaaaaaaaaccaactcaacgaccccgttcaacgatttcatcttcgttctttaatttatgaaaatttacttaagataaacaatttagtataacattttttttatattaattaggttttttaattttgtaagatcttgaaatttattagaacaatttaagagtatatataatgtagaaactggtatgataatacccatatgtgaccaaataaataaaaatttgataccatttgaactaaaaacattacaatttaacttatatggatctgatatggaatatgaatacatataaaagcaaaaaatcttaaagtaatcaacgagtcaaactttaggtggctatatgatcaatataaaaaaaaggtagaagaaaaagaagaaaaaatcttttagaaaaaaataaaacttttaagtggctatgttttgagagaaataaatattcagctaaggaaccatatctgccaaattaatcaagtttgacttaacaataacatgtgtccaaagtaaaacaataacaataaccaaaaaaaaaacatccgcctaattactgccataacccataaatgataaaatgaatgacagattgtaatccgttatgaacagctcaatgtcttcacactccttcttctttatttatccatctttctatgcatttctgtaaaacctaaacatttacatacaaaacttaatccacataaaatattataaccatgtccaagcgacgcatttgctgcatagtttccggaatcatctttgtcctcttcgtaatcttcatgaccgctttgatccttgcacaagtgttcaaaccaaaacatccgatactacaaaccgtctcttcaactgttgatggcatatctacaaatatatcactaccatacgaggtccaactaaatttcactcttacgctggagatgctgctcaagaatcctaacgttgcggattttgaatacaagacagtggaaaacttggtttattacagggatacactagtcggaaatctcacacttccttcgagcacattacctgccaaaggttcagtgcttttgccatgtcctctatttctccagctcgataaatttgtcgcgaatttaggtgatatcgtgcaagatgtattgcatggaaaaattgtgatggagacaagagcaaaaatgccaggaaaaatcactttgttgggaatctttaagatacctttggattcaatatcgcattgcaatctcgtactcggctttccttcaatggtagtggaggaccaagtgtgtgatctcaaaactaagctgtaaatagttttttcaggtaaacatttaggcttaagagagcagtttaattctagctagtttcctgtaataataaagattgtagtgctcttgatcgctgttctttaatcaactccatttttgtgagttcttgaaattaaatgtattcctttgaatttgaaataatgaatttgattcaaaaatctgaattattttatttttacctccatttgaaaaaaggaaaaatagtgtattattattattattattttatgacaaataatttggagaagacttgaaaacacgaaatcaacggatagcgacatcatgaaacagagttagaaaagcgtgcctcctttttttagtatctatctttctctctttcggatcattctctcctctgattccgaatcgggtaaattatt

SEQ ID NO: 10958 - DNA, 3000 bp, Unknown
  misc_feature (1)..( 3000): cDNA_ID_1442595_gDNA_ID_2214467_Annot_ID_182885 3000 nt of promoter + ATG
agaatagaaaaaaagaatgggctttttctgagctaaagaaaccaaaaaaggtgaaataaacgaagaagaagaagaagcagaggaattatttgttataaaaaaggattttctaaaaagagtttcatggctggattcacggttggagttttatttagaattttaaaaattgaatcaaaccactctcttgctcttatacgacaaagacagaagagaccatcttttgtttggttagctagatcttagttcacacttaaaaacgctcagcatcatcatcaaataaagcagacaaaaacagattgtatgaattagcacatggagaaaatgggtccattggatttgatatcttattggctctatcctgatatttccatctctagattagcaattcgattggatgatgtgtataaagctgatcaacttcatgaattgttatatataaaaaaagagataactagctattctttgtgttggtgaaagaataaaaacaaattttcattttacgtcatgacttgagcataacgaaccctaataaattatgatctctcccaactctgctttaatttccactttgggcagaactcagaagcatacgtgtgaaagaaacaatacacaactagtgcagttgggaaaatcataaccctttgtttctctcagaaaccactttgatatttacgagtgatgattgttatgtaacgtctacgacacctacacatatgctagcaatcatgtgttgaaacacgatataaaacattctcctaagttcacgatataactgttttgatttctttcgacgcaatcatgtcaattaatttacacaaactactaatttaaaggaaattttaattgctttaggttttactacttaaagtagtttcatcaatatttttttggttagaggtcatgttgatagatgtcgtataggaaattcactctacaaatgcttactataagtttaggttttaactcaaaatgtttcaacaaaataaaatcatatattttttactatcctattaaaaaagagagagggtctgcctaataaagaaatgcaacaaacataagaaaagaccaagtgtgcgttgaagaacgagaaaaaatggtcttggtctcatgcacatcaccacatgttgatcttacgccgtggtcgtccacttgcctcttgtttctgaatttttgtttagttgtccctgctttttcctattttttcctgtaagaaccctaatgtttccatatgtctcatttcttgttttgcataatttaatgggctcaatgaagttaatgggcctaagagtgctacgacccaatagcacttgaagatatgtccttcaaggacttcctaagctctgttcaggtcaacatgactaactttctgcttcacaggtttatggaaattaatcaaacatttggtgttttaatttgaacttttattttctttagcatgaactcatgagacttcttgtgtcaaagaagcgactaattataaacaggggagggacaaacaacagagattcatatttgagaaaaagaaataaacaaaaaagcatgagaacatgatgaattagtattggctaaatacaggacttaacatgaaggctatggtacgcgatatatgactcaaagaatggtgcagccgcttccactttcataggtagtaacagacacaacatcacaactgttgcagtaaggtggcttgcatacatgctttggtggttcaggtgctggtggaggctttggtttttcaggctctggaggctttggtggctcaggaggttttggtggtggtccaacgctaatgatcacaggtttctgtttaatctttttcagccttgttgctacgcagaccggatccattgtccccaccacggtaagtatactatttccttcatctaatgaaatatgattcacacctgcaccaaatctcatgttcaagatgatatgttaagacttaagagcacatatttcttgagtcttttttcgttcattaccttctatctctgtgactgcttccatgattgcgctgttgcattttccacagtttatatccaccttgatctcaactttctgctcacaaccacaacaaaaactcaaacattcggtgtcggatttgaaaaggaactagtactaggatgtttaccttgacagtcatgatggattagccaagatcgagaaaaatggattaaaggaatgaagaaggaagagaagaagttattaaaaacatgtgaagacaaacagagatgacagattggaataatgttgaagcagttgaggttgtgtttggtcagtattgttaattaaataatcaagagattacaccatctacgtgcttagatgcatgtttttgtataattgaataagaggttttgggaatttgcttagttggtattcagccaccatcttatggacttacttgggacattattgtggatggaatttgtttaatcttgaaaatttatgaatatattattgagtcccatattctatctaattttgtacgttcttgaccccaaatgtttatttatttattttaatattgtatatgttatgatcatgcaaatgcatggatagagaaattccaagccggtttaaggttttggttttatttctatcccggtttggatttagctgaaccaaacaaacctcttgagttctttcaccagtaaacaaccaaaatcatcaatcatttcgagtttggtgattattagagtttgaaggtgtttttgttatggtgagtgtcatcctataaactataggctaattaatgtgtccaacaaaacaaaactctttttaaacaccaaattttaaccaacgatcagaacacctaaacctaattatggcaaaattttaaaattaacacatctatggcccctctccataattatctcttctccattggttttccattggttaaatcttctttacgtagatatataaattgagaaacaatgttaaagtattttctcaaactcatcaataacatcttacaaacaacaacaatcaacaatg

SEQ ID NO: 10959 - DNA, 3000 bp, Unknown
  misc_feature (1)..( 3000): cDNA_ID_3038800_gDNA_ID_2214467_Annot_ID_182889 3000 nt of promoter + ATG
ccagatttaacttgtcgttttttgttatgtactcttcaagattactttggtcgttcctgttttattgtctaggaatgtaaataaaacaaaattaatgctagttaagctcagataaacaaagttagaactagaagatgtgtatgttctgtgtcggtagaaaaacaataaaaacaaaatatttgaatttagatatgtttgggcctttacacgtttgtgtgtgtgtgtttgttcacagtttgtttggatggaacattgcctggatatcacttgcaccgtggacatggatctggagctaatagctggctcattcaattggaggtttagtgaattatttgttgtcgatgaaacactagttaaagtcttcattgttgatgtttgatgtttttgtatcagggaggaggatggtgcaacaacatcaggacctgtgtatacaggaagactactcgacgtggttcctctaattatatggagaaacagcttcagtttacaggaatactgagtgacaaagctcaagaaaatcctggtttgtctcaatctttgtttaagttttgttcatgttagtgtaatgttaatattgaaaatcatatattctcattgtcatgtgctttacttctgcagactttttcaactggaatagagttaagcttcgttactgcgatggcgcttctttcagtggagatggccagaatcaggttgaaatcaatcattttttgagttactagagttcataagagacccattgttgtgatttggaacaacttgctagtttctaggcctttggaactctgtagtctataatcgtcaaggctgttattagccacagagaacgcttgatgtgatcttagttctgtagaattgagcagccattggttttgtgtaacatctgtgaactaatgcaaataaaattctttaccttaactttttcaggctgcacaacttcagtttagaggagagcgtatctggagagccgcaatagatgatttgaaggcgaatggaatgcgatacgccaatcaggttttgacacttaaccttctataagagtctgtatctcttccatagcataatatcaagggcaggaatggatttaactatttatattctgtcaggcacttctctccggatgctctgctggtggtttagcagcaatcttgcgctgcgatgagtttaggaacttattccctggatcaaccaaagtcaagtgcttgagtgatgcaggcttgttcttggacacgttagtttatttctcccaagtcaaagattgtattaaagctagttcattttcccttaccttagtaactactactgactcctttgtttctgtaattatagtgccgatgtttcaggcggccgcacaatcaggaacttatacaatggtgtcgtagaattgcaggttggattcctctttcttcacttgaaagtttcttactttacatttaaagagcacaagaaacttaagaaatcttcttcacaatttacagagtgtgaagaacaatcttccacgtatatgcacaaaccatcttgatccaacctcggtatcttatcttttgttctctcattctgatgctgttgcaaaccggtcattcgaagtcttgtgttttgataactcatatatctgtacagtgtttcttcccacaaaatctgatcagtcaaatgaaaactccactttttatcgtcaacgcagcatatgatacatggcaggttatgttttttctccctttgaaaagtgccacattgctactaaagaacagaaagttgatggttaggctgacaagtctctgtaatggtttttaaacagattcaaagcagtatagctccaacatcagctgatcctagtggattttggcatgactgcagactaaaccatggaaaatgtactcctgcacagttgagattcttgcaaggttgttctatagatcataaaaacttgtggacttcaccctttaaagcatcattgtatcactctaatcgtttaatcttttattcgagaacaggattcagggaacagatgcttagagtagtcaagggcttctcaatgtctagacagaatggattgttcatcaattcttgctttgctcactgccaaaccgagagacaagatacttggtttgccgatgattctcctgttatcaggaaaaaggtaaaacctcactcaaatctttcccacacaaacaaagtaacacacaaggaaagcctgtttccactttctagatcttgactttgtctatggaatgtttgtaggcggtggcaatagctgtaggagattggtatttcgatagagcggaagtgaagttagtcgattgcccatacccgtgtgacaagagctgccacaacttggtgttcagatgattgtttgactatgttctttattctctctcatatatacataccttagaaaatttctttctttcaaaaggaaagattttgtatcctttggtagtaaccaatgcctcattggtatatgattaagtgtatcgtggaaaatcataataaaaaaacaaaacaaaacaaagtttgcttaaaaagagttcaatgtaatcaatcacagagaaatgctctttcttttgttttgttttctaattttctttgcaaatgcaagtagttgatcaaatatattagaaatgtcaacattggtaccaaaagaattcaagcctaactaattcttttatgtattataagtgtccaacaaaagcagataatggataagaataataataaaatagtaaaagatagagagaaagtgaaaagagtaagaatatacagagtgtgttgacaacttgacaccctgtttttgtggggggtgtgagtgacagctatctagtgttccccactttgtgtgtgtatatgtgtgagtgttttttttacacctatcatttgctttcaatttctcccagtcaaaatactaacttcttcaacaacttctggaataataatctgaattcttgaagttgaaccctgtccattacttttctccttcttctcctgccttctgaatcttcttcc

SEQ ID NO: 10960 - DNA, 3000 bp, Unknown
  misc_feature (1)..( 3000): cDNA_ID_2704744_gDNA_ID_2214467_Annot_ID_182881 3000 nt of promoter + ATG
cacctcgtctctttacctagctgcactcgtggccagtttcgtcgcgtccgccacctgttctaaacttggacgcaggccgacgatgcagtttgcttctatcttcttcttgattggtgtcggtctcactgcaggagccgttaacctcgtcatgttgatcattggaagactctttcttggctttggtgttggatttggcaatcaggcagtgcctcttttcctgtctgagattgctccagcacagctccgaggaggtctcaacattgtattccaactcatggttacaatcggaatcctaattgccaacattgtcaactacttcactgccacggttcacccttacggatggaggattgctctcggtggagctggaattcccgctgttatcctcctcttcggttcactacttatcattgagactcccacaagtctcatcgagcgcaacaagaacgaagaaggaaaagaagccctaaggaagatcagaggagttgatgatatcaatgacgagtatgagtctatcgtccatgcatgtgacatcgcgagtcaagtcaaggacccttacaggaaactgttgaagcccgcgagtcgcccaccgttcatcatcggaatgcttctccagcttttccaacaatttaccggaatcaatgcgattatgttctatgcgccggtcttattccaaactgttgggttcggaagcgacgcagcccttctctctgcggttatcaccggatcgatcaatgttctcgccacgttcgttgggatttacctcgttgacagaaccggcaggaggttccttcttctccaatcttccgttcacatgctcatctgccaggttctaattaaatctctcatctctttgtttcttatgcctcaagtaacttaaaggtaggtttcttgtcccagaagtaaactaactaacctcttaaaacagttgatcattggaatcatcctagcaaaggacttgggcgtaacgggaacactcgggaggccacaagccctagtagtggtgatctttgtgtgcgtttacgtgatgggatttgcatggtcatggggacctttgggatggctaattcctagcgagacgtttcctctagaaacacgtagcgcaggattcgctgttgcagtctcatgcaacatgttcttcacttttgtaatcgctcaagccttcctatcgatgctttgcgggatgagatctggaatattcttcttcttcagcggttggatcattgtgatgggactgtttgcgtttttcttcataccagagacaaaaggaatcgccattgatgacatgagggagagtgtgtggaagccacattggttctggaaaaggtatatgcttccagaggacgaccaccatgacatagagaagagaaatgcttgaaaacacgagtctgttgatttgtgtctttttcccctgtttctgttttttttttttttttttgggggggtattctttgattctttcgcacttcttttgtttcgtgggaacgaatagttcaataagaccaacttgttgattcaggttaggtattatcaattaaattccatggaaacaaagtttttgaaaatcacattcctgagtactatatattatttagatgttctcattattaccgttttctctttgctcaatgtcttctaccaaacgcaactgctaatttcacattaggggagagagcgatcttctgcgtttgcagaatcgctacatcaagaactactgtaaaaaaaattcaaattttcgatagtttcaaacgccaatgttaaaatgttataaccctgagataaaaccttcttccaaaatctcattattttattttaaaaatctcaattgggataaattagctagataaaatatatgtgtaatttctagcacactcagataatatgatgattattttttaggtttatcttgaatcgaattgtaatgtaggattgagaattatagcagcttctttgagaaaaagacagcaaaaggaatggagataatctcgtagatgattgcaaaggaatttctccaaaaaataagaatacaataatatctgagataagtgaaagtgtttaccaccatccctcgagctcaacccccaatttatatttgacaacttgtaatgcacgtgattgtattgtcaaataaatgtgcacaaactgtaatttaataacaatgaccgtattatagtgattagggcacttagattaagtggctctgcacttgtatgtttatcttccaacttaccgtgagtcctttttggtcactctcctcatgatgtatacgtagccatcacttataaattccatgtattttgaactaatttcagatttaaaacgcaattcttttttacaacaaagattgaaaattcaaatatgaaggtggcctgtaatccaataattaatattatagctcaacttaagatttagataattattattgacttaatcacttaattgtgagaaatgtggatagagcactcaaacaaaaaatagcaatatgtcaaacatttaccctctagcctcctttgtttttttctaaacttcaatttgtgaatgtcatcagcatcacatcagttttttccatagttgggggaaatattattagttttttcattgaggcaaaagatgaggtactaattctagatttataccacacttaagtagtgaactatataagaaaattgccttttttataattatataattcactatataaatataaacatgtacgcaaaatctaaagtttttaagtattctttaatctcagtgataaaaataattgtcaattctttgttttgtgaaagaattctttctttgttcattcgcctaattagtcgtgtaaatcaaaaataggagattcaccaatgagatgtaacctttcgtacgactcttaattaataaaactcccattaaaaaataaatataactttattgtgctatatatagcgcatcattagcgtgcaatatttctcaattccttaccacaaagctaaggataaagaaaataaatagtaa

SEQ ID NO: 10961 - DNA, 3000 bp, Unknown; identical to SEQ ID NO: 10957
  misc_feature (1)..( 3000): cDNA_ID_2716962_gDNA_ID_2214467_Annot_ID_133044 3000 nt of promoter + ATG

SEQ ID NO: 10962 - DNA, 3000 bp, Unknown; identical to SEQ ID NO: 10960
  misc_feature (1)..( 3000): cDNA_ID_2704744_gDNA_ID_2214467_Annot_ID_133046 3000 nt of promoter + ATG

SEQ ID NO: 10963 - DNA, 3000 bp, Unknown; identical to SEQ ID NO: 10958
  misc_feature (1)..( 3000): cDNA_ID_1442595_gDNA_ID_2214467_Annot_ID_133048 3000 nt of promoter + ATG

SEQ ID NO: 10964 - DNA, 3000 bp, Unknown; identical to SEQ ID NO: 10956
  misc_feature (1)..( 3000): cDNA_ID_2716970_gDNA_ID_2214467_Annot_ID_182876 3000 nt of promoter + ATG

SEQ ID NO: 10965 - DNA, 3000 bp, Unknown
  misc_feature (1)..( 3000): cDNA_ID_3041106_gDNA_ID_2214468_Annot_ID_182903 3000 nt of promoter + ATG
ggtatgttatcgatttgtatgtaattttcgatcaccataattgtaaactaagttaatcactcgtttgccaaaaaaaaaaaaagttaatcacttaaaaaattgccacattttctttccaggagcaaacccttccatgtacgcgtcatgcatcaaaagtcaaggtacttatgattattggcttttgtacttatggaataggacatttcgaccctactgctccattgttcttatgttttcttctgcattgttgtgaccttcaggctcaagcaaatgcttgtggtggggcttgcaaaacctttcagccaaatgatgcagatcatgagcatggtaagataaatcacagtcaaagatgaaatgtaactctttcggttttcattgttggttctaggaatctcttagcgtgatcacccttattgacttttttgtttcattttcagcttccgggagctccaacgctaactcattgcaaagaaatgagaaagccaacagtaaaaggttgggtctctcttgatgtttcaaccattgtcttataaaaacttttggacaatcttgttatcctggatttcttgcttttctttataggagagtttctggaaggaagaatcccgccaattccgaggtattagatataattggcagatcgggagagacatgtcagatggaagacaacattgacaacaagaagttggtctctgatagtgacaatgatgctgaaaaccatataaatgacaatgtccaaagcaaaaggtttatttattcaaagcgattagataacgtaaatatatatttgtatttcactatcttatttttgcttcttcttttttgggttgtttttgctacagatattgtgcaggaagacagagtagcagttctaagactcgagaagccagccaaacagaaaccttgcaaaaggtggttgacgccaaagaaattaagggggatgcaaggtttgtttaactgcctttttccactttcaaatttgggaatagcattcaaagtggatgaagaatagtggaactgacttgtgagtatacactttctctgtttcaaacaggttttctttgacaaagcattctgactggttaaaatctcaagaacctgagccatctgaaagcctatacgagtcaaggttggttaactgtcctttttccagtttcaaattttggactaacatctaaagcctgtgaagactattggaaatgactagtgattttgcactctttgtttcaagcaggttccctttgagaaggcgttctgcccggttaaaatctcaagaacctgagccatctgaaagcttccatgactcaatagagacaaccaagaggaggaggtcggcaataaggttaggctctgtttataactactgtacccttctgaaggttgatatagtgcgatatgatcttttgcaggtctgctatgtttaatatccaagagctgggcgttattcaaaacttgaacggtttacctgatgatcaagagattgctgcaaaggccaggtttgtagaagcacatgttatttccttttccactaacatatccctgaaccaagtacacttatgccatttgcggtgttttctttttctttctttgtggatgtcatttcagatgctctgcacgtgaacagtctaccgggtctaaacccgaagcagtagaaccacatgacacaaaagagataatcgggaaaagcaggttttgtagtgatagataattgtctgtattctgcagtattacagactaaagtgttaagactgttatctaatgcgattttattttccgcaggatatctttgagaagacagtctgcgaggtttaatttccaagagctgggcgtgactgaaaacttgaatggtccacatgatgatcaaacgattgctgcaaatgccaggtttgtagtagcttcacatgttctttccttttccaatcctcttgacttataacttattcataaaccaagtacatttatgctacttcctctgatttctttatggatgtcattttagatgctgtgcaagtgaacagtctatcgggtctaaacccgaagcagtagaaccacatgacattgaagagagaatcgggaaaatcaggtttgtagtgaatatagatcaattttctatattccgttaaagtaaagacgtaagaatttttatctaaactggtatacttgacagagtctcttcaagaagacaatctgcaaacattgaaactccgagagccatcaaagaacctgcaaatccgcctttgcatgatgacaatgttgaggagtctagtcagatatcatgttcagtttcaatggagcttaaaagagaatcaaagaagaaaccaacaggcgacgaatcagaggaaatgagaaaaacaactgttggaagaccttcaaggcaagctgctgaaaaaatcaaatcgtacaaggaaccttcacttaaggagaagatgcgagggggcttctgagtcttgctaagatcgaataccctctcgtcagcctcgtatgtattggattctgcgacttcacttttgttcagtgagctattgctcaatgctgtagatcacaatgtatattcgtagttgcttgtagataaagctagcgagtggtcttgctactgtacatgaagcggattggacggtttaattcggtttgatggagaacccctctgtgtactctgctaagtaaattctttcacaatctcatttgtaaaggggtgaaataatattttcttcatttttttcttacagtaaataaattagtaaaaacaagctctctaattatatcatgggtaataaaactcgagcggtggtaaaacaaaaacctgacagttttgagttgacaacgaaccccataattcaaagattgggagacagtgaaaagtacacaagtgaatcacggtacgcaatctaccgccttatttcttaaaagataattctaaggatttttgttcttttcttgttgttttcctataaaaggtttaataattgttactttaaaggttttgatttatcagataaacga

SEQ ID NO: 10966 - DNA, 3000 bp, Unknown
  misc_feature (1)..( 3000): cDNA_ID_3038861_gDNA_ID_2214468_Annot_ID_182915 3000 nt of promoter + ATG
ggcttcttcatcacaaccgcaaacaccaacttcccggcaaaatccatctcgctctgcggtggataggctaaccactcgaactcttgaaccatcctcgctatcatcaaatgcacatgtaccgtcgccattcccatccccggacagatcctacggccaacaccaaaaggcatcatcttcactccagcaactcctgttatatcggcgtcttcccgccctgataagaaccggtcagggtcgaacttttttggctctgaccagatcttcgggtcttcactaattccgggaagataaaactcaatgttgaccccgacagggatgttatagccagagagagtcgttggttccgttacaccgtgacttaatgtaaagtaagtcggtggatgtcgccggagaatctctttgactacagcttgtaacaagaccattttgtccacgtctctttcatcgaccgcacgatctccaaccgttgatttaatctcatcgtacagtcgagattgaatctcgggattcgctatcaactctgcgattccccactcgatcgccgccccagtcgtgtccgtaccggcattgagaaactccgaacagagcgttacaagatcttcatcagacggcgtcgtttcacttccttcgatgattctaagatcaaagagtgtatcaagatacgagaaagacgataccgttgcggtccgaatcgccttccgtcgtttctcgatgaatccgacgacgaaatctacaagttcccgacgaagcttaagagcacgatttctctcattgtagttaaacggcgttaagatcggaaggtaatcgtggagttttggatcaacggcgtttaatatcgccgtcatcaactgatccatcttctcaattgattcctcttccatctcaactccaaaacagatatctaataaaacacaaaacgcagcgtatctgctgttttgcagaacccagacgagtccatcgttgtctctagcttcagatttgattctctcgatgagtttatccatggcggattttctaacagaaccaaactccttgagccgattcgagctaagcatgttctgaaccatgttccgtctcaatgacctccacacaggtccatacatagcggaatgaactgtgatttcactggagctgaagattttccgggtcggagtttcaacgggtcgggtcgcgaattgtgctccacgttcgattaacgcttcgtgggcgagactggcgtcggagatgatgatcattgttcgagtaccaagcctgagagtaagaatcggaccgtagatctttacgagatcctcgacgtactcgaaaaactgtttcccggagcgcgtgaactgaaataagtttccgatcaccggccatcctggtgggccgggcgggagatttaaatggttcgaattgtgtttccggtacgtaatggttttaagtaaaccggatatgataatcgctagaatggttaagaagacattactagataataagtccagagaaataggagaaaatgataagaatgacatttttaaaaatcttcacctcctctagtgttttcttttagcttcggatgaattgaagaagaagaaaagaggaagctttataattataagactgaaatatttttgtagtaggcaaataatttttgttaggttaatcgtcaatgttataaagccgtaacggtcgttacttgacttgtaaatcttaatttgatgtttgttttcctatttcttcgtataattatctttttaacgccttcgcattattgcttaccatttctatttgcgatatagtttcatttatttacatgtataataatcatattagacgtgtatacagcatgttatagcaatcggttatatgttatatggagtataaaatcattacttagaaacagttagacgttatataatctgatggaaattgagaatgggctcagcattatatggaaacgtttcttataagttactgcaaaaaccacgcaagattgattgcttaaaaagctgatttggccgatcagctcgagaggataacgagttacaatggttgaaaacatataacatgttgtagtgttttttaagtggtaagaggaggcaacatgctatgtgttatagaatattgacttagttaggttttaaagtggttataattttacaaattagtaccgacatatcttttggattgaagtggtacatatgtattgaggaacggacattcgaagagcaccgggaaatggtgcaaaaagtagtgtgtgctttttttttcttttacttttttttttagtcatgtattttctattttcaagtattccggggtttagtgattaattttaatatgctgaaattattattttttaggtaaaaactaatgagaaatatactattataaatcaagggggaaacgattgcggaatttttctgaaccgacagagtgttgcaggtaattttggtcttttataaattcaacttggataattcaggtgacatggctttgaagattattgatgttgatgtttaatacaattcaaattgttgataaacacctgtggattatttagtagtttgtgactttttgttgttaagacggtgacatataattgtgcacaactagagataagttcttctaccgtccaaaatttaactttatataagaaaaacatttcgtacattatatctaatacgaaaaacagtattttgaataatttaactttagttaaatttctaaattagcgttaagataaagaattattatggaaaaatattttggtaaatattttgattgacctcagattattttgccttgattttttttttttttggttgccgataaatacaaatagataacactaaacaaaataaagtacaaaaggaaaaaaacgacaacttcgtaccaaaccaaaacagtgtcgtattaattgattggtgtggcgaaacaaatccgtcgttttgctccgttgatcggcaggtgatcaccagaagcctcgtcaccgtctctttctctcccccctttttcatg

SEQ ID NO: 10967 - DNA, 3000 bp, Unknown
  misc_feature (1)..( 3000): cDNA_ID_3041147_gDNA_ID_2214468_Annot_ID_182926 3000 nt of promoter + ATG
tgtgttggacaattagaggagcctagactagagagagtagaggttgatgtaatgtttacagaagctagtgaagtccattttcagtgtagtcaatagaatctcactttcttgcttttgaagatgttgcaacttgaaatagtttctttctccatctttgttgactgacttcttctttctgaaagattgtatcttgattttcagaattagattttgacattctttttacagatatagaatattttgtaatcctcccaaaaacaaatattcgaaagccactaaataaagacaacccaacaaatataactgtacaaaattgtagaatggtttgacaaaagtatttatcaacttttgaattttgatcatagtgacatgtatctaatagtgatttgttaaaatggataataccgtagaagataaagatggcaataaagtttgtgaataaatgaatttttttatatttccataaaatttagaaaagggatgatactttagattagatgctaaaaacagcagcaagtatttggcatcttgcaagatcggatattgttatacacctccaccaataaaagcacaaatcaagtttgctttattccttttcgttatatcgaatatttgtaaatgtccaatttgttaagtcataactaaaaacatggataacgttggtgttgttcgtttggcagcaaaaacaatggaatttgatcacaaggagctgaaattcaaaacgattgtcttaattgttccgattgatagattctatgcccactgatttaaaatgggcctcatattaaaagcccgtttaaatcagttgtctcgaaaattgactttttggtccattttgaactatgatttggagttgcaataaattgaaaacagcatgtaattcatctcttcaattgttttgtgataagaaaatgatatcaaaaacgttttctatgtaagggtgtgttttgcacaaaaaatggtcagggtgtgtagtctttgtccgtaattttcagcagaatcaggtcgtgatatcagaagctcttctgtgttcacacctattgattctgctagagaaggatccatggcattctctgcatcaagataagcgcaataacctggtacaagcaagtcctttttagataaataaaaagctaatggagtgaagaacaaaagcaagtcagaatcaaactgtaacttcacaaaatcgaatcttagccagagcaagccaaaacgcttcttcttccattcagctacaaagcaagataagagtaaacacaagagacattcgtttagtcaggagcttgggcaaatcatcaatgctactctaaaggagataactttattttggttggattgttgtcctagtttcttcatctgaaaaatcaaatctttctttcttatactcaagctaagaattgttgagaaacattagagacgaagagaacctgagataagtaagagaagaaacggaatctctgaatcggactggcccatgagagtcgacccattccccgttcttcttcaagcggctcctccttcgctgttcagtttcaattccacagttctgtcttcgatctccagtttccgccatggtcattgtccttaaccagaagtggatacataaaaatcgaaaaccgtattaaaccgatcggttcaaggctaatggaatctaatttaacggaacctattaataatctaattattgggtaatgttagagtacaagcctattaacaaaccctaactttacccatataaattcttgcacacaagtttactttttctttttctttgctttcttctgtatttgccgccgcttctctgctctccagctccggtcaatccgtacaggtacgttctggttacattcaaaacggcacttcaccataaatgaaaacataggagaatttcataaaagaagttgtgaaattcatctcttttaattatagatgcagctcgattttggatctctcttgatgttcctgcatctctctagattgtatcaatacccaaatgttgaaatttaacggcataattgaaattgaatcctcatttgtagttactcgagactcttatgtcaattgttggttctttcatagtttattagtcagaagttgatgtatctgcatttctctgatttgtataaagtagtataatgtgaatgttctctgatggtttgtctgaatttgggcaggtaagtcaaaaagttgtgaaagatgggtcgtgttcgtaccaaaacggttaagaagtcttcacgtcaggtgattgagaagtactactcacggatgacactagacttccacaccaacaagaagatcttggaagaagttgcaatcatcccatcgaaaaggctacgcaacaagattgctggattctccactcacttgatgaaacgtatccaaaagggtccagtccgtggaatctccctcaagctacaagaggaagagcgtgaaaggcgaatggactttgttcccgatgagtcagccattaaaatcgatgatgttaaggtggacaaagagacactagagatgcttgcttctttgggaatgtctgatattgctgggatttctcaagtggagacacaacaagctatggcacctgctgtgtttggacgtcccgcaggaagataccaacgctaagtttattgggtttcaatcaaagatttcggagacgagagtttggtttattggtctagtatggattcaacatcgtttcctttgatttaagattaatgtcgtttcctttgatttaagattaatgtctggaatttatagcttttgctttgttttaacctttttttttggtccattttgaactatgatttggagttgcaatcaattgaaaacagcatgtaattcatctcttcaattgttttgtggtaagaaaatgatatcaaaaacgttttctaaattccaagggtgtgtagtctttgtacgtaatattcatgatgagtcaggggcataacggtccagttacttattaatttcccgaatacgtggaaaaataggttttggctcgaa

SEQ ID NO: 10968 - DNA, 3000 bp, Unknown
  misc_feature (1)..( 3000): cDNA_ID_3038846_gDNA_ID_2214468_Annot_ID_182930 3000 nt of promoter + ATG
tccccagttgagatccctggtgttagcaatatggatttcttgaatatggcattcaatgctcggaaaagaaagcttggtcagccagagcttgatccaatccaggtgccttatcgaattaaatgacttggatttggtttgcactgtttcttacttgttgttgtttgctaaatggtcccaattgtagaactgtctatgtattatgtcttactgatatcacatggctcatgcagttctacagccacttggtatcaaaactcgaagttgtgaatatgaagaccgattttctcaacagaaatgtcaatgaaggatttagtggtggtgaaaggaaacgcaatgagattctacagttagcggtaatggttctgcttcccttgtttctcagtatccataaggactgcatatgataagaaacaaatgtgattagagaaggtagtggattactaagcttgttccatgctacagtgtgcaaaaccacaaggctaatagttaggaatttcaggatatctgggtagattagcttaagcagttacaggttttaccataagtagacgcggttattgcatggcagttagtattctattacaagtatttgactgcagttttagctaaaaagacatggcatgttatatgtcttcatatctctttatattttcctgatcttgaaatatctgcctcccaaggagtggtcatttctggtttatcgataacatgagaacactattagtctcctattctttgtaagcaatatatggaaagaggtcatggaagtacgctaatgcaacgttttcctgtccttgcaggtccttggagctgagttggctatactggacgagattgattcagggttggatgttgatgctcttcaagatgtggcaaaggcggtgaacgggcttttgacaccaaaaaactctgttctgatgataacgcactaccaacgcctacttgactacatcaaaccaactctcatacatatcatggtgagcattgttgccaaaccagccttctttactggctacacaatgatcatatatattttggtaagctcatgtatgtttccttgggtttcaggagaatgggagaatcattaaaaccggagacaactccttggccaaactactggaaaaggaaggctacaaagcgatatccggttagttatcgcggatcatacatataacctgtcttccttctttgagagaccatggttattatatgggacaaatacaatggaagctaaagctgatgattggaaactgaaatctatcactacaatctttgacccgtagttttggtttgcaatttgcatgacaaactactttattgggatgtgaacagtattccacacctttttgtaactaacaagtttaaaattcagttaataaattttgttattataaatgctcttataaagtttgagactttaagtggatcaaatccaatcaaacctagtggttacttacattacttgagaaatttgacaaaataaaatttaatttgattattctatcgcctgctgctgctggaacgagttggtaatagaaaacaaattcataatttatgacaagaagaacgcaaaattcgctgatgattattaaacccaaacgcgtttttcaaactcgttcaatcaatttccttcatcatcttcatcttcttcgtaattgacttatcgaacaagattacacctccctttagctttttatgcaaatgtagtgcttttaagcattctctcgatttccctcccttattttccgacaaataccaaaccaatattgttccttttcttttcaatcccagatcgatctctttgttttcagacaatttctgttgtctggattcggttcattgcatcgttctttgtgttgggttcgtttaaactttcgattttcccattttgaaaattttgatttttttcttgtggcagattgattgttgttgtgcaagattcatccgttgcatcgacccgagtagggtttttgcttgttccatcggtgttcggagtttttaaaatcattgcctgatccggagtgatcaaatcctatatattgtcgttgcacaagagaaccaagtcttagattataaagagatttgactttcacttttagtgtctatgatcattaggaatgagatcagatcaggtcaatttgtgttcttttgatcagatcttgatgtggaaagcttgatgctgttgattataagtagagagatattttgatgggtaatgcttgcgttggaccaaacatttctggaaatggtttcttgcaaactgttacggctgcaatgtggaggccacggatcggagctgagcaagcttcttcttcttcccatggtaatggacaagtttctaaagaagcagcttcagaaccagctactgatcaagtccagaataaaccccctgagcctatcacaatgccaagctcaaagaccaatcccgaaactaaactgaaacccgatctagagatccaacctgaagaaaagaaggagaaagttcttgcagaagaaaccaagcagaaagttgttcctgaagaaagtaagcaggaagttcctcctgaagaaagtaagcgggaagttgttgtgcagccggagtcagcaaaaccagaaacaaagtctgaatccaagccagagacaacaaaaccagaaacaacgtctgaaaccaagccagagacgaaagctgaacctcagaagcctaaacatatgaggagagtgtccagtgcagggcttagaactgagtcagtgttgcagaggaaaactgaaaactttaaggagttctattcattagggaggaaacttggacaagggcaatttgggacgacgtttttatgccttgagaaaggtactgggaacgaatatgcgtgcaagtcgatttccaagaggaagcttttgactgatgaggatgttgaagatgtgagaagagagattcagataatgcatcacttggctggtcatccgaatgttatatctattaaaggtgcttatgaggatgttgttgcggtacatcttgtgatg

SEQ ID NO: 10969 - DNA, 3000 bp, Unknown
  misc_feature (1)..( 3000): cDNA_ID_2990859_gDNA_ID_2214468_Annot_ID_182928 3000 nt of promoter + ATG
agtagagaaaagtcatatcagcatgcctataggggagaaaccacttactccatctgaagccatgccatctacatcatatatttctaatggtgacgcctctcagggtacttctaatgggtctctggaaactgaaagaaacaagtttgttgctttccccattgaagctgttcagcaaagtaatatggcctctgagccaacttcaaagttcatccaagggactgagaaatcgagtatttcttctggcaagccaacctcagaagagaaacgtatccctctggaagagcctaaaaaacctgctgctgtatttcccaatatctccttttcaccgcctgccacgggcttattaaatcaaaacagtggtgcatctgcagacatcaagttagaaaagactagcaggttggtggcatgatatttttcctctcagcttgataggcttttatatcactacttgtgcctaagtgagcctcatccatattggttatgattttttttttctggtttactcgcttccgactctctttcttgatgttacagcactgcgtttggagtatcagaggcttgggcaaagccaactgaatcaaagaaaacgttcagcaacagtgcttctggagctgagtcatctacctcagctgcaccaaccctcaatggtagtatattctcagctggagcaaacgctgtcactccacctccgagtaatggctctcttacttcaagcccttccttcccaccttctatttcaaatataccttctgataattctgtgggtgatatgccgtccactgttcaatcttttgctgctactcacaattcctctagtatatttggaaagttgcctaccagtaacgacagcaactcacaatcaacttcagcatctcccctctcttccacatcacctttcaagtttgggcaacctgcagctccgttttctgcgccagcagtgtctgaatctagcggtcagatctcaaaggagactgaagtaaaaaacgccacatttggaaatacaagcactttcaagtttggaggtatggcttcagcagaccagagcactggcatcgtttttggtgctaaatctgcggaaaataaaagcagacctggttttgtgtttgggagctcctccgttgttggtggcagcacattaaacccttctactgctgcagcttcagcacctgagagctctggaagtttaatatttggtgtgacatcgtcctcaacccctgggacagagaccagcaaaatttctgcgagttctgcagctactaatactggaaatagtgtatttggcacttcctcttttgcatttacaagctctggtagtagcatggttggtggtgtatctgcaagtactggaagcagtgtttttggattcaatgctgtttcatcagcttctgctactagctctcaatctcaggcctcaaatctttttggtgctggaaatgctcagacgggtaatactgggagcggaaccacaacatcaactcaaagcatcccctttcagtttggttcatctccatcagctccttcatttggtttgtctgggaactcttctcttgcatcaaacagttctccatttggattttctaagtcggaacctgctgtatttacttctgtgtcaactcctcaattgagttcgacaaactcctctgcaagctctagtagtacaatgagctctcccctatttgggacaagctggcaagctcccaactcttctccaaactctggtccagtcttcagttcctcgttcaccacatcttcaactcctaccaccttttcctttggaggatcttctgctgctactgtttcgagcactactactcccatttttggtgcatctaccaacaacaccccgtcaccttcacctatctttggtttcgggtcaacccctcctaccactccccagcagccggtatttggtaactcagggactccatcacagtctctgtttggtaactcaactcctgggtttgcatttggtgcacctaataatggaaatggtatcaacaataaccaacaagtgagcatggaagacagtatggcagaagacacagaccaagctaatagagcatctatggtagccccaatgtttggacaagcagcagtctcgatgcctcaaccaaactttgccttcggtggaggagcagcaacgcagcctccatcaatggcaaaccccttccagtttggaggccaaccaatggcaagcacgttacagaacgcatcacctttccaggcatcacagagtctagagttccaaggaggtgggagcttttcactaggcagcactggaggtggcgataagtcaggccgcagaatcttcaaagcaaagaaatccaccaggaagaaataagaaaaacacattgttcaagagtcattttatcagccttatggtctttttgttcgctatatactccgggaaccttggggattacgagcatatcgtcgtttaatgaaagaggtaaagtatgagaatgtgtatcgtttatgctcttgatcgtctctgtcattttagtatgagtcaggattttgggggtcaaattgttcagggttataaaagttgtaggaaagttttgtaattttcagaaagtactggtgtctgtaagagtaatatagctctgtgcctctgtctttcgcttctttttctttttgtccttataaaaaaacacactttattgtagctgtttgttaaactcttttctctcttcagttctggttttagtggtttaaattaataattgcctcattacaacttggtttacccaaatcaaatcgaaccaaaccaaaattgaataaatccaattcgatgatcttcaaggaagcttcttttagttgaccaattccattaaatccaatccaattcgatcaagtaaataaacaaattctcaatccttttattagagaagccttcttctccaaagtctcgatttctctttattcttccaaattcttttgtctctctgtatcatccaaaattcccagatttattcacggagttagaagaagaagatg

SEQ ID NO: 10970 - DNA, 3000 bp, Unknown
  misc_feature (1)..( 3000): cDNA_ID_2034861_gDNA_ID_2214468_Annot_ID_182916 3000 nt of promoter + ATG
gttaccaaatttggaaggcccgcatgcaaaagtatatagatcccaaactctctctggcttggtacacttcagtaatgcatcaaacacattacgtctctgcaaatgtaagttttgaaggttagacagaatttacggagaaatgactaaggcagcataagaggaagtgagagtttcacctgcttggtgcgaggacgaaagccataaacaattatcctcatgtctttgcctgcaagatgaaagtgatcataacatataatgtcaagtaaagatacaagacgcatcaaataaagatgtaagagaagtagaaaacacttcaaccaacatcactgtgggaagatgtccattgtccaagataatattgggacgtcaagaatcaaggaaaaaaaacatgaaacacaattcaacgtcatagcgaatattaagctatgacgtgaaaaccaggtgaaacaaaacttaggggaaatcaaatctagcaaacaataaaatccggtcacataccagtgacctgtaaaagacgtcttggtggaatcttgtcagactgacggggacttgattgaactttcagaacctatgaacacatcacccatcaatcagaaaatgcacagacttaacaatataaaaccctagagcctaacttaaatagtattaatcaaatagctctgtccccaggggtgtatagcaactgaccattttgttaaacttctcaatagttgccaatggaattgtaccaagtggaatgacttttctggttccttcactcttcacaaaagagaaacaaagaatatattgatcaacagtacttaaaaactaaaggcctaatcctgaaatagtgaaatataagtaagttcaagatctgtataattacattggccagaaaaaatagatcaaatgcatataagaaacagaggaaagataatatcataccaaaaaaagaatacggaaattagtcaccaaaagggttcctgcctcatcggtgttaataagcacaactccataaccctgcaaataaagtccaaaatcatattacttcaacaacatattcttcacactagtatcatggacaaatgcaaattgcataccaagtctcaaattcaatagccggatatggtaacaaaaattcaaataaaagagacactttgaccaactctacctcgacgatgaccctctccgattccagcaagcaactcaaattcgagaaagaacctgaccctgaagttgactgcgaccaatcaaaagagaaccaaagcagaaattgtttgagcaatcaatttcaatacaataaccaaattatgagctttttggatacgaaaaaagaaacgacattcacgtgatgtctgtgtaattgtgggttaaaaggggaaaaagcgtgaatcaggagagaattgagagcaaattacatcgagtttggtccattcaagcgtgtcccaactaccggtaccatccatcttttctgattccgaagaataatcacgcagcgaccttactcgcccagacggtggtctcggcggcgtcatgaaaaaggggggagagaaagagacggtgacgaggcttctggtgatcacctgccgatcaacggagcaaaacgacggatttgtttcgccacaccaatcaattaatacgacactgttttggtttggtacgaagttgtcgtttttttccttttgtactttattttgtttagtgttatctatttgtatttatcggcaaccaaaaaaaaaaaaaatcaaggcaaaataatctgaggtcaatcaaaatatttaccaaaatatttttccataataattctttatcttaacgctaatttagaaatttaactaaagttaaattattcaaaatactgtttttcgtattagatataatgtacgaaatgtttttcttatataaagttaaattttggacggtagaagaacttatctctagttgtgcacaattatatgtcaccgtcttaacaacaaaaagtcacaaactactaaataatccacaggtgtttatcaacaatttgaattgtattaaacatcaacatcaataatcttcaaagccatgtcacctgaattatccaagttgaatttataaaagaccaaaattacctgcaacactctgtcggttcagaaaaattccgcaatcgtttcccccttgatttataatagtatatttctcattagtttttacctaaaaaataataatttcagcatattaaaattaatcactaaaccccggaatacttgaaaatagaaaatacatgactaaaaaaaaaagtaaaagaaaaaaaaagcacacactactttttgcaccatttcccggtgctcttcgaatgtccgttcctcaatacatatgtaccacttcaatccaaaagatatgtcggtactaatttgtaaaattataaccactttaaaacctaactaagtcaatattctataacacatagcatgttgcctcctcttaccacttaaaaaacactacaacatgttatatgttttcaaccattgtaactcgttatcctctcgagctgatcggccaaatcagctttttaagcaatcaatcttgcgtggtttttgcagtaacttataagaaacgtttccatataatgctgagcccattctcaatttccatcagattatataacgtctaactgtttctaagtaatgattttatactccatataacatataaccgattgctataacatgctgtatacacgtctaatatgattattatacatgtaaataaatgaaactatatcgcaaatagaaatggtaagcaataatgcgaaggcgttaaaaagataattatacgaagaaataggaaaacaaacatcaaattaagatttacaagtcaagtaacgaccgttacggctttataacattgacgattaacctaacaaaaattatttgcctactacaaaaatatttcagtcttataattataaagcttcctcttttcttcttcttcaattcatccgaagctaaaagaaaacactagaggaggtgaagatttttaaaa

SEQ ID NO: 10971 - DNA, 3000 bp, Unknown
  misc_feature (1)..( 3000): cDNA_ID_2033137_gDNA_ID_2214468_Annot_ID_182913 3000 nt of promoter + ATG
tgtacacaaactcgctaagctagctgtatatttatgtaattaattattacatttgctgagtaattttacggcaaaatatgacatattttggacatgccacgtagaaaagcatgtgatgatgatatatactgtatatagagtagatctgtgtaagtgagtcagtggtaatatctaactaaaaaagtacagaaatggaaagatctatatgatctctctcgcaggatctcaatctctggcccttttttttgtcaacccttcttcctctcttattatgttcttctctctcttttcttttggttactgtaatttgtttttttgtttattgacattgacacgttttcttgcttcgatttttacggaaagagagatatgtatatgaggaattaggataagtcgatgtaattttgtaaggccacgaaaccatacgatcacaatcaaacaatctgtagcatttagaatccatcaattataatcgatgttgaagtttcggtggtccaatatacttacggttgttaaaactttggccaaaacgaatcgtctaaaagcaataccagatttaaatggaatgtaaatggaaaaggaatcgagaaataagaacaactgatcttaaagtctcacaatgtcctacaaattaaaaatgcacttgtaataatagtaataataattaattatattaaaaaaactccttgcaataaaatcataatttatgtaattcaaaatagatcttgtctgaattagtttcaacatatttcctagaaatgcaaagattaatgaacaaaagcaggacatatataataaatcagattagagaacttctagatctagttctattacttagtcaatcgattaaaagttctatacactcagaaaaaaaaggatatatattcataatatagacagtttaacaacttgagttgaaggaaagattctcacatatattttcgaggcataagacacgatggccctaccattacaggatgataacaaggaacgaacattgtagacacaagaatcactgttacaggttggtaacaaagaaaacgaacctaaattgataagaatgaacgtgtcttttttttttttttttttggcaatccaaattttgttgcatatgcataggattccaaatcatttctgtttgttcttttgtttcgaccgtgtttttttgttaactttaaattatataagttagatgcataaaattagtacacacccatatagaagaagacaaataatcatgtgtctatcacatgaaattaaactgtttgagtatatatattagaccggaatttaatatgtaattttactaattaaaaaatgctttcaaattcgtaataagtcgcaaatcaaatttcgttgttacatttttaaaagaaagtatttcttcttttcaaggaaatattttttaaacaagatcaataaaatacgtattctaaatatagattaactctcttgttccatgtgtatctgtgtttggtgatgtaaagagctcatttacagacatttctttttcttgtaaagcggatatattgtaatgatcgcatgtgaaacgtaattacgtaaagcgacatgcaaatctgagttatggtatattaattacagtttttgtattgacgtgaattttaaaaatgaatttgtttagcatccactgccgttttaacattttattcgttgtaatgtacaatgtcgacaaagaaagcaagtgaaacgtaacgtgcatggcctccaaatcatgaacttattcgtaaaatatcatttctataataatatagtttagctatatatcgcaataataaatagaaaaaccataaaattccaaagaatatattaccaatcgacaccaaaaagtaaagataagggtcataatgggctctcccttggatggtttagaatcttcgtaaccaattgtctccctagtccctattatagctttgagagatgaacgagtaatactgtatcaatcatacaatatatatatatatatattaatttgacatatatattagagctaaccaaaaacaaatatcgcaatagcttagattagtgaatgatagttaattgttacatttgataactcattattagaccgccaagagtcccatcaaactagcaggttcatgcggccacgccgggaccaagatctggttcttttatttcccataacaagaatctttttcattttatttatattatagagaacttttaaagcagtctggttatgttggatctggaggaaaatcaggaaagtacatttgattttttaaatgtactcatatgaaaatgtaaacaaaacatgaataatcctttatatatgggagtgggacctagattttttttgttgctatttaacaaaacaacatttctccaacattctgaaaaacaggatcacttgttttgtttcactgtacagtagaagagttttcactaactagtaaactaattaattagtgatttttatttttttttaatcaactcaggcctaattgagataacttgttcgtgggtatcaggcccaatataaagtattctaaggcctactcaataatatctccaatatttttattttcggacagatcatttatttatttttgtaatattttgttttttcttctcgtaaaaccctaaaatatacaaaaccctcaaattcagtctaccagcgaggatcgatgtcggagctcacagtatctcctttcacgcattaactcaatttatctgctaaaccctaaatagcttcacgccgtttttctaattctcaatcaaagcttcaccgccgccgtgtgttgttctttctccgagtcgtgttctctaatctcaggtgaagcttctttcttcaatttgcctttggtttcgtttcgaaaaatcatgtcttttctaagatttatctccggtgctaatcagaattagtcggtatctaatgggtttctgaattatctgtctggtttggtatcagtgtttaattgtaattgagttgtttggttcgtttaggtgataaggatcaag

SEQ ID NO: 10972 - DNA, 3000 bp, Unknown
  misc_feature (1)..( 3000): cDNA_ID_3610508_gDNA_ID_2214468_Annot_ID_182908 3000 nt of promoter + ATG
agtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtggtactgtattgtccaaattactttcgaatttggtttatctgataatttccaaaagatctcaattctttgtttgggtgcagcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggtttgtgatttcttcttactctggcttcattacccaaaccttattagtttcattcaatatttcttgtatgcaaaaaactctgttgaaatactctctttcttagttttccattgggctgagtgagtttatttaactgcattagtctatttatgaaccaatctactatttcaacgttatttagtgcaaatgtacaaatttatctgatgcatcatttctcttgtttcacaagatattatatttattatctgcaaaactctgtgttgaagtgaagcttctcctaataactgtttcagcgggctgtgacgctagtaactccatttagtctgtaaccaactcttgtagaaatcaaccttataggtttatctgatgaatcaactctcttgatttagaagatatctgaattttcggtggtcttttttttttttgtttcttgggctttattcttaatcatactgattacaagatcgttcaaactttgcatcctcatttgaccagcaattttactgtgcatcatatgaactcacttaattgatcagtaaatgttgaccagaagtagaatgatttgttgttttagtgaaaatgcagttttaatccttcatcagcaaaattgattgaagcatttggtttcagataatttatgcgtcgtctggggttcacttgtaatttgttgtaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttctttttttgtgtggatgttcttgcatcttttgagaacattttttaggttgctccattgtcatatatcatctatctatctagtcttttcagacaaaaactatctttaagttgtctcgagaatgttgtcttcataacacactgagccttctctggggtagtagtggttaggtacgagggcataattgtcatttcctttgcattatcatttagatttccagacaagaagaactttctttgtttaaaataattgggaattatgttcggtctccggtaataccgtggttaatggtaaggatattttcggctaggattacgaatgtggatgcgtcagcgacgttagaagactttcgttacacgtaatttgcaataattttaaaaaagcgaaaaagtgtttggtacgattttttcaacttcaaatatattctctatttatttactctattcaaacaaaattgcatatagtatagaattttagtcatcttgatatttattgaagtggataaatcttcatttgcgcgaaccaaccaactacctcaacaaattctagagactttaaaattgatgactagtgcaagacttccacgtgtcagtttaataaagactgtcacccgaaaacagtcacagccagtcacatgatatgctctcgcggcacactttcctggaatattaaaacctcacggcgtgaaacttctttcgcacattttctagctacggtcgcttagctccgattggttcgtcgtcaccatcactcgtcttcaacgatttgcttcttttttttttctctctatttagtcccattttcctcaatttctaaaccccttatttcgaaatcattgttttgctctttcttttgattcgaattcgacagaacagctcttttaagttattcataaaccttgtgtttgagttttggtccatcgagtat

SEQ ID NO: 10973 - DNA, 3000 bp, Unknown
  misc_feature (1)..( 3000): cDNA_ID_2034846_gDNA_ID_2214468_Annot_ID_182909 3000 nt of promoter + ATG
catgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagagatgggagagattgggtttacagagaagcaagaagctttggtgaaggaatcgtgggagatactgaaacaagacatccccaaatacagccttcacttcttctcacagtaaccatatatacttagttatatataagctctttacatgttgtttatatatgcgagctaatgaacaatataattgtgataggatactggagatagcaccagcagcaaaaggcttgttctctttcctaagagactcagatgaagtccctcacaacaatcctaaactcaaagctcatgctgttaaagtcttcaagatggtaattacttactttccgattttccacatctacatatatgtgaatcacttgcatatactgtatcattatcttacacttccttaaaattgaaagtagaatgtttcattatttacagctaagaatctttatttactcattatataccatttatatataatagaaaatagtagtctgaattaacttttcttgtcatttattgacgcagccatgtgcacacaagttgcgattttgtttgaacttggctagttggctttgtcttcttctttgagaataaaaatctcatactagtaaagaatactctgtgatattttatttttaagaacaaacatagatttctctgtcaataaagaattgttactgaagaatccaagtggttcgggtcgctttatggatttttacttttttgctaatcttattataatagaaccatataaaccaaattccgtttactttttaaatttgggtttatgacttggtttggttcaactcacttttggcttctaagactttgcataacatgttttagacagacaaaaaagaaaaagactttgcataacatgtatgaatttttattttattttgtttgtgtgtagacatgtgaaacagctatacagctgagggaggaaggaaaggtggtagtggctgacacaaccctccaatatttaggctcaattcatctcaaaagcggcgttattgaccctcacttcgaggtctgttatgttaaaaaaaaatatatatacacattaattttggctgattttgattttcgatttgaacgcattttaataaggtgtgaatgtgaaagcaggtggtgaaagaagctttgctaaggacattgaaagaggggttgggggagaaatacaatgaagaagtggaaggtgcttggtctcaagcttatgatcacttggctttagccatcaagaccgagatgaaacaagaagagtcataaaaccctattgatcatttgggtatcgcatacatgaatctattccacatacatgatacacatatacgtgtttctgtgtgtgtactatgttgctctctgactttctacagttcactattttaattataaagaaggatcttgtgctatcattagggagatacgtgatactgtagttcttcttgaaattgttattcgtgagaaatatcatggtttgaagtatttattttcacaagatggatgttaacgtggggatcattttacaatcattctacaaataattttacttctccagacacaagattttggatctattttagttcaattttttctttttttaaaaaacagtacactaaaactattttttatattaataatgtggtattagtctgatgcatgataaattttatgaattttaagatttgccccggtaaaaaagataatacacaatttcctagtaatatgttatatataaatctatctacaatgttactcttttttctgaaaatgatgaaattttgtgggccaaatagaacaaaaattcttgaaacagaaaattagttttcattttttaataaaataattatatgtattggaccacaactagacatttataattttatagtaattaagaagcaaatatttgatctaagtaaaatataaagaaaagcaccatatattaaaattatgaaagatttcctatttataaattaagatatcatattgaaggttaattttaagttcataaatggaatagaattcactaagaaaataattaaatttaaaataattgctaacagtaagatctcatcggataaaacttgtataattatgtttattcatgaatcatccttgcacctacgtatccatcttttccatcatctcatctatatatatgtacatttgcaaagctgagaagaaaaaacatcatattgtcgattgagcctatctctttatattatattgggagatg

SEQ ID NO: 10974 - DNA, 3000 bp, Unknown
  misc_feature (1)..( 3000): cDNA_ID_2026721_gDNA_ID_2214468_Annot_ID_182910 3000 nt of promoter + ATG
tacataagaaatcacaattacataagataccagtcgaaaaaacattaatattgtgtagcgtttcgaaaatatactctgtttgaaactttgaatataagcgggttttcactgtaagatgttaaatttagaaggatttttttttaaatctatcgtaatattaatgacagcaataaattgggttatcaaaaatgctaatggcgtttaaaagtttttaggtgttaatttggtaggagatgtatcagttgcgtgtcctacgtgtaattgtgaaagcaacaacgcaaagaaaatgaagccttgatgaaaatatatgtttaaaacaaaattaattgacggaaatagtatgttttaaattaatgttctaattgtacaatagaaaaagcatgtacatgtacaaaactcagttatattgtaatcaaatttattgatctgtaattcatgcttgtttatgacttttttgaccggccgatagagcggcggacgcaactttgggatctgaagatattaaaagaaaatgttcctaaagaattctaatatcgaagttgattctcatcgtttcttactttatttctttatgatctcaaaatcatcaccctttagaaaatttgtttcatgaccagaaaatatgcaagtgttaacatgttttaatttagactgttttcaaaatttacagttgttatttagtaaaatttagcaatgaatacaaacaaaacgatacaccaaattaatgtttgtagtatttactatttagtaaatgcatggtactgtggtagactcgctaagtaaattgcatgtgttacattttaatatgtaaccagtaacctcatgcatgtgtatctctttcaagtttcaacaacctttttgttttttagaagtaaaaacttaaaattctttaattggcggacagaaagataaggcgattactcaccagaccaacaaaattaaatggaaattaaatacatatagagtaattaaatggctctgtgaccaaaacatggaattaatgggcgttattcattagaccagtaaaattgactggaaattaaatatatatagtaatgatacgatggtcctgcgacgaaggaggagccatgtctacgcaactcatccaataagcaacacaagctattcttttttacttctttcatgattgtcagtttcttctttcatttattctatcattgcttgagatatgtattctttaatagaagttaaatagtgtgtacatataccatgttgtcactttttaacaaacaaaaagtcatatggtatcatcatcatgtcgcatgaagaggagctacaacatttcttgattcatgcgttacgtggtctaacaaagggaatgtgatgaattgtcgctctgggagtaatttcgaaacgaaagttttcttacctaaaactctttattaattatctgagtttctgtagagagaaatagcatcaatttaaagcttgaaaagtttaacacatctttgacaaaacaaatttaggaagaccaaaaccaaaataattactatttctctctatctgttttcagtggggggacgaaagacctttctttctttttggtaatgggccgggccgggccggtttaatccaaggcaaatggcaagatccgtagagttttacatacaaactttactctagtgtaaacaagaaagtcagaaaccgcatgcgttatagttagtgaaaggttcgatttctgtcaggtcttcgcatccgtcacgtttgctatctcgaacttcagggagcatattacaaacgtaaaagaaattgatatattacgctaattaatttattcccgttgttgtcaagaaactaatgtcttaattagccttttaggttaaaccctaatttttgtcgatttaagttttgaaaaacgaattttgattgtttggattttggtaaaaggagatcagagttcatcgctggtaccatgttggttaactggctcgccgggagacccagcaataagttttatgctctccaaaagtcaatagacgagctacacaaggtattatcatatatattggcaattgatgtttttaagttcctatttatttttctgtgacattgaatctattttcaaaagcacccaataatgtggttctcattctttttttctgatcactaatgtgtgttcacctcaagacgctcgagtctcttgaacaaaaagaaaaggtttctctgctgccgtacagtacaaggaagcgaaaacatgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagagatg

SEQ ID NO: 10975 - DNA, 3000 bp, Unknown
  misc_feature (1)..( 3000): cDNA_ID_3041114_gDNA_ID_2214468_Annot_ID_182906 3000 nt of promoter + ATG
cgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaacaaaattaagcagaaattgatgaaccatttttttaagaaagttactgattccttgctttgtacaagacttgcaagattcttctctcttttttttcctttcttacttccttaatttcaaaggaaaaaccatatattatacaaatatatatactcccattaggcatatgcaatgctttgtaattacatccaagttaatgtaagatcttttggttacacaatataaataataaaaaccacattcgtttactattggggctttctcataaagagaccacattcccaacatccttctttgtatatatttaaatgaatcaactaaaatacatagaaataaaaaatttctctatactattattttcagttgatccattcaaatcattttctaaaaacttatgtcacgttcatgtatacttttagttaaagaatgtttttttttttttggattggaaaaaaaaaaagctcaaaccttttaagaaaataaagctcatgaaaagagcgtgacgggtccaactcttttttttggttaaatttgcaatttaaacagattacttgttcatgttgacattgaaatagcaggtcgagagcgagagatcaaaatgcaatgtattatgcccttaatttatgcttttatatattttgtttattaatgtcacatatcttattatggatatactttgcaacggatcacaaatcttaccctgaaatatgcaacctgttaccggaattgaaatttcataacacactattctcagctcttcaagattcagtgtttcattcgtgaagacgaatgcatgttgttctagtctcgatacgagaaactgcgtttatgaaaataagaaaaagaagaataaattagcatgggcttgatttacacccgtccgtcaccgaaatgggctacaaataaatcatgggcttttaatattctaacttagaagaaatttggcccattgcttaaacacgaggcacaaaccatatattttttttgagccaaaaaaaaaagtcttgatattttagcattttgtcctttttggagacagtggtgtcagatagctgacaacctatataaataaataaataaaatagagttttcttttactcttactttctttattagtttcataataatatgtgtaaaagtaagagttggatatttttcgttttaatttctgccttcgaattagttacgcatacaaagcataagagacaagagacatagcgtaccaaaaaagaagaaaatagtgcaaaaatatcatatagttttctggtacgcctcatcaattccacccccgtacaccataattatatagaatttcaatatcgaaatgtcgacagcaacaaaattcaacatgtcgaataatattgttttaaatattccattttactagaagatgaaaaaaagagagaagaaagtaaccttttgtctttgtcaccttgacttaaacagtaatacaaaccccacaagtaaattattcaagttcaaatcgtagttaatgtttatatttgagaattgcaaatggtttaaacgaaaaccaaactacgaattacaaatttgaagaggacttgtactagaaaataaatagagaaaagaagaataataaatagtaacagaaaatgggaaagatgatgattcgtgtggaccaagtctctcctcccctttagcttgccttattggtaaagtatcctcctgcaagcaaacgtatctgtcactccttttttattttctttcaccttctatcttattctcattaattcttcttttttggtcaacttcatgtatagaaaataataccaaaattttttgatatagtaaaactattagaactgaatttcaaacaaaaataatacaaatttaagcaaaaaaatattaaaaataaattttaaagaatatttttacatataataaatatacatagttgatacttttatataattattaatttatgatattaatgagaccatatatttacatagaacattcaaaataattattatcttattaatctatcgatatatatcactttttatactagtttttggaatcttaataatttattaatttgtagaagttattaatttatagaggttttactgtacatgtcagcatttaacttttgataagcacaaaaccattacatattttccaaccagattattttctatttatcctagcgtttgtaaatctttgaactacaataatttatcaaatacaatataagatttttatactaaagatgtatacaatgcatttaacattaaaggaaacaaataaactctaatcttttaaaaaaatactttaccttttaaaaagagttattaatcacataagcaatatttaatttttcattatttttttcatcatctgtctaacatattactttttaaaaaatatttatcgttggatacttacttttcagaccacacactaggactagtggttcctttattttactgcatagaacgacaacaaaaagctaagcagtaacattttttagggttttattactgcaacactcaaaaatgagaaattattattaaaattgaaaatgaaaaatagtaatcgcaatccgaaattactttttttctagccttctaggaactcgaaaagaaagcaaatttcttgcaattgaaggtacctgcttctctttttctggtttgtctggtttcatattaaaaaaaacattttgacaactatatttctggtttgtctgaaaaaattgagaagaaaacctagaaacaaatacggtcttttttttttcttttt

SEQ ID NO: 10976 - DNA, 3000 bp, Unknown
  misc_feature (1)..( 3000): cDNA_ID_3033293_gDNA_ID_2214469_Annot_ID_182944 3000 nt of promoter + ATG
ctcgagcataagaaacattgaattccatctagtttgaacatccagcgacaaaactaccccctgatcaccttctacgcattgctggaatgcaagccctctcgcttttgaagctttcacgcacttgacactatctctgatcttggttaaagcaccactaataatctttagtccatcttgcacaataagatttaggatgtgtgcacaacattgaacatgaaagagttcacctccacataacaagttgtcatctaaattaagccgctcttttagtatctcttgcatggtgtcattcgctaaagcgttatctagagtaagagtaaatatattctcttcaattccccattcttttagacattcatggattttagtcgccaaagcatcactggtgtgtggaggaggtatgtcacaaaatgacaagatcttgctattcaaagtccagctttcgtcgacgtagtgggcagtcagagttatataaccttcaccagcaattgctgtccaacaatcgaaagctaagcatatcctactctgaatctttgccaaatccatcttcagcttgttcttctcgctatcccaagttttaacaacatctgttgcttctgtgtttctagtgtagtagctataatctggattcagatattgaaaaaaccttcgcagctcttcatattcaacaacagaaaaaggaagatcatgccaaattataaccctactaaacttctctcaaacaacactctaatcaatcttcattcttcctagtctttccatctccatcaattatcatatcagcgacatgcctatattttgacttcttaatgcatctttgatgatgacgcttcataggagatgttcatgtggtaggttcatacacaagtttttcaccacaatagttacatttaactcgattcttgccatcgtcaccttttccagcttgagtaaaatgtttccacatttctgaagttttccttccttcgtttacgagaattttcttgagagttaccttctggtatctctgatgattgctcatggggttgaatcaatatcatcatcgtcatccatcatcatctcttcttcagcagctatttttgactcccagtccagatcttccatattatctatccataaatttaatataaattatagtcaaaaaacaatatatgtatagatcatcgttttagttctaaaataaataaataatatcaaacaacaccaaactgtagacgatatttagtataatctcaaacataactacaagaacgaacacatgaagccaatctattttgtttttactaacataatatttacttatttagcaaaacaaatcatatgatcatcataacatgcatgggcacaaatatcaatatgactataacgtaattacatagtacatactcctagacgaagatgctgtcatgctttcgaattcgataagacacgaacggagacaaaataaaaaccaaggcgatgagacacgagaactcaagaagtaatttaagaagcaaccatagaacgatgacgtctatttataataacaatacatgaagagaaaaagaaaaccctagtcttgggtttatatattttacataattagctgcaaggaaaaataaatattatgcatatattttaccttttacttttatatttaggtaaaatataaactttaatagttattttagatatttttacatatgtagttgtaaagaaaagaaaatattttacatatgtatatataaattttacataatatattaatataaatatatataaattttacttttttgttttgattgtgaaacccatgggtaacccatgatcctaatgggttttacccattaaacccatgactctaatagggtaacccactaaaacccatttatatatatggataaaaaaaatcatacccaaacccattaaaatcatgggcgggttcggataacgtatgggtattgacccattatgacacccctatcggagagcaacgacatcagatcttcgagttgtgttcaagaaataagtttgatccttcaccaagttgctttgtgatggtaagaatctctcttactctgtattaattgatgattattgattgttttgaaattagggtttttttctttcagtaataattaggataatttgatgatggattttgattaattgtatactgtatcttaatctgataattactagagtattcgtaatggaaattattttattgtggatgattgtttgaattactactcaaatggatcttcaatatattaattagttcgattagtttttggggttaaacgcatgaatgttacctatgaaatattgtgtcttaactgtgatattgtgttgtatcttaattgttaaatattttggtttttaccgattaaatttatcaaactttttttgttttcttttgaggtatctatggaggaaacattgatttggacattgatatggactctacagctgcaacatctcagatggtgagtaaggtaatgcattacattgacattagttgacttttgtatttaaattaggtaaaacttgacttgtattgattgtagtgtgtctgttttgtgataaatgtttgtgtgtgtattcaattgatagcttattgtctatttagaggttgattataataggtaagacttgacttacattgacatcattcttaatgtcaatgagttcaatgcttatatgtttttcattaggtaaaaaaataagttttaacattgaatgcttaaacctacaactagaacttaactcaactaaccacaactacaacttaaaatagtcaaagacttaaacctaaccttctatatatcccaagtaaaatcgctgcttaagccacacctttctcctctttattttctcacatcctcctttaaaagtcattgaaactctttcatcctcctttaaaagtcattgaaactctttcatcctccttaatgaatccttatgctaacacgtccggcttcttggatctggtaacaagtcaacaagaaacctccatca

SEQ ID NO: 10977 - DNA, 3000 bp, Unknown
  misc_feature (1)..( 3000): cDNA_ID_3081057_gDNA_ID_2214469_Annot_ID_182955 3000 nt of promoter + ATG
ctctaaaacttccatttcaaatccattaatcactgttagtacccgcagctccttattgggacacttgtgttctttggaccaaggtccatcacatctaaaacaaatccctttccttctcttctcatccaattctgcactggatgccgtctagtctctgatcatttcttccaattggtttgtcactaccatgatttgactcagtcattacagacttcatcttccagttgtttgtagctggtgtataagaactcttgtactcagaccaatgtggatctttattctctttacttaccaactgcaattccttttgcaccactcttctcatcacactcgtctccatagaacgtgccacagccaccatttcaggcagattctgtggtttatgcatgtgtaccagttcctgcatttcacctgtcaggccattcaagaatataccttccaatttctgatcatctaagcctccaacctgtgatgacagatcctcaaacctctgcacatattcagccactgaaccagtctgtttgatgcaaaacaaactctgactaggccctctcagcttcaaattcccgaaccttaacatcaatcctgatttcaacttcaaccaactcacaaaatccccacgactgatagcccaattgtaccaactcaaagcctcgccactgacgctaactgataccaaggctaattgttcagcctcattgtaacctcctgaacgaaaaaacctctcgactctcgcaatccacccatatatcccagatccatcaaacattggcatttctacattcttaagtagattctcgcgaattctaggtctaatcacaccacgacaaggttccagttgagaaacacgtacctggttcctatgatcttgcgatcttggaggaagagtttgacttgtaccacccacttcttgcaccgttgcaatacctggcatcgaattgagtaagagctccaacttcctctcaatcgctccgaattttagatcttgcgaacccattttgtcatccaacgacccaatcttggaatctagggttgataatcttgcatcagaacttctgattttacctcccaaatccccaatctgatcgtacacatccgccaacgaagccgcgtgctcctccgcctgagaaatttcacaaaccggagataaacttgattccatcaccattgcaactactatcgtcttcttcgatcgaacaaaaattcccaaacttcagcgttagattcaatccgagatcacgaacgcaccatttgataacaagaaaactgtaaatcttattatctgaaagagtcaatacaatttgtttgatacaaagagctctagaacacaaatctagatcattactctcacaaacccagacacatacgtcacaggcagttacaaacaaaatgcataaatcttctaaagaaagctaagtctcgatatatacacttcacacgtgtgacgtcttcttcagcgcacgtgctcctcagcaccatcttcattcgcacgtgcttcacgcctcttcctccttgtatacactattaagggcttgtcatcttctttgtcatcatatataaccttcgattagtgacgaagaagacctgcaatttctggcttaattctttcatcatttttttctggttttgatattagtagaaacgcttatatatttttgtttgcgtgatatggacagtaacatactttagttcggttggtttagagtttttagctctttcccacaggtgcatggttcgaatccgatagtaggatgatttttgtatttttgtttttaatacgaaaacgatgtcgtttactgtttgacggaagatgttgatgttgactttgtaccgttaaattgatctgttaattgactatacaatatattttatttggtaaagtcaacaaaaattagtgatttaattgaaaagtcaactaaaaatgatgattttattcaccataagtaaagtggatgatttgttcaccaacttttgcggaattatgaatttaatgacggttttcccggttttaattaaaccaaattaggacgttattaatattaggaaatattaggcaagaaaacactttttaaaaacttaatttggtgtgactcatgatttcggagtaagtgctgaggcgagtcgggaaccggacagggctctgtggcccccggggcatcggggcagacgtggcgacagggggtccgcggtgtcctgttggtcacatctccggagggcaaaggggaaaaacgggagacggggcaggacgcgccggcgggggacgaaggggacggtgaccacagctatagcggaggacgaggagcgcaacaggcgagaggggcgcatgggcccggaggtatccgtcagatactggtggacgggtaccgggtaaaccaagtacgcggggaccatactaacatgggaggcgccggcggagacggtggcgcaacgggtgcaaagaggcgaagtgggacgggaagggaatatctcgccgtaagataaaactgatcctttgccgtcggcacttagggggaataagtggtattaagaacgtgggtcctgggtgtcggtatacaaaatgcgagcgttattgatattaggaaatggtagacaagagagcactgtttaaaaacgtaatttggtaatagagcattttaggaggcagtatgtattttttaaagttttttttatcataaattcctcaaaagttagttaatcatagttagtttcatatggtttgggaataaaatattattttttgcagttttcctaaagtaaaacgacacgaccaattattcgtcactttgacctaaaagtgaaattatcctggcgactgtgttgaaataaacctccgtatccgttctcaatccgtaattcttctcccgtaaatcatattcgtcttgcctagttatccaaaaagtgcccatctaaattccgatcatttgccctccgtgaacttttaacaaacgggcgaacataaaatccctcatttttctttttcccaccggtcagtaatcaatg

SEQ ID NO: 10978 - DNA, 3000 bp, Unknown
  misc_feature (1)..( 3000): cDNA_ID_3081047_gDNA_ID_2214469_Annot_ID_182966 3000 nt of promoter + ATG
cagaagaattgatggtttggagagtaaattcctcttgttaatcagaaagtgattgttttagatgagtagcttagtaagagacttgcagctgtggagaatgatttgaaagctttgaaagagtctcatcccgctgatgtatccattaatgatgtcacatccaacaacaaaggagatgatgccacattcaacaacgataaagaagatgagacacccaataaagaacttgaactacaattaaaaattgtttttcatatttatcatgaattttgatgttgatgaaatattaaattattgattatcgaagtcttgtatggtagaggagaagccataatctcaagatggtttgccttgttagagagtagtgaagaaagttatctacttagtgaagaacaagaaaaagcatgaatgagaaatatctgagctgcttgttctttgtgaaaagaaagatgcaacaaagggtaagaagaagaaagttgcaatcatgcctaaaaaagcatctaagatacctaagaagaagatggccaaggtaaaggaaatgaaggtatcaactccaaaagttttaaagaagacaatgaggagagatgacgactatgttggtgatgtaactgaaaaagttgtagcagatactttgaaaatggcttgcagttttgaagatacattctctaatcctcatgtacagcgggctagtgaagcaatggctatcgtgttgtcgtcaattgaagaccaaattaaaaatttgaatgatggtactactagagagacgagtgactcaactagccgattatataaaacctccttatgtagggaaatccacagtgaagcgcattatcacggatggagcaccatccccttccatacccgagcatcttcaaccagtttcagatgagaaacttcatagtctcatggattggctaggcttgatgagtaagtttctgttttctagttctaaaatccatgatttcggttctcttttatcattttttttcccagagaagaaccatttcaaacaaataattttgatgttcgattgttttggcaaattataactcctagaaaagaccagatggaacacatggttgggtgaaagactatgtaagtattcccttttgtaatttacaattttcagcttgtggaattggtttaaaatttggttttaattgttgtattgattatgttgcaccacatgggaactacaatgactatgtttcctagaaagttcattcgtgatccttataaatacacaaatcaccgcattgctttccttgatcaagttttgataagaaagatgaagaatgactacaacaaacactattcgtctgattttaaaacctacaactggaccggctattatgtgaatcacctcaacggtacaagtcatacagacgcagcgacaaacaataagtggttcactaatgtagatcacctttacggttgtctctttgtcaatgaaaatcattgggtggctttggattttaacttgaagacaaacaggatctacgtttacgacagcattcccacacctgttgaggaattagaaatggttcaacagtgcatgtttttaaggaagataatcccaactatgttgtctgaatatattctagaaaaggaccataagaagagctacgcaatgttggaggtgaagagggttacaaagaagaacccagtgaatgacgatcgaggtgattgtgcaatatatgcgataaaatacattgaatgtttggcacttggaaagtcattcgacggattgtgtgatagaaacatgcaggccttatggatcaatcttggtgtagagatgtttgatgaattaggagagtttgtcggaacacttaactgtgagactcgtcagaaagaattcgagattcctcgccttaatgattcgtagaagctatgtttgtgtttttattttgttatgtggttgttttgggttttgtttcagacattcatggtatgtgtttcaaaatttcatgttattttgtctcagacttcgacgtatatcttttcatttctctcatacttctacgttataggcaagtagaaatgaatttcttactattgagtgactggcttaaaaaccattgcagaaccttaattattttttcatttgtctcagacttctacatcatatgtgactgaatcaaaaaaacgtggcaagacataaaagaggtttaagacaaaaaaatattgaaacaaaatagtagaaaacataagtgactgaatcaaaaaaacgttgcaagacacaaaagatatcaagtctaatagcttaaacatgcaaaacaagacaatagaagaggtttaagtctaaaaattgatgatgtcgtctctctcgaaaggcaattttttgggcgatcgacgccatttgcttgttctccactggagatttttttccgacctgagatgttcgcagaattccttctagagtcttcaacgccggtttttgtctgccaaatgacaatggtagttattcttctcccctctttacgggaggtaatcgtcaaccaaaaccgtcatggatcattctatttaaccctttcaatcatctattcctttttctctcaccactgttttaccaactcgacaaaaaccaacaatcaattatgagtgattttctaagaaagtttgtccaagatctgaatttgggaatcgacgatgctccaaatttcctgtcacaggaattcgtctcacaggcgttcgctgttaaccgcttctcactaatcgtcacaccagtgaatccccgaaaaaaaacctacgagcgttaatcagtcaaatgcctagagtttagggactggcggattcttgcgttgggcgaatcgttggcaatggaaaggtgcaattcaagttccaaacagatgaatcaatgaacttggtcctgcgacgtggtcattcaatgactggatgttgtcaatcaatcgatggtacctgaatatcacagagaatgagatgaagataattcttttctgggtttaaatccaaggtatccctcttcttttcttaaccaatgca

SEQ ID NO: 10979 - DNA, 3000 bp, Unknown
  misc_feature (1)..( 3000): cDNA_ID_3033234_gDNA_ID_2214469_Annot_ID_182968 3000 nt of promoter + ATG
cgtatgctaaacttctgaagtactggaactgatcgctttttgatagttttaggttcaaaactcataaaaccttcttggcacctagaatacgtgtttctcctcttcttggatcaagaaaggcaccaaattctctttgaaacataacaaaacaatagctaaaacgggctaaaaagctgtgttatcacgaagtacagtctagtacggtttgatgaattttgtgatggtggtttgcaggcaattgataaaagcatgatcccaaagaaaatgtgagttcttttgttttcaaatctctcctccagatcaagatttttgttttccttaagaataatcaaagagctaagtagggaggagttgatatgttgcgtttttaatgtcttaggtctcttcgttttgagtcatttaacatgtcgtagtccgtgttttgcgtcttttgggttgtgccttctgtattttgcctgttttaggtaattgtgacgggactggatggttttgagctttttggagtagagaaagggcgagaaaatctgaagcagggagaagactgtgtagaccaatcggtccagtagagggtgatgatccattttggctttcaacagacggtcaaaaatggttgaccgatcgattaaaatctggaccgatcggtctgatttcctaacgcaggatttcggttttccttaactggatttattttcttttttctgtaattgggtattaaaactccaaacacctaattttgtttttaccgttctttttctacaactttttgagagcttttctttgtaagcaactttgggagaaggatccatcctctttgacactttggaaaagatttctaatctttttttcttttatatttcattaatctattatatcttttcaactctttgtgttgtttattttgcttagagtgagtaatcacttaattgggttttgggttctaagtaggggattcaatgaattgatcgtttgattattgtttggagttctttatctttaagttctttgattcacatgttcttaatgtttgaataggttgtatcaccctgttttagagtctaggtttttctatgcatcaaaagtgtttgatagaatgcctaaaccaatgtgaattgaacatttaatttctagccaacaaatgttgacgttagaatgcattctgaacctaatgaacctaatcctaatgtaaatttgactaggaaattacaaatgaaagtttagtagtgaagcagtccaatttagtgattaataacttgattgagaattaggctaaacttgtgttcatgttcgagaatggttctttatgttgaatttcctgtctaatatttccattaatcatggatctctgaaataccctatggccgattgctttttatcatataagtttaatcgtttattttcttgcattttaatttataactctgaatactaaacaaacaatctctttagctttagctaagaacgagtcttgaaaatccttagagtatcttttgtccttgtggatcgacctcgaatatactatctaggggttaagtgtattcagtaattactcaagcaatcagttttaaagatggtcactctcgtttatcagttccaaagcattcttgttcatggacctgaatatcttaggcgatcacttgatgtattcttacaatcattgattcatgagttacaaacattgtggtccgagggagtagttgcatatgatgttcctctaaggaacatttttgtgatgcctgctgttctgatgtagacgattaataattttccagcatatggaatgttatatgggtggacaacgcatggaagactatcatgtccctactatcaggatactattaatgcatttcagcttaagcatggaaaaaagtcttgttggtttgattgtcatcgacggtttgataataggtttttaagatcaattaaacctaaagcactatcatgtcgttgtagtactgaaggttgtcaatccaaatgggtgtgatgctaacaatcaagatgtgatcagaagtcactaagtcaagccaagcaataacaggttttggtgtgttctagcagttctaagtgaacatgcagaaaacaaaaattcaagtagaaacaataaaacactcgaccaacacagctctttgcagagcactggatgaggtcgagtgacaggtcgagtaacagacagaaagtgaaacagggatactcgactgcacagtctgttgccagacaactgggtggtcgagtatcaggtcgagtaacagtaaagaattgcagaaactaagcaacaaatgacaagatgcagtagagtaaacaataaaatcaatcagataaagaattcccgaggatagggtaatcgagtagtttcgttttctcagtttactggtgattgacatgctcaataaataaaccctaaacaacaagttcattaaccaaatctaagtgccaccgcaacagagactctcaagttaacctagtcccagactcaatcaccattgacgagagctaacctaacaggcattacgaatcaacaagttaaagccaaaacgctccctgcaaccaataccttggtacagggtcacgaatctctggaattagtggttcagacatttcatcgaacaccttttgggtgcggaaatgtctgggctcaaatttcagttgatcagaaagcaataggcattaagaacaactaatccagaagggatctatcaatcaatactcaatcacctagcatactgagaattctacactactctaacccatcctcagaaacctattcactactcagacatcataacagaaagcataaacgttgaacaagttgaaaacataataacaacagtgtaacagcaggatgataacagaataaacaacagtaaacgaaatctagaacaaaagttgaatactgaatagataaagagaaatccggattacaaaaggtctagaacacaaggtctgcggaaaaactagataaaaacttttttttttaaacttgttctcgaaaatgtaaagtacatg

SEQ ID NO: 10980 - DNA, 3000 bp, Unknown
  misc_feature (1)..( 3000): cDNA_ID_3033256_gDNA_ID_2214469_Annot_ID_182959 3000 nt of promoter + ATG
gcttgaatcatactctgcatcgtctcttgagatatggtaggatgagtacttatttgatttttcttcaaaataagcttctttctgatcagcagagtagtcttcttcttctgaaccaggctgttttgaccaatcctaaaattcgaaactggggtagcctttaaccatttcttgaagttccaagattgcatggttcagtccttccatcttgtaagttagctccccaatggtatcctcttgagctttgtatccaacttagagtttcagaagttcttcagcaacagaatcatgaatcaagtattcttcttcagcagaggtgttggtgggctgtttaggcactcctggagaataaatcagaataggagtttcctcctcactcaacaacttgctctctaggcttctttcctctaagtgaactactttctgatcttctggtgcaaaccattctgttgtgaaattttcgtcctccttgatagctagtgcagtttccatcttctctagatcaataccatttgaaaaatttttaactcttttttcaaacatccaaagttgatctttcagcttcatcacccttgaagacaatccttctatgactctactttgccatttatttatttttctcatctcataccagtcatcttctgtaggatcttcagtctgagctagcctttctgttgttctcttcatgtggtcaaaagttctcttcagcttgctaacttgagaagtatagttaactcttggtggggttccagcttctgtttcttcatcaacatccatgttctgaaccccaaaattctgaactcctgttgttgatttccatgaagattctctgatgtcaaacttcatcttgatgccttcaaggttcagattaatttttccgttcctgacatctatgactgctccagctgaagctaagaatggtctgcctaggatcaggggatccttgcctttttcatctacgtccaataccacaaaatctgtaggtatctcaacattttcaatcttgacaggcagattttctattaaaccatgaggatgtgctacagaaccgtcagctaagagtaaagctaagttgcagaacttgtattccataatccctagccttttagctgtagagagaggcataagactaacagatgctcccaaatcacaaaggcacctattgaatgtcaatggtcctagagagcatggcagagtgaatgaaccgggatcatcaagcttttcttggatgattttcttcttgtatgtttcttgggtagaggcactgctgatcatctcttgattctgatccttcttgagtttttcaattttgaacttttttccaggatggtgagtattcagcaaaggtgtgtgctttatagtccagatgaattgctgggtggcaggtgcagcaatttgagttgaatccccccccccttcttgaatcatattttcctcagtatggggagtctgacgacttggtggagactcatcttcttggtggatggtgatagcattaccagtagcatagtccttaggattttggactgctttccctggaagttgttgaggatgctccagagcagaggttgatgcaaattgactctccacatacttgatttttgaattcaaagcttcaaacttgacattcagatcgttgtaagaacaaccgatcttgttatgtaattcagctatcttcatgtcaaaagccatggctccagtagcttgtccttggatgatctattgaatgagttgcttaatttcaggatcctgagctgttggggctggttctggttgttgagtgaaccctggtggtggattctgctgttggtagcctccattaaactgttgtttagggacataaccttggttgtactgaacaaaaggcttggactgattctgttgaggtggatacacttgatcttgggggttagctacattagtgcttctttatgagaggtttgggttgggatcgtagttgttgttccccttgttgaaacctcctttgttctgaatgtagcacaactctacagtttgatcattccccccttcttgcatttggaagtgctcttcatcagtgatgtagtgtatctgcttctgctgagccagcaacaacttgtctagcttttcattcagagccttgatatctttgctctttttatcctcactacctccagttcctctcactaagcgatcatagtattcattgtagcacccatcagattgtgctagattttcgaccaacttccatccttctgctacatccttgttcaggaagtttccattggaggcggtgtcgagtagcattctgatctttggtaaagctcctctatagagtgtactcaataatgaagctttcttgaaaccgtgatgggggcactgagtggtgtagcttttaaacctctccatcgcgtttcacaaagcttgtcgtttttctctccttgtgggttggttaggccaatttgtttcgattgagcgattgaatctacgagacgcaacaatctctttctgggttagggtttcttcacataaccttttgtggtttcttgttttgggcggagtttggtggtttctggaaccctagatagagaggagccttagggtggttaatattggcactggtgatttagatatagagaaagagatttgagagatatatgtgtaggtgttagggttttcattactttgtgaattgtggctgtggcattgaatagaggtgtttggggttttgtccctttggtaaaggatgagtgttctctagtgtgaagctaaattggtcttctaagccatctgtgtgagggatggaagtgtagaaggtgctgaaacaactcatttggattagggattggaattggattcgtcttgtggcctttaccgtggtagggatttagatggtagagaaagctagggtagattaaattttttgtaagaggagctttctctgttgttgttggtggggggtgaagaaggttagagagagtgtgtgttctttcttgtatctgatgaggtacagctttcctaatg

SEQ ID NO: 10981 - DNA, 3000 bp, Unknown
  misc_feature (1)..( 3000): cDNA_ID_3033289_gDNA_ID_2214469_Annot_ID_182945 3000 nt of promoter + ATG
tatcaatatgactataacgtaattacatagtacatactcctagacgaagatgctgtcatgctttcgaattcgataagacacgaacggagacaaaataaaaaccaaggcgatgagacacgagaactcaagaagtaatttaagaagcaaccatagaacgatgacgtctatttataataacaatacatgaagagaaaaagaaaaccctagtcttgggtttatatattttacataattagctgcaaggaaaaataaatattatgcatatattttaccttttacttttatatttaggtaaaatataaactttaatagttattttagatatttttacatatgtagttgtaaagaaaagaaaatattttacatatgtatatataaattttacataatatattaatataaatatatataaattttacttttttgttttgattgtgaaacccatgggtaacccatgatcctaatgggttttacccattaaacccatgactctaatagggtaacccactaaaacccatttatatatatggataaaaaaaatcatacccaaacccattaaaatcatgggcgggttcggataacgtatgggtattgacccattatgacacccctatcggagagcaacgacatcagatcttcgagttgtgttcaagaaataagtttgatccttcaccaagttgctttgtgatggtaagaatctctcttactctgtattaattgatgattattgattgttttgaaattagggtttttttctttcagtaataattaggataatttgatgatggattttgattaattgtatactgtatcttaatctgataattactagagtattcgtaatggaaattattttattgtggatgattgtttgaattactactcaaatggatcttcaatatattaattagttcgattagtttttggggttaaacgcatgaatgttacctatgaaatattgtgtcttaactgtgatattgtgttgtatcttaattgttaaatattttggtttttaccgattaaatttatcaaactttttttgttttcttttgaggtatctatggaggaaacattgatttggacattgatatggactctacagctgcaacatctcagatggtgagtaaggtaatgcattacattgacattagttgacttttgtatttaaattaggtaaaacttgacttgtattgattgtagtgtgtctgttttgtgataaatgtttgtgtgtgtattcaattgatagcttattgtctatttagaggttgattataataggtaagacttgacttacattgacatcattcttaatgtcaatgagttcaatgcttatatgtttttcattaggtaaaaaaataagttttaacattgaatgcttaaacctacaactagaacttaactcaactaaccacaactacaacttaaaatagtcaaagacttaaacctaaccttctatatatcccaagtaaaatcgctgcttaagccacacctttctcctctttattttctcacatcctcctttaaaagtcattgaaactctttcatcctcctttaaaagtcattgaaactctttcatcctccttaatgaatccttatgctaacacgtccggcttcttggatctggtaacaagtcaacaagaaacctccatcaatgttgctgatacaagactttgtgaatctgacgcccctgtcttcggtacatgatgatgtgaagcagcattgcatggtgaaaccacaaacacaaatcgcacaccaagaacaaggaccaagtagtcatctaaagaccatgttctactaatctttgtgtggctaaataaaaagcaaggatgttgttattggtaatgagcaacgagcaaatgtattcaggaaacacattgcgtagtacattgcagcaagtccctttgttggtactctcaacaatagaccagcaagtcattgtaagtaaaggtggtccaagatcaacaaatttacatgttgtgggatcccatgcaggtgaaacatctcggatggcgagtggaatgaatgagaatgatttgatgaggttagctcatgaaatttacgagagtgattacaatggagcattgttggagggagttaaggcatgatcagaagtaatgcgcctctcttccaaccaaagagacattacttagcaaaagaagaaaggttaatggtgctcctcgtgtagctgttccaaggattacacatgtagttgaagcttcctaagctcgtccaccgggtgtgaaggctgctaagggtaaagacaaggagcatggctggagtttcagcaaatgtggaagaagaaggaaagaggctagaaaggatggagagtttgggggaaattaaagcaacaagaattaagcttttaaaagaaacgttgaaccgaacagaaaactgcttaaacaggtttagttgcacagattttacaccccttactaaaagttggaaaccggaacttaaggaattaacctaatccaaaaccttgtttttttaccttggacaattctccttcaattcctttggcggttcaacctctttggcctttgaagcctttggggtttaaatggctttggagagttccagttaatgaggccccggggggggggttttgggccttggggttccggttgggtctgggcggttttattggccccggccccgtgtgtaggtctttttccttttctttttttttaagctttttagccgcctttgggcccggggtcatgtttttgaattttgggttcgtgtttggaacggtctcccggttgtgtttttgttttttcgttttcaaattgcgtttttaatggggttttctcgtccgcggttttcattcccgccgcccccgcattccgattggtacctttccgaaaaaccccgtttttgatggaaacacccgttccacaatatatttggttttttttgtggtcttttaatggcgggaattttattttcccgaatcgcggtggttttaatcgcgagtgggtgtacaagttgttcgatgaa

SEQ ID NO: 10982 - DNA, 3000 bp, Unknown
  misc_feature (1)..( 3000): cDNA_ID_2717005_gDNA_ID_2214470_Annot_ID_133055 3000 nt of promoter + ATG
caactgatgctctggaaagtgtagctgaagatggtgagattctttttttcatcacctgtaaaatgattcatactatttttcttctactgatgatgatgaaagcagatacaatcgaggacgacatgctgtcttaccacgaaggattggttctcgttcctcggggaagtgaaaatactgtaactggccctcacatcagaggcagcagattacgagcatccgctgttggtgatgaagaagtagatctccttcttcctggaacagccaggtaactaactctcacctggttggaaaaatgaaaaactaagacttaacaaatgctgatgacaaataaatggaatacatatgatccagacgacatggaactgattgaaacttagtccagttcggtttttgaaaagaatctctataaaatgcaggctgcagatacagcaaggagtgaacatgccggcaagagcagagctgataccgggaagagaagataaagagaagcagattttacatgactgctgcgacgtcgtactctaccttggcattatagacatcttacaagagtacaacatgaccaagaagattgaacatgcttataaatctcttcactttgattctctttcgatctcagccgttgatccaacattctactcccaacgttttcttgagttcatcaagaaagtatttccacagaacaacaaatcatagacagagaattgagtacagagttttatgtttttttttgtagagataaaaaagaattctatgttgtaagtatgttgtatacagatcttgagagcttcaataaataagtaaaaaactaattctccttttcttgattgcatgaagtatttggtttaattattaaaaggcaaaaatataaataatcaaaagtcacagaaaagccctaacgtgttgtcttcttcttcttcttcttttgaagagtaagaaatcaatgtcgtccctggaaaagaagaggaagaggaagactacgactaggacaaagaagaagaagctgtccccaaatcagtcaatccctatgatttgctattggacatcatcgcacgcgtcccaagattgtactatccgactctctcactcgtttccaagagctttcgatccctcctagcttcaccggagctttacaaggccagcaggtcattcttgggtcacaccgagcgttgtctctatgtgtgcttacggtgctgtcctggttatcgctggttcaccctgtgtcggaagccagatcaaaccctatccaatgacaccactgaaaagaagtcaagtgggtatgttttggcaacagtccccattcctagttttcataaaccgcgcttttcgagtctcgtggtggttggttctgatatctactacatccacgggccctcctctaacgtctcgattctggattgccggtctcacacgtggcgccaggttcaaagctcgattctagattgtcggtctcacaggcggcgcaaggctccaatcttgccggtggaacattcgtcacttactgctagcgtccttggtgaaaagatatatgtagcaggatgttacagcgatatgcatttaggttcttctttctttgaggtgttcgacacgaaaacggaagtttgggttagtgagcccatcccttacagcgacagaaaatacaactttcttcaccccaaaagcatttgtattgatggaaagatccatgtagtgactgacagtgagggggttgttgcttacaatcccaaggaaggtatatggttggatttggatcagtatatgcgttcagattcttattgtgagatagatgatattttgtactctgtttatagcagaacggttatatggtatgacactgaggcaagcaggtggagatatttggagggcttaggacaacttacgtttcctcttggtgcttctattagggcttaggaaagttagcggttttgtgggacgaggatttgctttatggtttgactagtttcgtctataagaagaagatttggtgtgcggagatttcgcttgaaagaagcaaaagttgcgaaagttttgggaagttgaatggtttgatcatgtgcttacagtgcctaaagaatgtgaattggtgaaagttcttgctgctactgtttaataattgcgtcacaaggcttgaaacgaggtctctttgtctctttattcacttgtaatcatttgatttcacttgctgattgattgttaagcttactttgttgtgaccaaaatgcttttgataactacggtcgtctctttacatatgtgtaaacaaaacaaaaaaacactttggagagtaattgatttgaatggttaattttgcaacagaaagagttttttttttttttggttatgttttaaagtgtaaaaaaagcctttgttcatgtacttgttccaaaactgatagtaacttgtaatccatacaagtgaacttgtgaacactctttataacaacttatctttcatgagagcttcactaagaaaactagttttcctttgtgtttttttgggtctgaatcgccgcaaaccgcaaaagataattgcaaacgtaacagtagtgctttgattgcatgaaatatttggttttataataaaaagctaggaaaaaataaaaaaaaatttgggagggagcaacaaacacgtggatacaaaacaagacggactttggaagaaacgttgaaacagaaacagatacgtgtcgtgaagcgaaatgtcggagaaaggagaagaagcagtaaagagttctttaatgtttttgacagtatttgttcaacaattctcattaacgtttttcattatttgttttctgctctgtaaagaataaagtttcttaatttgttgtatgaatcatagatttctctgcagaggcaaagttttctctcttcttttttcgattcattcttttacaagataacataaaaatcacttcttttgtttgtttgtttatctaagttgaatttgatttgatctctttactgtagtattagatagagtgagagattgtagaagaaa

SEQ ID NO: 10983 - DNA, 3000 bp, Unknown
  misc_feature (1)..( 3000): cDNA_ID_2705158_gDNA_ID_2214470_Annot_ID_182998 3000 nt of promoter + ATG
tcttttttttaatgagtgttattattcttttatttatgaattctggtgaaattgtataatcaaaaatatacattcaagatttgagaaaataattttcaatgagaggaaacattatccaaaaacattaattgtgattaattacactttgctcagctaaaattttcaaagttggtttatgaatctttgaaactaaagaggtgctacttcaattgttctgttagctgtttatatgaattaaaggagaaaattaatatatgaacagattatttttatttagtgtttttatatataaccatttttaacaaaatatttagctaattagttcatgcacacattttgtctactatatatgcagtgttagatgaacaaattcgttttatgtagtgattgtgtttaaccattttcaactaacatttagctacttaattcatccacacaatttgtcagactacataattcacatgacatttactgctctgtaatagtattaaaggaaacaaatatgaaaataacctactagtaattcttttgacaatatagagcttttcttagtcataaaacagcttttgtttcaaaattggaaacgatctctctttttgggatcttacacaaagtacacatgtacgaaattcctcattgatacatcattcctcattacgaaccacacaattagatctaacatatatatatttgttccactcaaatacaaatcttgttagggtaacatcacctctgaggaaacgacaaaatgaagttaatgaaagtatttggctttagatggattcgtagatagtacgtgacacgttgctgatatgcggacttcagataaattatcggctagtatcataaagataatgtaagggtctaagcatactcactaattaacgaaatatcttcttagaaacacctgagctcgatctatttcaatcatagtgactcaaacctaagaaaatctttgacatatgtatattacattagtgttccaagaagatgctacgttcgacgtcatatttgttatcctgtaaattataacaaagatgcatcaacattcaacagagaacaaagtttagtttttatatatatatatatgtcacgatcataggtctacataactataaattgatacaattgattttacagattttacacaacatatgtatccaacttgatgatatatccggtctgccgtttcccactatatatagagtattttataattgattcccatttatttttcttagtttatatatgttcgtcttttggaattgcttaatgaaagtgtgtgcgagtggttaggtatgcgattctattatgtctctttatttatttttgatttcgaatcgcaccactaccttcgtatgggaatgtttcaatatgatatctatctgtatatgatcacgaatataatttgattttgatcaaaatcaacatgtaatataatttcacgtaatatcaaacatccaatagttacagtttaatctggctactgaatatatatatatatatatatatatatcttcctttgaaagaatgtttatatatttttattctttgtgacgttttttttagctaatggtgatctcttgactctaaattcatacaaattttttaaaaaattagcttagggttttgaaaatataaaaactcttttagggcttatgttttctttttggtcaacggagcttatgcttttgtagaaacactaatttttaagacattaaagtatacatcagttttgttttgtgttttgggttaaacttatacacaattattcaaagacgacaaaacaagtttaaatatgaattccaaaataccagttcatcttttcggactactgtatataagaatattatgttggcaaaaagtaggtttattataggttaaaaataaaaataaagtatagcctactttgttaggaatacatattaaacttcacactaattactagtagatatttaggcaatataagtctagaagcggaaagtagacaatgcctattgcctagtatacatttcggacagcacaagtgacttttaactctttaatcacacagaagacagaactatgcaatgatcgacaacttcttcactctgtaaaatatttggatttctcaattaatggtttctgaaaataacatcatctttttaaagcatgaacaaattaatcctaatgtagacctaaataaaaatcttaagaccatctttatcagtaaaaacaaggaaagattctaaaaaaaaataaaaataatattttaattaaaacagatacattaattattatttaataattgaattaatagtatgatgacacttgtccaaattggatgagaatagtttctcaaagtttctcggaagagaaattcaactctccttctcttctacttttttttccttctatcatactttttcttctttaattattttttttttttattgggtatcttattgagatacttcaaatggagatgctctaataattaatgggaatgtgtttctaattaaaaagataacatctttctttctatatttttgtcgtcatataacacacctcaactcttttaagtactcgtgttgaattttgttttttgaaaagacaaaactccttataatcaacgtaattattaataacaaggagaaaaaaagtccaaagaaaaaaaaaagaaagctttttgggaacataaacaccatcgaaggagggtgggaggtgttttatgttcatgggtggagcttcttggccaacctgaccccattcatcatatcattacccactttcttctcctaaattattctctcttatctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataacat

SEQ ID NO: 10984 - DNA, 3000 bp, Unknown
  misc_feature (1)..( 3000): cDNA_ID_3034470_gDNA_ID_2214470_Annot_ID_182995 3000 nt of promoter + ATG
actccactcagtagcaaagctgttgggttcgccaggttctacacaacaccagcaaagaataacaaacatgtggatcataagctaaaaatcgaatcaagttctgatattgaatagtggcaagataatatctaaacccactgtatttgaaaacatgatttatttattagactccttaaccctcaatgctaggttggccagttattaacatcattcaagtactacaagcacgatcatccagtaagaaccattctacaatataaactagacaataatccattctacaatgaaagcttctgaatgttcaaccaagaaatggcatagaagagagtaatggagaatcttctctcaggaacagcttctatcatacttagttttagggtaaaagtaggcaagttcacttaaatttgtcaaaatctgtaatgcagtgtctaaatcctatttactctaataatttaacaagttaacaacaactctatgcatcaaacgaatttagaacgatgataacatctaagaatgatgactaaccattccagcaatatcaggtgcagagccgtgaacagcttcagcaagggcaataccatcctccccaatattcatactggaacaaaacataataagagcataagatgattgcctcattttcatactagacaataatctgtgagacgaagaaacaaatgttacctaggagtcagtcctagtcccccaacaagtccagcacacaaatcgctgataatatctccatagagatttggcatcaccaagacatcaaaaagtgctgggtttttcacaagctgtcagaattaagattatcaatcccacattgttccataagtaaaattagcgaaaagcagacccaagtatgggttgctgggaaatctaaccttcaaaatcaacaagattatcccaaatactaacttaattaacaatgagattgacctttacataatttggaacaaaagatagggtggatatcatgttatagcttaccatcatacagcaattgtcaataacaaccttctcgtaatatatctcaggatacttcgcagcaacttcatcacaacactgcaaagcaggaagcaaataaaaacttgtctcagaacaaaggttaagaaaaagaagccagtgagagactagaaaaattgctatgttcccctaattgagaagtgctaatgtattctgagttccaaaatgagctgacctgcaggaaaagaccatcagttttctgcataatgttggctttgtgaattgcagaaactttcttccttccgtgagtcttggcataaagaaaggcatactcggcaactctcatactcgccttacgggtaataattttaagactttccactacacccttgacgacctagcaaataaaaatgacaaatcatcaacatggctctaaaaatgatactagatacagattcactaaaatgacagaacaatagactaacctggtgttcaagcccactgtactctccttcagtgttctcacgaatggtaatgagatcaacatcatcataacgggttttgtaaccaggaagactgtaacaaggcctaacattggcatacaaattcagctctttcctaagagtaaggttcaaggaacggtgaccctttccaattggagtagccattggtcctttcaaaccaaccttgtttttaagcacagattgaagattatcccatgtcaagaaactattggttctaggatctacttcagtaccaacaaactgttcgtcccaatcaataaccacatcagcggcagtaaacacctggatcagcataaagggaaaacattttcagaaccatcagctataaactaaaaaaaacaaactttatgattcaaatctctcccttgacacgtctcaaaaagtattcagacattatggttcctaagagtatccagaatctataacaaaatttatatggtaacataaattacacaacaccaaagtagattgaaaaaagggacctgcttgacagattcagcgatttcgggaccgatcccatcaccgggaaagagagtagctttgatcggagtggaggaggagaagaaagccctagaaacggaaatgaacggaccggagctagaactcgaagtcccgagaatctggctcgatccgttaccgataagccgtctcgcgagaaatgctgtcatggtcatcgcttccagcctcagaaggacgcagagagagaaagagaggaaagaggagactttttgctgcgttggacctgaaaaagtttacttttataccttctctagctccagcagagaagcagagaacatttcgatttccatgaaataaaacggcacaaagttagtgtctgaaaataagaaacggcatcagcctatgttcttaaacggccatggtcaaatgaaccggatatcaataaattataaaaaccggtcagatgaaattaagcattcagatcccgataagcagtgtgacactgaaacagcgaaaggagctctctctcactccgaggcgatttcttctgtctcgacgatcttgcgcttttcacatttgaatcctccaatccattacttcttctccgatcttttattccggtgatcctttggattatgattatcgagatccattgctgcctatttgagtcttgaatcatttgtttgcgttctcatctgtgcttagttatgtgattctccgataagatttagttatgtgattaatgcatgtatgtatcaatccgaattttggtgattcgttgtctattattaaatacgtcaatctccatttgtaatccctggttgaaataatagctatcttgtcatggagatcatcaacattacatttactacactacacacataatgtcacatatgatcttagtatatgtactcttttgtaccagtgactagaacaactgtgagtgtgggttgaagtttttaatatcttgttaaaatcgaaagtttttgactcagatactacttggttttgtttttgtcactgtttcaggtacatctcaagtcttacaaca

SEQ ID NO: 10985 - DNA, 3000 bp, Unknown
  misc_feature (1)..( 3000): cDNA_ID_2705162_gDNA_ID_2214470_Annot_ID_182994 3000 nt of promoter + ATG
tgcacaaagatttgcataccacctctcaacctcagaaccaagtggagagttgactctttctggatgttgtaatcagccaaggtaaggccatcctcgagctgtttaccagcaaagataagtcgttgctggtctaaaggaatgccttccttgttctggatcttagccttgacattatgaatggagtcggaggtttcaacatcaagtgttatggtcttttctgtaagagtctttgcgtagatttgaattgtcatctgtaaacaattttttttatgggagagaaaggaggattctgaatggtaagaaccaaaaagatcaggcgaaaaaagatgatgagaagagatagaagaaacaaataccttgagagagagtagtagtacttcacagaaaacttttgcagaacgatcgatttagggtttgagtaaaagcgtttctcagtttatatagaagaggaaaagttttggatttaaatcagctttcgataattataaaatattcgacttaatctgttaattaaataattcgaaatttagtattatcttgtttatcgctttgatttttttataaaatgcgaaccaaaacaattcttgctttgattatttttataaaatacgaaccaaaacaattcttgctcttctgatatggcgtgcacctcaaaatagaaggttctgaggggtggcactttagtctttcttcaccttacaagatcactagcatctgaaatcgcttggaaaatgaaatattcctgaattgcttagagtttagacttcaattagagtaataaaattccactctccaaaaacattcatgcattgcacaaagctatatatataatcaaacctttactaccaaactttaagagtttgtttgcagaattcaattattagagactttcaaaccgaaagactcaaaaataaaaagttgctcaacatagaaattgaagtccatgcttctattattgtgtcgccatgatggaactcatgtaagcagacttcttgccagatgctcccgagctgttgctagcgcttgtgttagtgtctgcaataccgaaatgtaaacagagggttcaaattagaagttcacgtttgtgtttatagccaaaccagaccaaagttatagcaaaactaaatcaagactattgcttttccacagggagatgtaacaataatagtcaaaagtgtcgttacctgttcagagagtgaaccactagcttctgtgctctgcattgctactttccccgcaatgacgtttggatccgtttcaagaaccacccttaacacatattccataataagccacaatcagacaatagctaactgctaagatatatgggacaagcttaaaaaaggttgagcaaatctttagcatgcttaagacttttatgtaattgtcgtgtagggctaaactattaaacttgcatacccttgatcgaccatttcatcaaggcatagaaagatgagatccaagttctcaagggcttccatcttttccacattgctcctggtaaaaaaaaaaagggatgcatcatactttagttgtggagatggttgatcaataaataaaggcatattcagttgtcaagtcaaacaaatacctcagaagaagtgcaacagcatcaaaaaagccttgaagaacagaagctaagatgagctcgttttcattttcacctccagtaacaaagaagtgaaggtcctgggcaaacttatagacaataatattgctgtccaacagtgtgatctcagctgcacataaaacatcgatatggctatttgaaagagataagtatataagcatacacgaagtcaggaaacatgatagaaattgtgtagatgaaaaatgttatgtagtcttaccttctgtacgagcattggtcttagaggtctttgagaatacatacttctcaaaacttaacttggcggcattagttggccagtcatccgagtaatacttgacagccacacgctttccttcagagtctagaagaagaatgttctttaccaaaggacaagaatcctattcaatgtacattggaaagtcagtaattaagttccagtccaaaaaaagagtaaaactcctacaaagctgtatgattgcggcaacatacacacattctaacagaatacgaaatacaatcatataatgcatatgtacttacaggagacattgttgtaagacttgagatgtacctgaaacagtgacaaaaacaaaaccaagtagtatctgagtcaaaaactttcgattttaacaagatattaaaaacttcaacccacactcacagttgttctagtcactggtacaaaagagtacatatactaagatcatatgtgacattatgtgtgtagtgtagtaaatgtaatgttgatgatctccatgacaagatagctattatttcaaccagggattacaaatggagattgacgtatttaataatagacaacgaatcaccaaaattcggattgatacatacatgcattaatcacataactaaatcttatcggagaatcacataactaagcacagatgagaacgcaaacaaatgattcaagactcaaataggcagcaatggatctcgataatcataatccaaaggatcaccggaataaaagatcggagaagaagtaatggattggaggattcaaatgtgaaaagcgcaagatcgtcgagacagaagaaatcgcctcggagtgagagagagctcctttcgctgtttcagtgtcacactgcttatcgggatctgaatgcttaatttcatctgaccggtttttataatttattgatatccggttcatttgaccatggccgtttaagaacataggctgatgccgtttcttattttcagacactaactttgtgccgttttatttcatggaaatcgaaatgttctctgcttctctgctggagctagagaaggtataaaagtaaactttttcaggtccaacgcagcaaaaagtctcctctttcctctctttctctctctgcgtccttctgaggctggaagcgatg

SEQ ID NO: 10986 - DNA, 3000 bp, Unknown
  misc_feature (1)..( 3000): cDNA_ID_3038901_gDNA_ID_2214470_Annot_ID_182993 3000 nt of promoter + ATG
ttccctttatgctgatccaggtgtttactgccgctgatgtggttattgattgggacgaacagtttgttggtactgaagtagatcctagaaccaatagtttcttgacatgggataatcttcaatctgtgcttaaaaacaaggttggtttgaaaggaccaatggctactccaattggaaagggtcaccgttccttgaaccttactcttaggaaagagctgaatttgtatgccaatgttaggccttgttacagtcttcctggttacaaaacccgttatgatgatgttgatctcattaccattcgtgagaacactgaaggagagtacagtgggcttgaacaccaggttagtctattgttctgtcattttagtgaatctgtatctagtatcatttttagagccatgttgatgatttgtcatttttatttgctaggtcgtcaagggtgtagtggaaagtcttaaaattattacccgtaaggcgagtatgagagttgccgagtatgcctttctttatgccaagactcacggaaggaagaaagtttctgcaattcacaaagccaacattatgcagaaaactgatggtcttttcctgcaggtcagctcattttggaactcagaatacattagcacttctcaattaggggaacatagcaatttttctagtctctcactggcttctttttcttaacctttgttctgagacaagtttttatttgcttcctgctttgcagtgttgtgatgaagttgctgcgaagtatcctgagatatattacgagaaggttgttattgacaattgctgtatgatggtaagctataacatgatatccaccctatcttttgttccaaattatgtaaaggtcaatctcattgttaattaagttagtatttgggataatcttgttgattttgaaggttagatttcccagcaacccatacttgggtctgcttttcgctaattttacttatggaacaatgtgggattgataatcttaattctgacagcttgtgaaaaacccagcactttttgatgtcttggtgatgccaaatctctatggagatattatcagcgatttgtgtgctggacttgttgggggactaggactgactcctaggtaacatttgtttcttcgtctcacagattattgtctagtatgaaaatgaggcaatcatcttatgctcttattatgttttgttccagtatgaatattggggaggatggtattgcccttgctgaagctgttcacggctctgcacctgatattgctggaatggttagtcatcattcttagatgttatcatcgttctaaattcgtttgatgcatagagttgttgttaacttgttaaattattagagtaaataggatttagacactgcattacagattttgacaaatttaagtgaacttgcctacttttaccctaaaactaagtatgatagaagctgttcctgagagaagattctccattactctcttctatgccatttcttggttgaacattcagaagctttcattgtagaatggattattgtctagtttatattgtagaatggttcttactggatgatcgtgcttgtagtacttgaatgatgttaataactggccaacctagcattgagggttaaggagtctaataaataaatcatgttttcaaatacagtgggtttagatattatcttgccactattcaatatcagaacttgattcgatttttagcttatgatccacatgtttgttattctttgctggtgttgtgtagaacctggcgaacccaacagctttgctactgagtggagtgatgatgttgcggcacctgaagctcaacaaacaagcagagcaaatccacagtgccatcatcaacacaatagccgagggaaagtatagaactgctgatctcggaggttcctcaactacaacagatttcacaaaagccatctgtgatcatctctaaacacccgtgaaaaaccataattctttccttacttacttattggatcttcctcttggattttcactccaaaatttttctacatattgatcctcttcctatgaggagaaacaaagccgccataggctttagacattgacttgtgttttccttagatttgaagttcttgcagagctgtattacttcttctgcctttaagatccataacaaaagaaggatacagatattggaagaatccatcaaaaggttcacatttacagtttgtggattttgcctgaattgtttggcgttatgtcttattctctgtgaattttcaacaataataatatcgtcccttttgtccttacctaaattgtttgcctattctctgtgaatgaatgaatacataactctcaaaccctgaaaagtgaaaactttcaatgctgaaacaaaccaacgtggatgattcaggacttttcaatgccaccgacaaattcaatctttttcctattcattttgtaagttgcaatgctgtcacatttggttttctcattgtttttaactctctcttaaagaaacaacttaattataatttttatgttcttacaacaagatccaatagacttttggacatgtgttgacacttttctcaagtgggttggtgggatagggacgtatatagctgcatttgacaacaacactactctatttcatcaattatttcgttactcataaattttgtttcagttaacttttctctacaaatgaagttgaatgaaatgaactatactaaaatttggtttaatatagaattagaaattccaatggcaaatttatgcatgattttgagctaatatataaatatacattattttgcccaaaaaaaaagataaatatgcattaaaaaataatatatataaaataataggaagaagaagaatctatctttggtatacctactttggtttcagagcttataaacacaaacacttcactcacacaaaacacttgctcctccatttaccagatctgaacctcttccctttcctcgaaaatccttctaacatcatcatccatg

SEQ ID NO: 10987 - DNA, 3000 bp, Unknown
  misc_feature (1)..( 3000): cDNA_ID_3038905_gDNA_ID_2214470_Annot_ID_182992 3000 nt of promoter + ATG
cctcactaactgcactctaactaagtcacagcagctcgaatttgctacattccgtcctagattagatacagcttaacttatagctaagagttaaaagcttattattgtttgatgatatcaaccactcatctaattatagcataaaaactcttatccaaatccaggtttaccaaaccgtttgctttgttatattgtaataagaagattatcatacattttgtatcagtctcaagtaaactaattccggtggtttaaccctcttggttctctgtgttcataggtgatgcatttgtgggagggtttctgtcccagctggtgcacggaaaggggattgaagagtgtgtgagggcaggatgctacgcgtcaaacgtagtgatccagaggtctggttgcacttaccctgagaaaccagacttcaactaaatctagaagtcgcacaaatcatccttttagttttatctctgaatgagattttggtgattattattatacgacccaaataaactctatgttgttttcttgtatcaccttttgaggctttaagctattattgagtgtgtgttttggcttggttttattgtacctttttatgattaataaatattattactatactaggccgagtatgatattccaaatgtcaaaatgttcataacttgttatatcttcatggatgtaattatcctctatttttgtttgaacttgcttcatttcatgaaataattgaatgatcattattccctataatgtacattactgttatattaactagtttctctgttcgaattctatttggttcggttcaacgaaacaacattggacattcctatgcaaagaaaatttgcagaatcttttgtgtcggcacatgtatagaacaatttctattgaatcatggaaatgacaagtataatgtctcgttttggatgtatttgataatgtaaagtaggaccagtatgactcgtaaaagacttttgactttggacgatatcaacaactttgacttttacttcacttgtacagttctactttcttatcttctacgtatactaatcaaacgaatttgtgcataaattggcatgggaaaggccacgagtcaaatatgatttgatccattttagttttaacatctattggtacgtacgtgaagttacgagatttgagtgaaggcgaataatatcaatacgaaaagtacaaaaccgggatcaaaccgcaaattgtaacacagcaagcgtaagcaacacgacaaagtggtatggattagtttaacataatcgtataaataggttaagttaccaaggtttaaggtatctcaacaagtggtacaaattaccaaacaagattttaagaaacatatagatcaatcgggattcggaaaccaataccgaggatttctttaattcattattttttgtgtgaaaatgctaaactttgtcgttaaatttatgtactctaggttctaggaagatttaggaaatctcctaggtgacccaagtgaaatatcccttccacttccccattgcaaatctcatgattaccataaacaaataagattagtagtagagaactatgcttgttaacataaacattaatgtaattatgtaagattatattttgaaccactttggaaagtggaaaccattttggcatcatgggccgactcacccaccttaagaataaaacttcgtattgttatagattttcaatcactgatatttaacaatggtttttttttttttgcaacagatggttgatgttagatgatagtaagttagtaccattaaatataaaacaacattaatgaatacttgaaaattataaaactgtgactatattatctatacataatctataaaaaatatttatttttcaaaagctcaaacattggttgagttgtctatcataaatgcataatcatatacatcttgagtcactcaccgtcgtttattgtagactttgtagatagttttattttgtatgttaaaacgtttcaccatcgtttattcgcattccattaatttgaagatttattctgtcatagtaaaattccctaaacaatagaaaatgatgttgttgaaataagtaagattttattactaaataagaccataactcataagtgatttagatacactgatcgatctgttggctacttttctaagcacctcaccgttgaacaagtcaaaggaaaaagaaatgaaaacgttgtttttatgtgtgattgtgtgtctaataaaagaatattaattttggaaacatcttttaatagtaacaaataattcatttgttttgtccaatttaaattctcagttcttcgttctttcgctgactttagctatctctctctgtaaagacttcgttttttttttgttgccgtgtgacgacttcttcttcctcttcttcttcgacctctttctctcggaagcttagcttcttaaaatccatttctctcggaagcttagcttctcaaatcctcgatctcttttgtatcgtgattcattaaccacttcatgataattataatcttccttctcttctgacgattgaattacatcttcttctgatagctgttctgatttttttctgtatacaaagtaaattcaaaggtgagagttgtgtcatcttttgctttttatatacttgttcaataagtcaaagttctttatgttgctgttgggttttagtttattggaatcaacttgcgaaatttgattacttttagcttcgagatcccttctattactcactggaacttagggtttgtgttacttggaaaagaatttggatctgttgggtctaaaggccttcctctctgttaagtggttttgtacttgggggaagccttaactttggaaatgcttgtactttgcagattagttgttcgataatatgcttcaatggttttgattttgtggttcggtatatgttatatgatcattatcagtgttttattggtgtcctgcagtggacaaacatcggtattttaatctcctctcgataatg

SEQ ID NO: 10988 - DNA, 3000 bp, Unknown
  misc_feature (1)..( 3000): cDNA_ID_1027032_gDNA_ID_2214470_Annot_ID_182987 3000 nt of promoter + ATG
atccttatccgccagattacgaaaatgaggagcttgatccgagagaggcatagtgaaagcttatctgtgaattcttaggatttgaatctgaatactcaggctttttgattccttctccgttacatgctgattcaattttgagctcccctgctagtgtaaatctcctcagctcggaaacttagggtttagtttggggtcctttgctcttcgttgcgtaagccatgtttaagaaaatcatgaaaggtgggcatcgaaagccctctaaatccgaagctaatgaaccgtctagttatgggattggtctacctgataataggtcaggtcctggctccaatgtggtcgttagtcacgcttctcgtggtgcattggttaattcttctccgtcgccagtgactgcaactccacctcctccgcctttgggctcggtggagccactcccgttgtttagagatgtgccggtttcagagaggcaaactttgttcttgaggaaacttcagaattgctgtttccttttcgatttcactgacacgattaagaatgctagagacaaggagattaagaggcaaacgttgttggagctggtggattttatacagtctggatctagtaagatctcagagtcgtgtcaggaagaaatgattaagatgatttctgttaatattttccggtctctcccaccagcatcacacgagaatacgggtcaagagcctgcagatcctgaggaagaagaaccttatttggaaccttcttggcctcacttacagctagtttacgagttgctcctgagatatgttgtttcgactgacactgatacaaaggtggccaaacggtatatcgaccattcttttgtgttaaagttgctcgatttgtttgattctgaggacccaagagagagggagtatttgaaaacgattcttcataggatatatgggaagtttatggtccacagaccctttattaggaaagcaatcaacaacatattctataggtttatttatgagacagagagacacagtgggattggggaactcttggagattctaggcagtatcataaacgggtttgcattgcctatgaaggaggaacacaagctattcttaatcagggtgttgataccattgcataagccaaaaccaatcgttgtatatcatcagcagttatcttattgcatcgttcagtttgtggaaaaagattataagcttgcggatacagtaatcaggggattgttaaagtattggcccgtgacaaactgctcaaaggagaatctcttccttggagaacttgaagaagttcttgaggcaacacagcctgtcgagttccagcgttgcatggttccattattccaacaaattggtcgctgtctcactagctcccactttcaggttagtcgtcgtgtttgcaatggtgtttttttttaatccccacatggaaggcttattatgcatattaccttaaatatggagattttgttatttagctcttttgactctggtctgatttcttccctgaaaagaactagtgcttcatcaagtttagtgcaaattgtttttttttgttctgtttttctttttgctttgcctctttctcttcatttttgccacatgttgattttcattcataaaatgatcttgttggtactaactctcataagtatgcgttatatctcatgcttttgatagcttctactctgattaaatccttggattcctagatcatcttcattttccatgattcagttgtttcaaaatttatggagtgaattaactctctgaatgtattgttactgtgcttactgatttctaggaatcacacaagtttcccgttatgtctttgtgcaacagctcaaactttcctagaattctatgtggggtttgccttatgctcatatgtatatctcataaatccgatacaggttgcagaacgagcactgttcttgtggaacaacgagcacattgtgggtctaatcgcgcaaaaccgaagcgtgatccttccaatcatatatcccacactggagaagaacatccagtctcactggaaccaagcagttcatggtctaaccacaaatatcaagaaaatgttcatggaaatggatcctgaactgtttgaagaatgtcagagacagtatgaagagaaacaagcgaaatccaaagaagtagaagaacaacggcaatatacatggaagagattagcagaagcagcggcggagcgagatggaggaggaggagaagaagatcatatgatcacttcctagatcgatcaaaaagggtataattctttcacttttttttttgtttgttctcattttatcaaatgagttactatattaattttcttatcaaacttggatttgtttgttgttttgagaatcatgggttcaaaatctgattgctcagagaagtagagagagagaagtgagccattactatcagagaatatgtctttagtactaagaaatgtgtttgtgatcttctgtctaattttgttcgtggaaaggcactttaaaattttgtaaaattttaattatatatactgtggatggatgtttgtagcttgtgttattagccatctcaaaatccaatttggttttcttgttttgatccattcttaccctactttttgtgttatttgtatcaaaactttgaatttgtatataggaggaaactagtcttccaactgatccaggacaatgtatttgattcctcaatttccaaaagataagaagagttttcattttaactcttaaggtaaactaaacacaatatcgtcttctttattattaaccaaattggttcagagccattggaccgaaaacatagaccgagagaatataccaagttatatacagttaattaactgcgccaattcaccacgagaaaacctaaattttattgaggtagcttattgcacggcggcgattagttgttttacttgttacaagaaaatcattccacggcggtggagaaaaaacaaaagagagcgagacaaagagagactacaatg

SEQ ID NO: 10989 - DNA, 3000 bp, Unknown
  misc_feature (1)..( 3000): cDNA_ID_1440942_gDNA_ID_2214470_Annot_ID_182986 3000 nt of promoter + ATG
tggagaagaacatccagtctcactggaaccaagcagttcatggtctaaccacaaatatcaagaaaatgttcatggaaatggatcctgaactgtttgaagaatgtcagagacagtatgaagagaaacaagcgaaatccaaagaagtagaagaacaacggcaatatacatggaagagattagcagaagcagcggcggagcgagatggaggaggaggagaagaagatcatatgatcacttcctagatcgatcaaaaagggtataattctttcacttttttttttgtttgttctcattttatcaaatgagttactatattaattttcttatcaaacttggatttgtttgttgttttgagaatcatgggttcaaaatctgattgctcagagaagtagagagagagaagtgagccattactatcagagaatatgtctttagtactaagaaatgtgtttgtgatcttctgtctaattttgttcgtggaaaggcactttaaaattttgtaaaattttaattatatatactgtggatggatgtttgtagcttgtgttattagccatctcaaaatccaatttggttttcttgttttgatccattcttaccctactttttgtgttatttgtatcaaaactttgaatttgtatataggaggaaactagtcttccaactgatccaggacaatgtatttgattcctcaatttccaaaagataagaagagttttcattttaactcttaaggtaaactaaacacaatatcgtcttctttattattaaccaaattggttcagagccattggaccgaaaacatagaccgagagaatataccaagttatatacagttaattaactgcgccaattcaccacgagaaaacctaaattttattgaggtagcttattgcacggcggcgattagttgttttacttgttacaagaaaatcattccacggcggtggagaaaaaacaaaagagagcgagacaaagagagactacaatggctgttccaagaggaggaaatggtttgaatgaagaagaagatgttgacggagaaaacgctatctttgaggaaaacggtgttgactacgacaccgattccgagcttccctctcacctccgtgacttggccgccgctgctcaggccggagatgtcgccgccttgcgcaccgccatcggtactttccttacttcttctcgttgctgcttttaacaaatttcaatttcaatttcatcttcaattgcgtattgcttgattagctggtcagaccaaaaaagcctcaaaatttcccacattcattgcagaagattcctctagtttgatcttcgtctcatccttttaagccaccttaagggcttcattttccatttgactcactggtttgctcaatctagtttaggttcacttaggaaggataagagaaacctctagttttatgcctatgtgtgtattcatgtctatctttgttttgtttgttgcttggggctgtgattgatctgacgtaagatttgcatactcttttgaactgatgaaaattagtttagtctagatcatctttctactggtagaagtaatggtatcagattttgcattgtgtggatatgtcttaatttgtgcactttctgctgtttttgagaagatgaaatgtttaaaggcaatcatattccttttctgattttgatagacaatttgaatgggagagtcgatgagccactcgaggataatgactcggcacttcacttggcatgtctatatggtcacctaccttgtgttcaggttgctttttctttgtcatttccatcgactctgatagctaatgtatctgtaaattaatttttgtattgattttcactgcagctgctcttagaaagaggagctgatatggaagtgaaagatgaagacgaagcaattcctctacatgatgcttgtgctggaggtaaagtttgtcatggtcctaccattcttttggtaattctgtctcacggcatggtcacattctgtggcttattgttctttctctttaacttgggctcgcaggatacttggaaatagtacagcttctttttagccgagctagtagtcctgaatgtgtgaagagaatgattgaaacagcagatatagaaggtgatactgtaagtattctcaatcttcaattgcctcattccctctagctcttgctctctataatgtaattcatcccaaagtttttcttgttcacagcctctgcatcacgcagcaagaggtgaacatgttgacgtggttaggtttttgctgggttccggggcttcaccaacgacacaaaactcctatgggaaggtgaaaaaaaacatttgaaagcaatttctatctttggcttttgaagtatggttagcgataataacaaggttgtgataatgcagacaccaggtgaattagctgatttaaacactgatgctaagaggatactcgaagaagcgataaacaactcaatgatctcctagtgatgctgcaaatctgcagagttcattggccagttttggcgactcagtgaagtagtagcaaaatgttaactttttcttaatcctgttttttggtggtttcatatacaaaaggtttcaaattttgatacctatggaattaagaacttccgtgtcggttttaatcatgaaattattatcagatttgagtagtacaaaatatactagtttctttgtaagaaaactggaatcaattttaaacatttcaaacatctatattaacaagaaggaaattgagcggtttaataagttggtggattgaagtgtgaatacttgagaaataaaagactaaaacagtaaaaagtaataaaatatgatccaccaatgagcagctttgaacttgatagcaagcagagcacttattctgcctctttcctttctttttggctgtctccggcgagaagagattttccgggggaaaatagcaaaagctcggttttagtttctgtttagaaagaggatacagaatagtgattactaacatcttctccgatg

SEQ ID NO: 10990 - DNA, 3000 bp, Unknown; identical to SEQ ID NO: 10982
  misc_feature (1)..( 3000): cDNA_ID_3038912_gDNA_ID_2214470_Annot_ID_182985 3000 nt of promoter + ATG

SEQ ID NO: 10991 - DNA, 3000 bp, Unknown; identical to SEQ ID NO: 9339
  misc_feature (1)..( 3000): cDNA_ID_3041372_gDNA_ID_2214470_Annot_ID_182980 3000 nt of promoter + ATG

SEQ ID NO: 10992 - DNA, 3000 bp, Unknown; identical to SEQ ID NO: 10989
  misc_feature (1)..( 3000): cDNA_ID_1440942_gDNA_ID_2214470_Annot_ID_133056 3000 nt of promoter + ATG

SEQ ID NO: 10993 - DNA, 3000 bp, Unknown
  misc_feature (1)..( 3000): cDNA_ID_3038905_gDNA_ID_2214470_Annot_ID_133062 3000 nt of promoter + ATG
ttaaattctcagttcttcgttctttcgctgactttagctatctctctctgtaaagacttcgttttttttttgttgccgtgtgacgacttcttcttcctcttcttcttcgacctctttctctcggaagcttagcttcttaaaatccatttctctcggaagcttagcttctcaaatcctcgatctcttttgtatcgtgattcattaaccacttcatgataattataatcttccttctcttctgacgattgaattacatcttcttctgatagctgttctgatttttttctgtatacaaagtaaattcaaaggtgagagttgtgtcatcttttgctttttatatacttgttcaataagtcaaagttctttatgttgctgttgggttttagtttattggaatcaacttgcgaaatttgattacttttagcttcgagatcccttctattactcactggaacttagggtttgtgttacttggaaaagaatttggatctgttgggtctaaaggccttcctctctgttaagtggttttgtacttgggggaagccttaactttggaaatgcttgtactttgcagattagttgttcgataatatgcttcaatggttttgattttgtggttcggtatatgttatatgatcattatcagtgttttattggtgtcctgcagtggacaaacatcggtattttaatctcctctcgataatgaagtgtttcttgttctctggtggggataagagaggggaacagaagacccctatttcggtttcattgacctctatcttctctgaccgcgaaataaaccgaagcgggtcagagttcaactctcgtgatgtctctgggacgagcacagaatcatccatggggaggaagaactcgtaccctccggtgtctactagagcaagtaatctcagagagttcagcattactgatctcaagtctgcaacaaagaactttagccgatctgttatgattggagaaggcggtttcggttgtgtcttcaggggcacagtgaggaacttagaggactcgtcagttaaaatcgaagtcgcagtgaagcagctcggtaaaagagggttgcaggtatgtctgttttttccaatcttgttctcaagatctgttactcatccactggtttaacactattatctcatttcttggatgttgcaggggcataaggaatgggttacggaagtgaacttcctcggaatagttgagcatacaaacttggtgaaattgcttggctattgtgcagaagatgatgaacgtggaatccaacggcttttggtttatgaatacatgcctaaccgaagtgttgaattccacttatcccctcggtcactcacagttcttacttgggacctcagactgagaatcgcccaagatgcagctcgcggattaacatacctgcatgaagaaatggagtttcaggtaatatgatgactctgctacgttactgatctcatttcactctcttgactaacttttatttattggcttttcagataatattccgcgatttcaagtcctcgaacattcttttggatgaggactggaaagcaaagctctcagatttcggtttggctcgtttaggtccatctgaaggattaacccatgtttctactgatgtaagttctgcattcacttcttttggttgcaagattgaaaaacaggtatgtttttgaacgggtttctttggctttattaggttgtaggtacaatgggttatgcagcacctgaatacattcaaaccggccgtctcacatcgaaaagcgatgtgtggggttatggagtcttcctctatgagcttatcactgggaggcgaccggtggacagaaacagacccaagggagagcagaagcttctagaatgggtgagaccttatttatctgacacaaggaagttcaagctcatattagatccaaggctggaagggaagtacccgatcaaatcggttcaaaagctagcagttgtggccaacagatgtttggttaggaactcaaaggcacgtcccaagatgagtgaggttttagagatggtgaacaaaattgtggaagcttcttcaggaaatggcagcccacagctagttccgctgaacagtgtaaaagcttcgagagacgcgagaggaaagaacaatggtggtggcggtgaaggaggttggtttggcaagttatggaatccaaagacaataagagcttgttgactgcttatagaattcaacctcttcttacagcaaaaaaaagagtcaagaaaggtttcatggagattccgaaggttgaagattctagcgagatcaagatgaagctcatatacatacataaagataattatatatgaagatttgtgaaagattctaaaatgatgaaatatgatttttgtatgaacttatgaatagtaaccacagctaaattagtaagatatgtatattaagcaagaacggcttatcagagttttgttccaaagctgatcaatctactcgtgcttaagtgtatatttgtggtaatgtgttaagagttcctattaattaccataagtaaatcacaaacataaataaaatgaaaataattatgggctttaaggtctggaggactactgaaatttgggagaagtagttggaaaaagaatattagtcgataggtaggaaattgatattgcttgtggaatggaggaaaaaattgaacgaaaaagaagtttctagaattctaatcacataacataaatagggtgaatatttgggaaaagtaaaacaataggggtcggtttgatattactagaagataagaaacaaaaaggaaaataagaataaaggaaaaaaaaagagctctcttttccaacaagaaacgtagagagatataattagagaaaatctgtgctctttcagatcccattatcacaaatccatctctctctctctctcagagaagaaaccaaagaagaagaaaaagctctcaactttcttcgatttctcagggaactctttcgttaatctcaaactcaatcatg

SEQ ID NO: 10994 - DNA, 3000 bp, Unknown; identical to SEQ ID NO: 10987
  misc_feature (1)..( 3000): cDNA_ID_2716988_gDNA_ID_2214470_Annot_ID_133063 3000 nt of promoter + ATG

SEQ ID NO: 10995 - DNA, 3000 bp, Unknown; identical to SEQ ID NO: 10986
  misc_feature (1)..( 3000): cDNA_ID_3038901_gDNA_ID_2214470_Annot_ID_133064 3000 nt of promoter + ATG

SEQ ID NO: 10996 - DNA, 3000 bp, Unknown; identical to SEQ ID NO: 10985
  misc_feature (1)..( 3000): cDNA_ID_2705162_gDNA_ID_2214470_Annot_ID_133065 3000 nt of promoter + ATG

SEQ ID NO: 10997 - DNA, 3000 bp, Unknown; identical to SEQ ID NO: 10984
  misc_feature (1)..( 3000): cDNA_ID_2716986_gDNA_ID_2214470_Annot_ID_133066 3000 nt of promoter + ATG

SEQ ID NO: 10998 - DNA, 3000 bp, Unknown; identical to SEQ ID NO: 10983
  misc_feature (1)..( 3000): cDNA_ID_2705158_gDNA_ID_2214470_Annot_ID_133069 3000 nt of promoter + ATG

SEQ ID NO: 10999 - DNA, 3000 bp, Unknown
  misc_feature (1)..( 3000): cDNA_ID_2990667_gDNA_ID_2214470_Annot_ID_182999 3000 nt of promoter + ATG
tttttccttctatcatactttttcttctttaattattttttttttttattgggtatcttattgagatacttcaaatggagatgctctaataattaatgggaatgtgtttctaattaaaaagataacatctttctttctatatttttgtcgtcatataacacacctcaactcttttaagtactcgtgttgaattttgttttttgaaaagacaaaactccttataatcaacgtaattattaataacaaggagaaaaaaagtccaaagaaaaaaaaaagaaagctttttgggaacataaacaccatcgaaggagggtgggaggtgttttatgttcatgggtggagcttcttggccaacctgaccccattcatcatatcattacccactttcttctcctaaattattctctcttatctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataacatatgggaaacattagcagcagcggtggtgaaggtagacgccgtcgacggcgaaaccatacggcggctccaccaccacctcctcctcctccttcttcttctcttcctccaccacctctacctacagaaatccaagctaatcccatcgttttcgctgccgttactccctatcctaatcctaatcctaatccggtttaccagtaccctgcttcttactaccaccatcctcccccgggagccatgcctcttccgccgtacgaccaccacctccaacatcatccaccgcatccttaccacaaccactcttgggctcccgtggcgatggccagatacccttatgctggtcacatgatggctcaaccgactccttacgttgaacaccagaaagccgtcacgattcgtaacgacgttaatctcaagaaggagtctcttaggcttgaacccgacccggataatccgggtcgctttctcgtctcctttacgtttgatgcaaccgtctccggaaggtagatttcactttctccctttcgttgatttcgtgatccatttgagcagataacacgtgaattttgttgtgttcttcctcgtgactatgtaatttggatcttcttattgcaatttgatcaaatcttcttcatgtgtaattgaattaagcttatgttattatgttggacttgtgaaaaataggattagtgtcattttctttgctaaagaatccgaagattgcaaactcacagcgacaaaggaagatatactgccacctatcactctagatttcgagaaaggacttggtcagaagtttaaacaatcatctggttctggtatagacttttcggtctttgaggacgttgagctgttcaaagcggccgcagacacagagatctatccattagcggttaaggcagaagcagctccctcaggtggtgagaatgaagaagaagaaaggtcggggtcgaagaatgcgcagattactcaagcggtttatgagaaggataaaggagagattaagattagagtggtgaagcagatactatgggttaatggaacgagatatgagttgcaggagatttatgggattgggaatacagttgagggggatgatgattcagctgatgatgctaatgatcctggtaaagaatgtgttatatgtttgtctgaaccacgagacaccactgttcttccatgtcgacatatggtaagtgaaagctgatgatttactactattatgtgatgatggacatatatatagatgttaaaaattgtttgggtttggtggtgcagtgtatgtgtagcggatgtgctaaggtattgaggtttcagacaaatcgatgccccatttgcaggcaacctgttgaaaggcttttggagataaaagttcacggtaacaacggaagcgggaataacaccggacagggagaaacagttgaacaagagtagctaaacacggccgagtatggattgaaatgccatcgaaatattagtagtatatgcatgtttgatccttgtatgttaacaacaaaatgtgtgattgtcaattcataatatagagattacgaaatcatttggagtcataatgacacaatacttgaaacattcttcattagatacaacaacaaagtaggcagtttcttacttagctagttgctcaaccggaagttgcagtggcaggtgaagccattttagttgcaataagacagaaacttaaacatggaaaacacgagatatagtagcggcaacatgacattcaattatatagctgaccccttcgtttcttatttaaaaggggcaatctccaacgttttgtggtcaaatgggcctgcatttctttttatccgcctctactattgggccctaagcccgagttttccggtttcgtaaacaataggttcatcatacttgtgtaatttcaatgttttggaaaattcggttcacagcttcgttaaaacatcaatcatctcatatctgtgactcgtagtttggttaaaaaatgatcccaaaaaagagagagacagatccaaaaaatcatctcatatctgtgtctctctctttgtttaaatttaaaatgcttgccgtagacaaaacatacaaatacgaggctgtaataaacaagtatttaatataataataaggacaaataaacggaccaaatttaggccgagaaaatgggacattgtgatataatctcaaaaagaattgaaatttgtatgatcgatcagatatctcaatttcaggaacccagaaagagggacttgtcttttacctccaaagggttcctgccgtttcttttctacaatttttctcctgctaattatcaaatttttcttctgattttcattgtttgttagagattcttcttctcctctgcttttctattctctgggagctcg

SEQ ID NO: 11000 - DNA, 3000 bp, Unknown
  misc_feature (1)..( 3000): cDNA_ID_3038923_gDNA_ID_2214470_Annot_ID_182977 3000 nt of promoter + ATG
acaaggggaatgaattgggttttaatcattgaagatatttatcgtaattaagaacaataccacaaaggggaagagcttttatcaaaagaaaagatgatgtgtgtataaaattggtaagttagtaacgtttggtgaagagcacattattttagccatgaatggaattgcgtgagtaagttaattaagaaggagatgtacgtaattatgaatttataatcacgattcacgaatattattactgcagtctggctgtatatacgtcaccgtctcattcaattataccatgttactttccgtttaagaatgaatattatatttttgcccaaagaaaaagaatgtatattatttacacaaaccagaaaacgtaagagaattaatgaattagggacgtgaagaaactagtaagcatatcaatatatcatgaagaaaaatttctgttggcgttttaaaaaaaaaagttatgcctcaaaagtcagtccaatgttttccacatgctatgctctgggcaagtatatattctttgaaccaccatcgaaataagtaataaaaatttgagataaaatatttaaaaatacttccggtgtcaggaaattgacttatataaattgtagtttataagaatttttaaaatggagttggtttaattaccacatgttgccatggattaattgattcctcctaaaactttatgttaattaccacatgcactacgaaagtacaaattaattgatatcttattacagttaaaaagccagctaatatcatcatcccagttttttccgctataagaaaattaatccgttttatactccacacaacacaacaatatccaaaacatgtttatgtcaaaaagagcaattacagaataataattacacgagagaatcaagaagagcgattgagagaattgaagaattgtatgatgctgtaatagtaatgtgaataataattagtcttttttttcttatgaaataatgaagaaaagtcattgagtacataggaatttgaccgtacgatctgaaatgtttacacgcgaagatttcgacggttgcgatgaagtaccttatgtaatcataaccattgaaacagttgacttttgttgacaaaactatcaaacatcatcgaatcaaataatgcttagaattattgattgcattgcaagaaacaagactaatgatgacccaaaaaccacgaactgtgatctgcgtcggagacatccatggaaacatatcaaagctcaataaactctggcttaatcttcaatccgatatccaaaactcagatttcagctcagctctcgtcatcttcctcggcgactactgcgatcgtggaccggagactcgaaaagtcatcgacttcttgatctctttgccggagaaacatcccgatcagacccatgtctttcttgccggaaaccacgactttgcttttgctggcttcttgggtttgttacctcgcccttcagatgggtctgagtttaaggaaacgtggaaagagtactcaaaaagtgaggagagagaaggatggtataaaggtgaagggtttgagaatatgcatctccaaagcaggagatgggcgggaaagattagggttcagttcgattattccgcatatggagtgttgtataatggatcaatatacgatgcggcgtctacttttgaatcttatggcgttcctcatggatcttctggtgacattctccattgattcttctttctggttatagtttatgattagacgtttgtctttgtcggaaactgtaaatataggtcaagtgatcgatcatgtaattggtgatcagtcaaataagtaatgattggatctttggttaaccaaaaatataattgaatctttctcgatttggagttttcatgttctcatctctgtactagtgaaattatgaaattttataactgttttgaatctattggtattggttttgaaacttgtttgttttcttttccttgatagatttgataaaggcagtacctgagagtcacaagaaattcttgaccaatatggtttgggtacataaagaggtaagggcttttctcctaccatgtgacgtttcttaggaacaaatgttgagttgttataaagcaaatactttttgtctaagaaagcataagctaaatttgtaggaaaatgtacatgtagtaatagttatcatattgttgatactattgtaggatgatgtttgtatagaaacagaggaaggccttacgcattgtaagttgattgccgtacatgctggtctagagacaaagaataacgtagaagaacagcttaaactattgagagataaagacacaagcatcccaagaatacaacctctaactggtcggaaaaccgtttgggggatcccacaggtaaaaaaaacattgaaagaaccaaactttgtattaagatcttgctctcttttgaaatctctttgtatgactttgtttgctctggaacatactctgtaggaactggatgataaaaagactattgttgttagcggccaccatgggaaacttcacatcgatggcttgagattgatcatcgatgaaggtggtggatataccgatacacctttggctgcaattgttcttccttctaagaagattatccgcgacaccgataatttttccaattaagtatatcatgtcttcatattaaaattgaaacttctagtagttttttgtgattgttctgttgttactttttaattagtgtttcggtcttttccgctacttgtataacttgataatttttttccaaaattagaaaatggtataactacttaacactgttatgaaaaaaaattttgaaacttgtaaattcttttgcatgttgttagcttatgaaccaccaacttagaaaggagataagaagaagctaagaaaaactagacgaccaaaaaaacatgttattatttcgaaataatatatatagccaaaggcccatgaagcccacaagtacattatcatcatttcaagaaacagagagagactaatg

SEQ ID NO: 11001 - DNA, 3000 bp, Unknown
  misc_feature (1)..( 3000): cDNA_ID_2724771_gDNA_ID_2214471_Annot_ID_133070 3000 nt of promoter + ATG
gtcagttcgtcgcggctcatgccttgaggaaaggaactgcaagagcccaaagccagctccaatcccctcaacagaaaatctgttgcatgcagtttctctgcaggatccaacttctgcttcctgctcaagaatcttgtatctggtctctcccatgatatacgctcctgttgccaaagaattgattagtcagaaacagataattagtcccacaagacgggtcaaaacaaaagagttacagttatataacagatgatatttcagtgattatgcttaattttgtttagacagttggcttacatggtggattttgatgttcttgagtgtgtttttagctgctgcagacaatgaagcagcccgtgcgatcaaaacctgagctgtggtgttgtctcgtgccatcatgatctccacaaacatattcaacctctcaagagcattttcagcatataatttgcaacccttactcatctgcaaaccatttaaaacccaaggtaagtattttgtgaccatctcatcgtcgtggaaaaacaaaaaaaaaactcaagactcacctgactatgagccagccttggaaacgggagaagcactgcgatgagtgaagcaatggctccaagtgctgtactgcctgccacatgaaccgggagcatgaatacatgagccacctctccattgaacaccacaaaagtcacgtagactacaacaatctgcccaaaggcaatccgtttagtcagcagactcgtggacacggggaaagccactatgaatgaagctagagccacagcaactggagccaccaagccattccctagtgaagctggtccaaccaccaagacactcactagcgcaatggctattgtctgaaaagtggcgtaagagacatcaagacagcacttgagaacttcgccgtatgttggttcagcatcggagagccagatcaagattgtggtcaggtaagaaaaggctggaaacgttgtgaagtgtcttagtggtttgggaccgtacaaagtggttaagctcacgatgagacaagccatggcggttcgcagagccaggccaagtcgctcgagccatgttgtgtcgcgcattcttttaacggattgttgttttagtggatttgtatgtaggaatacttgttagataaagatgatgagatgaaggttatggtgagcaagaagactacgtatatataaggtgtgatgggatttaaagtggcaacgtcaaagagttaagacttttgagcagctgtcttttaactccaagtactttcattttctatattgtgtagttaccaaaccaaaccagtctctgtactgcatctggttagtttcggtttaggcagtgcctcatacatcaaaggagggaagagacactgatatttcaaatagtttgggttaaattaggccatgccatatacaaatagttggaagggaaactaattttaaccgaatggattacggtttagtttggtttaggccatgcccatatatccggtttcggtttgacttacactgttctagttttggtaccaatttcaagtttgattgtgtcttcttattttccgatacttttcgtatatatcgaagaaaatgtaactggtgataaaccgaaataaaacttgaatcactttttggatacagcttggtcagattaaaccaaatgggacatctctaaaattgaggcacgtataggttggaaacgagtcaaaaccagctggtttcatactctaaaactaaaacataatggtttcaaatactaattgataaaacagtattttctacaagtttctcgagagtttaaaatgttataatttctccacgtaatcgacctttcatttctcgatttaaaatgtggtagaccgaaaaaagggtaagattaaatataggaataagacaaaagagaagaagaagaagtgatatgaaagacattagtctcatcaacagttcgagttcaagtagagatcgagagcattaatcacaagctgcacgcttcatggttagtattgtttcctcttcaccaggtaatttccatggcataatcaatttggtcctactctatcatatacttggtacttgtacacctattttatttccaatttgtggctacaaatttctgtgccacaaaaattcgtttttttttcaatagaaattttaatctgaaaatgagttccctttttttttggttgagtttctatattggttatttcattgcatttataaattattttctttgagaatgttaaagttattacatagttacgttacgtataccgtccactttgcatgcttcttccacgtattgtttggggcttattttagctatcaaaagaggaaacccaaaactctttactctctcgtcaatctctttcaattgtgtgtacaattctttgggcttattgtgaatatagctcgagcaactcaaactattcaaactcatggaccatgtcaacaactgccctgaattatcatttgtgtaaaaggcaaaaacctatgcagcatacaataaataaacacattaactttttcttgtttttcaaattttctccaagataagcccattgggcctacagctagttttgggaaaaaaaacagaaaaacgaaaaggaaaaaagctatcaatgagtcactgacggtgaacggtggaccgactcaaagccaatgagaacgcaagaaaatgttgagccaatgaccgacttttgattatggactaagccatcgaaccgaacattctcgaacctttttaaacggctttccttatttgttaaaggaaaaggaaaagtaggagaaaagaatcattcctggaccgtcagatccaactccaaaagatcgtgcggttacatagcgagccatcgaaccttctcgaaactcgagtacaagactctatatagacttctccttcgacctgatattttggaaaaaagaaaacaaacctagccgcaattcacaattcctctttcacaatctttctttcgattttttagcttaatcctgagtagcgttaacaatg

SEQ ID NO: 11002 - DNA, 3000 bp, Unknown
  misc_feature (1)..( 3000): cDNA_ID_2731368_gDNA_ID_2214471_Annot_ID_133071 3000 nt of promoter + ATG
gtcctcttcgctctctcacaggcggttctcaacctccttagagctctcgggtttccactaatgtccttcttgttcttcctcttgaactcttgaacaaagtgattcaccattctgttgtcgaaatcctcaccaccaagatgagtgtctcctgcagtcgccttcacttcaaatataccttcctcaatggtcaaaagagagacatcgaatgtaccaccaccaaggtcaaagatcaaaacgttcttctcaccaacacttgtagccttcttgtcaagaccgtaagcaatagcagctgcagtaggctcgttgatgatacgcataacattcaaaccagcaataacaccagcatccttagtagcctgacgctgagagtcattgaagtaagctggaacagtaacaacagcgttcttgatcgttgtaccaaggtaagcttcagcaatctcacgcatcttgatgagaatcatagaagagatttcttcagcagaaaactctttatcttctcccttgtagttaacgacgatcattggtttttcagcaggtccagatttgagcgtgaagggccacaatttgatgtcactttgaacagagctatcagtaaatcttcgaccaatcaacctcttcgcatctgtcacacaacaaaattgaacacaattagaccacagatactatacgaattaaaacgatgctatatgtatattttgcctaaaggctaaaattagtaacattagatcgaaaattgaatctcactagctccagcaatgttaaaacattcttatgaaaccctaaatcatcgctatggatctaccgattacagatctacttataatccaagttcgaaagacaaatttagcaagaggaaacgagtgaaacgtaccgaaaacagtgttaatcgggttcatggcgacctgattctttgcggcgtcaccaatcaaccgttcgctatcagtgaaggcgacgtaagacggtgtggttctgttaccttgatcattagcaatgatctcaacacggtcgtgttgccaaactccaacgcaagagtaagtggtaccgagatcgataccaatcgctggaccttctcctttaccagccattgttaacgctactcaggattaagctaaaaaatcgaaagaaagattgtgaaagaggaattgtgaattgcggctaggtttgttttcttttttccaaaatatcaggtcgaaggagaagtctatatagagtcttgtactcgagtttcgagaaggttcgatggctcgctatgtaaccgcacgatcttttggagttggatctgacggtccaggaatgattcttttctcctacttttccttttcctttaacaaataaggaaagccgtttaaaaaggttcgagaatgttcggttcgatggcttagtccataatcaaaagtcggtcattggctcaacattttcttgcgttctcattggctttgagtcggtccaccgttcaccgtcagtgactcattgatagcttttttccttttcgtttttctgttttttttcccaaaactagctgtaggcccaatgggcttatcttggagaaaatttgaaaaacaagaaaaagttaatgtgtttatttattgtatgctgcataggtttttgccttttacacaaatgataattcagggcagttgttgacatggtccatgagtttgaatagtttgagttgctcgagctatattcacaataagcccaaagaattgtacacacaattgaaagagattgacgagagagtaaagagttttgggtttcctcttttgatagctaaaataagccccaaacaatacgtggaagaagcatgcaaagtggacggtatacgtaacgtaactatgtaataactttaacattctcaaagaaaataatttataaatgcaatgaaataaccaatatagaaactcaaccaaaaaaaaagggaactcattttcagattaaaatttctattgaaaaaaaaacgaatttttgtggcacagaaatttgtagccacaaattggaaataaaataggtgtacaagtaccaagtatatgatagagtaggaccaaattgattatgccatggaaattacctggtgaagaggaaacaatactaaccatgaagcgtgcagcttgtgattaatgctctcgatctctacttgaactcgaactgttgatgagactaatgtctttcatatcacttcttcttcttctcttttgtcttattcctatatttaatcttacccttttttcggtctaccacattttaaatcgagaaatgaaaggtcgattacgtggagaaattataacattttaaactctcgagaaacttgtagaaaatactgttttatcaattagtatttgaaaccattatgttttagttttagagtatgaaaccagctggttttgactcgtttccaacctatacgtgcctcaattttagagatgtcccatttggtttaatctgaccaagctgtatccaaaaagtgattcaagttttatttcggtttatcaccagttacattttcttcgatatatacgaaaagtatcggaaaataagaagacacaatcaaacttgaaattggtaccaaaactagaacagtgtaagtcaaaccgaaaccggatatatgggcatggcctaaaccaaactaaaccgtaatccattcggttaaaattagtttcccttccaactatttgtatatggcatggcctaatttaacccaaactatttgaaatatcagtgtctcttccctcctttgatgtatgaggcactgcctaaaccgaaactaaccagatgcagtacagagactggtttggtttggtaactacacaatatagaaaatgaaagtacttggagttaaaagacagctgctcaaaagtcttaactctttgacgttgccactttaaatcccatcacaccttatatatacgtagtcttcttgctcaccataaccttcatctcatcatctttatctaacaagtattcctacatacaaatccactaaaacaacaatccgttaaaaga

SEQ ID NO: 11003 - DNA, 3000 bp, Unknown
  misc_feature (1)..( 3000): cDNA_ID_2714633_gDNA_ID_2214471_Annot_ID_133073 3000 nt of promoter + ATG
tagtaaaactaaaggattccattatctaacttagcaaagctataaacaattaagaatcctatacattccaaaatcgagaaatgttcaaggtaaaaacgaaatctaaagtttgtcgacaatacgtacattttagagagcttgtttggagcacctccggtgactttagcgacacggaggagagcgagctcagctttgagttccttcagctggttttgaagatcgctcttcgacttctccctcaattcgtgaaccttaatcctcgctacaaaacagaaccaaacaaatattaattagacgtaattctccgatgaaaacgaaacagattagaagacatttagggattagccattgccatacccattgtgagcttcacttgtgttcaacttctgcgccgctgcttgctcttcttttagctccgagaatcagaaaccctaataacggaggagtggtcatttatatatgacgagtctccttattgggtggtataaagctcattattcatacccaatagcttaacttaagagaaatacttaatgggccttagcccatgtattatcactttcattacgagaagcctaaagcaaataaacgcacgtgacctttatggtttcagtcacattgcatcatctaatttcatcttgtctttattatcacaatgaagcttccgcttctcaaatgacaaatactcacccaatctttgtacaaagtgttaaaatcacaaacaaaaatcaatagagagttttgaactttttcaatttccaccatacttagccaaacttattaaacaaagaagccatggaaagcctagcaaatgtagataaatagcagtagacattatcgtaagctacgatgactctccattcatttgagttcgtggtcctcgcggcagtctctctagacgggtgattccttggtataaccctagcaacatgctcaaattgcttcgcagcttcctctcccttattcatcaatgtatacacgactccttgaaacaaatatatagtgaaatcatttggatcttccttcactagctcttcacaaatccgaattgcttcaactgattttccttcaataaacctaatctgtgcgatcaacattctgaaaccgagaatctctttcgtcttcttctccttcttgcatcttcgaatcactttgttgatcctcttctctatctctgttaatttaggtttagagttgtaatactccatcaccaagtaatgataagcatcgacgcgtatcggatccttttcgagaatctcctcgaaagcttcgattgctgattcacttttcccgtggtatgagagaatccgagccttcatagccggccattttcgttcatatggctcgatctcgatcagacggtccagaaatacaatcgcctgctcatgtttatcggacttaaatttgatttccgtcagcaatgataaagcattcacatcgtttgattgtgtctcgaggtgcttctcgagtgtcgtctctaccacagcaactggagtcatcgcggcgcgtttgttgacgaagtaaaacgatgctgagaacagagctgcggctgcggtgaggctgatgaaggtggttttaagcagtgaaggtttatgatttgacgccgacgaagatgatgaagctcttatgacgggaaatctgattggtgttgactttgcttggtctctgaataaaagaggaaacgagagttttgaaggagattttcgctcgacgaggttgatctgaaggttaagttttgttctagagaattgaaacgtcgccggagacgccatttttgcttctgagaaatcccaataactaagtcaacgctgaaatggaaagagaagaacagagcagattaaagaagagcagagcaaataagttggaaatcgacgaaattttttaaaaaggatgccgtcttgtaaaaggccaaggcccattagatgagcccacgattagttcggttcctctcgtgaattcaaccgtagattatcttgtatcaacgcacgtgataacgccacgtagacgatccgtgagattgatcaaaaaccaatcatgttcgtatcagcacctctatatatatctcggtatcactcggagagcgatcattaatcgtcaatttacaactagtcgcgaaatccgaattttatccaaagcaatggcaccgaaggcagagaagaaaccgtcggagaaagcaccaaaggcagataagaagatcacgaaagaaggaggaagcgagaggaagaagaagactaagaagagcacagagacgtacaagatctacctattcaaggtgttgaaacaagttcatcctgatatcgggatctctggaaaagccatgggaatcatgaacagtttcatcaacgacaccttcgagaaaattgctctggaatcgtcgcgattggctaggtataacaagaaaccgacgatcacgtcccgggaaatccaaaccgccgtaaggctcgtgttgcctggtgaattagcgaagcacgctgtttctgagggtaccaaagccgtcaccaaattcaccagttcttagattaggttctttttttctcttcgattttattttcggttaatatgttcaccagttgatttcaaagatataattttcggcagtctcttcgatattttctatgattgattttacgttatgatgctattgaaattagggtttacaaatctttgggtataataaatacaaaattgtaaaggatctcgtttcttcctcagtttccccgggaaataaacggaaattataaatcttgagattctttaattggcccagcccaacaaacaccaatctcaatttagtctgaaccgatataaattgaaattagaaataccgtaccaaaataaaccgaaccgcaatcatcaccggtcttggaagttccaaatctctgaaacggtaggcatcgatctctctctctacagagtttgactttcactctctccgtggagcaccgctcatctttcccggagctgtagtcagtgaggtgaccggactaaatctccgccatg

SEQ ID NO: 11004 - DNA, 3000 bp, Unknown
  misc_feature (1)..( 3000): cDNA_ID_3597145_gDNA_ID_2214471_Annot_ID_133076 3000 nt of promoter + ATG
gcaaccatggagcaaaacatgaaggacacatacaatatccccagagagattgttcccaaatcctgaagtaatcaaaacaactcaaatatcacaacacacacacacagtctaacatgtcctgctcctaaattcatattcctctctcttaagatccatcaatacaaaatgacagtataatttaacggtagagcaccttatttacggtagtttcgaggttctgagcagcaccgtaagcgaggaagattagcagaaaggagatgctgaggatatgaacatcccttgtgtagcactttccagctctgactttccgatcctcaccagaggcagagatcaacggcgcctcctcgtcgtttcgagattccatggcggagatttagtccggtcacctcactgactacagctccgggaaagatgagcggtgctccacggagagagtgaaagtcaaactctgtagagagagagatcgatgcctaccgtttcagagatttggaacttccaagaccggtgatgattgcggttcggtttattttggtacggtatttctaatttcaatttatatcggttcagactaaattgagattggtgtttgttgggctgggccaattaaagaatctcaagatttataatttccgtttatttcccggggaaactgaggaagaaacgagatcctttacaattttgtatttattatacccaaagatttgtaaaccctaatttcaatagcatcataacgtaaaatcaatcatagaaaatatcgaagagactgccgaaaattatatctttgaaatcaactggtgaacatattaaccgaaaataaaatcgaagagaaaaaaagaacctaatctaagaactggtgaatttggtgacggctttggtaccctcagaaacagcgtgcttcgctaattcaccaggcaacacgagccttacggcggtttggatttcccgggacgtgatcgtcggtttcttgttatacctagccaatcgcgacgattccagagcaattttctcgaaggtgtcgttgatgaaactgttcatgattcccatggcttttccagagatcccgatatcaggatgaacttgtttcaacaccttgaataggtagatcttgtacgtctctgtgctcttcttagtcttcttcttcctctcgcttcctccttctttcgtgatcttcttatctgcctttggtgctttctccgacggtttcttctctgccttcggtgccattgctttggataaaattcggatttcgcgactagttgtaaattgacgattaatgatcgctctccgagtgataccgagatatatatagaggtgctgatacgaacatgattggtttttgatcaatctcacggatcgtctacgtggcgttatcacgtgcgttgatacaagataatctacggttgaattcacgagaggaaccgaactaatcgtgggctcatctaatgggccttggccttttacaagacggcatcctttttaaaaaatttcgtcgatttccaacttatttgctctgctcttctttaatctgctctgttcttctctttccatttcagcgttgacttagttattgggatttctcagaagcaaaaatggcgtctccggcgacgtttcaattctctagaacaaaacttaaccttcagatcaacctcgtcgagcgaaaatctccttcaaaactctcgtttcctcttttattcagagaccaagcaaagtcaacaccaatcagatttcccgtcataagagcttcatcatcttcgtcggcgtcaaatcataaaccttcactgcttaaaaccaccttcatcagcctcaccgcagccgcagctctgttctcagcatcgttttacttcgtcaacaaacgcgccgcgatgactccagttgctgtggtagagacgacactcgagaagcacctcgagacacaatcaaacgatgtgaatgctttatcattgctgacggaaatcaaatttaagtccgataaacatgagcaggcgattgtatttctggaccgtctgatcgagatcgagccatatgaacgaaaatggccggctatgaaggctcggattctctcataccacgggaaaagtgaatcagcaatcgaagctttcgaggagattctcgaaaaggatccgatacgcgtcgatgcttatcattacttggtgatggagtattacaactctaaacctaaattaacagagatagagaagaggatcaacaaagtgattcgaagatgcaagaaggagaagaagacgaaagagattctcggtttcagaatgttgatcgcacagattaggtttattgaaggaaaatcagttgaagcaattcggatttgtgaagagctagtgaaggaagatccaaatgatttcactatatatttgtttcaaggagtcgtgtatacattgatgaataagggagaggaagctgcgaagcaatttgagcatgttgctagggttataccaaggaatcacccgtctagagagactgccgcgaggaccacgaactcaaatgaatggagagtcatcgtagcttacgataatgtctactgctatttatctacatttgctaggctttccatggcttctttgtttaataagtttggctaagtatggtggaaattgaaaaagttcaaaactctctattgatttttgtttgtgattttaacactttgtacaaagattgggtgagtatttgtcatttgagaagcggaagcttcattgtgataataaagacaagatgaaattagatgatgcaatgtgactgaaaccataaaggtcacgtgcgtttatttgctttaggcttctcgtaatgaaagtgataatacatgggctaaggcccattaagtatttctcttaagttaagctattgggtatgaataatgagctttataccacccaataaggagactcgtcatatataaatgaccactcctccgttattagggtttctgattctcggagctaaaagaagagcaagcagcggcgcagaagttgaacacaagtgaagctcaca

SEQ ID NO: 11005 - DNA, 3000 bp, Unknown
  misc_feature (1)..( 3000): cDNA_ID_2714614_gDNA_ID_2214471_Annot_ID_133080 3000 nt of promoter + ATG
ctcgtcccatttctagcagatttcttcttctccttcttccttactatcctcgtcctcttcgatttcaccacataatatgtcattatactcaaaattccggtcatcgtaacagttcctatgaccgttaccacaaccgccgcgtatctatttctccgaccaaccacaatgtacgatgaggaaatgaatgccacggtggtgcagacagaagcgagccacatgagcttatttattacttccaccacacgtctctccgttttagtctctcctcttacaagcgtgatttgcacgacaactactgctaacgaagtgaagagcgcgatcgcgttgaatataaagaatatcttgaaagatgttgcatggaccataacggccacaccgtggtcgtcgtcacctcctggaaccgtgaaaatggcagcaaatgcaaccgtggcaaagagaacagccacgacggttacagagttggtcgcattgttgattccagctctgtggagtttccttagctccttggcgatcccatcgacgtttttgttggtttttcgggtttgttccagctgagtgtgaacgtctttcttgatctcggtcacggtttttctaagctcgtctcttggctggtttagttcgttggctttaagtgcaccgcaacgcgataatatctctttgatctctgccgtttcctctgaatgagtgagtccttcagcgatgtcgtatgcggttttatggtctcttgttagcgcattcacgtttgtatccggaagttgtaacagctcattcacaatctgtgaatcaaaacaagaatataagaatcaagaatcaaaaattcaataaagagcagatcaatcattacctctgctcttttctttcgtgtagcaatatgcaacacggtgttaccaaatttatcaggaagcatgacaatagccggatcagctcgaaggagcaacctcacgacttgtgagctaactcctttcacagccatatgcaaagacgtctgtcctttcttgtctgttcgtcttgctaactgcggatctttatcaagcaaggttcttacaatatctacatgaccttggcgcgcagcaaggtgaagcgcgttttttccattcgatcttgaaatctcaagcaagcttgagtctttagcaagcaattcattgacaacttctgaatgccctcgagttgcagccgacacaagtggggttgcgtttgattgagctactgttttactcaattgaggttcatgctcaagcaataactgaacaatagctgcatgaaaaaagaagctcacgtgcggttagaaagacagatttgcaaatcctttgcttcaaagaggttttggtttacatgaatcaagacttacatcgatggccttgactacaagcaatgtgtaaagcgtcaaatccagaaagattcttctgcataagagattcaatggtcgtgtaaggcaacaattccttgacaacatctatgtttcctttctctgctgctgtaaaagcggtgtctcccccagctcattcacctcgtttactacggatgtcattatttgagctacctcgtcatcaaaatcagctccggtaatggtaccagtaatctgagaatcaatgtcactaagaatctgcttaacagaagccaagtctcctctttgagcagctaggtgaagctcggtgtcgttgtgccgtcccgtgacctgtttaacatacttcttcttccccgttggatcaaaccttttccctgaattcgaaagccccaaggacttgctcgagttagacaccattaaagccttacccgaattggacagaaccagagtcttccttggggttggagttggcgacaggtccgctacagtactccctgtaggactcgttggatccgtcgccagacccttctccatacctggttccagttccttctctgcgagagtgagattgattacacaatgtttgtttgtttatcacgtaaactagagatccgttgaagaaaatgattaaaaaaaaataacaccctaagagatatttcaagacctaaccctaataacacgcattgtctaattccgcaacgaattttcgtaacgattggagtcagaaatgtaaaatgaaggagaaggagaaatcattgtaccttcttcgattctggatcccattttgagagattagaaaacagagaaatttcaaagcgggatcatgatattgtaaaaaacgacgactctccgattggagaaagatgaataagccgtcggccaccggtgccttcagtgtcacggcaagggtttgcgatctgattatttgtaggagaagcagctgaattacctttttttgggttgccttttcttcttcttcatcttcttcagttagggatgtttcccacgtcagcatttcattccgatttaaattcaccgaatactgtacatatatcttcaatatacggtttaggaaaattggaaaaaaaaacttggttagttagcaatgggctttagtttttggtttgtcaacacttgtgacgagtctcaaacatgtgtgttgggcttcattaaggatatctatacttttgaaaaattatttctaaatcatgtttaagcctttagccacatttcttaaacttctgtccaataaccaaaaaaaaaaatttgtcatatttttattttggtttgtcatttccttttaaaattaagctaagtggtgatatgaaaatgtaaattcaaaataaaaagggactctataaaaattaaagaatcttatcatgcgaaaatatctataaatttgaaatcgtcttaacaaaaagacaaacattttccaacattttattcaaataaataaaaatagatttgtgtcggcaacaaaaaaaaatgaaaaagtttttttttttccgacaaaaaaagaacaatattctggcacagttccaacaaagctaccatcaatatggttcagttgaaacaaagagcaattatatcccaaaaatacaaaaactgaaactgtccgaaattgaattcaacatttgttatataaattagatatg

SEQ ID NO: 11006 - DNA, 3000 bp, Unknown
  misc_feature (1)..( 3000): cDNA_ID_2714610_gDNA_ID_2214471_Annot_ID_133081 3000 nt of promoter + ATG
aacgtgacttgtgtccgctcctattaacatagttttgttgtggttcatgaaatggcatctgaaatatttgtttgaaacataaaaacatgaacacaatgggtagtcatagtatatgtaatctgtaaaaaaaatcatgtttaaaacgatttttagaatatcttttcaatacaaacatagactcaaaacaatataagatttaacttacttagtaccataaaagatttaagagacaaaccttgagacagtgatgtcagtgctttctcgtgtgatatcaatcaaaccatcatagtaattcttgagactacaccgatcaatccaaatattgtgcgattttggtttgatctgaatagcgtctgcgtctggtcccacaccgccttcaaattcaagattgcagattataacgttttcacactcttttagccttaacccttttcccgttatcttcactttttgtcctctcccgtccaccgttgtgtgcgatgatacgttgacaaacgaagacagattgatcgttcccgatacatcgaacacgatccataaaggttctggcctcttgcaagcctctcgcaacgatcctggaccctcgtctgcacataagattattcgtttttatatgaactaagactcgaaccgcacaacatcgtactgccactcaattttaatatgaatttgaaaccagaggtgtccaaatttgactaaaccgacccaatgcttagacatcaatatggtggatatcagaattactttggcgtaaatgagtaagaatattttaaaaagacgtaagcagctctgatccaatgataatttcatttacattaccaatttgaacatggttaggatatcagccaccattttttcttaagatatatgcaagcaaaattcagaatccaacaaatggttaatttgcttttttttttttaccacagaaaaacaaattacgttgcttttaagattttttttttttgtttttaaattactttggaagttttgttcctatttggagtatttggctgacatatcacttgatcatattttttttctatttggagtaacaaaacagagaactacaaattaaataaaaaaaatatataaatccaagaatttgagggataaatgaaggaaaaaggggacttttgaaatttaccagctaaagaagtgacgtggcaaatcggaccatttagaccaccaacggcggcgcggccgaaaccttcggcctttccggcgagagagcggaggctggagtctacgtggcaataaggtcccactgtcatgtggtgatcggatggcgatgacggagctggagctggagctggagcggctgtatatggtggtgggaaaggtgaattgggagcttcgccgggaaaattagaaccgccgtgatgggatctgtgaatgccatgtaagtttcccatatctaatttatataacaaatgttgaattcaatttcggacagtttcagtttttgtatttttgggatataattgctctttgtttcaactgaaccatattgatggtagctttgttggaactgtgccagaatattgttctttttttgtcggaaaaaaaaaaactttttcatttttttttgttgccgacacaaatctatttttatttatttgaataaaatgttggaaaatgtttgtctttttgttaagacgatttcaaatttatagatattttcgcatgataagattctttaatttttatagagtccctttttattttgaatttacattttcatatcaccacttagcttaattttaaaaggaaatgacaaaccaaaataaaaatatgacaaatttttttttttggttattggacagaagtttaagaaatgtggctaaaggcttaaacatgatttagaaataatttttcaaaagtatagatatccttaatgaagcccaacacacatgtttgagactcgtcacaagtgttgacaaaccaaaaactaaagcccattgctaactaaccaagtttttttttccaattttcctaaaccgtatattgaagatatatgtacagtattcggtgaatttaaatcggaatgaaatgctgacgtgggaaacatccctaactgaagaagatgaagaagaagaaaaggcaacccaaaaaaaggtaattcagctgcttctcctacaaataatcagatcgcaaacccttgccgtgacactgaaggcaccggtggccgacggcttattcatctttctccaatcggagagtcgtcgttttttacaatatcatgatcccgctttgaaatttctctgttttctaatctctcaaaatgggatccagaatcgaagaaggtacaatgatttctccttctccttcattttacatttctgactccaatcgttacgaaaattcgttgcggaattagacaatgcgtgttattagggttaggtcttgaaatatctcttagggtgttatttttttttaatcattttcttcaacggatctctagtttacgtgataaacaaacaaacattgtgtaatcaatctcactctcgcagagaaggaactggaaccaggtatggagaagggtctggcgacggatccaacgagtcctacagggagtactgtagcggacctgtcgccaactccaaccccaaggaagactctggttctgtccaattcgggtaaggctttaatggtgtctaactcgagcaagtccttggggctttcgaattcagggaaaaggtttgatccaacggggaagaagaagtatgttaaacaggtcacgggacggcacaacgacaccgagcttcacctagctgctcaaagaggagacttggcttctgttaagcagattcttagtgacattgattctcagattactggtaccattaccggagctgattttgatgacgaggtagctcaaataatgacatccgtagtaaacgaggtgaatgagctgggggagacaccgcttttacagcagcagagaaaggaaacatagatgttgtcaaggaattgttgccttacacgaccattgaatctctt

SEQ ID NO: 11007 - DNA, 3000 bp, Unknown
  misc_feature (1)..( 3000): cDNA_ID_2714606_gDNA_ID_2214471_Annot_ID_133082 3000 nt of promoter + ATG
ctgcgattgtcttcagcgcaaacactacaatcctcgtaaagtacaaatacccgatgacaacaatgtagaattgtctaaacagagtcaatttcgccaagttcctagccgctttcccatcggttttcgaagtctctcttagcgaacgtatcgaccaaacaatagggaataagatcgcacaacagcaaactatatctacaagcaagaatatctgattccaagtaacccaatctttgataaaaggtccagtctctccaatcacaatggaagcaatgttagcgagaacctgaagtggaacaacaaccatcaacacattcttctctttctcttgtaagaatggcttcaagaaggaccagccagttccaatcaacacaatcacagtgaagagaagaacaacacgaataaactggaaaatgtagaataaaacatcccagccatgaggagtaccggtgactttcacgtaatgcttatcctcggcggcgcagatcagattcaaagccttcattaaaagcagagccgccataagaacatggatcctatgaacaacacgtttattgacccaacaagcatatccccagagaccaaggaaagctaagtaaccgagggagaagaagaaatacaatccgggtaatcgggttgacccggcaggaaggtaatccttagacccgttcggatctaaattgtacatctccgttcgaaccttcatcgaaattttggtttccggtacgcaattcacgaagaagagagagtattcgttcggagacatcaccggatacaagtgctcgtatttggaaccagggggaggagagagatcgtgaaatgtgaagagatggaggacgtaattggaatcgagtacacagaagttggggttttgctcgatctctaagactacctggagaagcgattcctctgacataaggaagaaccctaacctcgatggatccgggatcggatcagacgaagaagatactactgctacagaggaaatagagacgctaacatggccggactgagtgaatccgaacttttcgaagagaatcatcggcctagaatcgtcggagattgtgagagatttgatctccgccgccgtgcgagtgatgcaacttgcggagaagaggaggaggacgacgaagaggggtagtctcgtcatattcgcgccgtaactgtagaggtgagaaacaacgatgcttctcgtgatttctggtttcgttttaagcttaagcttgaaggaagaaacgagaatggcgttttgaccagatttaatgctgaggaaacgaaacgacgccgtctctcatacggaaaattctggcagcccgtaatggttgatttgactcgaatttaaacaaagcccattgggcctaatttgatagagttggaagtcaaaacttaatatgaaagagaacggtttggtaacagtacatggtaagagaatgtgtaacacgtgcggtgtcacctgtcttcttctctcacatatctgtagccatttaatattccgcttaagagaaaacaaaaacctgttcatatattaaaatatgactgtgctgttatatttttatatgcgaaaaagggcttagcgtattaaatttatcggagcgaccaacgtgaatcggtaacattaatggaaaatgatttgacttagaagaaaacgagttaggtgagaacgtagcaacataggacacttgtgaacgatgcttattttcaaatttttacatttttataaagagattgaacacaataaattggctaactaaataaacaaattgattttgcgtatagacaaagaatataccagatatgctattgtgtggatcactaatattcccacgagtccacgactatcccattttctttttctctattttatgaacatttatttaatagattaatttcacttatgtctttaccaagactatatttcaattttttataaaactattttctcatttatcatcaagaagtgaaaaaaataatagatttaaacgttgttttaaaaagtagatttaaacaaaaaaaaggtggaaacttaatttttgtggtcaaaaatatattaattcagcatatttgttttcttttgtgtaaaatcaagcatattctttcgcaggttttaatatggaaataccaaaagtaccctcttagagaagcaataattacgacaaaagtcgaagagagacccttctcgtaattctccctcctcccttcacagagtcatctcatcatcttatataagcaattacagtctcttaagttcatggcggatttaatttgttctggttatccaaaacaaccatctttttcctctttcttataaatctctcccaccggtagcggtaaaatacaatcgtcgaagcaaagacaaatcctttttgactttcattaaaaattccgagaatctttttatcaacccaatattttttttttatcccccgagagagaaatttcaatgaaattcttagtataggatacaattcattaaaatccatttcattttcaatagtaatctcgattactgattcgtcgtttcttccgccgtgttttgatttttctcggattctccgctcagagttcctaatctgtgtaagttgatttcgattttccgactctgagatttttaaatgtttggttcgtgggctatcatcgtatctcgttgtatctttccaacaatttgaaagctgtttgatttttcttctttgggttgtgttagttcagaaactgttaaagttgcatgcttgaaattgggaaaatggttggatacttgtgtaatcggaacattacgaatggtttttttttgtatctgattgatttgattttcctccttatgagttttttgtttttagtctctcacatgttattgttctctaattttggcttgttgttgggttgttttgtttcacctgtaggctggaattaacctgtctaagaaactaaactttctctagtttctagatttttgtatatgattaggacagtaaaagttgaagactttctcaaagatttgatgaaatg

SEQ ID NO: 11008 - DNA, 3000 bp, Unknown
  misc_feature (1)..( 3000): cDNA_ID_2990667_gDNA_ID_2214471_Annot_ID_183042 3000 nt of promoter + ATG
ttccttctatcatactttttcttctttaattattttttttttttattgggtatcttattgagatacttcaaatggagatgctctaataattaatgggaatgtgtttctaattaaaaagataacatctttctttctatatttttgtcgtcatataacacacctcaactcttttaagtactcgtgttgaattttgttttttgaaaagacaaaactccttataatcaacgtaattattaataacaaggagaaaaaaagtccaaagaaaaaaaaaagaaagctttttgggaacataaacaccatcgaaggagggtgggaggtgttttatgttcatgggtggagcttcttggccaacctgaccccattcatcatatcattacccactttcttctcctaaattattctctcttatctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataacatatgggaaacattagcagcagcggtggtgaaggtagacgccgtcgacggcgaaaccatacggcggctccaccaccacctcctcctcctccttcttcttctcttcctccaccacctctacctacagaaatccaagctaatcccatcgttttcgctgccgttactccctatcctaatcctaatcctaatccggtttaccagtaccctgcttcttactaccaccatcctcccccgggagccatgcctcttccgccgtacgaccaccacctccaacatcatccaccgcatccttaccacaaccactcttgggctcccgtggcgatggccagatacccttatgctggtcacatgatggctcaaccgactccttacgttgaacaccagaaagccgtcacgattcgtaacgacgttaatctcaagaaggagtctcttaggcttgaacccgacccggataatccgggtcgctttctcgtctcctttacgtttgatgcaaccgtctccggaaggtagatttcactttctccctttcgttgatttcgtgatccatttgagcagataacacgtgaattttgttgtgttcttcctcgtgactatgtaatttggatcttcttattgcaatttgatcaaatcttcttcatgtgtaattgaattaagcttatgttattatgttggacttgtgaaaaataggattagtgtcattttctttgctaaagaatccgaagattgcaaactcacagcgacaaaggaagatatactgccacctatcactctagatttcgagaaaggacttggtcagaagtttaaacaatcatctggttctggtatagacttttcggtctttgaggacgttgagctgttcaaagcggccgcagacacagagatctatccattagcggttaaggcagaagcagctccctcaggtggtgagaatgaagaagaagaaaggtcggggtcgaagaatgcgcagattactcaagcggtttatgagaaggataaaggagagattaagattagagtggtgaagcagatactatgggttaatggaacgagatatgagttgcaggagatttatgggattgggaatacagttgagggggatgatgattcagctgatgatgctaatgatcctggtaaagaatgtgttatatgtttgtctgaaccacgagacaccactgttcttccatgtcgacatatggtaagtgaaagctgatgatttactactattatgtgatgatggacatatatatagatgttaaaaattgtttgggtttggtggtgcagtgtatgtgtagcggatgtgctaaggtattgaggtttcagacaaatcgatgccccatttgcaggcaacctgttgaaaggcttttggagataaaagttcacggtaacaacggaagcgggaataacaccggacagggagaaacagttgaacaagagtagctaaacacggccgagtatggattgaaatgccatcgaaatattagtagtatatgcatgtttgatccttgtatgttaacaacaaaatgtgtgattgtcaattcataatatagagattacgaaatcatttggagtcataatgacacaatacttgaaacattcttcattagatacaacaacaaagtaggcagtttcttacttagctagttgctcaaccggaagttgcagtggcaggtgaagccattttagttgcaataagacagaaacttaaacatggaaaacacgagatatagtagcggcaacatgacattcaattatatagctgaccccttcgtttcttatttaaaaggggcaatctccaacgttttgtggtcaaatgggcctgcatttctttttatccgcctctactattgggccctaagcccgagttttccggtttcgtaaacaataggttcatcatacttgtgtaatttcaatgttttggaaaattcggttcacagcttcgttaaaacatcaatcatctcatatctgtgactcgtagtttggttaaaaaatgatcccaaaaaagagagagacagatccaaaaaatcatctcatatctgtgtctctctctttgtttaaatttaaaatgcttgccgtagacaaaacatacaaatacgaggctgtaataaacaagtatttaatataataataaggacaaataaacggaccaaatttaggccgagaaaatgggacattgtgatataatctcaaaaagaattgaaatttgtatgatcgatcagatatctcaatttcaggaacccagaaagagggacttgtcttttacctccaaagggttcctgccgtttcttttctacaatttttctcctgctaattatcaaatttttcttctgattttcattgtttgttagagattcttcttctcctctgcttttctattctctgggagctcgatg

SEQ ID NO: 11009 - DNA, 3000 bp, Unknown
  misc_feature (1)..( 3000): cDNA_ID_1381941_gDNA_ID_2214471_Annot_ID_183040 3000 nt of promoter + ATG
aattgcaaaaaaacaatcagtttcatattttgtcttctaatgaaattatctcagtaaagcttatagattgtcaactcaagaaaatatcatgcatgctacatcgaaaacatcaaaaaactaatgagtaacggagtcatacaagttctagtccagcagagtgagttatcatcaaaggataatcccgacaacatataacaaaagctactcgccaggaacttggacgccttgcttcatcttctctttcttcatcttcttcttagaaacgggtttcttcttcctcggaggtaaattcttctgtgcgtatgtgtaaaggatgaagtttcctacaaggaatgtcagtagcaaccctcctattacaagaaggacgatcagtcccgggtttagccctttgctttcgatttttccctgttcattgtgttcttattagtaacatatattgaaatctagatgcaagaagaaacaagaagatttgagaaatataatatatgaaacttgaaaggacagaacacaaggtatactaactagcttctcaatcttattggcccgtaagacagaacacaaggtatactaactaccaaagaccattactgcaagagtttggttaagtgacagattactgcagattaactaacactgacaagcacgaatatcatgaaacgaataccacaagttataatatccatagattgtacaatttgggaatgtataaaccatcatattcgttattcaccatgaaccttaaactctgaaacagccaaaaatgaaaaaacttgacattccatggcaagatcaagatgaaagtgatgaagttaaccaaagtcctcaaactcaaaatgtatgaaattctaaagaaaaaacaaaactttaccgatccaattgtgctaggtcctaacccatgctaaatttcagagaatttgatcatccatcgttaagaagcgttacaacaatcatacacgtattgaccaaaatgctcgaacataaacaaaaaaagctcgcaatcgcaaatcttaaaccggaacatcatgcatcaaaaccagaagatcagactcaagcaacacataagattacgagccacgcgtgaaagagtagcaaacgattgtaggaaagcagaattgagacagagtcaaacgcagatctagcgattcatcgtgagtaacgaaaaatttgatctcagacaaggaaacacaggtagacaaagagagatattcagagaggggacagaacttacatcaaattctgcggccatggcggcgtttcggagctacgaggttatcagcaccgctcgccggagaaaatatagacagcttgaagacgagttttgccaagaaaagactcatagccataagtaacagcaaggttggtcaatggggttactttgcaaattataaactataggatttgtttctatcttcgattttggcatgcattttacttctacaactgatcaaccccgcttgacaattgaaatttatttctctttgattttggcaaatcattttaattgtagtactaagtaccaaccaatcctacttgacaaatgaatatttttaaatgtattttcaacccttttaatttggtatattttaaaaaaactttatattatcaattcaaatttgaatgatatcgtttggttaaaataaaataaaatttaatgtgatattagactactagtaaaacgaaaatatagcaaaataataaaatggttgacccatttggaataaacatttttatggttaaataattgaaaatatgcaaaatgataacaaatcaattatacaattcaataaaattattatatcatagaaataatttattctcaaacaaaacaaaaaattctcatatgcaattattaaattagagatttttcatcaaaagtaaatacttgtaaatataattcaagatccaccttgtttcaaaatgcatttgaaataccatctcaaaatatttgtatgactttgaactgttattcacttgatctattaaaacggacacatatgttttcactataatacacaattcataagtcttcaacattacttaaaaatcgtctttcataactttacttaatattgtttttggaaactttttttgtgtgatgttttttactttaataatcgattgatttgtttagtttataagaatgttttttgtgatgttttaagttttcaaaaacaacatggaagacaggaatactaactttatagtgaattcggtgttggtcccgaccccttcaccatggtcatgttcaaaccggattttgcaagactagatatggatactaatattgataatgacacaatttctctaatgatctacatcctcgtggaaatcttgttttttaaaataataatgaaaaattatttatcaaatgcttataatcgtttcattcttttggattcaatgccattaaaaatcattcgacaatttctttttggtaacttcttgatgtcatactacataatcatagttgatgagtttgtacaaaacttgaatagtttgatatcgttattagaagtaacacatgtaacaatcttggagatataaaaatgaatataaaaagtgtattttgtaaaatatttttaagattattattgtgacgaaattatttttgtataaaaaggtttagaatttgatagatagcgttaatatcataaaacgcaaagtattatattattgatcacaccattagagtgagtaaatacatatttgaaagaaaaaattaagaatgttcagactaaaaagaaaaggaaaaatgttttggcttccggataaatgttggggtcaatattaaagaaataaaaggtgtgggtgctgatacggaaattagtttacaggctgtaatttttctttcaggctctctctctttcgtcgccgaaccagttccagaaaggctgtagcgattcaaaatttcacaaattaaagtcttcttcctctccgaatcagagattgtctccttcttagctcagatctgggagcttcttgtgatagatttggaagaag

SEQ ID NO: 11010 - DNA, 3000 bp, Unknown
  misc_feature (1)..( 3000): cDNA_ID_3034487_gDNA_ID_2214471_Annot_ID_183036 3000 nt of promoter + ATG
gttgtttaaacatggatacatgatgactccataggccttttcatcccaatgatctgctttcttgcctcgtgatcagttttgttatgttggctccatgagactgagagatcctgattcaggtcctcttcatgctcatcatctgtagaaacatcaagaaatgttttacgctgtgagagactgcttgtctttgcataatctaaagtttgatcaccgccaaaagaaatgcaagcaagcaaatgatttggaacgtttctttagttcagttcttgtcaatgagaaaaattcacaatgagatttcaattgcacctgaacggtccaagagaggaaactctgttaggcgtctaacgcagaccttaagtgcttgaagctcagcttccttctcttggagtttggactgagtagtttgtagttcagcttcaagctcattgatctgtccttcttgttgttcgatgagaaggtggcttagtttcttgtccagctctgatgccgatattccaccacattggtatgactcagctccattaaccaaatccttacattcctccataacatcacttgtctaaggggaaaacaaaataaaagatgaatataagcttcagccattgaacccacccaacagcataatgaattgttggaaaaacaatccagatgaaattcaccttaatagatttgagaggagactctaggaatatatgtcaatggaaaaagataaaagcacactcacctcagccaagttcaatttctgcagctcagattcaagttccatctctaattgttccatttctactgcctcttgttctggctcctcagttaggacgctgctagcatattctccatcattgcctgacttgatatcgagagatactctactcaccatctctgatctattgagatctatctggccagatttctcagaacttgctgcacagccacgaaacttgaaaccctgtaaagatttaatcctagagagttcatcttttagctcttggatgactttggtagtttcttctgttgctgcatgcagcttactgatttcacctttctctgctgacatcatatacatcatgcagacacccagtgctgagctgaaagaggaatgatctgaaacacagaagaatgaagcttcaataatggacaatgccaacaggaatatgaagagtcattgttttactgaaagaagtccaacaaggtacaatcaaacctcaaagcagttaatcaccataacattgaacccataaataaggcttattagatgaagcatttatggggacttaatagatgcagtaagcgaattagcacttggaaaacacatagataaggcttattctactctatagaagcataggcaataagtgattcccctcttatccaaccactataaccacaaagtctcttgcactcctacaaaatctagaggtctgaagatttaccgatcaaagagtactttttatcactcaaatctcaagaagtctaggaagcaaaacctaacgccattatatatcattctataacacaagatccctgaaagcttttccccaagattaacaccactatatatcattctataccacaaggtccaaaactagaaaaactcagcacacgatccaatcatcaaataagacaagttcagaacactccaaaaactaacttaagatccaaatttcccatcatgcaagtgataacaacctcactacagatatgtcttcatcaaccgagattccattcatacttcattttcaaaccgagaatgacagaagaaatcaatcagagttctcgaaagagtataagcaaaaccttgattactataacatgacccacgttttgaagcagaagcagcacccaaagttttcgtctttttcgagcaaacctcactcttcatttcaaaagcaccaacatttccagatcgcttctcgatctcacatcccccactattctttttcttcttcttcttcatcaatccacgaaccctaactctacatttcacccctgaactcttcctaaacccaggagaagacccggatcctgatcctgagttaacggtagacccggaactagaaaatcggaaaacgccattggttttgtcgcaaggagaatcgagaaatccaatgctcacaggaggagtgactggttcctgctcttcagcgtaattctcgggagtaggagaatctcgagagaaagggttgaataagcgtttggctacaaaaccagtggatccagcaatggctgctcctagaataacttgccacatctctaacaattcgtaaacgataaaccaaaagtggagttaagtctgaagtgtttaaatccgacggaaacagagtcggagaaagtcccgatgtgtcagagacagagagagagaagaagaagaagtgagatttttttgtttttcagcggcggtgggtcacaccatcacatgtttcccgcttttacacacaaatttccaaatttattggtttcttaccaaacctatcagatctaatttaggctttttgttttatttgggctttaataggcccatttatttaacatctttaatgtattgctcttataggcttttagcaactccaattttaatattggtgttcaagtaaatgactgtaatacccttaaaattatatgaaatcaaccaaaacaccaaaccctaattgtaaaacccaaaatctgcaagagtctctctggttcttcgattcttctcggtatctattcgccgtcgtcagtgtcatcgccggcgtttttaatttcgtctctattgttaccattattgctgccttttcctctcctccggaaacgctctctttctctatttaggtacgacttagttgtaatatcttctcttggtaattttctctactgctctgtttcttctctttggcgttctccctttttttttctgctctaatcgaatagtactcagcttaaatttattttctgatgttttcagtctatgttgatatgattccattgccttgtattgagagttttatggttacttgacagatg

SEQ ID NO: 11011 - DNA, 3000 bp, Unknown
  misc_feature (1)..( 3000): cDNA_ID_2714666_gDNA_ID_2214471_Annot_ID_183035 3000 nt of promoter + ATG
aaagaaacttattaaaggaagcaatttccacattagattgatgactaaaccccttgtcaaaacagctgacttctcaaagctgtggtgtgatgttctcatatcaacgccgatgcggttgaaaagagcaatcaaggctaaaaagattgacttaagcaagtaagtcaatatcatatgttagaatataaacattgtatttctatttgtgttgtgcccatattcatctttatctctgttgaatacagggtcgagtaccttgtccttgatgaatctgacaagctgtttgagcagagcttgttaaagcagatagattgtgtggttaaggcttgttcaaatccttcgatcatacgttcattgttcagtgctactttgcccgattctgttgaagaacttgcacgttccataatgcatgatgctgttcgtgttatcattggccgaaagtaagtatagaaaacatgatagtatgatactgaagcttattatagatacttcacaacatattttgaagcaaaatgatcttaccttttactattcaatatagaaacacagcatctgaaaccgtcaagcaaaagctggtttttgctggaagtgaagaagggaaacttcttgctcttcgccaaagctttgcagaggtaagttcacttatcttaacagtatgatcaagttagtccaataccttttgtaattccttttctacttggcagtagagtctgaatccaccggtactgatctttgtacaaagcaaagaacgagcaaaagaactctatgatgaactgaaatgtgaaaacatcagagccggagtcatccattccgatctccctccgggagaggtaaaatcatctttcatgtagtcatcaaataaagtttgctcctctatggaaagtatagagatatataaattgatatgaaacaatttaccattggatgctgcagcgggaaaatgcagttgatcaattcagagcgggagaaaaatgggttttgatagccactgatgtgattgccagaggtatggatttcaaaggcatcaactgcgtgataaactatgatttcccggattcagcttctgcatacatccacaggattggtacgcatattattattactagagcctttgtatctaaatcttatattctctgttctatgagagtcatttttgatgatgagttgatgtatttggcctcttttaatacatttcaggacggtctgggagagcgggaaggagcggagaagcgataactttctacacggaacaagatgtgcctttcctaaggaacatagccaacacaatgatgtcatcaggctgtgaggttccatcgtggatcatgtctttgaagaagaagaaatggaggaagcataggccgagacgtgattctatatctactaaaccaaaagccgataaaaacgatacagatgagtaacctcaaattttgtcttttatatttcttgttgttgttacattgatgaattagtcttggtcttttggatccaaaacactttacactggctagaatcgggaatctagtagaatcgaacttagttgtcacttggatcgtactacgaaatacatatgtaactcaaacctagttactattcgattgtgagacttccggtttttcatgtcggattcaatgatttcttaagatgcattataccataagttttggtttggtataactttaagagcgatgtatattatttgggttgggtttaatcaaaccggttttctccgaattggataatacttaagttcttgcttagctggggcatcactccaaataattattggaattaaagagtaataaatatcaatgatcttctttgttaaaataaacgaatcatgacaaccaaatattagctcaaagttaagaaggaaagagaaaaaacaaaacaattgattacatatttttctaattttacaaaatttgggacaataaaatctatcaaacaatcttaatatcatttgttcataagaaacaaaaaaaattagattggaccgacggagagagagaatgatccaaaactctgactaacaaaacacaagacgtgtgcattatgtatatgtcttttctagataatcaattccattttgaggttattaactaatatacaaaacaatacttatgatttacatctcatataaataaataagtttatgcacatattaagatttctaagaaattatatattgaagcataccacaacgaccacatgtattatggtacattaaaaaaaacaatcatggtgtagatacacgattttcatgattaaaaaaccaaaaaaattgaatctattattgagtgaactcgtacgttccacttccaattgtttaagttcacaaaaaaaatcaagattgacctagtttacaaaatcttagggttatattttcagcatttcaataatgattaaatcatggtaatgagtaattaagcatcattaagagatttaaaaccaattaatctcattagctgcggaagctgttagttaagagcaaaaaaaaagcgccaagctgttaaaagaggaaatcaaagtagggcccacaaaaaaagcagcccaattagtgggctcacacacacacagagacagagacaaatactctctctgctccaaattcctctctctctctctctctgagttcttctcaagtcaggaaagatcaaaacttcgacccattcaaattctcatttccaaggaagtctcacattggcattaaaaggaacttaaaaggcgtgtttttgatggtttaaagttcagtttcgagcttctcttcttcaagatctgcttttacaggttcgattcctcttctatctcccgtttccaggctaaagaaggttcctttctattcaattcaactgttttgacttttgggtttgatcaaagaatttagctattatatttgtgacatcagagaatctgttgcaatccgtgattttggaaattttttatcatctgaaccaacatttttcatctgagtaggaggatcaaacatagaacggcgacgagatg

SEQ ID NO: 11012 - DNA, 3000 bp, Unknown
  misc_feature (1)..( 3000): cDNA_ID_2714670_gDNA_ID_2214471_Annot_ID_183033 3000 nt of promoter + ATG
aatgagtaattggtaagaatataatttgattactcattcaaaagtagatgtcaatctaacttacattttcttcaatgtagttcaaacaaccatcattggggacaaaggcagcaatctttttaccattcttgatcaactgaactctagcacacttacggatagcagagttaggctgcttagcctcaataccactgcataatcaaacacagagtctcatcaaagtcaagatctatactactaacaaaatcaagaaatggtaaatatatatgtttatacaaacttacattttctcaagaacgattcctttagcgtgagaagaacaagcaaaaggcttcttccactcgttgcctcgattagacttcttgtaatgcttgtccgcccacctctgagtaatccgaagctgcttaagcttgcgaccagctcccataccacgtgtcttactgaagatattcaaatagaagataaaagaaattgagaaccaaaggacatttcatcagatgaaatcaactcactcagaacatataaaacaaattcggagttgataaagaacataaagttataatctaaatcacaaatacttaacacaagaggagagtgtagtaaggaaaaaaatcaaaaatcataatcataatttccacatttcagaccaaataactccaacgtttataagaaaaaactacgaattatagcaacttcgtagcttcaacagggtgattaacaaagtattactacacgacgtatgaatgtcattcaaatcccttaattcaaccatcccgacccgagataacgaaaacggcaaggcaccaaagagaaaccggaataaacaaaaaaaacataaaacaaatcctaaacccgacataacaaaaacacgatcacttataagcggagagatgagactgaaacataaagagtctaagagaggataccgtaccccatgttgacgacggcgcgagtgaaaaagtcgagagatgagctgaaactgctaaaggcgcgacgttttaagttcgtgagagattgaaaaaccctagtgataagaaaataggtatatataggcttgggtcaagactcgtgagagccctggtttaggcattaaccggtctgcaatgaaattgattaaacggcaaatgattatttttatatttgggcttaacaagaaggcccatcacatgtcaacccaaatattatgccaactccttaaggtaataatacgggaaaaatgtcgttttatacgtgaactttaaaaaatggccatttaatacgaaaatttttgtgtggccaaataaaacataataaaaacgttgaccggccgtttcacacaaatattattgttgactacgccaaagtctccatgccgttatctttcattaacggatccgttaattccgttaacacatgttaattagtttccgtcaatactcaaaacgacgtcgttttattgaaatcaaaaaatcaaaattcctaaaattgatttcaaaatctctaaattccaaaaaaacaaatccttaattcctaaattccaaaaatcaaatccctaaattctaaaaaccaaatccctaacagcctcttattttcagcaattggtcgtcgtaatagtcatcgtcgtaaagatcctcaagagagctaaagaagggccttcgctttgatgtttcctccttgttcatcatcgatcttgttcctcccccttcgtgaattcaaacgaacaactgctgtcaatagtcgaatgttattattcatattcaaattggttctcatgtgtgtgtgttcgtaacattttattcacaagacaacaaaacaaaaacagggaaacttccaacatgatgaaataagattatgagagtgagaaaagaaccttggacaacgggattgagattcctaaagaagaacatgatgttgccatgtgaagcagatggattgaagaaaaatgaattggattccattttggaatttagggattttgaaatcaatttgggaattttgattttttgatttcaatgaaatgacgtcgttttgagtattacaggaaactaattaacgtgtggtaacggaattaacgtatccgttagaaaaagataacggtatggggattttggcctggtcaacaataacatttgtgtgaaacgaccggtcaacatttttattatgttttatttggccacacaaaaaattcacgtattaaatggtcactttttgaaagtttacgtataaaacgacatttttcccgtaataccgtatacgctgcattgaaacattccagtcctagtcacgtgcacggtgcacctactagcccacgactcccacactatccgccacgtcagaaaacgaaaccggttgtagcaggtaaaaggcacacaaagctaagcataaggaagcgcgcgacacgcaccggttcagccggtactctgcgtcgataaacgacatgcaagaccgtccattttcttaaaaaagcgatcttgatctgacggtccttatttgtttattcaaccggtaaaatacaaaaaaatcaggaaaaggatcgtggatcgtcaatggcggactggagtaaatttctttgacaataaccagtcctaaatcaaggtagaatattgcaaaaatgttcaatggaagaagatagattggtgaccatgattatcaacgacgtctaagctgtttctgcgtcatttggtaagtgaagcttttgtctctttcgatttctctaatgcaaaaaaaaagggagaaagattttgattcgttattgaaattattctctttgagttattttaattagaaagaagtaatttttatatatatttgtcaagaaaaaaagtgagcttgaagttcacgcttgtaaaggtgtcagttttgcagctcattatcgccatgttcttctctctcgcgctctttgtgttttcttctctttgctcataagaacccactttaatgtatgttcaggtcttcttcttcttcgtcttgttgctctgaagagttggtcctgacttgggatttagggatttcgttttgata

SEQ ID NO: 11013 - DNA, 3000 bp, Unknown
  misc_feature (1)..( 3000): cDNA_ID_1377843_gDNA_ID_2214471_Annot_ID_183032 3000 nt of promoter + ATG
ataatatacctgtgagagctaggaggaagacgaagaaaatcacaggccaagcatgaacaggatcacgatcctcaggcaagtactcgttaaggaagctaagcttcttcgaaaccttagcagctggtttccggagcttccttacaacgaaagagtcgtcggtcaccaccatctgctgcacaacgtctttgcatccgattgcgagatccataagcatttctccccaagacttcataaaccccgtcacttgatctttcaaactctccactgattcggatccagaacccgactcgaaacccgaactctttgacctcgattcagtatccgccgtcaaatcaatcggagatccgtcgtattgtaaacctccgtccatgagactagctaactcgtcttgccacgtaggcactcctcttcgcatctcctccattatcaaaacgaaatccctaaatcccaagtcaggaccaactcttcagagcaacaagacgaagaagaagaagacctgaacatacattaaagtgggttcttatgagcaaagagaagaaaacacaaagagcgcgagagagaagaacatggcgataatgagctgcaaaactgacacctttacaagcgtgaacttcaagctcactttttttcttgacaaatatatataaaaattacttctttctaattaaaataactcaaagagaataatttcaataacgaatcaaaatctttctccctttttttttgcattagagaaatcgaaagagacaaaagcttcacttaccaaatgacgcagaaacagcttagacgtcgttgataatcatggtcaccaatctatcttcttccattgaacatttttgcaatattctaccttgatttaggactggttattgtcaaagaaatttactccagtccgccattgacgatccacgatccttttcctgatttttttgtattttaccggttgaataaacaaataaggaccgtcagatcaagatcgcttttttaagaaaatggacggtcttgcatgtcgtttatcgacgcagagtaccggctgaaccggtgcgtgtcgcgcgcttccttatgcttagctttgtgtgccttttacctgctacaaccggtttcgttttctgacgtggcggatagtgtgggagtcgtgggctagtaggtgcaccgtgcacgtgactaggactggaatgtttcaatgcagcgtatacggtattacgggaaaaatgtcgttttatacgtaaactttcaaaaagtgaccatttaatacgtgaattttttgtgtggccaaataaaacataataaaaatgttgaccggtcgtttcacacaaatgttattgttgaccaggccaaaatccccataccgttatctttttctaacggatacgttaattccgttaccacacgttaattagtttcctgtaatactcaaaacgacgtcatttcattgaaatcaaaaaatcaaaattcccaaattgatttcaaaatccctaaattccaaaatggaatccaattcatttttcttcaatccatctgcttcacatggcaacatcatgttcttctttaggaatctcaatcccgttgtccaaggttcttttctcactctcataatcttatttcatcatgttggaagtttccctgtttttgttttgttgtcttgtgaataaaatgttacgaacacacacacatgagaaccaatttgaatatgaataataacattcgactattgacagcagttgttcgtttgaattcacgaagggggaggaacaagatcgatgatgaacaaggaggaaacatcaaagcgaaggcccttctttagctctcttgaggatctttacgacgatgactattacgacgaccaattgctgaaaataagaggctgttagggatttggtttttagaatttagggatttgatttttggaatttaggaattaaggatttgtttttttggaatttagagattttgaaatcaattttaggaattttgattttttgatttcaataaaacgacgtcgttttgagtattgacggaaactaattaacatgtgttaacggaattaacggatccgttaatgaaagataacggcatggagactttggcgtagtcaacaataatatttgtgtgaaacggccggtcaacgtttttattatgttttatttggccacacaaaaattttcgtattaaatggccattttttaaagttcacgtataaaacgacatttttcccgtattattaccttaaggagttggcataatatttgggttgacatgtgatgggccttcttgttaagcccaaatataaaaataatcatttgccgtttaatcaatttcattgcagaccggttaatgcctaaaccagggctctcacgagtcttgacccaagcctatatatacctattttcttatcactagggtttttcaatctctcacgaacttaaaacgtcgcgcctttagcagtttcagctcatctctcgactttttcactcgcgccgtcgtcaacatggggtacggtatcctctcttagactctttatgtttcagtctcatctctccgcttataagtgatcgtgtttttgttatgtcgggtttaggatttgttttatgttttttttgtttattccggtttctctttggtgccttgccgttttcgttatctcgggtcgggatggttgaattaagggatttgaatgacattcatacgtcgtgtagtaatactttgttaatcaccctgttgaagctacgaagttgctataattcgtagttttttcttataaacgttggagttatttggtctgaaatgtggaaattatgattatgatttttgatttttttccttactacactctcctcttgtgttaagtatttgtgatttagattataactttatgttctttatcaactccgaatttgttttatatgttctgagtgagttgatttcatctgatgaaatgtcctttggttctcaatttcttttatcttctatttgaatatcttcagtaagacacgtggtatg

SEQ ID NO: 11014 - DNA, 3000 bp, Unknown
  misc_feature (1)..( 3000): cDNA_ID_3034495_gDNA_ID_2214471_Annot_ID_183028 3000 nt of promoter + ATG
agcaaattttcactctttaacgctccatttcgtacattactttgatcatttttctttttatctatttttttcgtcgaccgttttctttgacgatgtttgttatatgattctaaaagcatccacaatggtagactcttagcaaaactcttaacaaatatttaaaaaattatataatttaaatattagataaatctcttaaatttggtaaaacttaggtcaattgtctcttagttaagagacaaatagtcgggttttattaggcccactagttcgttaaaggctaaagcagtgcccggttcttatagcggaggtaactttaaatattgggcccttactgaaaggtaaattagttgggtttattgggctttattataaggcccactaattcagcagtaaccctaacgaaaccctagcatatattagttcttaaacttcagctgagagaaaaccctaatttctcaaagagtctaaagagacggagagtgagagaagagagaaacatttcgagacaaatggccgccgccgctgctcgtcctctcgtcaccatccaaaccttggatggtgacatgtccaccgatcaatcctccaccgtcgtacttcccgacgtcatgacggcgccagttcgaccagacatcgttaacttcgttcacgcccaaatctccaacaacagccgtcagccatacgccgtatcgaagaaggccggtcaccagacctccgccgagtcctggggaaccggacgtgccgtgtctcgtatccctcgtgttcccggtggtggtactcaccgtgctggtcaagctgcgttcggtaacatgtgtcgtggtggtcgtatgttcgctccaaccaagatctggcgccgctggcaccgtcgtgtcaatgtcaacatgaagcgtcacgcaatcgtctcagctatcgctgcaactgctgttcctgcgcttgtgatggctcgtggtcacaagatcgagaatgttcctgagatgcctcttgttgtgagtgactccgccgaagctgtggagaagacctcagctgcgatcaaggttttgaaacagatcggtgcttatgatgatgctgagaaggcaaagaacagcattggaatccgtcctggtaaaggtaaaatgaggaaccgtcgttacatttctaggaaaggtcctctggtggtttatggaactgaaggatctaagatagttaaggcgtttagaaaccttcctggtgttgagctttgtcatgtggagaggcttaatttgttgaagcttgctcctggtggtcaccttggtcggtttgtgatctggaccaagtctgcctttgagaagcttgagtctatctatggttcgtttgagaagccatcagagaagaagaaggggtatgtgcttcctcgtgcaaagatggtgaatgctgatcttgccaggattatcaattcagatgagattcagagtgttgtgaatccgatcaagaaggatgcgaagagggctgttcttaagaagaatccattgaagaatctcaatgtgatgttgaagttgaatccttatgctaagaccgcgaagaggatgtcactgttagctgaagcacagagagttaaggctaagaaggagaagctcgccaagaagaggaaaaccgttaccaaggtaatctcaatacttgacttgttctcttatcaaccgtttttggattgtctttgtttagttactgattacattttgatctgtggttgcatttcatttgacttaacttatattgcaattgttctaattgactgagtttgtgtatgttaagctatacaataatctgttcccctctggtttagtctatgactatagtagtctttctttactagatcttaccttttctgttctgaattgtggtctagtagtttgtcttgtaaatctgttgtgtacgattctttgtcttgatattgattttaggttgagctattaagcaattgaatctcttagcactttcttgtcccttgtgaaaattgttcttcatatgtcctcttttctaactccactttgaaatatctatttttcttacatcaggaggaggcgttggcaatcaaagcagcaggcaagtcgtggtacaagactatgatctccgacagtgattacaccgagtttgataacttcaccaaatggctcggtgctagccagtaataatctcgtctgctttggaacactttccatattttagtcaaaagattttggtttttttaatctgttttgtctttgggtgtctggatatcaagttgaattatgaacaagtttcacttttttacatctccatttcttacttcgcctttatcagtttcatttatttatctcttgctccttcgtttcctatgatgatgcttgttatgttatgaacctacttaaaaacaagctgaagctttctttggtttaccccagcagaaacattaatcaagttcaattgatcaatatgtcgattgatttactgtttaaaggcatagtgtgtctatcaacccttaagtctttttggtggatagtgaagctcaaacccaattcaaatgtcgatcaaccctaacgtttttgtgctcgatagtaaagcatgagtataaaaagaacgtcgcttcttcctacaatcacacagatcatttgaagctttgattagttggtacaacatactcgaggaatacagaatgacacgtggtgtgtatctgttggataaatttgtattattcttctttactatggatggtttctggaaggcgcgccaagagtccttctttttccatctacaaatcatgaccgtccatctccaaaagaagactgaaacagtgaaactagaagcttcattttgatcatcagccagttttataaattgatccgtatactaaagtaacaactactagcactttcttctgtgatcgatcattgtgtttaaactaaaggtttgtatgttcttgtaatcttattgatctcgataggttctccattctctttaggttttaaagccttcaacgatttccagaaggaagcgaatttgaaaaaa

SEQ ID NO: 11015 - DNA, 3000 bp, Unknown
  misc_feature (1)..( 3000): cDNA_ID_4262542_gDNA_ID_2214471_Annot_ID_183027 3000 nt of promoter + ATG
caacgggaggctgatctttgatatgcctcaacataggcaaaacaaagccaagggttttacctgacccggttttggcaaccccaatgcagtctctaccgctcatgatgattggaagtgcttgtgcttggataggcattggcttttcatagttaagcttcttcagagtatccaaaattttgctagttaatccagtctggtgccaaaattgaatgggtcttggaacatctttcccatgaactttcagctccaattcctttctataagcgttcactgcatcctgtgtcatccttgagatatccttgacttcgatataaaaattcttccggaaaggttcatactctattttggagtggtcaacaagagacaatttctctgcttttgtcttcttaactctcttcataaactcctcgtcgtcttcgtctaaacttggatcatcatcactctttggttctgagtaatctgaatcagaatcttcaccttgaattatcctaccaagggcggccttattaaaaccttttttggcttggtcaccagtttccttcccattcattttaaaatccaaaataccatcgatcacaatattgctaagcttttcaacctcaggtaataccatagtattcataaaagcatctaagggatcaatttcgtcttcatctgcagctctgtcacctccattctcagagacagtaacagctgtctcattctccgaggcgaccatcttggcatctccaccattttcgagtttagtatcacgatcaacatccatctctgagtctgatttaacttcatcatcagattcaccatcaagagtccaagccttaccggtctcaggacccttactttcaatttgagcttcctcgttttgcctcttcaactcttgccactcctggactcttctcctccgtttttctacttcctcagccaactgcttctgctcatcctctacttgttcatcccgagttttcttctcaacatcgtcatctccatgcctgctacgctccgttcttttgcgtttcaagccacacttgacatcatcactctcttcattacaatcctcacgtgacctctcctttttctgtttcttcctacccttttctttctcacgttctctcctctctctgtcccttttcagatattttcctctatctctgtcacgttctcggcgtcctcttcccttgtcctcccctctgcgtttactatccctctcgtattcttcttcttcaaaatcgctactttttctatccctccgtatccgtatcctctcctcttcctcagaatcgcatctcttaactctcgagcgcatctccgtcgtatctcgccgaccattctctttcttactgcgatcacgatctttgcgatcattttccttcctggacttagatttctctaacatcatctcaaacgcaacaaatcccgatagaaaattccgtaacttaaacccaaattcaaatcaaattcatccgccaaacaaaagcttcaacgataaccctaaaaatgttgcggtgaagaagacaaagctaccagaagaatcaaaactctctacaccgtaacgttgtaacgtctcgttagtgtcgagtaacagagataataaagctgtaaggttgggcccttattggtaaaagataaaagtgaaaaccagttattgggctatttgggctttagttaggtccactattaatcgatattttcctcatgggcttctaaacaacatcgcaaggttattctattcaaaataattattcatttcgttgatttcatctcatgaatgatttcctattatttatagttcattccccaaaccactcgcatcacaggcgcgttgagcacgtgaggctaaaatccatggactatataaccttcctttttggggattttttgcataaattaaaaactgagaggacctgcagcgcgtgggttgggatttcatttgttgtgactacaattttttttttttttcccccaaaggtctttctgtttattgactttttatcataagataaaacgttacaaaatgggttaaacctatctaggtgattacaaaatttcaaaaattgaaactaaaaaggcctaaccccaataaaaggatatcaaacccaacttgaagagaggcattgaaagctaaaaggactggaccaaaaacccaaacgactacagtattcacatgaaaatataaccaaacgaaaagaactattaccgtgttttatcttttgctcagattatggtccgaaaatattgttatcgattcttgatttagattaaaaatgagataaaactgtaaagattttctgaatattttgaggtgtgcattttaatagaaaacgaagccgatagtgaatacaccgagtttgataacttcaccaaatgactcggtggcagtgctaatcagtaatatctcacctgcttaggagcacttccatatttaggaaaagaatatgatttgaaatattttgccattcaagatcgagactaaagattatttgaactataaagcaaattttcactctttaacgctccatttcgtacattactttgatcatttttctttttatctatttttttcgtcgaccgttttctttgacgatgtttgttatatgattctaaaagcatccacaatggtagactcttagcaaaactcttaacaaatatttaaaaaattatataatttaaatattagataaatctcttaaatttggtaaaacttaggtcaattgtctcttagttaagagacaaatagtcgggttttattaggcccactagttcgttaaaggctaaagcagtgcccggttcttatagcggaggtaactttaaatattgggcccttactgaaaggtaaattagttgggtttattgggctttattataaggcccactaattcagcagtaaccctaacgaaaccctagcatatattagttcttaaacttcagctgagagaaaaccctaatttctcaaagagtctaaagagacggagagtgagagaagagagaaacatttcgagacaa

SEQ ID NO: 11016 - DNA, 1314 bp, Unknown
  misc_feature (1)..( 1314): cDNA_ID_3034470_gDNA_ID_2214471_Annot_ID_183046 3000 nt of promoter + ATG
caagaactattggttctaggatctacttcagtaccaacaaactgttcgtcccaatcaataaccacatcagcggcagtaaacacctggatcagcataaagggaaaacattttcagaaccatcagctataaactaaaaaaaacaaactttatgattcaaatctctcccttgacacgtctcaaaaagtattcagacattatggttcctaagagtatccagaatctataacaaaatttatatggtaacataaattacacaacaccaaagtagattgaaaaaagggacctgcttgacagattcagcgatttcgggaccgatcccatcaccgggaaagagagtagctttgatcggagtggaggaggagaagaaagccctagaaacggaaatgaacggaccggagctagaactcgaagtcccgagaatctggctcgatccgttaccgataagccgtctcgcgagaaatgctgtcatggtcatcgcttccagcctcagaaggacgcagagagagaaagagaggaaagaggagactttttgctgcgttggacctgaaaaagtttacttttataccttctctagctccagcagagaagcagagaacatttcgatttccatgaaataaaacggcacakagttagtgtctgaaaataagaaacggcatcagcctatgttcttaaacggccatggtcaaatgaaccggatatcaataaattataaaaaccggtcagatgaaattaagcattcagatcccgataagcagtgtgacactgaaacagcgaaaggagctctctctcactccgaggcgatttcttctgtctcgacgatcttgcgcttttcacatttgaatcctccaatccattacttcttctccgatcttttattccggtgatcctttggattatgattatcgagatccattgctgcctatttgagtcttgaatcatttgtttgcgttctcatctgtgcttagttatgtgattctccgataagatttagttatgtgattaatgcatgtatgtatcaatccgaattttggtgattcgttgtctattattaaatacgtcaatctccatttgtaatccctggttgaaataatagctatcttgtcatggagatcatcaacattacatttactacactacacacataatgtcacatatgatcttagtatatgtactcttttgtaccagtgactagaacaactgtgagtgtgggttgaagtttttaatatcttgttaaaatcgaaagtttttgactcagatactacttggttttgtttttgtcactgtttcaggtacatctcaagtcttacaacaatg

SEQ ID NO: 11017 - DNA, 3000 bp, Unknown
  misc_feature (1)..( 3000): cDNA_ID_2705158_gDNA_ID_2214471_Annot_ID_183043 3000 nt of promoter + ATG
tttttttaatgagtgttattattcttttatttatgaattctggtgaaattgtataatcaaaaatatacattcaagatttgagaaaataattttcaatgagaggaaacattatccaaaaacattaattgtgattaattacactttgctcagctaaaattttcaaagttggtttatgaatctttgaaactaaagaggtgctacttcaattgttctgttagctgtttatatgaattaaaggagaaaattaatatatgaacagattatttttatttagtgtttttatatataaccatttttaacaaaatatttagctaattagttcatgcacacattttgtctactatatatgcagtgttagatgaacaaattcgttttatgtagtgattgtgtttaaccattttcaactaacatttagctacttaattcatccacacaatttgtcagactacataattcacatgacatttactgctctgtaatagtattaaaggaaacaaatatgaaaataacctactagtaattcttttgacaatatagagcttttcttagtcataaaacagcttttgtttcaaaattggaaacgatctctctttttgggatcttacacaaagtacacatgtacgaaattcctcattgatacatcattcctcattacgaaccacacaattagatctaacatatatatatttgttccactcaaatacaaatcttgttagggtaacatcacctctgaggaaacgacaaaatgaagttaatgaaagtatttggctttagatggattcgtagatagtacgtgacacgttgctgatatgcggacttcagataaattatcggctagtatcataaagataatgtaagggtctaagcatactcactaattaacgaaatatcttcttagaaacacctgagctcgatctatttcaatcatagtgactcaaacctaagaaaatctttgacatatgtatattacattagtgttccaagaagatgctacgttcgacgtcatatttgttatcctgtaaattataacaaagatgcatcaacattcaacagagaacaaagtttagtttttatatatatatatatgtcacgatcataggtctacataactataaattgatacaattgattttacagattttacacaacatatgtatccaacttgatgatatatccggtctgccgtttcccactatatatagagtattttataattgattcccatttatttttcttagtttatatatgttcgtcttttggaattgcttaatgaaagtgtgtgcgagtggttaggtatgcgattctattatgtctctttatttatttttgatttcgaatcgcaccactaccttcgtatgggaatgtttcaatatgatatctatctgtatatgatcacgaatataatttgattttgatcaaaatcaacatgtaatataatttcacgtaatatcaaacatccaatagttacagtttaatctggctactgaatatatatatatatatatatatatatcttcctttgaaagaatgtttatatatttttattctttgtgacgttttttttagctaatggtgatctcttgactctaaattcatacaaattttttaaaaaattagcttagggttttgaaaatataaaaactcttttagggcttatgttttctttttggtcaacggagcttatgcttttgtagaaacactaatttttaagacattaaagtatacatcagttttgttttgtgttttgggttaaacttatacacaattattcaaagacgacaaaacaagtttaaatatgaattccaaaataccagttcatcttttcggactactgtatataagaatattatgttggcaaaaagtaggtttattataggttaaaaataaaaataaagtatagcctactttgttaggaatacatattaaacttcacactaattactagtagatatttaggcaatataagtctagaagcggaaagtagacaatgcctattgcctagtatacatttcggacagcacaagtgacttttaactctttaatcacacagaagacagaactatgcaatgatcgacaacttcttcactctgtaaaatatttggatttctcaattaatggtttctgaaaataacatcatctttttaaagcatgaacaaattaatcctaatgtagacctaaataaaaatcttaagaccatctttatcagtaaaaacaaggaaagattctaaaaaaaaataaaaataatattttaattaaaacagatacattaattattatttaataattgaattaatagtatgatgacacttgtccaaattggatgagaatagtttctcaaagtttctcggaagagaaattcaactctccttctcttctacttttttttccttctatcatactttttcttctttaattattttttttttttattgggtatcttattgagatacttcaaatggagatgctctaataattaatgggaatgtgtttctaattaaaaagataacatctttctttctatatttttgtcgtcatataacacacctcaactcttttaagtactcgtgttgaattttgttttttgaaaagacaaaactccttataatcaacgtaattattaataacaaggagaaaaaaagtccaaagaaaaaaaaaagaaagctttttgggaacataaacaccatcgaaggagggtgggaggtgttttatgttcatgggtggagcttcttggccaacctgaccccattcatcatatcattacccactttcttctcctaaattattctctcttatctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataacatatg

SEQ ID NO: 11018 - DNA, 3000 bp, Unknown
  misc_feature (1)..( 3000): cDNA_ID_3034498_gDNA_ID_2214471_Annot_ID_183026 3000 nt of promoter + ATG
atcaagacaaagaatcgtacacaacagatttacaagacaaactactagaccacaattcagaacagaaaaggtaagatctagtaaagaaagactactatagtcatagactaaaccagaggggaacagattattgtatagcttaacatacacaaactcagtcaattagaacaattgcaatataagttaagtcaaatgaaatgcaaccacagatcaaaatgtaatcagtaactaaacaaagacaatccaaaaacggttgataagagaacaagtcaagtattgagattaccttggtaacggttttcctcttcttggcgagcttctccttcttagccttaactctctgtgcttcagctaacagtgacatcctcttcgcggtcttagcataaggattcaacttcaacatcacattgagattcttcaatggattcttcttaagaacagccctcttcgcatccttcttgatcggattcacaacactctgaatctcatctgaattgataatcctggcaagatcagcattcaccatctttgcacgaggaagcacataccccttcttcttctctgatggcttctcaaacgaaccatagatagactcaagcttctcaaaggcagacttggtccagatcacaaaccgaccaaggtgaccaccaggagcaagcttcaacaaattaagcctctccacatgacaaagctcaacaccaggaaggtttctaaacgccttaactatcttagatccttcagttccataaaccaccagaggacctttcctagaaatgtaacgacggttcctcattttacctttaccaggacggattccaatgctgttctttgccttctcagcatcatcataagcaccgatctgtttcaaaaccttgatcgcagctgaggtcttctccacagcttcggcggagtcactcacaacaagaggcatctcaggaacattctcgatcttgtgaccacgagccatcacaagcgcaggaacagcagttgcagcgatagctgagacgattgcgtgacgcttcatgttgacattgacacgacggtgccagcggcgccagatcttggttggagcgaacatacgaccaccacgacacatgttaccgaacgcagcttgaccagcacggtgagtaccaccaccgggaacacgagggatacgagacacggcacgtccggttccccaggactcggcggaggtctggtgaccggccttcttcgatacggcgtatggctgacggctgttgttggagatttgggcgtgaacgaagttaacgatgtctggtcgaactggcgccgtcatgacgtcgggaagtacgacggtggaggattgatcggtggacatgtcaccatccaaggtttggatggtgacgagaggacgagcagcggcggcggccatttgtctcgaaatgtttctctcttctctcactctccgtctctttagactctttgagaaattagggttttctctcagctgaagtttaagaactaatatatgctagggtttcgttagggttactgctgaattagtgggccttataataaagcccaataaacccaactaatttacctttcagtaagggcccaatatttaaagttacctccgctataagaaccgggcactgctttagcctttaacgaactagtgggcctaataaaacccgactatttgtctcttaactaagagacaattgacctaagttttaccaaatttaagagatttatctaatatttaaattatataattttttaaatatttgttaagagttttgctaagagtctaccattgtggatgcttttagaatcatataacaaacatcgtcaaagaaaacggtcgacgaaaaaaatagataaaaagaaaaatgatcaaagtaatgtacgaaatggagcgttaaagagtgaaaatttgctttatagttcaaataatctttagtctcgatcttgaatggcaaaatatttcaaatcatattcttttcctaaatatggaagtgctcctaagcaggtgagatattactgattagcactgccaccgagtcatttggtgaagttatcaaactcggtgtattcactatcggcttcgttttctattaaaatgcacacctcaaaatattcagaaaatctttacagttttatctcatttttaatctaaatcaagaatcgataacaatattttcggaccataatctgagcaaaagataaaacacggtaatagttcttttcgtttggttatattttcatgtgaatactgtagtcgtttgggtttttggtccagtccttttagctttcaatgcctctcttcaagttgggtttgatatccttttattggggttaggcctttttagtttcaatttttgaaattttgtaatcacctagataggtttaacccattttgtaacgttttatcttatgataaaaagtcaataaacagaaagacctttgggggaaaaaaaaaaaaaattgtagtcacaacaaatgaaatcccaacccacgcgctgcaggtcctctcagtttttaatttatgcaaaaaatccccaaaaaggaaggttatatagtccatggattttagcctcacgtgctcaacgcgcctgtgatgcgagtggtttggggaatgaactataaataataggaaatcattcatgagatgaaatcaacgaaatgaataattattttgaatagaataaccttgcgatgttgtttagaagcccatgaggaaaatatcgattaatagtggacctaactaaagcccaaatagcccaataactggttttcacttttatcttttaccaataagggcccaaccttacagctttattatctctgttactcgacactaacgagacgttacaacgttacggtgtagagagttttgattcttctggtagctttgtcttcttcaccgcaacatttttagggttatcgttgaagcttttgtttggcggatgaatttgatttgaatttgggtttaagttacggaattttctatcgggatttgttgcgtttgagatg

SEQ ID NO: 11019 - DNA, 3000 bp, Unknown
  misc_feature (1)..( 3000): cDNA_ID_3034502_gDNA_ID_2214471_Annot_ID_183025 3000 nt of promoter + ATG
cgatcttacggaggagatcaatggtgggaacttcatcggcggcagtcaatatctcttcgtctgacttgattagaaccctagctctcgtcaaagcgataagccctttgtcaacgacggatccgatcggattcgcgagagatgccaccgaatcccaaaaatgtcggagaggatcagcgacggtgtgaaatttaccgccgtaaaacaccttagctccggcgtagaatctctgcagatccagtgcttcataatctagaagctttttagcttcggggtacgcggtgatgaaaatctgaaatcctctgtcgagaaagaagccgtcgacgatatctgtacggacgcgtccgccgacgccatcggaagcttcgaggagtaggaaagggattcgtttggaggtgagctggtttgcggcggctaaaccagcgagtccagcgccgatgatgatgacgccagtttgattcttccgaatgtacggatcttccgtggaagattgagctccggaaaagcgttgatatcggtgatttgcatggccgcggcggcgagggaagaaatgagaagtagatgaggttgggagagagatcgccacgggcattttaaaagtttggataaggtttttctcattcctttactttattttccccgggaaaattatttgtctagaaaaaataatatatatatattcaaataattatttaaaagattcgaataagtcttgttttcttgattcttttccttattaatctgaacaaaaacaaattatgaagaccagagtcctagtcccagagaggaccgttgtcctagagacggatacagcccaagagacgaccttagtcctgcggaagatgaagaccaatgaagagtaggaagactggtgattgcttataggccgtctattttggcttataatgattttaaataagtgtaatggattttgttgcttaatacttcgtctgctatcttgttttaaatatttaagaaaataaaacgactttcgggattgtctttttctttctgttccatgtcttcttaactgctatgagtaaaagagctctcccagactcttcttctatctccaaaagcttttatttttgtttgtttattttggtactgataatatctgagtatatatataatatagtagaaacaatgagcaaaagtcaatatgtccgagtggttaaggagattgactcgaaatcaattgggctttgcccgcgcaggttcgaatcctgctgttgacggaattgtttttctttttagcttttgttgggttgtgaaaagtataacaaccttaataatttcgtttttttaatctaaaaatatacggtagttttctcatcatcaccaataagaattgtttgatatgaaacaacagaatcaggaaaatttgttaaaatgtcagaaaatggaaaaatctctaactgaacaaaagtaacaaaaaaaactcccttagaaacagaggaatcatgatgagagacaaaattatacagagacgtggagatgtctgtaacgttgtctcatccatcatcatgtcttcttcttctcttccttctcttttccggtcatccctccgtcctcggaacctccatccccgacgcggtgaacacggcggcgcgtttggtaaacagagcgagaagagcaaaactgtcgagagaatttctacaagcgcacaacgatgcacgtgtttcttcaggcgtgccaacgctcggatgggacagagacctggcccgattcgctgataaatgggctaaacaacgtaagtccgattgcagtatgatacattcaggtgggccttacggtgagaacattttctggcaccggcgtaagaagacgtggtcgccggagaaagtggtgacgagatggtttgaggaaaggtttaactacgacgtgaaaacaaacacgtgcgcaccgggaaagatgtgcggccattacacgcagatggtgtggagagagaccacagccgttggatgcgcacgtgtgaaatgccataacggtcgtggctatcttgtggtgtgtgaatatgatccacgcgggaattacgaaggtgaaagaccattttgatcaaaacagttaaaatgaaaaaattgttagagattcaaaatattttttcttcttctaatgtaatgaagatggtatattattcttggtccttacatatatacagccatgtattgaagaggtataaattcaaatggttcggaatcttttaattttatatattaaagatcaataataaaaaaaaacgtcgacagcagggttcgaacctgcgcgggcgaagcccaatagatttcaagtctatctccttaaccactcggacatatcgacttgttgtatttgtttcgtaagatttgaatacaaaaccgaattctctgttgcctaaatcggagcttttcatcccttgactctctaagacatctgaagcagctaaagtgttggatgtttcacataacgacatgggcggcaagcacccagtggacacaacaaggtacctttgttcttggccgccctctaattcgggtgaaattggaagagaggtgcttggtatatactaggatgcgtatttggtgcttagagatttgatgaaactgaagcagttagatattagagacaacgacctaatatttgcaggtgaagagttcagctcttttgtccgccaggtttttccaaagcttgtatggcttgatggccacaaactcgcaagttaaagataaatgttaggccacttgttttaattaaagtataaaactctttcgtttttttggattcattttcatgaaatcaaaagactacaagtctacacgtgcttcaagcttgaggctctaaatgaagtggtaggaaagaatgaaataataataaaaaaagtcagaaaaatggatggtctgagatcaaagtgaaacctactccacatacacatcccaacttcttccccgccatgtggacttttctttttcctactttctctctctgcattctctcttacacctgtctttatctgaaaaataaccg

SEQ ID NO: 11020 - DNA, 3000 bp, Unknown
  misc_feature (1)..( 3000): cDNA_ID_2990750_gDNA_ID_2214471_Annot_ID_183022 3000 nt of promoter + ATG
aaactacaaagctactaaccatagttcagaccaacaaaaaatgaagttccttactctgatctgtatcgggttctccttcgtcgacactagaagtcacacccactgaaactacagtcttcctgtcctcgttatccttatcaacttcctccctcgttgaatctatagagactctctcagaatcctggtcttccgattctataatcccaccttcctggttgttaatcaagatggcagtttctgcagatattcgtggctgttcatccttacattctgaatcagcattagaatcaacggatatactggattcctggttgttaaacaagatggcagtttctgcagatgtttgttcatccttacattctgaatcagcattagaatcaacggatattctggatccttcggttgttttcacttcttctattgttatttgggttgtagaagattcaaaactatcaacaagagtatctattgattcaatagtaacttcatcttcacttctatcattttccataatggtgcgaagtggaaactcaccttcttttagattccgatcctcaaaagtaggacctggttcctcagacttcacattctcactagttttggtcagctctgactgctccagacagctcccaagaagatctctttcagcatcatgagaatctttttcggcattatcacgagaatgggaatccaaatcattacgctcatcattaatggcatctactttatcagatgcaatattagcagtatcagatgactcctccactttgtcgatatattcagtatcccacggagtctctgatgaagcaaactcagtattaccttcacaaaactcagtcccatcaccaggggccaaatgaaactgaggagtatttaaccgtaaattctcagcctcctgctcagcaactgacacaggggctgttagtatatgtccatcaatactgaccaaaaccacttcagaatctgagccttgagaatccccataactttccacatttagattgtcaaatcgagcacttccatattctgaggttggcgaaggaggatcatcctgaaaatcataaaacctcctattacaatcagactctgtcctctcaagccgactcaaagggtcgaaaccctctcgtaattctccagtaccagagtccgataaactgtgctcaagtcgataagtaacaccgttattctgattaccattgttattctcagacccggaaatcaaattgttggtgtcattagctgcaggatcaacttccctgatgaaatatgcttcaccagaattatcaagatacatgtgaaaatcagcttcggttccattaacagaaatcctgacaaacttctcagcgcctttgagaacaccttggaacttaccaaacctaacataccaaggcgtgctacggaaagaaccatcttgttgttgaacaacgatgacatcaatagcaccaccaaagggatgaaatggtgtcgctacagagtaaaccccttgagaaatcaaactcccaactcttccaaccaaactcatttcatcaaatctttgagaaagtcttcaacttttactgtcctaatcatatacaaaaatctagaaactagagaaagtttagtttcttagacaggttaattccagcctacaggtgaaacaaaacaacccaacaacaagccaaaattagagaacaataacatgtgagagactaaaaacaaaaaactcataaggaggaaaatcaaatcaatcagatacaaaaaaaaaccattcgtaatgttccgattacacaagtatccaaccattttcccaatttcaagcatgcaactttaacagtttctgaactaacacaacccaaagaagaaaaatcaaacagctttcaaattgttggaaagatacaacgagatacgatgatagcccacgaaccaaacatttaaaaatctcagagtcggaaaatcgaaatcaacttacacagattaggaactctgagcggagaatccgagaaaaatcaaaacacggcggaagaaacgacgaatcagtaatcgagattactattgaaaatgaaatggattttaatgaattgtatcctatactaagaatttcattgaaatttctctctcgggggataaaaaaaaaatattgggttgataaaaagattctcggaatttttaatgaaagtcaaaaaggatttgtctttgcttcgacgattgtattttaccgctaccggtgggagagatttataagaaagaggaaaaagatggttgttttggataaccagaacaaattaaatccgccatgaacttaagagactgtaattgcttatataagatgatgagatgactctgtgaagggaggagggagaattacgagaagggtctctcttcgacttttgtcgtaattattgcttctctaagagggtacttttggtatttccatattaaaacctgcgaaagaatatgcttgattttacacaaaagaaaacaaatatgctgaattaatatatttttgaccacaaaaattaagtttccaccttttttttgtttaaatctactttttaaaacaacgtttaaatctattatttttttcacttcttgatgataaatgagaaaatagttttataaaaaattgaaatatagtcttggtaaagacataagtgaaattaatctattaaataaatgttcataaaatagagaaaaagaaaatgggatagtcgtggactcgtgggaatattagtgatccacacaatagcatatctggtatattctttgtctatacgcaaaatcaatttgtttatttagttagccaatttattgtgttcaatctctttataaaaatgtaaaaatttgaaaataagcatcgttcacaagtgtcctatgttgctacgttctcacctaactcgttttcttctaagtcaaatcattttccattaatgttaccgattcacgttggtcgctccgataaatttaatacgctaagccctttttcgcatataaaaatataacagcacagtcatattttaatat

SEQ ID NO: 11021 - DNA, 3000 bp, Unknown; identical to SEQ ID NO: 11007
  misc_feature (1)..( 3000): cDNA_ID_3034507_gDNA_ID_2214471_Annot_ID_183021 3000 nt of promoter + ATG

SEQ ID NO: 11022 - DNA, 3000 bp, Unknown; identical to SEQ ID NO: 11005
  misc_feature (1)..( 3000): cDNA_ID_2714614_gDNA_ID_2214471_Annot_ID_183019 3000 nt of promoter + ATG

SEQ ID NO: 11023 - DNA, 3000 bp, Unknown; identical to SEQ ID NO: 11004
  misc_feature (1)..( 3000): cDNA_ID_3597145_gDNA_ID_2214471_Annot_ID_183015 3000 nt of promoter + ATG

SEQ ID NO: 11024 - DNA, 3000 bp, Unknown; identical to SEQ ID NO: 11003
  misc_feature (1)..( 3000): cDNA_ID_3034514_gDNA_ID_2214471_Annot_ID_183012 3000 nt of promoter + ATG

SEQ ID NO: 11025 - DNA, 3000 bp, Unknown
  misc_feature (1)..( 3000): cDNA_ID_2731368_gDNA_ID_2214471_Annot_ID_183011 3000 nt of promoter + ATG
tttccactaatgtccttcttgttcttcctcttgaactcttgaacaaagtgattcaccattctgttgtcgaaatcctcaccaccaagatgagtgtctcctgcagtcgccttcacttcaaatataccttcctcaatggtcaaaagagagacatcgaatgtaccaccaccaaggtcaaagatcaaaacgttcttctcaccaacacttgtagccttcttgtcaagaccgtaagcaatagcagctgcagtaggctcgttgatgatacgcataacattcaaaccagcaataacaccagcatccttagtagcctgacgctgagagtcattgaagtaagctggaacagtaacaacagcgttcttgatcgttgtaccaaggtaagcttcagcaatctcacgcatcttgatgagaatcatagaagagatttcttcagcagaaaactctttatcttctcccttgtagttaacgacgatcattggtttttcagcaggtccagatttgagcgtgaagggccacaatttgatgtcactttgaacagagctatcagtaaatcttcgaccaatcaacctcttcgcatctgtcacacaacaaaattgaacacaattagaccacagatactatacgaattaaaacgatgctatatgtatattttgcctaaaggctaaaattagtaacattagatcgaaaattgaatctcactagctccagcaatgttaaaacattcttatgaaaccctaaatcatcgctatggatctaccgattacagatctacttataatccaagttcgaaagacaaatttagcaagaggaaacgagtgaaacgtaccgaaaacagtgttaatcgggttcatggcgacctgattctttgcggcgtcaccaatcaaccgttcgctatcagtgaaggcgacgtaagacggtgtggttctgttaccttgatcattagcaatgatctcaacacggtcgtgttgccaaactccaacgcaagagtaagtggtaccgagatcgataccaatcgctggaccttctcctttaccagccattgttaacgctactcaggattaagctaaaaaatcgaaagaaagattgtgaaagaggaattgtgaattgcggctaggtttgttttcttttttccaaaatatcaggtcgaaggagaagtctatatagagtcttgtactcgagtttcgagaaggttcgatggctcgctatgtaaccgcacgatcttttggagttggatctgacggtccaggaatgattcttttctcctacttttccttttcctttaacaaataaggaaagccgtttaaaaaggttcgagaatgttcggttcgatggcttagtccataatcaaaagtcggtcattggctcaacattttcttgcgttctcattggctttgagtcggtccaccgttcaccgtcagtgactcattgatagcttttttccttttcgtttttctgttttttttcccaaaactagctgtaggcccaatgggcttatcttggagaaaatttgaaaaacaagaaaaagttaatgtgtttatttattgtatgctgcataggtttttgccttttacacaaatgataattcagggcagttgttgacatggtccatgagtttgaatagtttgagttgctcgagctatattcacaataagcccaaagaattgtacacacaattgaaagagattgacgagagagtaaagagttttgggtttcctcttttgatagctaaaataagccccaaacaatacgtggaagaagcatgcaaagtggacggtatacgtaacgtaactatgtaataactttaacattctcaaagaaaataatttataaatgcaatgaaataaccaatatagaaactcaaccaaaaaaaaagggaactcattttcagattaaaatttctattgaaaaaaaaacgaatttttgtggcacagaaatttgtagccacaaattggaaataaaataggtgtacaagtaccaagtatatgatagagtaggaccaaattgattatgccatggaaattacctggtgaagaggaaacaatactaaccatgaagcgtgcagcttgtgattaatgctctcgatctctacttgaactcgaactgttgatgagactaatgtctttcatatcacttcttcttcttctcttttgtcttattcctatatttaatcttacccttttttcggtctaccacattttaaatcgagaaatgaaaggtcgattacgtggagaaattataacattttaaactctcgagaaacttgtagaaaatactgttttatcaattagtatttgaaaccattatgttttagttttagagtatgaaaccagctggttttgactcgtttccaacctatacgtgcctcaattttagagatgtcccatttggtttaatctgaccaagctgtatccaaaaagtgattcaagttttatttcggtttatcaccagttacattttcttcgatatatacgaaaagtatcggaaaataagaagacacaatcaaacttgaaattggtaccaaaactagaacagtgtaagtcaaaccgaaaccggatatatgggcatggcctaaaccaaactaaaccgtaatccattcggttaaaattagtttcccttccaactatttgtatatggcatggcctaatttaacccaaactatttgaaatatcagtgtctcttccctcctttgatgtatgaggcactgcctaaaccgaaactaaccagatgcagtacagagactggtttggtttggtaactacacaatatagaaaatgaaagtacttggagttaaaagacagctgctcaaaagtcttaactctttgacgttgccactttaaatcccatcacaccttatatatacgtagtcttcttgctcaccataaccttcatctcatcatctttatctaacaagtattcctacatacaaatccactaaaacaacaatccgttaaaagaatgcgcgacacaacatggctcgagcgacttggcctggctctgcgaaccgcc

SEQ ID NO: 11026 - DNA, 3000 bp, Unknown; identical to SEQ ID NO: 11019
  misc_feature (1)..( 3000): cDNA_ID_2714599_gDNA_ID_2214471_Annot_ID_133086 3000 nt of promoter + ATG

SEQ ID NO: 11027 - DNA, 3000 bp, Unknown
  misc_feature (1)..( 3000): cDNA_ID_3054609_gDNA_ID_2214471_Annot_ID_133087 3000 nt of promoter + ATG
gatatgaaacaacagaatcaggaaaatttgttaaaatgtcagaaaatggaaaaatctctaactgaacaaaagtaacaaaaaaaactcccttagaaacagaggaatcatgatgagagacaaaattatacagagacgtggagatgtctgtaacgttgtctcatccatcatcatgtcttcttcttctcttccttctcttttccggtcatccctccgtcctcggaacctccatccccgacgcggtgaacacggcggcgcgtttggtaaacagagcgagaagagcaaaactgtcgagagaatttctacaagcgcacaacgatgcacgtgtttcttcaggcgtgccaacgctcggatgggacagagacctggcccgattcgctgataaatgggctaaacaacgtaagtccgattgcagtatgatacattcaggtgggccttacggtgagaacattttctggcaccggcgtaagaagacgtggtcgccggagaaagtggtgacgagatggtttgaggaaaggtttaactacgacgtgaaaacaaacacgtgcgcaccgggaaagatgtgcggccattacacgcagatggtgtggagagagaccacagccgttggatgcgcacgtgtgaaatgccataacggtcgtggctatcttgtggtgtgtgaatatgatccacgcgggaattacgaaggtgaaagaccattttgatcaaaacagttaaaatgaaaaaattgttagagattcaaaatattttttcttcttctaatgtaatgaagatggtatattattcttggtccttacatatatacagccatgtattgaagaggtataaattcaaatggttcggaatcttttaattttatatattaaagatcaataataaaaaaaaacgtcgacagcagggttcgaacctgcgcgggcgaagcccaatagatttcaagtctatctccttaaccactcggacatatcgacttgttgtatttgtttcgtaagatttgaatacaaaaccgaattctctgttgcctaaatcggagcttttcatcccttgactctctaagacatctgaagcagctaaagtgttggatgtttcacataacgacatgggcggcaagcacccagtggacacaacaaggtacctttgttcttggccgccctctaattcgggtgaaattggaagagaggtgcttggtatatactaggatgcgtatttggtgcttagagatttgatgaaactgaagcagttagatattagagacaacgacctaatatttgcaggtgaagagttcagctcttttgtccgccaggtttttccaaagcttgtatggcttgatggccacaaactcgcaagttaaagataaatgttaggccacttgttttaattaaagtataaaactctttcgtttttttggattcattttcatgaaatcaaaagactacaagtctacacgtgcttcaagcttgaggctctaaatgaagtggtaggaaagaatgaaataataataaaaaaagtcagaaaaatggatggtctgagatcaaagtgaaacctactccacatacacatcccaacttcttccccgccatgtggacttttctttttcctactttctctctctgcattctctcttacacctgtctttatctgaaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtaataatttatctctgtttctctgtttttagagacttcaaatttcttagtttgctgctgatttctgagtttagttagttatagactgaacaaacagaggaaagtttatgttacttagcttaggtctagtagtaacttagctataaaaaatctgcttagctaaaaagatctgcttcttggagcacttcaactgtaataaatttatagttgtgttgactttttgaaagtgttattgatgtaactaggacctgattctgctgatactactactcctctatgttccttaggtttgatcgtgactggaagaagattgaagattttgttggttcaaagactgtgattcaggttttaaaatagcttactctgcatttttggtcgcagttactttgtggcaatgttttcaacttatttgactttgtactgcagataaggagtcatgctcaaaaatactttctcaaggttcagaaaaacgggacattagctcatgtgccacctcctcgacctaagcgcaaagcagctcatccgtatcctcaaaaggcatcaaagaacggttcgaatattttataatacttcttagtttggttatagagttgagtttttaactcacattttcttgcagctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaaggcatgcacatttgtctatcctttttgttttcttcattttattggtagttgtagtaagaataggttccatcaaaggacgtttcatgtgcttattatggcatataacgccactgattcagctgatattggatcaaagggcttattaaatgttagtagcccttctacatctggcatgggaagctcaagccgaacagtatcaggttctgagattgtaagaaaggctaaacagcctccagtgcttcacggtaaccatctgtgaacaattccatgttttttcactaacttttatgcatgatggagactgtactgatactatctttgtaggtgttcctgattttgctgaagtttataatttcattgggagtgtctttgatcctgaaacgagaggccatgtggaaaagctcaaggaa

SEQ ID NO: 11028 - DNA, 3000 bp, Unknown
  misc_feature (1)..( 3000): cDNA_ID_2714687_gDNA_ID_2214471_Annot_ID_133088 3000 nt of promoter + ATG
aagacaaagaatcgtacacaacagatttacaagacaaactactagaccacaattcagaacagaaaaggtaagatctagtaaagaaagactactatagtcatagactaaaccagaggggaacagattattgtatagcttaacatacacaaactcagtcaattagaacaattgcaatataagttaagtcaaatgaaatgcaaccacagatcaaaatgtaatcagtaactaaacaaagacaatccaaaaacggttgataagagaacaagtcaagtattgagattaccttggtaacggttttcctcttcttggcgagcttctccttcttagccttaactctctgtgcttcagctaacagtgacatcctcttcgcggtcttagcataaggattcaacttcaacatcacattgagattcttcaatggattcttcttaagaacagccctcttcgcatccttcttgatcggattcacaacactctgaatctcatctgaattgataatcctggcaagatcagcattcaccatctttgcacgaggaagcacataccccttcttcttctctgatggcttctcaaacgaaccatagatagactcaagcttctcaaaggcagacttggtccagatcacaaaccgaccaaggtgaccaccaggagcaagcttcaacaaattaagcctctccacatgacaaagctcaacaccaggaaggtttctaaacgccttaactatcttagatccttcagttccataaaccaccagaggacctttcctagaaatgtaacgacggttcctcattttacctttaccaggacggattccaatgctgttctttgccttctcagcatcatcataagcaccgatctgtttcaaaaccttgatcgcagctgaggtcttctccacagcttcggcggagtcactcacaacaagaggcatctcaggaacattctcgatcttgtgaccacgagccatcacaagcgcaggaacagcagttgcagcgatagctgagacgattgcgtgacgcttcatgttgacattgacacgacggtgccagcggcgccagatcttggttggagcgaacatacgaccaccacgacacatgttaccgaacgcagcttgaccagcacggtgagtaccaccaccgggaacacgagggatacgagacacggcacgtccggttccccaggactcggcggaggtctggtgaccggccttcttcgatacggcgtatggctgacggctgttgttggagatttgggcgtgaacgaagttaacgatgtctggtcgaactggcgccgtcatgacgtcgggaagtacgacggtggaggattgatcggtggacatgtcaccatccaaggtttggatggtgacgagaggacgagcagcggcggcggccatttgtctcgaaatgtttctctcttctctcactctccgtctctttagactctttgagaaattagggttttctctcagctgaagtttaagaactaatatatgctagggtttcgttagggttactgctgaattagtgggccttataataaagcccaataaacccaactaatttacctttcagtaagggcccaatatttaaagttacctccgctataagaaccgggcactgctttagcctttaacgaactagtgggcctaataaaacccgactatttgtctcttaactaagagacaattgacctaagttttaccaaatttaagagatttatctaatatttaaattatataattttttaaatatttgttaagagttttgctaagagtctaccattgtggatgcttttagaatcatataacaaacatcgtcaaagaaaacggtcgacgaaaaaaatagataaaaagaaaaatgatcaaagtaatgtacgaaatggagcgttaaagagtgaaaatttgctttatagttcaaataatctttagtctcgatcttgaatggcaaaatatttcaaatcatattcttttcctaaatatggaagtgctcctaagcaggtgagatattactgattagcactgccaccgagtcatttggtgaagttatcaaactcggtgtattcactatcggcttcgttttctattaaaatgcacacctcaaaatattcagaaaatctttacagttttatctcatttttaatctaaatcaagaatcgataacaatattttcggaccataatctgagcaaaagataaaacacggtaatagttcttttcgtttggttatattttcatgtgaatactgtagtcgtttgggtttttggtccagtccttttagctttcaatgcctctcttcaagttgggtttgatatccttttattggggttaggcctttttagtttcaatttttgaaattttgtaatcacctagataggtttaacccattttgtaacgttttatcttatgataaaaagtcaataaacagaaagacctttgggggaaaaaaaaaaaaaattgtagtcacaacaaatgaaatcccaacccacgcgctgcaggtcctctcagtttttaatttatgcaaaaaatccccaaaaaggaaggttatatagtccatggattttagcctcacgtgctcaacgcgcctgtgatgcgagtggtttggggaatgaactataaataataggaaatcattcatgagatgaaatcaacgaaatgaataattattttgaatagaataaccttgcgatgttgtttagaagcccatgaggaaaatatcgattaatagtggacctaactaaagcccaaatagcccaataactggttttcacttttatcttttaccaataagggcccaaccttacagctttattatctctgttactcgacactaacgagacgttacaacgttacggtgtagagagttttgattcttctggtagctttgtcttcttcaccgcaacatttttagggttatcgttgaagcttttgtttggcggatgaatttgatttgaatttgggtttaagttacggaattttctatcgggatttgttgcgtttgagatgatg

SEQ ID NO: 11029 - DNA, 3000 bp, Unknown; identical to SEQ ID NO: 11015
  misc_feature (1)..( 3000): cDNA_ID_4262542_gDNA_ID_2214471_Annot_ID_133089 3000 nt of promoter + ATG

SEQ ID NO: 11030 - DNA, 3000 bp, Unknown; identical to SEQ ID NO: 11014
  misc_feature (1)..( 3000): cDNA_ID_2714682_gDNA_ID_2214471_Annot_ID_133090 3000 nt of promoter + ATG

SEQ ID NO: 11031 - DNA, 3000 bp, Unknown; identical to SEQ ID NO: 11013
  misc_feature (1)..( 3000): cDNA_ID_1377843_gDNA_ID_2214471_Annot_ID_133094 3000 nt of promoter + ATG

SEQ ID NO: 11032 - DNA, 3000 bp, Unknown; identical to SEQ ID NO: 11012
  misc_feature (1)..( 3000): cDNA_ID_2714670_gDNA_ID_2214471_Annot_ID_133095 3000 nt of promoter + ATG

SEQ ID NO: 11033 - DNA, 3000 bp, Unknown; identical to SEQ ID NO: 11011
  misc_feature (1)..( 3000): cDNA_ID_2714666_gDNA_ID_2214471_Annot_ID_133097 3000 nt of promoter + ATG

SEQ ID NO: 11034 - DNA, 3000 bp, Unknown; identical to SEQ ID NO: 11001
  misc_feature (1)..( 3000): cDNA_ID_2724771_gDNA_ID_2214471_Annot_ID_183010 3000 nt of promoter + ATG

SEQ ID NO: 11035 - DNA, 3000 bp, Unknown; identical to SEQ ID NO: 11010
  misc_feature (1)..( 3000): cDNA_ID_2714662_gDNA_ID_2214471_Annot_ID_133098 3000 nt of promoter + ATG

SEQ ID NO: 11036 - DNA, 3000 bp, Unknown
  misc_feature (1)..( 3000): cDNA_ID_2714658_gDNA_ID_2214471_Annot_ID_133099 3000 nt of promoter + ATG
ctttccatagaggagcaaactttatttgatgactacatgaaagatgattttacctctcccggagggagatcggaatggatgactccggctctgatgttttcacatttcagttcatcatagagttcttttgctcgttctttgctttgtacaaagatcagtaccggtggattcagactctactgccaagtagaaaaggaattacaaaaggtattggactaacttgatcatactgttaagataagtgaacttacctctgcaaagctttggcgaagagcaagaagtttcccttcttcacttccagcaaaaaccagcttttgcttgacggtttcagatgctgtgtttctatattgaatagtaaaaggtaagatcattttgcttcaaaatatgttgtgaagtatctataataagcttcagtatcatactatcatgttttctatacttactttcggccaatgataacacgaacagcatcatgcattatggaacgtgcaagttcttcaacagaatcgggcaaagtagcactgaacaatgaacgtatgatcgaaggatttgaacaagccttaaccacacaatctatctgctttaacaagctctgctcaaacagcttgtcagattcatcaaggacaaggtactcgaccctgtattcaacagagataaagatgaatatgggcacaacacaaatagaaatacaatgtttatattctaacatatgatattgacttacttgcttaagtcaatctttttagccttgattgctcttttcaaccgcatcggcgttgatatgagaacatcacaccacagctttgagaagtcagctgttttgacaaggggtttagtcatcaatctaatgtggaaattgcttcctttaataagtttctttccttctctagctgtttgggcagccagttcccgagcaggagaaaggataacagctcttattccatcagttgaagggcgctaatacagcaaagaaaaaactcataaacatgagtcaagaaccaggatcggcgaaatctggagggtcttaagggcaaacacaatttaataccttgagttttataagcatgggacaaataaaagcaaaggtttttcctgacccagtcggagcacaggcaaagcattcacgaccctgggataaagaaaaaagatgataaaactaaatattagaactgataccccataaaagaattcacaaaataatctggacaaaggagttctttctctgctcttaagtgactccagtgtaataaatggaaaaggagtgaataagaccataccgataggagaattggaatagcctgtctttggattggggtaggctctttaaatcctagttcagccaaattgcgtaatatgtatccttcacagccatacctgtagatggattaagcattaagataaaaacccagaggagaggaagatctaaacacataattagagtatgtcaatagactcaacgtccatgaaacaacaaatacatacctaaactacaaaaccactaatactatgagcataatatcaaactactgtaaagaaacaatccagttccacgcacctggatgacaactctgcgaaacttttaagcggcggtggaatattgttaccggaaacatgaatgctgtactgtttcctcgacaaagcatctcgctgccattataaaagagcaaacaaagtcatgaatctgtcacactttgcctttgatgaaacagagacaacattaaaaacaactccaatacctccatttgacgattaagttccttcttgggattctctacaatctcattctttgtgatttgttcttctgctttacctttagcacgtgccttctttgagctcttgaacacatcgaatccttcaactggcactatttcaacatatcaaaaaattagatcaagacacagttagcacaaacctgagggaaacaataatttaacttttcagacttaccagaattagaagatcttcgtttcctcttcttagaggacacaataactttctccgcctccggctgttcagtgtcctcttcttcttccacaaagaagttcactttcttattggaatcatcatcctccgtagaattctaacacatcaatgagacatttttaatataagaacaaagagtgggagtgagtagtgctgatttaaataacacatcagctgcagaactcaccttgaatttagcaaaatcaggagcaaacttcttcttattgaagtttgttccaccaaacagaaaatatgagcttttctccatctgtcaagtaaccataaaactctcaatacaaggcaatggaatcatatcaacatagactgaaaacatcagaaaataaatttaagctgagtactattcgattagagcagaaaaaaaaagggagaacgccaaagagaagaaacagagcagtagagaaaattaccaagagaagatattacaactaagtcgtacctaaatagagaaagagagcgtttccggaggagaggaaaaggcagcaataatggtaacaatagagacgaaattaaaaacgccggcgatgacactgacgacggcgaatagataccgagaagaatcgaagaaccagagagactcttgcagattttgggttttacaattagggtttggtgttttggttgatttcatataattttaagggtattacagtcatttacttgaacaccaatattaaaattggagttgctaaaagcctataagagcaatacattaaagatgttaaataaatgggcctattaaagcccaaataaaacaaaaagcctaaattagatctgataggtttggtaagaaaccaataaatttggaaatttgtgtgtaaaagcgggaaacatgtgatggtgtgacccaccgccgctgaaaaacaaaaaaatctcacttcttcttcttctctctctctgtctctgacacatcgggactttctccgactctgtttccgtcggatttaaacacttcagacttaactccacttttggtttatcgtttacgaattgttagag

SEQ ID NO: 11037 - DNA, 3000 bp, Unknown; identical to SEQ ID NO: 11009
  misc_feature (1)..( 3000): cDNA_ID_1381941_gDNA_ID_2214471_Annot_ID_133100 3000 nt of promoter + ATG

SEQ ID NO: 11038 - DNA, 3000 bp, Unknown
  misc_feature (1)..( 3000): cDNA_ID_2990667_gDNA_ID_2214471_Annot_ID_133102 3000 nt of promoter + ATG
agagatctatccattagcggttaaggcagaagcagctccctcaggtggtgagaatgaagaagaagaaaggtcggggtcgaagaatgcgcagattactcaagcggtttatgagaaggataaaggagagattaagattagagtggtgaagcagatactatgggttaatggaacgagatatgagttgcaggagatttatgggattgggaatacagttgagggggatgatgattcagctgatgatgctaatgatcctggtaaagaatgtgttatatgtttgtctgaaccacgagacaccactgttcttccatgtcgacatatggtaagtgaaagctgatgatttactactattatgtgatgatggacatatatatagatgttaaaaattgtttgggtttggtggtgcagtgtatgtgtagcggatgtgctaaggtattgaggtttcagacaaatcgatgccccatttgcaggcaacctgttgaaaggcttttggagataaaagttcacggtaacaacggaagcgggaataacaccggacagggagaaacagttgaacaagagtagctaaacacggccgagtatggattgaaatgccatcgaaatattagtagtatatgcatgtttgatccttgtatgttaacaacaaaatgtgtgattgtcaattcataatatagagattacgaaatcatttggagtcataatgacacaatacttgaaacattcttcattagatacaacaacaaagtaggcagtttcttacttagctagttgctcaaccggaagttgcagtggcaggtgaagccattttagttgcaataagacagaaacttaaacatggaaaacacgagatatagtagcggcaacatgacattcaattatatagctgaccccttcgtttcttatttaaaaggggcaatctccaacgttttgtggtcaaatgggcctgcatttctttttatccgcctctactattgggccctaagcccgagttttccggtttcgtaaacaataggttcatcatacttgtgtaatttcaatgttttggaaaattcggttcacagcttcgttaaaacatcaatcatctcatatctgtgactcgtagtttggttaaaaaatgatcccaaaaaagagagagacagatccaaaaaatcatctcatatctgtgtctctctctttgtttaaatttaaaatgcttgccgtagacaaaacatacaaatacgaggctgtaataaacaagtatttaatataataataaggacaaataaacggaccaaatttaggccgagaaaatgggacattgtgatataatctcaaaaagaattgaaatttgtatgatcgatcagatatctcaatttcaggaacccagaaagagggacttgtcttttacctccaaagggttcctgccgtttcttttctacaatttttctcctgctaattatcaaatttttcttctgattttcattgtttgttagagattcttcttctcctctgcttttctattctctgggagctcgatgatggatgataaagctcgcaaagaagaagaacatcatgtgtctcaccaacataatcattctcctctgcaaagggtctctcgttaattccattccaatcttgtttcaatctatcttccattgatattgatattgtttataaatttctttctttttttattttgctcatggttttgattttgttggttatcctcagaatttcatcaatcttccatgattttagggtttaggggtttagtagattgtttaagtcgagtctcttgataaaagattaggcttttaagttatttgtcaaagatcatgccttttgtttttttggaatctgagaaattggatttgaaattaatctttctttggtgtttgcaggatggaaattctgctgagattgcacaaggacaagagctatcatcaccgggccgagacctatggaggcgaggtcttgtgttagatttaccatcaacaacacctgaagatactacaagagatgatctttttagacgaaatgcatctttaacttcaagtcctgttgccaaaagagtcaacttttctccaatgtccagccctagagtcggacaacgtggtgcatccttgagtccttcttcttctacttcttcttcttcaagaaacaaacctaatagcctgaagaatctaatccccaagttaagctttaagaaccggaacagcaataacgataatgtggatatcgagaaagccgcggatttgggctttgtgtcctccccttcttcaggaaatggcagggacaggtctacatggactctcactaatattttaactccaagattgaagaaaactgagtctcttcctgtaacccctatagctcactcaaatcctgagtccactcacgggagatttgccgttgatctagttacttccacggtgagtaacttgacggatcgtttcatttaggttctcatgtgaattctattgtggtttgtgctgttatctcattggcaagggacattttattgtctcgtacttcaccttggtctcagtagagtaatcttaagtgatgcattgtgcttgtaaaataagtttagctaactaggttatcttctgcttcacttcattgttggtttgaccaattatttttataaaaatgttttcccaacagaaaaaagggcctccactgcctatccaccgttcacgctctgtcccagcattcaacaaagatggaagtcaaaggcaattaggtgttttccgggtgattccaactccaaacatgtctccaaccagaaatactattaaacttaacggttagaaattgtattttttcatttgatttttaaagccaaaaagacatgaaagtttgatatttttgtgattatatccttgtaacaaaccctgtgccttatattagtgaaatgtttcagacgcgaatgttgatggagctgaagatgttcctgaagaagaagctgtgtgtagaatctgccttgtagaattgggagaagattcagaagccttcaagatg

SEQ ID NO: 11039 - DNA, 3000 bp, Unknown; identical to SEQ ID NO: 11017
  misc_feature (1)..( 3000): cDNA_ID_2705158_gDNA_ID_2214471_Annot_ID_133103 3000 nt of promoter + ATG

SEQ ID NO: 11040 - DNA, 1314 bp, Unknown; identical to SEQ ID NO: 11016
  misc_feature (1)..( 1314): cDNA_ID_2716986_gDNA_ID_2214471_Annot_ID_133106 3000 nt of promoter + ATG

SEQ ID NO: 11041 - DNA, 3 bp, Unknown
  misc_feature (1)..( 3): cDNA_ID_3019256_gDNA_ID_2214475_Annot_ID_133108 3000 nt of promoter + ATG
gaa

SEQ ID NO: 11042 - DNA, 3000 bp, Unknown; identical to SEQ ID NO: 10099
  misc_feature (1)..( 3000): cDNA_ID_3038936_gDNA_ID_2214475_Annot_ID_183093 3000 nt of promoter + ATG

SEQ ID NO: 11043 - DNA, 3000 bp, Unknown
  misc_feature (1)..( 3000): cDNA_ID_2994697_gDNA_ID_2214475_Annot_ID_183092 3000 nt of promoter + ATG
catagatatcagtatatcaaaaaactgaaaactcttccgtcttttgagaataaaagagtccaacttttgcattcgacatttgactataacagtatcttttcgagaagacgcaaagtcgttacgtgcgtttatatttcgtttattcatgtcccaatactacctcttaggaaataagagactattaagactttcttgcttcccaatacacccccactaatatcaaataacctagtttaatttcttccgtttctcaacacttttaagaaaatacttaacaattgacataaaagaaaaaacgtacagaggaatttgaatggacaaacaaaggtgaaacaactagaatggacaaacaaaggtgaaacaactagaatttaacaatagacaaaaaaaaaagaaaaggatttggttaagcaatattaaggtatgaactaacctaaaccataaaatagtaaaaaaggaggattaaggttactttgtttaggagcagcacgttgataaccaaaaagccataattatcgcttccttcagcgcaggatccttctctctcctatctctctgtatatatatgtggaccttcacgtaatagcttcgtacttcaaacctcaaaagcaatttagctctctgtcttcaagatgacttctcttttcttctttgttctccttttctcgtctcttctcataagcaatggcgatgccaacccaaattacaaagaagctctctccaagtcattgctcttcttccaaggtcagcgatctggtcctcttcctagaggccaacaaatttcctggagggctagctctggcctttccgatggctctgctgctcatgtacacaccttaaaccatatttaactttgatacagaatatatctttgttagtaacattgatatatgaattgcaggtggacttaaccggcgggtactatgacgcaggagacaacgtcaagttcaatttaccaatggcgtttaccaccacaatgctctcatggagcgcactggaatacggtaaacggatgggtcctgagctggaaaatgcacgtgtgaacatccgttgggccacagattatctgctgaaatgtgccagagccacgccggggaagctttatgtcggtgtaggagatcctaatgttgatcacaaatgctgggaacggcctgaagacatggacacaccacgtacagtttactctgtatccgcttccaatcctggttctgatgtcgcagctgaaacagcagcagctctagctgcagcttctatggttttcagaaaagttgattccaagtattcacgtttgctgctcgcaacagctaaggatgtgatgcagtttgccattcagtaccagggagcttacagtgattccctttcctcatctgtctgtcctttctactgctcctactctggttacaaggtctgctttcacatgaaactaaaccactcttaccactacatcagatcctcatttttaaaaatgtgaatttatgaacacaggacgagctaatgtggggtgcgtcatggctgctaagagcaacgaataacccgtattacgcaaacttcataaaatctttaggaggtggagatcagcctgacatcttcagctgggacaataaatatgctggtgcctatgttcttctctcacgggtttgtctctctgctaataaaaactcattgagaacatagcttttagcatcacactatctaacttttacattttggcagagagcattacttaacaaagacagcaactttgaacaatataagcaagcagctgagaatttcatctgcaaaatccttccagattctccttcttcctctacccaatacactcaaggtaacctacttcacgatatagaacacaaattgctaaacaacaacctcttctaatcatatgtttaccaattacaggaggattaatgtacaagctacctcaaagcaatcttcagtacgtaacctccataacattcttgctcacaacttacgccaaatacatgaaagccacaaaacacacattcaattgcggaagctccgttatcgtccccaacgccttgataagcctatcgaagcgacaagttgattacatactcggagataacccaatcaaaatgtcatacatggttggattctcttccaatttccctaagagaatccaccacagagcatcttctcttccttcacacgcacttcgttctcaatcgttaggctgcaatggtggattccaatcgttctacactcaaaaccctaaccctaacattctcaccggagcaatcgtaggaggtccgaatcaaaacgatgggtatccagatcagagagacgattatagtcacgcggaaccggcgacttatataaacgccgccttcgtcggacctttggcgtacttcgccgccggccgttcgacttgaaattgaattcgccaccgccacattctccgatttgtagttccattgttagttaaagatccgttggtccaagcctaacgtgaaaatcagaagggacaaagttatttaaatgtaaaactcttaatgggctaagacccaatactaaaggacccgacggaaatatttctcgtggtcttatttaactctaaccatcatcattacgcgtttcaaatattcaaccaaggccgttaattaagcaccacggaaatatttcatgtttggttatagcaccatgaaagaacactagaatatttacttgtcaattatgtcatgaaagaacactagaatatttacttgtcaattatgtcatcagtacaaagattaaacagctgaaagatatgcattaagtaggaaatgtaaagacaaaatatcgttttctgctaaaaggaattacacatatgccaaacaatgggccgagagagaattgaaactaatgggccgagagatattttttctcttagtgggcttttaggagaaactgtagcaaaaacaacagatttcgaacaaaattttgatgtagatcatagctaaaaaataatctggagtgagcgacaagcaagcggcggccgtc

SEQ ID NO: 11044 - DNA, 3000 bp, Unknown; identical to SEQ ID NO: 10101
  misc_feature (1)..( 3000): cDNA_ID_2717032_gDNA_ID_2214475_Annot_ID_183087 3000 nt of promoter + ATG

SEQ ID NO: 11045 - DNA, 3000 bp, Unknown
  misc_feature (1)..( 3000): cDNA_ID_2717080_gDNA_ID_2214475_Annot_ID_183070 3000 nt of promoter + ATG
tgaccattaaaagagctaaaaaaaaaagtaaatgaactttaaacttgaggctgattttttttccgttgagttttgggaaataagaattaatagttgaaagtttggaattactttggattaaaatatgaaagtttagttggtttcttattgtaagatccatatattcgaagaaataattggttagaatgtctaacaatactagttagatttttctagcatatatcaattaattcatatattaatgttatctaaagaaacccactttctcagatcgcaatgcacataagctcatagttaaattaaaagcatgcattaggataaataatatacaaagaaataaataaattttagggagtggagaatcaaaagaaactttatgcccctaaaagacatgaaaatcaaacaagtgtcaatcatagatacgatcttgatcgagccaatgagcgcaaagatgcgaggaaaaagaagcaacagatcgatcacacactttttgcgttttgcatgtttgatgcattttgatttgacaaagattctttatttacttccttcttccttacttaagctgaccctctttcttaaagtttaaactgtttttagaacgatcaatcatttcaattttggaagcatcgaaatcaaaatgtccaaaatacatattttgacagcgaaatattttgactagatttcaatagtttagaactttggttccacaccagtttatgttgtaatggcaaatgtaaattatttatagaggaatcccattctaatactattttgaatactaaccttggccttttcaacaaaaaaaataaatcgaaatgtgtacaatcaccacgaaattatcatattttttagttatggattctgtaaagatggattaaattagttaaagggaatatactcttacattagctatattaaaaaaaaaaaaaattagctgctaaggggatttagtccatggaaaatgttatttaattctagtttgattaaaccttactttcttcatggtgaaatttaaatttgatgatataatccacgctaaaaaataccatcgtaaaaaacgttgctaaaagctgtgtctttttttttttttttggtaaaagaagctgtgagtcttttgttatatgatgagttaaaccgctcacagaataccagttagtgaccttaaccaaaaaagttccatcgttacagagtatcaatctatgtttcaatgtattatgtatttctttgaaatattgatgtcgaatataaggtggattttctactcagaaataagagaaaaatcccatattccaagaaaaaagtgagttgaaaaaccccgtaatgttgaagaagaataagattcaggagtttgttatgtagaccaaaggcaaagcaagatggtcaaaaaaatatttagaaaggagaaaaacgacctacttaatcaattaacaagcaaaaaggtgaaattcaataaattaatacacctaacaaaaaaaaaaggctacattggcacctaacatgggcaggtcattggttctccaccacgatgagatgcacatgatacccgctttaatatgggctaagtatgcttaatgaccatcacttaattgttctttttagttgttaaaatgggttaagaattccacgtcgttaaatgtgagaaatgtataattcaatacagaataaaaagctcggacgaaaaaaaaaaaaaaaatacagaataaaaagctcaccatggatttttaacatgacataataatgatgagcagttctatatataccacaatgaaaattctttgtaaacttctttctattagtctgctttatattttctagtaatcgaatttcatatttagacactaaatagagatcatgtgagtttcaactctagatcaaatatggttcgttttaataataacaaaaatatatacatataatatattttgttattattcggacggtaattcgatagtgtaaatacattaaacttttgcttaatcaatagagcaaaaacctcccacttttttttttttttttgataacttcttgtttattattagttgattttaagatgaaattttatgtatttttaatgatttacatcaagtcatcaacccaaaataaatatattcgatctttggatccagttaaagtaaataagatatgagaggtacgtgcagagatatattcagaactatacattagtaaatataagaggcaaaataaatgatgctatgaataaagatgctatgaatgtttaactaggaacagaactagtttttgtttcattgttgaactcttatttactctaaatccttcacataataacgctttgtttataaaaaataaaacaaagaattctttttttaagaaagtgaatcgcatgccatttgggaactcaatctttttttatatatatagtcttgcacatatcaaatccagcctccatctcttggtgtagaatgtaaattgtaccaaattagattgttaaatatatttggatattgtaacaatagtgcatgtcaggtcatatgtcacatcagatgtaacatcaatcaatcaaaaagaaacctaggaaattatactacaagctagaggaggaagggatagtacaatacaaaccccttataataacaaagaaagacggagctttcgcatgtaaagctatatactattgtatgaatgcatacttaacatataacgtatatgagcgcatacatatataagggaaaatgaggctgatgtggaaaaggtgctttaagaagcagtgaagttagtgggagaatatgataatggagattatatataaagacaagaaggtggcatgagattggtaataacttcacagttgtctccgaagaaacagagaaaccaaagagttaagtggggaacctcgaagctagttcaaactagtgggaggttgtttcacgtttcaactttcaagtcataaaaccaaatccaactctaaacgtaaacccaaacgtcaaatcatcagatagaaggaaatattctgattgagag

SEQ ID NO: 11046 - DNA, 3000 bp, Unknown; identical to SEQ ID NO: 11045
  misc_feature (1)..( 3000): cDNA_ID_2717080_gDNA_ID_2214475_Annot_ID_133112 3000 nt of promoter + ATG

SEQ ID NO: 11047 - DNA, 3000 bp, Unknown
  misc_feature (1)..( 3000): cDNA_ID_3035228_gDNA_ID_2214475_Annot_ID_133120 3000 nt of promoter + ATG
tcctgctgcatccaaacaatcgacctcaaagcttgatcaaatctaccgttggctgcgtatccagacatcaatgcagtccaagatatggcattcctctgtttggatccatagaacacacgtctcccagaagccatatccccacacttgcagtataaatcaatcaaaccagagtgaacaaacggctgttccacgtaattcttcgatttcaatacatgggcatggacctccttccccagtttcagtgccttaacatccccaagtacgggaagaatcgttgtaagtataactgagtttggatatatcttttcttcactaatcatcgtcctaaacagtcccaacgcttcccactgccttttattgtgagccaatccagcaatcatcgccccccaaacaactatatctctctctacaatctcatcaaaaactcgacgtgcaagccctactttaccacacttaaaatacatatcaacaagagaagtcttaagaaagacactattaaacaaaccattcttaatcgcaagtgcatgcgtcttcaatccctgtctcaaagcagatgcaccagcaaaactcttaaacacattagataaactataaacattcaaatcaacaccaagctctctcatttctgtaaacgtagaaagaacatcttgataccgcttcttccctgatataacagtccctctaagcaacgcattccaagagtaaacatttgagctagtactttcatcgaacaccttctgtgcatctttaaccgaaccacaagcagtatacatatgaacaagcttggtccttagaaactcattactctccaacccattaatacgtatatgaacatggacttgtttaccgtgaagcaacgacttccggcgaacacacgcctctaaaagagcagagaaagttgtcgcatttacaggaatccctctctgttcgagataatcaagaatcgtgagagcgacttcgagattgttctgcctcgcaaaaatttgaatatctctgtggataatgtaggggttcttggagtggagaggaagagaagaagggaaagcatctctttccctaaaaggtttcggctttttggcgggagaagtggaaggtcgtctagttctgcttggtctaatcggagatttcgccggagcgccatctttatcggaacgatgaggacggtggttgagactcgtcgtcacggagagggacgccgggaggtctcggattccgagagacgacactacttccattgtgaccactaaccacttgattaagctaaaggtcgttagtatttatatgtagctttaaactatttttataaagtatgcaattgaaattgaaagctaatatttgggccagaaaattgaaatatgggcttagggcccccaaaacaattgtagcccatcagttcacacacggtttcgtttttaaaaaaagcatgtatttagaatttattggcttttattttggtggttgcttcaatcttcctcgtttaaaaacaattcatgtcaacttggacaagttacaaaaaaaacgtttcatatttttgtcactaaaaatattcagttaaataaagtaattgactcttcgttttcccgacgatactgtataaataaacatcatgtttctacttgttcacatatcgactctttgtttgtccgattctatctctctctttagaaactttatctagtctcttcgaacttaatcttaacgacgatggtgccggttacgatcaactctccacctaaacctgaatcatccgaagaagaactcagcgactcccaagtttccaactcatcggaagacgacgactcaatggaagacgaaccatcagactctgaaaacaacaatggaggtacatgcatgcatcactctctattttatttcagatttttcacttcaccatttcacatgtttccactgtaaagaagttggagcgtttgttaagaaatactttgcatgttcatgttctgtttgactgtgaggtttcaagattattacgttgatataaaaatcttaaaagtgattaagatagtttttgtatcgtatctttaatactttcttaaaaaaaaatcttatgtcaatagttgttacagaaactgaggctaatggtattaaagatgagttttgggctcggtatccatctttgaagatgtttttaagtaaggagatggtcaaagaatttatttctgaagagtatattttggagaaaggtaagcttattggagataataaggccaaagaattgaatgaaaaatgtgaggttttgtttatcaaggagatagagcatctcatcaacaaatatcgcttcatggctgatgttttggagttgttgtttttgtgagaacttttcgatagtgacgtgcatggcttgagtttgattttctcgtttttatttatgttataattattgtgttccatctatgaatgtaaaagatttatgaaggattcgatttttttctctttttttaaagattattataaacgtctttcataaccatctctttattcattatatgttcaggagtgaaaaaacaaaatctaaaaaatagggttaaatgtttgcttagcttctctctttatgtagatttgagaaccgatgaacaagaatttactgaaaatatatcattgatctaaaaattatgaaaaacaattcaactttttatccaccaacacatatttttctttacttttctgttctgctacgcattacctagtcttatatttcgaaaaattataaaatctcatttcacaactaaattaaaagtatcatttcacaaacaaataagatgaaatgatgatagaaaaatcatcaattaataggaaagaggattggagtatacttctattgattgttacagtatccacatggcatcgataatcatagggactactaataagaatttctgtccacaaattccaattgaaattcaaaattcaactctttgctctcttaatcacaaacacaaatgagccacaaaaacgaagacatcatatcaagaaacgacgatg

SEQ ID NO: 11048 - DNA, 3000 bp, Unknown; identical to SEQ ID NO: 10101
  misc_feature (1)..( 3000): cDNA_ID_2717032_gDNA_ID_2214475_Annot_ID_133127 3000 nt of promoter + ATG

SEQ ID NO: 11049 - DNA, 3000 bp, Unknown; identical to SEQ ID NO: 11043
  misc_feature (1)..( 3000): cDNA_ID_2994697_gDNA_ID_2214475_Annot_ID_133131 3000 nt of promoter + ATG

SEQ ID NO: 11050 - DNA, 3000 bp, Unknown
  misc_feature (1)..( 3000): cDNA_ID_2717012_gDNA_ID_2214475_Annot_ID_133133 3000 nt of promoter + ATG
taagtttttgtttggtgatctgatcttattggttggatgtgaaatgcaaagatcacggagagctcttctggttagaagaagagtttctgagactacttctaatggaaggaatcgcttctacaaagtttcattgtctttggtttttctcatatgggggcttgtcttcttatctacattgtggatcagtcatgttgatggtgacaaaggtaactttttgagttccttatttggacagaatgcaaaacagttattagaatatggttagagaactgaacttaagtaatatacgctcttagagatatgacaatcatgaagatgtatagaccatatcttaagtgtatctaaggcttactcttgggcatttgcaggtagatctttagtggattcagttgaaaaaggtgaaccggatgatgaaagggcagatgagacagctgagtctgttgatgcaacatcactagagtctacctctgttcattctaatcctggattgagttcggatgttgatatagctgcagccggagaaagtaaaggctcagaaaccatcttgaagcaattagaagtcgataacacaatcgttatcgtaggaaatgttacagaaagcaaagacaacgtgcctatgaagcaaagtgagataaataataacacagttccagggaatgatacagagaccactggttcaaagcttgatcagctatctcgtgctgttccgcttggccttgatgagttcaagagcagagcgtccaattctagagacaaatctttgtcaggccaagtaactggcgttattcataggatggagcctggtgggaaagagtacaattatgcagctgcttcaaaaggtgcaaaggtcttatcttctaacaaggaagcaaaaggagcttcaagcatcatatgccgggacaaagacaagtatctccgaaacccgtgttctactgaagggaagttcgttgtcatagaactttcagaagaaacgttggtgaacacaatcaagattgcaaatttcgagcattactcttccaatctgaaggattttgagattttggggaccttggtttacccaactgatacgtgggttcatctagggaatttcacggctttaaacatgaagcacgagcagaactttacatttgcagatcccaaatgggtgagatatctaaagctaaacttgctaagccattacggttcagaattctactgcaccttgagtttactagaagtctatggagtggacgctgtggagcgaatgctggaggatttgatatctatccaagacaagaacatattgaaactccaagaaggagacactgagcagaaagagaagaagacaatgcaagcaaaagagtccttcgaaagcgatgaagacaagagtaaacagaaggagaaggaacaagaagcctcaccagagaatgcggttgtgaaagatgaagtatcacttgagaaaagaaagctgccagatccggtggaagagataaaacatcaaccaggaagcagaatgccgggggacactgtcttgaagatactgatgcagaagataaggtcgctggacgtgagcttatcagttcttgagagttacttggaggaacggagcttgaaatacgggatgatattcaaggagatggacctggaggcgagcaagagagagaaggaggtggagactatgagactagaggtagaaggaatgaaggagagggaagagaatacgaagaaagaggcgatggagatgagaaagtggcggatgagagtggagacagagcttgagaaggctgagaatgagaaagagaaagtgaaggagaggttagagcaagtgttggaaagactggagtggatggagaagaaaggtgtggttgtgttcacaatctgtgtcgggtttgggactatagcagttgtagccgtggtttttggtatggggatagttcgagcagagaagcaaggtggcttggcttggcttctgttattgataagctccacattcgttatgttcattttgtcactttgatgagagaagagttctcagttttggtctttctttttgttttctagtttttttcttactgtagagttagctgagtcttctttatacccaataaaactatagaagttacctagataagttatgatgtgcctatgaggtttcaaatacaagagttttgtccggttcaatggaaaaaactcttatcaaatcaaagcttatacgtagaaagagttttcattgcagaaagttgatttacaaacaaaactattattcacagaaaacattttcttatgaccaaaataattataaacattttctttcaataattaaccctagcttcgtcattgccacagagcaaagatagttttaaaattcgaatccaatcaacctcttataccaatctctcacatgtcatctcctactcttcatagttcatccaaagtggggttatttgtcaacgtaacttcagcataaaactgagctttatactagagagaaataaagttagctataatcatttataaactgaagattgatggaggtttattaatggttaataaacctttccaaaaataggcgtatgccgctaagaacagagaagacacggtattctttagtaaaaggcgaaagaacagttcgctttgtcttcactgcacagctccgtgactcttgaaggcaagctctcgatctttatttatactaaagtttactcactgttctcaagaaatgagccgatgtgggatagtacaatcaatcaaattaattcatgggttattaatagcagtatatgggccatatcttgtttatttttaagcccatcccaaagcctggaggtttcatcatcttacaattctagactggttttggtgaaccggtttgatgaaattagaaattacaatgcaagagacacgtggcaggcttagaaaaataaccgaaagcaaaaacaaaaaggtttaagagagagacgacactagtctggttttggttcgagtcccgcagtggtaaagggacgactacaagcgaacata

SEQ ID NO: 11051 - DNA, 3000 bp, Unknown
  misc_feature (1)..( 3000): cDNA_ID_2716865_gDNA_ID_2214477_Annot_ID_133135 3000 nt of promoter + ATG
cgggatcgttggtcataacagctttgatctacaaccttttacgaagaaatcctacaatcaaccatcttgtgcaggtacggcctatctttgttagtgcaaagaacatattaacagatgaaaatgacgtctgtataataccactcacaactacgcaaaataatgtatataaaagcatggacttacaaagaggtcactcttgttcaggaaatcgttgaaaatgccgatgaagccaacacagaggctggtgaacacaatgagagccaaccaaagaccatcaaaaagcgaaagcttggtattgactatttcaacaaccaggagagtgatcccaagaaatctggagccttaagtaagtcgttaacattctattcccagtcttttttatttttcctttccatgcccctagcacaaaatcacacccctatgtagaagcttgattcatccaacaaaaaacaatgatgtgtatgctttcagatttcctgatttgtactttcataacagcggctttgtagcataattagatttattagtttgataagaaattaagaatgccaaggttctctagattcatcgataaattcaaaaagtaaagttttaactgctttgaaagttcaagaacaatgtgttgttttgccttctgtaagttgttagcttgttaaataactttgtaatctaactgatgaatgatgatattcgttttactggaaacctacagaaagttctctttgggagatcgacactttgcgccatcattactgtccaccagtttcacggtatatttgctcaccaaacaattttatccgatttttttaaaatttttacatttggtcatctccttgatacctcttctcacttttgtaggtttatctcatctctagaaactaatctaaccatcagatcgaaaaccacggaaatgaaaattgaagatttttgctctggttcatatgccaccatatttggggacgaggtaatgttgctctggttcatatgatatcaactctttgttgagaaaaaatcagttgactttggtcttccatttatagttgggaaactgtaaccatttgctgaactaactgtggagatttgaaaaattggcagattcggagaagggtaaagcaagttcctttagcgttctacaaaacggttccaacatctctgtttgcggattcagattttcctgggtggacgttcactattccacaagaggaaggcacatgctgatttctaagagtaaccaactcatgaactaaaaaaactgcaggctattcgaagatttgtgctaccaaattttgtagttttgatactgaatgtgtcacatacttgattttgagggaaaacaatttttgatagaaattttcggcccatgaaaacgagtttccgtccaattcgtatatcggagtaagagatgggaattgtgagaaccatgaaaacacctggaaagaaaaagtctaaagaaaaggtagtacgcacattctagttttgaaaatagttaaattgtttgacatcatacttaggaaaatagtttacatctttaaagtattaaaatagtataagatatattattttaaattctaatcttaacattcttaaatgatgatttttgttttcattcataggcaaaatatgagttttcgttcactaattggagtgcattgataaatgataataaattggagttttcgttcacaactttatatatatggtccaaatttcagtggagactccacacaaattccaaattattcctttgccattcaactttgtttgtgcatcattccaaatactactctcaattccctttcgttaatcattgcattcttttattcgtgcgttactaacaccactacactatctacgaacaacaccaattgtgcataatgtagttggagtttttctaaaaaaattatatatatagcaaattgaatatcatcaaaagtcactcaaggaaatcatctttaatcgatagatatgttcaagggttagttaaatatatgtacatatgagatgatataattaagaatgtatatatggaaagttgatatttaggtgtaataaaacgtgcaaatcgaatatgcctattttaatcctgttgttctgacatacatttagtgtataattattttgttagcatgctaaactagcatataacgcattatcgaaataatatcgttagcgaaatatggatggggtttgctctatggatgaaatgatgtagggtacaaaccaacttaatatgttaataatatatttgacgatataaacaaattttctgttattgaaccaatgattagatttcaaagactgatatatatgcgaaaacgataacattattattaaaaggtaacaaaaatatttgcatgaagagcaaaaaagttgacttgcaactcaataatcatgtaaaaaagtacatgcattagaatagttagcagataacgtattatcaggataacatgataacaaaatctcggtaatacttattaggttaacatgataacaaaatatttatataaataagtttataattatatcatgctaagtcattttgtatcgcgataagttgtaacttatgtgatatatttatatttaccgtcttaactcatttattatattatatataaaaaattaacgatttagtataacgtgcaaaatatgaatttcatccaataatattaatattatcactacatttaaataaaattttagttaactcggtaatttgattgttaaccaatttgggataaaaaataaaagataaaaaaatatagggataatgatgtaattttctttagtaatgtactatgtaaatagtgacacatttgtgtcagttaattttctctgttattctatgtatacttcttataaataccttatgttcaatcgttttgagtcaagaaaaaaaaaaacagaaataaaaaaaaacatttggtcaatcatctttactcatttgggtgaacagaacaaaaaaaagaaaagaaatcagtgttttgacaattcttcttcata

SEQ ID NO: 11052 - DNA, 3000 bp, Unknown
  misc_feature (1)..( 3000): cDNA_ID_2716861_gDNA_ID_2214477_Annot_ID_133136 3000 nt of promoter + ATG
tataaaaggagtagatacactcatcagtagcactggtcgtattggtttccaggttggttcttttgctgaaaactacatgaccgatgagcttaacattgccagctccagacttgtgcctctcgcctcccctgaagaatatgctaatgcgcttcaaaatggcactgttgcagcgattgttgatgaacgtccttatattgatctcttcctctcagattactgtaagtttgccatcagaggccaagaattcaccagatgcggttggggatttgtgagtcatccatcttctgaatatcttctctctttaccagcatgtttgaacataattctgatcacatttttgcattttctgttcaaaaaggcattcccaagagactctcctttagcagttgacatgtcaaccgcgattcttggtctatccgaaactggagagcttcagaagatccatgaccgatggctttcgaaatccaactgcagcagcccgcatgggtctcagtcaggtgactcagaacagctcaacgtgcatagcttctggggtatgttccttgtggttgggatagcctgtctcgtcgctctctttatccacttcttcaaaataatccgcgacttctgcaaagacacacctgaagtagtagtagaagaagctataccttcaccaaaatcttcacgtttaacaaagctacagacttttttagcatttgttgatgaaaaggaagaagaaaccaagcgaaggttaaagcgcaaaagaaacaacgatcattctatgaatgccaatagcattatctcgaggactgcatctagaagacccatatgattatccttatgattttgttcatctgtacatttcaacacacacctcatttgcaacaaaaatgagattttgtttatataccaccatttacaatcatctaagctaaagccaaaccaaagtggacaagcttaccggttcggttcagttcggtttgttgttaaaccgttggattttcactggtctgaatctgatctcatcactcactgcatctttaaagtaatcagctttactggagaaaacattaggttaggtggtcacgtttgttcatctctctcttatatatttgtttaaaggcttcgtctttgttcatttgcttttgttgatctcattacttgttcatcaatggcaagtctttgtttccaatctccttccaaacccatttcctatttccaacccaaatccaatccatcgccaccgttattcgccaaagtctccgtctttcgatgcagagcttccgtacaaaccctcgtcgccgttgagccggagccagttttcgtctccgtcaagacttttgcgccagccaccgtcgctaatttgggaccagggtttgatttcttaggatgtgccgtcgatggtctcggagaccatgtgactctccgtgtagatccctctgtacgagccggtgaggtctcaatctcggagatcaccggaaccacaacaaaactcagcacgaaccctctccggaactgcgccggaatcgctgctattgctacgatgaagatgttagggatcagatcggttggtttatcattagatttgcataaaggtcttcctttaggtagcggtttaggttctagtgcagctagtgccgccgcagctgctgtggcggttaatgagatctttggccggaaattagggagtgatcaattggtattagccggtttagaatcggaagcgaaagtctccggttatcacgctgataatatcgcaccagcgatcatgggtggattcgttttgattagaaactacgaaccacttgatttgaaaccattgaggttcccatctgataaagatctcttctttgttctagtaagccctgactttgaagctccaactaagaaaatgagagctgcattgcctacagagattccaatggttcatcatgtttggaacagtagccaagcagctgctttagtcgctgctgtgttagaaggtgacgcagtgatgcttgggaaggcattgtcgtcggataagattgtggagccgactagagcgccgttgattccgggaatggaagctgtgaagaaggcggctttagaagctggagcatttggatgtactattagcggagctggaccaacagcggttgcggtgattgattcggaggagaagggtcaagtcattggagagaagatggtggaagcgttttggaaagttggtcatttgaaatctgttgcttctgtgaagaagcttgataatgttggtgctaggcttgtcaacagcgtctccagatgatctttgtgtgctgtttgattatgttaagattggaactgtttgattatgttaagattggaaccaatcttgctctgtactgtaatttctagatgataataaagttctttgttttctacaccaataaaggacaacgttttatgtgtttgtttagctctttttggcttctgggagtatgaattgtgtgagacttgagagtatcacactctccaaatcagtagcaaaattgagtttcaaccttatgtagcaaacaactttagtcactgactagtggagcaaactttatagttgagagcccaaactataaggcccatgaaagcccaatttggagaagaggaggactcataaataattccggtaacggtaaagcaacgaatctatccgccggcatgaggaaacctaaattgaaattaccattttttctcttaaagattcgatttttccgccaacccgttcccgaaagcttggaactttatttgttgaaaaagtaaaagagagagccttgtgtttatttctgagccttgtctttgtccgtgagacgtggacgagcgatctccatcagaaaatgagaacccttcccacgtacacactctttgcctttccttttatagctttcctgtgacgtgtttcttcgtttctgggttttgggtttactagcgaaaacgtcaaagatcaacttttgttctgagagattacgattagggtttatcggggattttgaaacgatttttggtaagaag

SEQ ID NO: 11053 - DNA, 3000 bp, Unknown
  misc_feature (1)..( 3000): cDNA_ID_1808399_gDNA_ID_2214477_Annot_ID_133137 3000 nt of promoter + ATG
tcagaaaatgagaacccttcccacgtacacactctttgcctttccttttatagctttcctgtgacgtgtttcttcgtttctgggttttgggtttactagcgaaaacgtcaaagatcaacttttgttctgagagattacgattagggtttatcggggattttgaaacgatttttggtaagaagatgacaagagtcaagagtaaactagacgaggaactgtcgtctccttggttttatactgtttgtaccatgggaggaatgcttagtgccggaacaacccatttggctataactcctcttgatgtcctcaaagtcaatatgcaggtttgtgtttcctttctctgcttcttgacttcttcaaatctctaatcttgtttgtttcttctagttattgtctttttagggatgtataatgatcgatataactgctaaatttaggatcttttgcttttctctgagcttaaatttggaaccatcatgattgttcagtcaatgaggatcgatcattctctcttgtaggtgaatccagtgaagtacaatagcattccttccggtttctctactctcttaagagagcatggtcattcttatctttggagaggttggtcagggaagctattaggctatggtgttcaaggtggatgcagatttggactctatgagtacttcaagacactctacagcgatgtgttacctaatcataacagaacttccatatattttctcagcagtgcttctgctcaaatattcgccgatatggctttatgtccttttgaagccataaaagttagagttcagacgcagcctatgtttgcaaaagggttgcttgatggatttccaagagtgtatagaagtgaaggtcttgctgggtaagcccttttttcagaatcattctacttggctggctcactttgcgttcgtttttgagtcttttatctcttcaaatgcagcttccacaggggactttttccgctctggtgtcgcaatcttccatgtaattttactgcttcgtgcaatgcctgttttcacttaatctatttgatcatcaacgtctctcgttatcagtttgatcttaatcttattacaactctcaaactgtcagttatgtaatcaaatcattcagttttagtcattagcatatgagacagatacttgagctatagatgcacattagcatgtctgtagacttggttgtgttttctaccaaaaccatatcttgttgattatatcttctatgtggtttcagtttctatggtgatgttctcaacgtttgagcagtcagttgagtttatatatcaaaagattatccagaaaaggaagcaagattgctctaaagctcaacaactcggtgtcacatgtcttgctggctatactgctggagccgtaggtacaatcatctctaaccccgcagatgtggttctttcgtctctctacaacaacaaagccaagaatgtgttgcaggtcgactcttaaccatcattatttatcttttaaaatccatttcgaaatttcacaatcatgaagcaaagtattcttattgatgttggttatttgcttgagctttaggctgtgaggaatattgggtttgttggtctattcaccagaagccttcctgttcggatcactattgttggacctgtcattactttgcaatggttcttttatgatgccatcaaagtcttaagcggattgtaagtagaaatctctcaaaatttccatatcagaaactcgaatctctctgctccaaatcctcatctaaccagcttgattgtacaattgtgaaaattatagccctacaagtggcggagtgaagaaaccagtggatgcagctaaattatcagtgtgaagcttagaagagtagatctatctctatcaacaataaaaccaggaactcaaaacatacggtcatataagattctcttgcaagtagatacgaggcgttgtgtagcgattagaaggagctttttgatattttcgtttcatgcgcaaatgcatttgtcttgaacccctgcctgaaattggattgtaagtaaagtgctaatgatggatattgctgtaaacagaaacaatgatctttaactgattgatgtcaaaggaatgagtctggttttatctttggtatgctctgaacaatttttgtatgagaagagaagactgagatttgctgtttttagattgttcaatagcttccaagtactttggttttaggcttttagctaattagtttgtgccgtcttcatattttccccttcttctttgcaattttgctattttatggaagctgattatgaccaagcatcaatgaaggaatctctccactataacttatcaggttcacataactttcttaaaagtaaaacagtgaagaaccattcaccttccatatctccagagcaggttcattgcatcttagttagggtttaaccttcaaacttgtctttacactatcctaggattctattgttttcttgtcttctttgtattgctgcatttgattgacttaccactactctcttgagattggccaatttttgctgattaacagttcatttttgctctaagtttcatcagttttttttcttggcatggatgttttgctgaattatcattcgcctaatgagttacacaaacaaaattgtagattttcagagaaaacaaaacaaaacatatgaataaaaaagttatgcatatgatacgcgttaagaaaaacaaatgattaacgtacgtcggctgtgaagtgttgtttgatacaattgggggaagtgacggcacaatgggctggtttcacggcccctttctaagtcatacacgtctcctttttttattttcgtttttttcaaaataataaaaataatatagagagtggcatatccgacggtttaggatctctgccttttctcaacttatagtatataccaaacactttctaaggtaacatgagatatttcacatccttttctctcttattcgtttctgagattcccttcttgttgttgtagcc

SEQ ID NO: 11054 - DNA, 3000 bp, Unknown; identical to SEQ ID NO: 11052
  misc_feature (1)..( 3000): cDNA_ID_2716861_gDNA_ID_2214477_Annot_ID_183159 3000 nt of promoter + ATG

SEQ ID NO: 11055 - DNA, 3000 bp, Unknown
  misc_feature (1)..( 3000): cDNA_ID_2705209_gDNA_ID_2214477_Annot_ID_133138 3000 nt of promoter + ATG
tacataagttgttaaggagtttgttagtatagatgagtgaagatcacattgttaaagattgtttttatggatgcagggtgatcatccttgtgacaggcgaagaagcgtcactgagtacaaggctctctttcccgctattgatttctcaattgtaagaaaaacatcttatatggttaatatatatctctgtggaaatgttggcaagttgcttatgctttgacctctatggttttagattgaaaccgacaatgatgttctgtggaagccgagtccaagagagagccttgaagaagttgcagccagaggtgtagagttcatcaaatggtgagtttcatttttgttacttatttccacatggagatatatgtaaacatatgtatagctgaatctctctactgccatttgctttgtgaaggatatggacaaggaaagagaaggagatcgcaattgtatctcacagtggcttcttgcacggtctcttgagttctttcgggaaggattgttgcgatgacctaaagaaagagttgtctatacagtaagagcttaaacaaaaacttgatgtctacaagcaccaacaatttgtataacttgaaactgtttaactaatcaacatctttaactttgttcagtttgagcaactgtgagcttcgctcaatggttatcgtggatcgagggtaagcaataattacaataagttttgacagaatataaatataatttgagagtgtgttggattatttattatggtgttgggtgtgtaggaacctggggactgactctgcagagaccacaaactatcctgggaaggttcctgaaggacttgataatcctagtggctaaatggctgaagagtaagagagagaattctgagatagtttttctttctaaaataaataaattacatgatgtttccattggactagaatctggcattttcagttatttgatgaacattagtgttggtatgtagccatgtaggttgactctgctgctacatgaatttattgtatgattgttattatccaaaatttagcggtagctttaatatttctgctccaattctcattttagctgtgattatacaattgtggaaataatagcattacaagtagaggaactggtagatgcaactaaattataagtgtgaatcttagatgagtagatttatctctatcaacatgagaaccagcagaaacttaaaacattatttatgtaagatcaacttcatattttatggcagctgtgttgaattttcttatggccaagcattttaataaaacaaagagaaaattccaaaaattacactcagcttttcttatagtactaggttttatcttttggtgttgagattttttatgaaaatagaaaatgttttaagtgtttttatagaagtagatcaaagtttaatgctcttcgtacgttctatgtatttggactttaatataatcgataatcgtattcagattctttatagaaattacgctctctccaaactattggagaaagcttttaccattaggaattcgaaattttttgttccccaattttgaacatatgataagatcttttaaagaacactcgacaatgtaaaatttaaagtaggtctagcttcttatccgtttaagagaacgatttttttttttaaatgatatgattcacggtttgtaaagttatctattggaaaataaaaaaactgtaagtacaatactgtgatgtcaaaaagaaaaaaaaagtacacccaaactaaatttgtaccacgtgcgagacaaattgtagtctgcgatcttactcactacccgacaatgacatgccccatgccttagttcttgtaagaaaaaagtgatatcctatatacttcactaattattggtaaaattatgcaaaactttcagtgctaaaagtttgatttatactgtactagttgttatttcaacgtagacataccaaaatgtttattcaagaaagcctatatactagcaaaagtaaaaaagaatgtgacatctttgatgaaccaatgtgaaaagtcaacataataaaacttgagttttcagaacaaatttagttgtccattgtttcgatctgttaatcaagaccataaattaactcttaactatatgcatctaataataatattttgtagttagctaagttaagcacatccaactcttaaaaaaagctagtataacgttaggcttataatcattctcttaataataagttatcctaaacaaattattgcaattttttattctccctacttgcactaagtatcattacaccagtaaaagatgatgatcccttaaattaatactaattaaacaagcaattaaggaatgaagaaggtgagacgaaaccgcgtaaaagacctttcttctttgcaccatcctctctccttcatcatttcacaaatccacaaaagaatcaatctttttaacactctctaatgattcaacgaatccaattacccaaccagaaacagcaacacatatagagatatatactattaaacaataacataacaaagaaaccattttttctcttttgttattgacttaaacaaaaactatcaacgaataattatccttttttgagtttttcccatttcttcttcgtctccatttcatcgtcttctcgctgttctgctatattccggtactagatcctctgttttctcatgtttcttttattaccaaatgatttcttcatttattgttgtgtctttgattcttttttgggatctataatgatcgatgaacatttaaagctacgacttttcaggagctcttgtctttttttctttaatctttgattatgttacaaaacaattatgttttttgaagcttgatctgatgtgggttctttgatttcgttccaaagtttgatacttttttggcttctctttatctgattttttttgtgtatgtttgttcatgaaacagtttcgttggatgaggagaagaagaaagtgaaaaaagttgtgaaatagagagagtttgtttc

SEQ ID NO: 11056 - DNA, 3000 bp, Unknown
  misc_feature (1)..( 3000): cDNA_ID_2716859_gDNA_ID_2214477_Annot_ID_133141 3000 nt of promoter + ATG
aaaatgtaaaatatgttttgatatttttagctttattagaaaccgtgcgactaattttatagctattttgataattggttgagttatttttatttaatattttttgaaaaaaaatgtatgtcataacccttgtgttatagccaaaacatcaaacattttgaaacactagagctgttgacccagtggtaaatctctcatgcatgtggaaatgttgtatttgaggagataaatttaacttggtgtggctctcgtctctagaagatgtagactttcgggcttgaacttccagatattcaagaaaaaaataaaaaaaaattcatcatctctttatctcatagtaattttatttatggagatatataatcgcaattcagatatattattagttttattagtattatttaccttatataaaatcgcaatttttttatttttttgagttttgacatccaaaaggaaaataacatatactgtatataatttttggaaagcacttgtatgtacatatatttgccaatcattttctatgtaatgtttgcaggattacttctcaaaatggggagaaagtggggaagtggatctaaaggccgagttagagcgtctaatcaccttgactgctagtagatgtctattgggtcgagaagtccgtgaccaactttttgatgatgttgctccattgttccatgaccttgataaaggcatgcaacccataagtgtcatcttcccaaagctccccattccagctcacaattgtcgtgaccgtgctcgcggaaagattgcaaaaatcttttcaaacatcatagcaacaagaaaacgctctggtgacaaatcagagaacgacatgctacaatgtttcatcgactcaaagtacaaagacggtagagagacaactgaatctgaagtaactggtttgctcattgctggtttgtttgcaggacaacatacaagctctatcactgccacatggaccggtgcttatctaattcaaaacaaacactggtggtccgcggctttggacgagcagaagaaactgattggaaaacatggggacaagatcgactacgatgttttgtctgagatggattttctgtttcgcagtgcaaaagaagctttaaggcttcaccctccaaagatcttactgctgagaacagtacacagtgatttcaccgtgacaactcgagaaggaaagcaatatgagataccaaagggtcatatcgttgcaacttctcctgcattcgccaaccgcttacctcatgtctacaaagatccggaaaattttgatccggatagattttcaaaggaaagagaagaggataaagcagctggttcgtgttcatacatctctttgggagctggtaggcacgagtgtcctggtggatcatttgcgttcttgcagatcaaagccgtatggtgtcacttattgagaaactttgagcttgagttagtgtcacctttccctgaaatcaactggaatgctttggtcgttggtgctaaaggaaatgtcatggttcgttacaagcgtcgtcccttttcttaaaaaccttgttgcaacttttttttttttttaatctttcctttgatctttgtttgttatgttgcttgtttgatcgtatgctaataatttcactcataaatttcaacatctacaaaataaatgatatatatatatatacaaaaacaccacgaagtttggaatttggctactatttaaagtagtaaatacaagggtttatttgtaaagtagacactttttcaaaaataatttgcaaaataggtagttttttaaaaaattagagatatagacacttttttttactttttgtgagatagagaatatgtctaatagactaaaaaacaaaatacctatcaaatactaaaataccctttatcttgagagagaataaaaataatatgagagaccatttttattttattttgtttgtctttattttctatttttctttattttagttttcttaaaaaattatattgatttttagagtatttttatgtcatcaatttaatacacaaacatttcaaacatcgttttgtatactaactattattcattggtgtacaagtgtgtataccgatatttcataactagaggtaatgttgtttttaatattttacaaacataatgattgtataaaccaaatattattactcaatataatggtgtacatgatggtgtacataattaagttaatcttgatggtgtacaaaatgattgaaactattatgacgattggtgaatagaatggtgtatacaacttttaaatgatagcatataagattggtaaacaaagtgtacacttactagaaatgtataaatcattattttagttagtggtgtaaatcatctcgtacaccaatgttagtacactgttttatatatctctaaaggtgtacgatcatgtacaccatattttcaatcatctttgtacaccattttgtataccattgtaatcggtctatcacttcttacatcaatattatatattaacttttacattattatcgtacactaacatttgttcaccagttttaacaatattgcgtataccgtcggttgaaattaaataaaaaaatgctacatatttttgaaatatagcaaaattagtctttttagattaacataaaaaatttaaagttaatatgattatatggtaattttttatgaaaaattattatcaaacaaagtaaaaatatttaagtaaaaataaaaaagagaaaaagtaaaatttgacttaaattttgtttttatcttactacataacaaaataacaaaaggttatataaatcatttactaaatagagaggaaagagaaaagtgtctatttctaaaaaataactaaaaaactacctactttgcaaattatttgtagaaaaagtgtctacttttcaacttatctctaaatacaatccgaaaactgacccgtacatacccgacccggatctattagacactcgttcttcgtcgttatcaattcggagatg

SEQ ID NO: 11057 - DNA, 3000 bp, Unknown
  misc_feature (1)..( 3000): cDNA_ID_2705198_gDNA_ID_2214477_Annot_ID_133143 3000 nt of promoter + ATG
acaagtgaaacttacaaaggcaccaccaagtttatcaagcatccaatgcttaggagcattgagcctcttcaaatgcttcttcaaacctcttgcctgcaaaagaatatcgaacaaaaataaaaatcaaaacacaataaatgtttataatagctcaatcactaaaagtctcatcactcaagacctcaagtcacagaacaagagaataacgccagggaggtttcatatctgactaattgagtcctatcttttgagatctcaatatcaatccctaacccattttacagatcgcacaaaggaattcactttataaacattaacaattacccataattacatggaaatgctatctagattacaaagagagattttataatcccgcacaaaatgaattcacagatggagacaaactatccaaaaccaaaacaaacacatgacgcaatacgcttgtgaatacgagacttagagaaagagacgaagattacgaaccatgtttgcagcgaatgagttctgagttctccgcggctaagcaagccagtctcaattatatcttctagggtttgagaagaagcgaaacacaaagccctaattttaagtttttaacatgtgtaatccaaaaatccgctgccacacgtgtgacttatgttaagtacaggcccaatataggcccaataagagcccgcttttatttatttttcccactctgaagaagattagaaagcggaaaaaaaaacaaaaggtcgtgaatgtctctgtccctttcttcctcagttctcacgcaagcttcaacgagaaaagatcggaatctcgccgtcggtaaagcgccgccgtaagtaaaagacggaaaaccagaagaaggaggagattgtatttatgtgtagcagcgtttagtgtgaggaaggaggagattttgtatatagttagaatttgcttcgaagacgatgtcgctgagaattaaattagtggtggataagtttgtggaggagcttaagcaagcacttgacgctgatatacaagatcggatcatgaaggagagagagatgcagagttatatagaagagcgtgagcgtgaagtcgctgagcgagaagctgcctggaaagctgagctctctcgccgtgaggttcgtttttttttcaaattttgatttttagggcttttggagaatccggagaaatctgtgtggggatactgattttgttctgattttgacagacggagatcgctagacaggaagcgaggttgaagatggagagagagaatctggagaaggagaagagtgttcttatggggactgcgtcgaatcaggataatcaagatggtgctctggaaattactgtgagtggtgagaaatatcggtgtcttagattctctaaggctaagaaatgaggttggaaattggaatctggattctaaatttagggcacaaaaggaaaagatttgttcttgcgtttatgatggatgcaatgggaattgttggaatgatgcttggtttgtgtaaattattaattcaatgaagaaagtattgtgttttctggaaagagagtttgtctgatcacttcaagcctcaaggtgctttcttgctctattcaaacttttgttgattgctgtgtgacatgttgaaattcaggtttttagatcacggtatgtgtgaatgatgggtttagtttgattagtatagatgtttgtaggaaatacaggggcaacaccggaacatatctttccgttttcttctgttcttaaggatttttcatgtggttttgcttgaatgtgtaaacatcttgtggcatgaagagaatgaaaggtggccagggtaaagatgctaggatgcatgagtgagtgattattggtgttagtatctatcatgatttatggtgattgatgagagacaataaacaaatgtttttgggtagggattagggagatactagcatttagaatttcttctcctgttatagttagcttggtcttttggcaaagcagcacccagtagcaaacctaaggggtttcacttttcagaacatagggaagaagtagaaggttgtgcccgtatgagtgggcttgttagtgtttaagcagatagccagacagatgagctaggttccattatccactatgttacaatagtaataattgctttgctgctggaactaacattgtggtacagtgtacctatttccatattcttgctgtttcttaatttctttatctaggtttgtatatcttattccgaaggatgagtttttttcctggtcctgttagatttgcttgactcagaattgtgtccgacatcggtatgcatctatgaaaaggaaatatccatatgtttttctctacttttaacattctctctttgagttaaatctaaaacaaacttgtacctcagtggctttattcaagcagtaggtgttgtggctaggttggtattggatcactctaattgggagagcttctttgcttgtcaaggtgcctaggtgtggttttaccacttatgataagtagctgattacaattgtaaactcctgcaaaattgaacttctttatggcatatgaatgttttctataatctccagcttccttaccaaaacaggttactccttaatccaagagggcattgatattatgttcgacaaatacggttatacgggcagcaaacagcaagttttgccagagtttcaatggtttctacaattcagattgctgctcgagctaatatagccgaccacagataaggtatcaaatcatttgaagaccaaagatgactgattagtatagaacaaaaaacttaactttgcagaaacaaacaccacaaagataggaacttggctactatttaactaaatccaaaccaaacccaaagcaaaaaatgcaacatttattcgtgtggtagtggaatcactaatatggatctttgacccgtacccgacccggctctagatacacttgttcttcatcgtcatcaatcattgtatcatttctgaagatcatcacaagcaaagaaaatg

SEQ ID NO: 11058 - DNA, 3000 bp, Unknown
  misc_feature (1)..( 3000): cDNA_ID_2994689_gDNA_ID_2214477_Annot_ID_133145 3000 nt of promoter + ATG
catcggtagttgaggaaacggaaccatctctgaatcgctctccattttctttgcttgtgatgatcttcagaaatgatacaatgattgatgacgatgaagaacaagtgtatctagagccgggtcgggtacgggtcaaagatccatattagtgattccactaccacacgaataaatgttgcattttttgctttgggtttggtttggatttagttaaatagtagccaagttcctatctttgtggtgtttgtttctgcaaagttaagttttttgttctatactaatcagtcatctttggtcttcaaatgatttgataccttatctgtggtcggctatattagctcgagcagcaatctgaattgtagaaaccattgaaactctggcaaaacttgctgtttgctgcccgtataaccgtatttgtcgaacataatatcaatgccctcttggattaaggagtaacctgttttggtaaggaagctggagattatagaaaacattcatatgccataaagaagttcaattttgcaggagtttacaattgtaatcagctacttatcataagtggtaaaaccacacctaggcaccttgacaagcaaagaagctctcccaattagagtgatccaataccaacctagccacaacacctactgcttgaataaagccactgaggtacaagtttgttttagatttaactcaaagagagaatgttaaaagtagagaaaaacatatggatatttccttttcatagatgcataccgatgtcggacacaattctgagtcaagcaaatctaacaggaccaggaaaaaaactcatccttcggaataagatatacaaacctagataaagaaattaagaaacagcaagaatatggaaataggtacactgtaccacaatgttagttccagcagcaaagcaattattactattgtaacatagtggataatggaacctagctcatctgtctggctatctgcttaaacactaacaagcccactcatacgggcacaaccttctacttcttccctatgttctgaaaagtgaaaccccttaggtttgctactgggtgctgctttgccaaaagaccaagctaactataacaggagaagaaattctaaatgctagtatctccctaatccctacccaaaaacatttgtttattgtctctcatcaatcaccataaatcatgatagatactaacaccaataatcactcactcatgcatcctagcatctttaccctggccacctttcattctcttcatgccacaagatgtttacacattcaagcaaaaccacatgaaaaatccttaagaacagaagaaaacggaaagatatgttccggtgttgcccctgtatttcctacaaacatctatactaatcaaactaaacccatcattcacacataccgtgatctaaaaacctgaatttcaacatgtcacacagcaatcaacaaaagtttgaatagagcaagaaagcaccttgaggcttgaagtgatcagacaaactctctttccagaaaacacaatactttcttcattgaattaataatttacacaaaccaagcatcattccaacaattcccattgcatccatcataaacgcaagaacaaatcttttccttttgtgccctaaatttagaatccagattccaatttccaacctcatttcttagccttagagaatctaagacaccgatatttctcaccactcacagtaatttccagagcaccatcttgattatcctgattcgacgcagtccccataagaacactcttctccttctccagattctctctctccatcttcaacctcgcttcctgtctagcgatctccgtctgtcaaaatcagaacaaaatcagtatccccacacagatttctccggattctccaaaagccctaaaaatcaaaatttgaaaaaaaaacgaacctcacggcgagagagctcagctttccaggcagcttctcgctcagcgacttcacgctcacgctcttctatataactctgcatctctctctccttcatgatccgatcttgtatatcagcgtcaagtgcttgcttaagctcctccacaaacttatccaccactaatttaattctcagcgacatcgtcttcgaagcaaattctaactatatacaaaatctcctccttcctcacactaaacgctgctacacataaatacaatctcctccttcttctggttttccgtcttttacttacggcggcgctttaccgacggcgagattccgatcttttctcgttgaagcttgcgtgagaactgaggaagaaagggacagagacattcacgaccttttgtttttttttccgctttctaatcttcttcagagtgggaaaaataaataaaagcgggctcttattgggcctatattgggcctgtacttaacataagtcacacgtgtggcagcggatttttggattacacatgttaaaaacttaaaattagggctttgtgtttcgcttcttctcaaaccctagaagatataattgagactggcttgcttagccgcggagaactcagaactcattcgctgcaaacatggttcgtaatcttcgtctctttctctaagtctcgtattcacaagcgtattgcgtcatgtgtttgttttggttttggatagtttgtctccatctgtgaattcattttgtgcgggattataaaatctctctttgtaatctagatagcatttccatgtaattatgggtaattgttaatgtttataaagtgaattcctttgtgcgatctgtaaaatgggttagggattgatattgagatctcaaaagataggactcaattagtcagatatgaaacctccctggcgttattctcttgttctgtgacttgaggtcttgagtgatgagacttttagtgattgagctattataaacatttattgtgttttgatttttatttttgttcgatattcttttgcaggcaagaggtttgaagaagcatttgaagaggctcaatgctcctaagcattgg

SEQ ID NO: 11059 - DNA, 3000 bp, Unknown
  misc_feature (1)..( 3000): cDNA_ID_2705190_gDNA_ID_2214477_Annot_ID_133146 3000 nt of promoter + ATG
agaagcatttgaagaggctcaatgctcctaagcattggatgcttgataaacttggtggtgcctttgtaagtttcacttgtgttggattgaatcttattagagcttagttttcgtttgattcggtgcttataatgctatttctgtccaggcccccaagccgtcttctgggccacacaagtctagggagtgtttacccttggtccttatcatcaggaacaggttgaagtatgctctgacatacagagaagtgatttcgatcttgatgcaaaggcatattcaggttgatgggaaagtgaggactgacaagacttaccctgctggtttcatgggtgagtctgttagtgttgtgatacgttttcagagtctggctatagtccttgtgctgattgatttttatgcttcttgtgatcaatgatctaactaaggataaatatttatttacagatgttgtgtctatccccaaaacaaatgagaacttccgtcttttgtatgacaccaagggacgtttccgtctccactccatcaaggatgaggaggctaaggtttgttctcctaaatctcttacattgccatatactgaatctgtcaaaacaaagtcaagtctttattcattgctctatacttacattagaggtctgctgaatttgcatgttgattaccagtttgtaatatattccaacaagtatcctcttttgttgttgtgcagttcaagctttgcaaagtgagatcgatccaatttggtcagaagggtattccctacttgaacacatatgatggtcgcaccatccgttatcctgacccgctcatcaagcctaacgacaccatcaagctcgaccttgaggagaacaagattgtggagttcattaagtttgatgtgggcaacgtagttatggtcactggaggaagaaacagagggcgtgttggtgtgattaagaaccgtgagaaacacaagggtagctttgaaaccatccacattcaagactcaacaggacatgagtttgcaacaaggttgggaaatgtgtacacaatcggtaagggaacaaagccatgggtgtcccttccaaagggtaaaggtattaagttgaccatcattgaggaagccaggaagagactttctgctcaacaagcttgatagttaatactatgctctgttttccagtttcagaacaaaccatgctttagtttgcagcttttcaatgagtcacttttgttttaaaacttatcttttcggattgttatgagctatattttggaccttttgcgctattaatattaagtttgaactcaaccttgtttcttcagatagttattgaattgcttcgtagtatttaggggccattttgttaatgttagggtcttagggagatcacaacttctgctaaacaacagtaagataaatgtatcacttaaacatgtggtaacattctgattgatgtttcaaatttccgatctcgatgtcatatttcggtgtgggagacaaaacaaggtttatgggtttgctctagaaagtcttacattgattatggtgcacaagcatacgtgtctgctttaagaatactgaagtcatgttgatatcgttattgtcgctagcttcacgtggtagttgtggcgagtgttattttaaaatcgttagtagaagttgctcaaagattcttctccttggtgacttggtcaaacaaaaaatcctacaaaatgagaagaagataacaacaaaaacgacactgaagtcaatgtcgaaccaagtgcctcggaaatgcaactacagtcaggtatattgattgaaaacaatgtatctcttgtatgaaatcaaacgccatgcatgaatctgttttaagcttggggaaattataagagtaaatcaagaaaaatattctagatgatagaagcatagaacattgatcatgtaacttcatgacaacaagaaattgtcttcgaatcttttttgatggtttttctacattcaagttaaaaaaaatgtcatttgatgtgaaccggttcgacttagcatatggttaattgaaatccagcaaaataagaaaagacttgagaatatctaaagccaaaactgctgaattccaaaagccaaaataggtgttaacttatggtggatataaatataaatcatagagaaaattttacggagattgaataattaatacccgcaaaaggatcgggaaactgaatagcaaaaagacgagagagaatgagattttacttctttataattgaagttatgcgaatgttgtgtatttttacaatgaacggtttatcgttctttatatagagataaaaaaaaagataaaatttactgtgttggcatagtaacatttaaattttaaactacatcactaaataattagctttgaaagaatatatatttctcttagttttttttcttttctttttaagttattattaagaatgtggccaaatttacccaagagttaaaattttgtcccatcctttatattttaaggaaaaaattaatagttttagagattgatttttaccatttcaatttgggggaaaaaaataacaatctaaaagcattgaaggtttgaatttttgattcaaaaagacccaaaataaacgcctcatctttaggttaattttcagaataactattaaaaagtgaataattcttcactgatccatgttggactagtaagtagtaacaatcaaatccataacattaaatgtgttgaaaaaaagaatcaaaagtaacaaaaaccataaccctaaataatcatcccaaaagtggaaataataaaagaagcagttagattgtgacggaggagacaaaatcatcatctctgttcttcttcttctcctctctcacatacgatgatgacccaacaaccttgacgttgatttcgatgtcacacacaacactataaataacactcttcacctatttttgtcatctcacactttggactttggagcccaaaataatctcataaccattaaaaacaaatctcctccttctctccggcgtca

SEQ ID NO: 11060 - DNA, 3000 bp, Unknown
  misc_feature (1)..( 3000): cDNA_ID_2918714_gDNA_ID_2214477_Annot_ID_133148 3000 nt of promoter + ATG
acggtccagatttaaaacactaccccagtaaatacaaaaccaactgaagaaaaataaataaaaagtaaatttttaaagagtccgacccgggtccctcaaaaaaaaaaaactccgacccgggacaagatccgtatccaacaaacttatatgtgtatcggacacagaagaatactttccacgatcatcagcttctggagatctcttctgggaatcgagcttcactgttaaagattttccttcaatcggctaaaaatggtaacaatcgccactccctttgcttttgggcttctctgttatctgttcgaattttggatctgccttcgatcttgtactattgcatcgagtatctacgatttgatttgatgatgaaattgaatctaatcctccggtatccgtagatttctgcttggatctgtccggttcttttctcgcttacgaattgatcgattatttaggaagtgaaaggattagtttgtttcgtgaagcttgaaattgttatgtttctgttgcccattcgaatctcttgtgagttattaaatccaattcattgtttttgaaccactattgctcttgaagtaattaagcttcttggattcaaatgtaatagggtctaagctagttcatgtacctcacatctctttatttgcctctgtttctgaattggcaaaataagctcgttgatctctccatctttccatatctttaaatggtttaaaaacttttcttgagatgcttgtggcttgcgtttaggtgtatgatggtaaatgattctcaagttctggtacttgatctctcacaattccctcttttgcttgccttatgcaattatgtgcatttcaaatctttatgagttgccagaaatcgtgatatatactactggttttgtctggtcttgttttaattctctttatctcgatgctgtctttgtgattctagaattttctcatgcttgatatgggtgaggagacgtcaaaaactaattaatgtgttatgtattgccattcacaatgatagaataatgctttcttgaaaagaaaaaaaaaaacttctaaggtggctgttttgggttatgtttgtattttcagatacatttcgtgttactagtcagtcgacaagggaaagtaaggctcaccaagtggtattcgccgtatacgcagaaggaaagatctaaggtatgtacagcttaagtgttattgagttaatgccgcattatgctttgcatgcctatttaatcttacatttggaaaaatgatctggacaggtcatacgtgaactcagtggagtgattctgaaccgaggtcccaagctctgcaattttattgaatggagaggatacaaggttgtctacaaaaggtaatagacatattttatataagtagcatgtatttgctactttaaaaacaatggttataaacatgatggttttgtaattttgcagatatgcaagcttgtacttctgcatgtgcattgatgaggcggataacgagttagaggtactggagataattcatcactacgtcgagattcttgaccgctactttggcagtgtgagtaaacgcttatccaaaatatactcctaccactctatcataaccttacaaaacatctagattttgattaagagctgtttattctatgatcttcaggtgtgtgaactcgatttgatttttaacttccacaaggtatacatactcaactctatcaatgattctctactctctgtattttacttcaatatgacaattttcgaatctggttgttttgttctaggcgtattatatactcgatgagctgttgatcgccggagaacttcaagagtcaagcaagaaaacagttgcaaggataatatcagcccaggtatggtttcttaatcctaatgcccactgagacaaaaacgattagtccgtaagggttgtgtaaatgatgttgtgttataatatttgaaggatcaattggtggaagttgcgaaagaggaggcgagttccataagtaatataattgctcaggctaccaagtagtccttttctgaacttttcttatgcagctgaaacaatcgtaaatgagttaatattttccttaaactctgagatattctcttctgaatcacacttttgtttgtcatgtcatgtgattgtttgattgattagaagaaagaagcattcatcgttttgggtttaaaagtagtgattgatctgcgaaatcataaatggtatactattttttcacatatgttacgttttaaaacgtggaatgctgaaatttcatcaagttcatcatctcgaaattataatttgtccgattgattgaatagaattggtttttgagcctgaggactgatgcaccaaacaacatgccagtgtctcgttctttcttcttcaacgtgcctaattttgtaattcgggcgacctaacctcattttgtgtaaccgtgatccgccatgagaggaggtatccgctcgaagagttatcctttctcctcacaaaagcaacgccaatgtcccttttctcactttgccctgtttgctccttagtacttgtttcaccaaaataatctataggatttcaaatacatgaagaatgtttgatggtaacaccaaaaatagtggagaagaaacagacacttatgggcttgggctcaaggactcgaaacttgtatacccaaacttaaacgtgactgcgtcttgttcttaccaatccaataatttatagtaatgataataattcatctttccatatataattttttttaattattgaaattaaaaatgagggaaagaatatccgttttctttgccacaaaaacattttcatttgggggttttcataatttttggttcttcagctcctcaagcttcgataggtatcgatcgtcttcaccatacttttggattttttctgatcacgtttcaattccaatctgagagatcttccttgattcgatttctgaatatatctctgtaattttttttctggttttttctagggttttagtaattttccg

SEQ ID NO: 11061 - DNA, 3000 bp, Unknown
  misc_feature (1)..( 3000): cDNA_ID_2705186_gDNA_ID_2214477_Annot_ID_133150 3000 nt of promoter + ATG
tgagtgagagttttaactgtaaaactaaatatacgattttacaaaaagtaatataaataaattaagcattatttggaaaataatgtaaagctgataattatattcctaattttaaatccatattgtttccttaaagaatatttcaatataattgcaaaaagaaaagaaaggaaatatatcttccgacaatattatctgatgcgcgtgaaatagactatcaggccaagattaggtcaaaaagcccgtgagcccaaaaacctgagaaaacccggttcaaattgcaaaccctcgatttcatttctccaattcgatagacgctgggtaaaaaaattcggaggacgacgaaagagaaaacgagtgtttcagtcactgccccacggagctctcggaaatttgtcttccccttgtcgtcgtctccctatctactgcttcttcttcgttttcgtcttctttatcaaggtgcgctttagcttctcaacgccgtttgatttttagaatttcgatttttttttttttttcttctagttcttgaatcaatccggaatttggcgactatgttgcttcgtttgtaaatcgtattctcctgtttagaaatcttcaattgactgtgttataggaacaatttaaatctcaatttcaatgtctcttttagtcaccttcgtgtagtaatttgcttttgaattactgttaatgaatctcaaaaaatggattttataatttgggaaaaggggcttctgggtttaattaaagaacacgagataaggtctggttttttcttttcatttctttgtgtgtgtttttggtttctttgattttcttctgggttatggtccgtttgagtctggtgatagttagttggcaaccaatttttattgatctattacaatcgagaacacaaaactaaaccctaagaaagaagtacataaagttgttgaaaagatctcgttaactctcccaaagtcctagggctttcacacaaccagtgattaaataacctttgagctgttctccttcccacactttatatgtgtgtttgtggtttgtctaatttgtgaggagcttctatgaaacctctggttattttaattgttttctgcaattcctgattgatatgtttatatatatttcttgtatttgtgaatttgtgtaggaatgctgtttaattggaatcaacaatggagaatttgacggaaatagaatcaacgatggagagtttaacggaaatggagagtgagagagttgaacagggtaccgataaggaaattggaagtggagagaaaaggcaggatgatgtaaaggaaacggagaatgagaattctggagagagagtaggagaggaagctcctgtcagggaacatgaagattctccatgtctcattgttattgaagaaggtacttccctagcttcccttgaggaggtgaccaatgctgatgatctgccgaagattgatgatgagaagaattcccaatttgaaacaagcccgcatccaagtccttctccttcagtagctttagacactgaagaagggttaatcaaccctactgcagaagacactgtagaagagaacatagtgtctagcgaagtaagttcggatatcttgaaagatgacggagatgccgtcgaggttgacagagatactgcagaagtccaggaagaaacggccaacatacctgaatccaaactctcggaggacacaggatcacctcatcatcatgctgatattctgatggtgcaggaaaaagctgcagaagaacatgacatgatagcctctggagaccatgaagaatttccagtcaatcctgataacaaacactctgaagaaaatcagtcaccacatcatcatgctaataatgtgatggagcaggaccaagctgcagaagaacgtgagatcatatccccaggagaacataaggaaattccagccaatcctgatactaaagttgttgaggagaacaatgacaggatagatgagggtgaggctaacaatttgaatttggctggcgatggaagtggagcagtcgatcatgattacttgaccaaaacggagctggacaaagtgctagaggtgcctggttctgagaccatatcaaaactggaggataggccatctgagcatctctcagaaacctcaatgaacgtggaaaaagaactagaaatgcctgccgttgaaattttgccagacaatgacaaaaactctgatgtgttggcagttggagtttctggagacagtgacaatgtggtatctgtcttgcccgcttcccaaacttcctctgatcgtgatgaaggaatgattacagttgatgctgaacctacggaagacatgaaacttgatgttccagattctaaattggttactgatactactgttgactctactaataacaaggatgcccatgttgaggctaatactgaaaggcaagataattctagtgcacttgtgctaaatgatgcaaataatgaaagtgcaccagtgaaacgtgtacctggtccttatgttgcatcttccaatataaagtctgaagcgcggggtagtggagatttgaacaatggagtacataaaatagttcggaccccacctgtctttgatgggaccatgcgcgcaaagcgctctttcctcttggatgatgcgtctgatggtaatgaatctggaacggaagaggatcaatctgcttttatgaaagaattggatagtttttttagagagcgaaacatggatttcaaacctccaaaattttacggggagggactgaactgcctcaagtaagcttgatacccatcattatttggtcactttactgtgttacattttaaaattttcagcaggagctgatatctaatcaatttctttggcacaaggttgtggagagctgtaactagattgggcggatatgacaaggtacgggtcactgtgaatacgcctgttgaatgtcacagcatcttttttgacaagcaaatgtgacttcggcttttcatcttttgttccatcctggcttacttgc

SEQ ID NO: 11062 - DNA, 3000 bp, Unknown
  misc_feature (1)..( 3000): cDNA_ID_2705178_gDNA_ID_2214477_Annot_ID_183175 3000 nt of promoter + ATG
ttgaagccttagagaaaatcaaagctggtaagtgagcatatagccttggttttcttaaatctttttggttttggtttttaaatggtgactgattctacagagctgatgatccttggattcatttctttattactcacttttggagaaccatatattctcaagatctgtgttcctcgaaaagctgctctctctatgttaccttgtttatctgaagacacagtgcttttccagaaacttgctccatcatctcttagcaggcatcttttggctgctggtgatacatctattaattgcaaacaaggatctgagccactcataacattgaaaggcttgcaccaacttcacatcttgttgttcttcttggccatctttcatatcgtatatagtttaatcaccatgatgcttagcaggctcaaggtaccataaattctagttttgatcaaaactttgtttgatatagtgaataagtgcttcattttttgttggatttttggcagattcgtggatggaaaaagtgggagcaagagacattatctaatgactatgagttttctattggtactttgttcatcagattctgttttgtacccctgaactgaagtgttgttcttttacagacttacttctgttctgtggtgcagatcattcaagacttaggctcactcatgagacttcttttgtgagagaacatacaagtttctggacaacaactcctttcttcttttacgtcgtaaagaaaccatttctctcattcttcatctctttcaaatgatcaaaatgatcttcattcgatttattatatgctctttggttacagggatgcttctttaggcagttctttgtatctgttgaaagaaccgactacttgactctgcgccatggattcatctctgtgagtttttttttctaaatcttccatctctccatttccttctatctcaatcttgatatgtgattttcgtgatgttttgattcaggcccatttagctccaggaagaaagttcaacttccagagatatatcaaaagatctctcgaggatgatttcaagttggtagttggaataaggttacaacacaatcaaatcatcaaatgcaaatgaaaccggtcttacataatccggtcgtatataacagttttaacaaattgttttgctctgcagtccagttctttgggcatcatttgtaatcttcttgctgttcaatgttaatggtgagctaaatttatatctttaaatttaaattcaattcacatactgaagtctttctattcaattctaggctggagaacattgttttgggcatcgatacctcctctactcgtaagacaatctctccctctaatacatcttcttgaaagtttcttgatgaacaataagtatttttgcagataatcctagctgttggaacaaagcttcaagcaattatggcaacaatggcgctagaaatcgtagagacacatgcagtagttcaggggatgcctttagtgcaaggttcagatcgatacttttggttcgactgtcctcaactacttcttcatcttatccactttgccttgtttcaggtaattatgaaaacatcttctccttgatttcattcttgaactaacatgttttcgcagattctgtcttcttctagtaatgtttctctctctaaccggtaaatttatttcctctgtgttatgcagaatgctttccagataacacacttcttctggatatgggtaaagaaacatctattcttactttggtgttatagaatgatgttactgagtaacatctattactggcatttgcagtattcttttggattaaaatcatgcttccataaagatttcaatcttgtagtcagcaaactctttctatggtaaaaagcttattcataaacttacttatattatagaggaaaagtatttaaaaacatgtgaggatgtatgtatgtatgtatgtgcagcctaggagctttgatcttatgcagctacatcactctcccattgtacgccctcgttactcaggtaattaacttgtaaacaacagttttcgatcgatattttagtcgaatggtctattgaaggaaagaaaatagagagatgatgaaatggtgtgtggagcagatgggttcacacatgaagaaagcagtgtttgatgagcaaatggcaaaggcattgaagaagtggcacaaagacatcaaattgaagaaaggtaaagcgaggaagctcccgagcaagacacttggtgtttcagagagtttcagcctctcttcctcttcctctgcaaccactcttcaccgttccaagaccactggtcactcttctaacatcatatactacaaacaagaagatgaagaagacgaaatgtctgatcttgaagctggagcagaggatgctattgacaggattcaacaacaggagatgcaattccacaactcttagctgctttagtttcttctgttgttacttcatagttcaaatgaaacgatgctgtttactaacttagtcaggaaactattgtcgtacaagtgtttctttaatgtgttactacgtttaagccaatatagatatctaataacttgtcctaaactaaataactcgcactacatgatcattgttattattaatatagatttatttcgatttgaaaaatcctaacacgacatgatcatgttttcttcttctccttattatatgtgatccgtatcaaatacttaatcattgtttacgtcaatgcttgacattaacaaaattatcattaagctaaacagataaggacgcgagagatagagatagatagtgactaatatttttgaattatttaatgcagtttgagagaaagagacgaggaagaagaagaagaagaagaaaggaagtgacgaagaaagaatgagaagacgaagaaagagaaaacaagatccgattcaaaatatggaaacttgaatatcttcttcttcttcttccttctcctttctcatctctcactttgagggtgaattttgattttgtagaaa

SEQ ID NO: 11063 - DNA, 3000 bp, Unknown
  misc_feature (1)..( 3000): cDNA_ID_3038599_gDNA_ID_2214477_Annot_ID_183172 3000 nt of promoter + ATG
gagtctattgttcaccagaccgctagtcttggtgatgtcgaggtaaactgattcatacactgttagtctctcgtgtttctgacggtctatattttatacttaagtcggaatcattgatcgaggttagctcataaactctctgtgcattgatttcctgaaccaaccagggtttgaaagctgccttggcatctggtgggaacaaagatgaagaagactctgaaggaaggactgctttgcattttgcatgtggatacggcgaggtatgtcaacgtctcaacaagccttaacaaaaaaaactgtcgaaatgtcactatcacagaatcatggaaggcagtatatactaccaatatttactagcatcatgcacttgatggataagcagcttcggtttcacttagtagattattacacaattatctgtagcattctttacaaaggaaattgacagttgccattattacatctgcaattagaagttgttataaaagcttaatccgaagtttgaacccagctgacctaggttgagtttgtatgtaggtgagatgtgctcaggttcttctggatgctggagcaaatgcaaatgcgattgacaaaaacaagaacacaccattgcactatgctgctggttatggaaggaaagagtgtgtaagcctcctcctagagaatggtgctgcagtgtaagtttgcaacaacaagaacacaaattcgatttccaaacaacttagtaatggttatataagactcttttaagtgtcgtttcattttctgtttgcagaactcagcaaaacatggacaataaaaatcccattgatgtggccaggctaaacaatcagctagatgtggtgaaactacttgagaaggacgctttcctctgagctgctttgactcttgaaggatatgtttcttctctgtcatgtaatagtgtcacagagtctgattgcaaccttgtcttctgtgggggttttcatcattaaatctggaaaaaaaagatggagaaaatggatgtttattatggttttgtaatgaattattttcttcttgaattggttttttcttttggctcttaaagtcttttttgtccttctttgtgtgccacagggctttagtgttgcaatcacaaagaaaaaacccttaaactgttatattcgagaaggaatagactgtttaatcaaatcggtgataagataatttggagatttttaacatgccaaccgtaaattagaatgaagagtagaaagcccatagaggataacgatactaatagatgagatttgtacataagtaatgtgcagaatggaagtcgatagaatgaaatgcaaaagtgaactcaagaacagcaaagatgataaaacttggacctcaaatcatctttggctctttgctgtttcttttgttttctctcttgaaagtattattgaaaaaacagtaaaaaaaaactcaaaattgaggttacttcaatttaacaatagtaaaatcatcaacacaatttttttttttaaagacatcttaattttctaaaatggatatacaaaatcatatcttgcacctcggaatttggtccaccttagacgtttttagtggcaaaaattcccggatttatgtggattccaatattagtctaggtttcggcatagaattctcctggttaattaaaaatatgtatacaatgttataatttaatcaaaccaacaaaataaaaagagtttgtaaaaatttcaaaatagttctttcaaataaattctgaacagtcttttaaatttatttttagtgtttagtgtgtcatatgtcatatgtatacaaaaacttaatttaaaatttgttattttgagtgagagttttaactgtaaaactaaatatacgattttacaaaaagtaatataaataaattaagcattatttggaaaataatgtaaagctgataattatattcctaattttaaatccatattgtttccttaaagaatatttcaatataattgcaaaaagaaaagaaaggaaatatatcttccgacaatattatctgatgcgcgtgaaatagactatcaggccaagattaggtcaaaaagcccgtgagcccaaaaacctgagaaaacccggttcaaattgcaaaccctcgatttcatttctccaattcgatagacgctgggtaaaaaaattcggaggacgacgaaagagaaaacgagtgtttcagtcactgccccacggagctctcggaaatttgtcttccccttgtcgtcgtctccctatctactgcttcttcttcgttttcgtcttctttatcaaggtgcgctttagcttctcaacgccgtttgatttttagaatttcgatttttttttttttttcttctagttcttgaatcaatccggaatttggcgactatgttgcttcgtttgtaaatcgtattctcctgtttagaaatcttcaattgactgtgttataggaacaatttaaatctcaatttcaatgtctcttttagtcaccttcgtgtagtaatttgcttttgaattactgttaatgaatctcaaaaaatggattttataatttgggaaaaggggcttctgggtttaattaaagaacacgagataaggtctggttttttcttttcatttctttgtgtgtgtttttggtttctttgattttcttctgggttatggtccgtttgagtctggtgatagttagttggcaaccaatttttattgatctattacaatcgagaacacaaaactaaaccctaagaaagaagtacataaagttgttgaaaagatctcgttaactctcccaaagtcctagggctttcacacaaccagtgattaaataacctttgagctgttctccttcccacactttatatgtgtgtttgtggtttgtctaatttgtgaggagcttctatgaaacctctggttattttaattgttttctgcaattcctgattgatatgtttatatatatttcttgtatttgtgaatttgtgtaggaatgctgtttaattggaatcaaca

SEQ ID NO: 11064 - DNA, 3000 bp, Unknown
  misc_feature (1)..( 3000): cDNA_ID_3038603_gDNA_ID_2214477_Annot_ID_183171 3000 nt of promoter + ATG
taaccaacacttttttcctctcgctcttcttcgctactgtttattttcttcttagccgatggcgtgagaagatccgtaactcgacgcctcttcacgtcgttgacttatctgagatctgtgctctaatcggtttcgttgcttcgtttatctacctccttggtttctgtggtattgatctcattttccgatcttcttccgatgatgatgtttgggttaacgatgggatgattccatgtaatcaatccctagattgtcgtgaggttcttccgattaaacctaattccgtcgatcctcctcgggaatcggagcttgattcggtggaagatgaagaaatcgttaaattagtgatcgacggaaccatcccttcgtactcattggagacgaaactcggagattgtaaaagagcagcagcgattagaagagaagcggttcagaggataaccggtaaatccttaaccggtcttccattggaaggtttcgattacaattcaattttggggcaatgctgtgagatgccagttgggtatgttcagatcccagtggggattgcaggacctttgttgcttgatggggttgagtattcagtgccaatggctacaacagaaggttgtttggttgctagtaccaatagaggttttaaagctatacacttgtctggtggtgcttttagtgttcttgtgaaagatgccatgactagagctccagttgttagattcccttctgcaagaagagctgctcttgtcatgttttatcttcaagatccttctaatttcgagagattgtctctcattttcaacaagtgagttttgaaagtttctccttttacttagtgatttgagtgttgttgctgacttgtttgttgttctatatgttatagatcgagtagatttgctaggcttcagagtattacatgcacgattgctgggaggaatctgtatccgaggtttgcgtgtagtactggtgatgctatggggatgaacatggtctcaaaaggtgttcagaatgtcttggactttgtaaagagcgagtttcctgacatggatgttattggcatctctggtaaactcttctttccctctttggtgttgtctcgattttcgaaataaagttgaactctttttgattaatttggtgttatggtgttcagggaactactgttcggacaagaaggcttcggctgtaaactggatcgaaggacgtggtaagcatgttgtatgtgaagcttttattaaggctgagattgtggagaaagtgttgaagactagcgttgaggctcttgtagagcttaacacgctcaagaatcttgttggttcagccatggcgggttctcttggtgggttcaatgctcattcaagcaatattgtcagcgctgtgttcatcgccactggccaagacccagctcaaaacgtggagagctcacactgtatgaccatgattcttcccgatggtgacgaccttcacatctctgtttcaatgccttgcattgaggtataatgcatgttctatcttgaaattaaacccattattgcagagaacacaaagccgttagttttttgaattattgttggatccaactcatgaatgttttgtttattgatgtgactccaggttggtactgttggaggtgggacacaacttgcatcacaagcagcttgtttgaatctactcggtgtgaaaggatcaaacaacgagaaacctggctcgaacgcacagcaattggcaagaatagtggctggttcggttcttgcaggagagctttcactaatgtctgctattgcagctggacagcttgtgaagagtcacatgaaatacaacagatccagcagagacattggcccttcgtctcaagtcaacaggtgatgtttggagcacgatgagacggataataataaaacaacaaaaacccataattagatttgatgtaattctaacttcatttgatttcttcttcatcgatctcttttcttttctatctattttgtactaagtctccaaattttcttaatttatgtaaagtcttttgtccttccatctttatggcttatattaatatcatagcttagcatcaaaatgtgtaattaaattgcggtttaagctttaaagccatgatttttttttctaacattgaatagattattgtggcagtgtttgctttgtgatgattatgtacgtgacagagttaggtactactaataaatgtagaaatgtagttgtgaatattgcagacgatggaggagtgatatggtagtttgacaaatgaagcatttgaggcaatgaagtctctcctcatggcatgtgtgtgtatgggtctttgatgatatcttagaaagtaagcagtagagactgtgcagagagctaaaccaacaatcattattgattttaaaccaaagagagtaagagttttattattattgatttctgattacttctcttacaattgaagtaatgaattttatgttacgacaaatttgatcatttatatagacgtaaaaatgtaaattattatgcatgcatagtgacgctgaggctcatacaagttataatttactctcaatattttcaggttgcacatcaattgttgatattttgtttcctcctttgttctaacttttacaacaataatatctcattttgaaaaattgcctaaaccttttaataaaaagttgtgattttgttgcaatttttaatctgtaaaaatgcaatccgattaagtcggaccgtcagatcagtcctcatcttgtttgtttaacggtccagatttaaaacactaccccagtaaatacaaaaccaactgaagaaaaataaataaaaagtaaatttttaaagagtccgacccgggtccctcaaaaaaaaaaaactccgacccgggacaagatccgtatccaacaaacttatatgtgtatcggacacagaagaatactttccacgatcatcagcttctggagatctcttctgggaatcgagcttcactgttaaagattttccttcaatcggctaaaa

SEQ ID NO: 11065 - DNA, 3000 bp, Unknown
  misc_feature (1)..( 3000): cDNA_ID_2994689_gDNA_ID_2214477_Annot_ID_183169 3000 nt of promoter + ATG
tttaatgggattttctggttaaaaaacaggattgcaactgttgcctataagcttccagaaactactcttgatgtaaataagtcaaaaaccaagtaaacccaggaaagtcaacacaaacaacaaaccaacgacattagtcgaatttagctgaaagacgaaaagtttcctgagctttttgatatttgaggctaagagaagtagttttttggtaacaaaatcaaagcttggtctgacccatgaacatgaacagagtctgaatctggtcaaagtaaatagaaactaaataaggtcggaagagagaagtagtgagaagagaatgaacttgaaagaaggaatggaattggcgaagacgttgatccacgagatttcatttggagtggctttcttgggatcatcagaaggaaatctgtaaggaattgtgcaagctctgtagttgttttctattggcatcggtagttgaggaaacggaaccatctctgaatcgctctccattttctttgcttgtgatgatcttcagaaatgatacaatgattgatgacgatgaagaacaagtgtatctagagccgggtcgggtacgggtcaaagatccatattagtgattccactaccacacgaataaatgttgcattttttgctttgggtttggtttggatttagttaaatagtagccaagttcctatctttgtggtgtttgtttctgcaaagttaagttttttgttctatactaatcagtcatctttggtcttcaaatgatttgataccttatctgtggtcggctatattagctcgagcagcaatctgaattgtagaaaccattgaaactctggcaaaacttgctgtttgctgcccgtataaccgtatttgtcgaacataatatcaatgccctcttggattaaggagtaacctgttttggtaaggaagctggagattatagaaaacattcatatgccataaagaagttcaattttgcaggagtttacaattgtaatcagctacttatcataagtggtaaaaccacacctaggcaccttgacaagcaaagaagctctcccaattagagtgatccaataccaacctagccacaacacctactgcttgaataaagccactgaggtacaagtttgttttagatttaactcaaagagagaatgttaaaagtagagaaaaacatatggatatttccttttcatagatgcataccgatgtcggacacaattctgagtcaagcaaatctaacaggaccaggaaaaaaactcatccttcggaataagatatacaaacctagataaagaaattaagaaacagcaagaatatggaaataggtacactgtaccacaatgttagttccagcagcaaagcaattattactattgtaacatagtggataatggaacctagctcatctgtctggctatctgcttaaacactaacaagcccactcatacgggcacaaccttctacttcttccctatgttctgaaaagtgaaaccccttaggtttgctactgggtgctgctttgccaaaagaccaagctaactataacaggagaagaaattctaaatgctagtatctccctaatccctacccaaaaacatttgtttattgtctctcatcaatcaccataaatcatgatagatactaacaccaataatcactcactcatgcatcctagcatctttaccctggccacctttcattctcttcatgccacaagatgtttacacattcaagcaaaaccacatgaaaaatccttaagaacagaagaaaacggaaagatatgttccggtgttgcccctgtatttcctacaaacatctatactaatcaaactaaacccatcattcacacataccgtgatctaaaaacctgaatttcaacatgtcacacagcaatcaacaaaagtttgaatagagcaagaaagcaccttgaggcttgaagtgatcagacaaactctctttccagaaaacacaatactttcttcattgaattaataatttacacaaaccaagcatcattccaacaattcccattgcatccatcataaacgcaagaacaaatcttttccttttgtgccctaaatttagaatccagattccaatttccaacctcatttcttagccttagagaatctaagacaccgatatttctcaccactcacagtaatttccagagcaccatcttgattatcctgattcgacgcagtccccataagaacactcttctccttctccagattctctctctccatcttcaacctcgcttcctgtctagcgatctccgtctgtcaaaatcagaacaaaatcagtatccccacacagatttctccggattctccaaaagccctaaaaatcaaaatttgaaaaaaaaacgaacctcacggcgagagagctcagctttccaggcagcttctcgctcagcgacttcacgctcacgctcttctatataactctgcatctctctctccttcatgatccgatcttgtatatcagcgtcaagtgcttgcttaagctcctccacaaacttatccaccactaatttaattctcagcgacatcgtcttcgaagcaaattctaactatatacaaaatctcctccttcctcacactaaacgctgctacacataaatacaatctcctccttcttctggttttccgtcttttacttacggcggcgctttaccgacggcgagattccgatcttttctcgttgaagcttgcgtgagaactgaggaagaaagggacagagacattcacgaccttttgtttttttttccgctttctaatcttcttcagagtgggaaaaataaataaaagcgggctcttattgggcctatattgggcctgtacttaacataagtcacacgtgtggcagcggatttttggattacacatgttaaaaacttaaaattagggctttgtgtttcgcttcttctcaaaccctagaagatataattgagactggcttgcttagccgcggagaactcagaactcattcgctgcaaac

SEQ ID NO: 11066 - DNA, 3000 bp, Unknown; identical to SEQ ID NO: 11056
  misc_feature (1)..( 3000): cDNA_ID_3038615_gDNA_ID_2214477_Annot_ID_183165 3000 nt of promoter + ATG

SEQ ID NO: 11067 - DNA, 3000 bp, Unknown; identical to SEQ ID NO: 11055
  misc_feature (1)..( 3000): cDNA_ID_2705209_gDNA_ID_2214477_Annot_ID_183161 3000 nt of promoter + ATG

SEQ ID NO: 11068 - DNA, 3000 bp, Unknown; identical to SEQ ID NO: 11053
  misc_feature (1)..( 3000): cDNA_ID_1808399_gDNA_ID_2214477_Annot_ID_183160 3000 nt of promoter + ATG

SEQ ID NO: 11069 - DNA, 3000 bp, Unknown; identical to SEQ ID NO: 11062
  misc_feature (1)..( 3000): cDNA_ID_2705178_gDNA_ID_2214477_Annot_ID_133153 3000 nt of promoter + ATG

SEQ ID NO: 11070 - DNA, 3000 bp, Unknown
  misc_feature (1)..( 3000): cDNA_ID_2714595_gDNA_ID_2214478_Annot_ID_133154 3000 nt of promoter + ATG
ctctctgataaaaaaaaaagaatgatccagctaaacctatctcaggcagctgtcaaaatgtcttcaattcaacattcttacctcaaaacgttgatggaagatgtcgattgccttttgaacattgcgtgtaattagccccctcctataaagtaaaatacaaaatgtaacaacagtcaagttatctgaacaagaaaacaaaaaatcatagacagaagtatctgaaaaccacagactttatctttttggaatcaaggaagccacatagttcagcagtacctgccacataaatgatcacatatcagaagagaattaaacctctaaacgccaaagaaacacagtactccttctagattttcaactgctaaatcatcttatagaactcaacagcataaagtcaatgaccagtaaaggaatgatctcaaatcgtgatgtggggctctaagacaaaagtcaaacctccgttagaccataaagtcttcacttttaacaaatgttcattttatctttcagccttgaatttgcaatcttttctcatctttaactctacgaaattctcaatctttaacccattttacgatagattatcagacgaaaacccaaatccttaacacttcctcagcgcaaacacaaaatcaaaaataaaaaaataaagcagatgaatccgtaccaggcatgatttgaagcttatctattccttgtttctcataatcagcaatgatttcatacgccttctgctgtttatcaggactccacgactcaatatgatgcagaatatcaatcccactagggctctctgctttgattcgcttgtaagcatcttcaccaagaacagctctatacattgcggcgaaatcgatgaccggaacagtcagggttccgtccatatcgaatacaacacctctcaggcgagttttagcgttcgtcgttaaattcgccatggaaatcgaacaagaaggtctgagagtgagagaaataaatgttcttgataagaggaaagtcatggaaaagaaatggtgatgctcaaactgaaattgaggctcataattattctctatttttaaccaatttcggttcggtttaatttgaacaacttggtttgttttggtttagtggtttttcacttgagcatgtttgtgtatgtgcttaagaatggaaacaaagacaccaacaatctcaacaataatggttctgctgccttttctcttcttactctcttcctcttcggtaacggtttcttcttcggttcgcttgttggccgttcgggaatggtggtaccaagcccgtctaactcgtcccacccaccaaacttagaagccattccagctgaactacggttaactccacggccattgacattgtttctaacggttgatgggttgtatcgaatcctgctactacttctctccacttcttcttcttcttcctctatcccgaattgatttgctattgatgtacctctgcgtttatcccaaccaatcaacttctggaacgcataaaataacaatgatggcccgattgctacggctagtgacacgaggaaagctttgggtccggtgctgaagaaaagcgataagatgatgaatgggaggagatatccatacgatttgaatgcctacaaagtgaacataaaccaaacacaataaagatcccacaccaacaataagagagcaaaatctggtgtatgcaaataaaatgcagctatatatcaacaaagccgtttctcttatctttgagcagaaagacactatctagttagaaatcaaaactagttcagattcactacacaacgatattaactgtttcttacatgatcaccataaccattaccaaagaacaattttgatactttaatcaatcagcattttcaattagcagtagtagattcccggctaatttcataattaaggcttaaaagatgcatgattgaaactaattacctttaaaatccaaacattatctacaatttcctctaagatcttccacaggtcaaaattagcactaccaattccaccaccaccatcatcttcatcatcatcgtcttcaacattatcttcaaaaagttcttcccatagctcccgccgcttccttcccctttttcccctttccgtcaaacggtatcccctaccgtcatcagcggcggcgcatattttatagctgaatctccggcggttcagctgaattatcttcgccgaagttactctagagcatgaggaagagaaacagaggagttgagaacgagagggaggataagatctagggttgtggaatcgccagacatggaggtttgagaaactaagataagtagaagctcgcggtaacgaaagagctcctctatccgccattaacgtctggcgaagcgagaacagtgaagaaaatgctctgctccatgtatagacacactcaacttgcgccacgttgtcatcatctcctccattagaatcgaatactataaaccggcttggtccaggagaaatgttagaactgaaatccggtataattgcaggggtaatttcgagatcatcaaatgtctgacctgacacgcctacgtggattctcttttctcttcctttttccagaaacgagggagagagagacgaagcatcaaacaaggcaaaaacaaaaaaaaaccaggagagaatattccgagggaaaacgcgagaaaatttcttacgttctgcgagaatctccagctttcctggggaaatattggaaggcaaaagccgaagggtttaaggtctctgtaatcgtcggagaaatttgaaatatcgtccgtaaaacgtgaatgtagtcttaatcttccgcatttataacgtcgatcagagattttgaagctagtagagagagagaagcgttttgtgtttgatttatggtgtttggatccatggtgtggaaacaccagctgattgggttctcagggattttttctaatgtttctcccgttggaaatctttattcgggatcatttctaggaaaatcagaccagatttggccgtgataatg

SEQ ID NO: 11071 - DNA, 3000 bp, Unknown
  misc_feature (1)..( 3000): cDNA_ID_2705308_gDNA_ID_2214478_Annot_ID_133155 3000 nt of promoter + ATG
ttcaaaactttatatcccaggattgataataagcccttaagaaagaagccgttattgtaaacctaccaatcaaacaatttagaatagacaatcttggcaagagcatctctgcttagtgctgcactaccgggatcaagaggctttgtaatgctttcaccacgagtcaccatcaccctattgcacaaggagttctctagagctttctcatcacacctacccaaaaaagagcaatcagggttctacctcccattgacaagaaacctgtaatccgagaacacataatagtgaagcatatacatgaaaagttttgcagcaacttttagatggaaccgggatttatcgtccttgggttctgcaccatctgattcttcgctctttgcaaactcaatgtttcctagatgaaggatagcagcaactacccgaaagattgcatcctacaaaagtaaaatgtaagaagagttatcctcattgctgatcatgtcaatgaaaaaacaaaaggtacctgttcttcaggactaattccaacaacgtccatagctttcctcgtagctaggtattctttggaatcatcaattgcatccaatgcatggcaattcgattgatttaggtagtgaaatgtgcttggtttccctaactgataccgctcagtttcctgaaatttcagaacagaagctagttttcagtatgaatcccatatatggccaagcactggacatacagagccttcatatgttcgacctgatgtaaacatacaagggaccatgtttacctgttctggcgcagcgcaaagcatgtaaaagcaatgatagtttctttcaggatcagaaacttgacaaactcgtgacctctccagcaaatatgttctaatagcagctcctgagattcttcccatatgattgaactgaatctccacaaatttaccaaaacgactgcaatatgagatttgcctacatatgtcaaggttgacttcaagaacatacataaacttgaaaaatcaagaaatgtgaatgacattccaccttgaattattgtttctgacggtttttgcattaccaaaagcttctaaaactggatttgactgcataacaggatcataatacgagaagaataagaagatatctacagagagaaactcagtgagtctgtctctagtaagaatgtagatgcattgtaaacagactatctacctccaaaacttgctgttcgacagatcgtccttcactctcagcttttccacccatgtatgcaagatattgcatgagcatttttgtgctctctgtcttcccagcaccgctttctccactcaccaagatcgcctggcttactccctcgttgatcatttttctaaatttatattcttgatgatggtgaggcccaaaaaaaaatgatagtgcaacattagttaaagtttcatctatgcaacaaaagattacctgtatgcagaatcagcaacagcaaaaggatgtgggcttaactcgccaaaatctgtgcccttatattgctccattatctcatttccatataggtggggtaatcttttaaagggattcacagctatcagtatattccctgtgtatgtctgtaaccatcaagaagaaattagcttgctacaaacacttcagagaaatattaatgatattgctataactgtgcagtaattttcagcaaaacaatggtagagataatcatagaattcataagtgggtgtaatgaaagaaggaaaactgacaagagttacatgctgaagcgtacatatatttcatttgcattgtatctggcttttagattgagaagaacccctggttcatgcaaatacgcaagctttgtcatgtcgtccacaccaagctcaggaaactcaggatccttggggtggacagcattaacctttgccacaacctacaaacaaatgcatcacaaatatgagcaatgtattcttaaggtaccttaagaactaacacattgtctcgttgctttggagaaaagggactaaccgtcttggtttggcaattaactttgatctcttgaccgttagcttccacaacttctccatctagccaggcttcatctggatcttccacccagacctgtgaccccacagttaccttcactgaagcctgattaaagtagaatatattagaaacaaataaaaaaaatattgtcaagcttcattagctggttcttttgttctcttttagacacatcttataatgaaatctaaaatgtaaggggcaacataaaaatcagctcaaatagcaattatggttacagaagataaaaaaaaaaaggtaaaaatgaagaacacggagaaatcgcaatgcagataagagaagagagactcgtaccattatcacggccaaatctggtctgattttcctagaaatgatcccgaataaagatttccaacgggagaaacattagaaaaaatccctgagaacccaatcagctggtgtttccacaccatggatccaaacaccataaatcaaacacaaaacgcttctctctctctactagcttcaaaatctctgatcgacgttataaatgcggaagattaagactacattcacgttttacggacgatatttcaaatttctccgacgattacagagaccttaaacccttcggcttttgccttccaatatttccccaggaaagctggagattctcgcagaacgtaagaaattttctcgcgttttccctcggaatattctctcctggtttttttttgtttttgccttgtttgatgcttcgtctctctctccctcgtttctggaaaaaggaagagaaaagagaatccacgtaggcgtgtcaggtcagacatttgatgatctcgaaattacccctgcaattataccggatttcagttctaacatttctcctggaccaagccggtttatagtattcgattctaatggaggagatgatgacaacgtggcgcaagttgagtgtgtctatacatggagcagagcattttcttcactgttctcgcttcgccagacgtta

SEQ ID NO: 11072 - DNA, 3000 bp, Unknown
  misc_feature (1)..( 3000): cDNA_ID_1582654_gDNA_ID_2214478_Annot_ID_133161 3000 nt of promoter + ATG
aagtaatatgttttgttttttcttacaattctgatatactatctgactgatgtagacaatgttttgagataagttgatttatataagaatgcaataaatttccatttttaacagtcgtatatctaaatttttgtgtataacttccttaattatgtcttcggattttttttaaaaaactcgttgatatatactaacggaagcaataaattctttaattgctaaagattaataaagttgtaaccttttttttgggtctttttctttaaagatcgttatgaaatgggtatggaccatgctagtatgctactaattcaaaatagtacattggctatctaaagttggactgtgtgaaatagtttattctacaatttaagacctttttcaggtaaggagaaatcacatattagaactaagataatcttaaatgtcttcgagtgatcatttactttgttatacaaagacaatttccttttaatatctactgtaaaacatattaatatatcgacaatattgtttagtctcaaagtctttatgttatggtcctaataaaaacactaatttttctacatattgattttagtctagcatgtagtatttttatcactttctaaaaatcatgactagtccttaatcttactttacagaatacaatcctcttgcaaactaatactctcattatatatcttttcttagaatagttatatgttactgttgggatgtttataatataagatcaatcaaatcaaacaaatatgtatatttatttatatacatctacaagcgtgaaaattcatttggaatgtcacatatgttacaattttggaacgtttatactttatcaatatatatatatattaatatatatttacaagcgtgaagtcatctccatcatttatcttcaaccatttgattacaagttatgtatcatgaatctgcttttgtcttttccttatgattccaaatgatattaaccttcaacttgttgcatgttcacaagagacaaacacaattcacggtatatttgatcaattgtaattcgttacatacataactttaattcattgaaatatacacgaactagatcaattaaaaaattcaggacgttgaaaaagctttacaaaagaaaagaatgtataacttttcctttacacgaatagtaaatgagaaaaactcacatctacaattttcgttatcgtgttaaatagtatacaaatttaaaccactttttgagcatttagacctaagttttattttccggagataagctgttattttgctctgtttacgttttcttttgcatcactactcttatgcatatgtatataagtcctcactttactcattaataaatttcttatttaaactaaaaaatcatataccgaagttactataaaacctacgaattctctctaattcataaacatttgtaaacagcattcattaatactatatgatagataataaataactgttcgtataatctacttatttttcttatttcacctttacagacaaccccacagcccacttgggtatcgactttatagttaaagcaatgttcgtgccttttgtcctataaaggaacgacacaggtagcgcctaagaaaaaaataaaaactaacaagtgagtaaaaatgcaaaataagtagaagggaaaaagaaaaaacgagtataaaaatcacacgcaattctagaacaaacgtagataacgtgaaaaacatagaatcaactatttgatattgactaactgttagtgtacttggaactgtgagaataagtcgctttgaagtctgaagaggttcaggtgtcctgagtttctaaataaataaagagaacaaacttgtacttgttttttggttgtgaaatattactgtatcttaatactgtgaaatttcaacatatttcttgaaactaagtttggtatttctagcaaatccatcaatagagtatgaaattcaatgttctcatttagtcatgattttgatcaaaagagaattttccacacatcaattgcgattgaaaaagttttcaaaggatcatcatagctcacatcaagaaacatgatgatgaataatctcatcaccactatttatttaataattccttataatgaaaaccaattttgttctcactttatttggaacccatcatagtctagtcctccacgaaaaaaagaaaagaaaataaatgagcatatagtgacccaaaactaaacccaaattcaactttttttcaaaactggtacttagctatacgttttcacatatttaacagttgttactatgaacatgatataaagcatagctaaccagataagatcaaacgcaacgaatacaaaataaactctaatatagcaatcatcaaaacgaatacaaattcttgcaaaaatagaaaagaaagtgtgatgcaaaaacaaagctttccacaaatacaaacacataacacaaaaacaacagtttatatatttaatatagtttaataagatatgtttgttttgtttatcatatttttttataaacacaggagaaaacaataaggtaaacgggagcacgacaagtttgataatgtcgggaagaaaagttaaaaagaatttctttgttaataataaaattagggaataaaaaaagggtaaaagagaagaagaaagaatggcattgttgttggtatggccactaccagacatatgggtcctactcttctcatcactctctccaccacctaatcctctctctctttcttcttcctcaattcttgaaactctctttcagatttcaagaaacccttaaaatcctctctctgtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatg

SEQ ID NO: 11073 - DNA, 3000 bp, Unknown
  misc_feature (1)..( 3000): cDNA_ID_2705295_gDNA_ID_2214478_Annot_ID_133163 3000 nt of promoter + ATG
ggaactcttacagtccgttccatgttcttttaattcatatactttttgtgtaactttagttaatgatgctttattcaggtgcgagctgtaactgtgcatcccacaaataaatactttgtctcggcatctcttgatggtacatggtgcttctacgatctgtcctctggctcatgccttgcacaggtccctaaacactttccttaaagaaccaactaatacctgttttcctttctagctttgcctgtatgctatataacagaaatgattatatatatttacaagaaacaattgtgtggattatactttcttcatgagcattttcatatcagctaaaatccgtggttcggtgtatggttagagtacgagctcctttactcatgaaagcctttgtcatattccttgtttttattcaggtatcagatgattcaaagaatgtagattacacggctgctgcttttcatcccgatggtctcattctcggaaccggtacttctcaatctgttgttaagatttgggacgttaaaagtcaggtaaaaactatgggcttccaaactatatgacctattaaaattattaattgtgtacagtgttcttcattatagttttcatttttttggttgataataggcaaatgtggctaagtttgatggacacactggggaagttacagctatatctttctctgaaaatggttacttcctcgcggtgagtactttgaacaaaatacgagaagagagaatacagcttaagttatgcttacatgaatgattttctttttgtcctggaattgacagacagctgcagaggatggtgttaggttgtgggatctgcgcaagttaaggaacttcaaatcatttttatctgcagatgcgaactctggtacacaactatcgtatctgtttctactcattttgttgatagagaactttctatgtattataagctcgctttgattaaacctactttttttttgtgtgcagtggagtttgatcctagcggatcttatctcggtattgctgcatcagatatcaagtgagtacacatttgaaaatagtgatcaaaacatccaaagctcagctaaagaaaatatccaaagagaccaagctagcttgattaatctgcacgttgggttaacacaatttatgtgttttggctgcagagtataccagacggcaagtgtgaaagctgaatggaaccttatcaagacactcccagatctctccggcactggtaaagtcccttacctaactccttcaatgatcacatagcgataatgttgctaatttcgaagcccttacacttgcaggtaaagctacgtgtgtgaagtttggttcagatgcacagtacgttgcagtcggttcgatggaccgtaactacggatatttggtcttcctggtgatgaaaaagccaacgtcgatgatgactctgcgcaagactcgtgaacaatccgtaaaaaactcagacagaacattccaaatgtccatctccagtgttatctcgctcaaatttctcaagttctgttgtatcttacagtatttgcagcaatgggggagaatttcataggtgcgggtcatgagtgagtggtgattgtgatcatcctcgctacctcttggaattcaaacaatgacactcacaaaccctcgagttttcttataggctcttttaatcgctttgtaccttcaatatatgtaccaaaaaatgtgttctttctgttgccaaatgaattcagacactaatgaagatcccaaaccgatggtgctaaaccgcatttggtattatttaatctgttctagacagtggtggtctgcttagtattccgtattccaacaaatgatttcagctggtctctgagaacaaaattttaactaaatgttaaagaatacccttgactgtacttggtcaaaaatcactgggcacaatatttacatttatccacgaatatcagattcgtgattccttttgcaattccaggattagtttaacttcacgcaaaagataatgttttgtaataccctttctttattgtgaccaggattgacaattcgtgttaaggtataaccacgtgtttcctcacaattctaaagaatgcttatgtttctccctgtctatattatttttttaattttgtctgaaaatactaaaataacttgaacaaatcatcgtataaaaactacaaaatacataaactaagcttaaagaaatacctacacgatgaactttttatatagtaattagtaacaactacaaaatacataaccttactagctactgggaaaaaaattgtccagttttagatgatcagagtaaatataatactaattgtcttccattttaattattgtcgaaaacgtgttttcataaagtaactattattgggtttcattactaaattctaaacatcaaatggaattgaaaccaaaagagtagttattctaattttaaaaagttaggtgttgaataaacagtttaagtgaaatctaataatcaaagactgcaatacacacaccaagctcactgtactgtctttagactggtcagtggtggctgaagaaagaaaagagtgtttgattgttatattaaaaaataaagaaaacaaattacgctcccttctctacagactctctctatcctaatcctatttctttttccacatctcctaaagaaagagaaaagagtggtcatccatccatccacagcctcttacaaaatctctctctttcaccattaacaccaaattcagaaaactcagaagaagcaaaataaagagcttttactgatccaccaaacacagaatttcataaactcccaaaaaagttaaattccaaacaagccccacaacaacaacaacaacaaaaaagattttaatctttctcatttacccatatcctcaaaattcccacaaaaatctttcctccaataacataacaaaacaactcttcttctacaacaaactatgttctgattttttagtttcttcttccacacaatacaaaagaaatg

SEQ ID NO: 11074 - DNA, 3000 bp, Unknown
  misc_feature (1)..( 3000): cDNA_ID_2705291_gDNA_ID_2214478_Annot_ID_133164 3000 nt of promoter + ATG
tttgtggaataatattggaatgagtgatgtatgatgaacaagaaaatccatggaagaaattcaaatattgggaggaaaaaacaacaaaaactgaaaaaacaaagaggtaattgaattaaaaacagaacaaaggttcttctgtttggacagagaagaaattcaaattcttatagttttctggaaaaaaagaggttatgggagtttcacgtaacaatcatacatatatatatatacttttggttttatgtgtatgtatatatttgtatatactaaactaatgcatgtgtgtttcagtgtatgtacaaattattttcacataatttttataatatattccagcgtggacttgatgcaaaaatgtgataccctcgattctcctcttcacatgacgtggaaagcccacgtagatataatggtgttgacgtgggtaaaggatctcacgtaggaggaaactatttagaccggtcaatgagtttgacccaattcttgttccgtggattttgacgtttttgactgaaaatcgtcctaaattaagccctatattcgtggaattagtttctatgtttttaatttagatatgcatttttctatcttttatctcgtttgctaattttattgacttggctcatgatttcccgcaaaggagagaaaaagatttcgaccaggtcagtaaagtattagaaaatagaagatatctaaagtaaaatgctactggacaaaatgtctttggacaataagcatattatttgccttaagaaaatatttagggatatcagataaaattcgaaaacaatgtttaaccaacttcgaacattttttttaataaaaaatatgaaaatgatttcatatagaaaaatgctttgattgtgacagtttgagcatagggtcaatgcattgttattcaaaattgagaatatttcactttcgtacacttttgttattctaataaccataaggtccataacagaaaaaaattaatatgagaagatatgtgtgtagagactacaggctacatgctcgagatctcattatcggtacgtaagacacaaacaaaagtacgagtcgtacgtgttatccatcaaactataacttacgagtgtttatttcacatttatagtcttcaaataggtaaacacggattcactttttgtttaagcccacgatttacatttgtacttgtgttgccgataaaaataaaatattattttaatggttttgaaagcgtttttggttactatagtagatcttaagtgttttttgtatttcacttatttcattacatggaaaatatagttctcttctttttatttgttctaatcatgagacatcaacatcgcctttcagtatcttattttggtcacaaaagtctatctaccatttgaaaatcattgtcaagagtctatctagttattctatgtccaaaaatattattacttcactttcaagtcgtctgcacaaactaaattttatatgaggttttttttttgaacacaaaattgtgtatgagcttaaactacactacacacgtgcataatagcgattaagacacatattataaggattatctgggtgtagaagttcagaatttgggattacgagaattgcaataaattgtttacagattaaaatttaacgaaaggaaattaaaataaaagtaaaacagcttaagatcaaagctgatttgatgaattgatacttttgaagatatgaccatcttcatataaagtctgaaatgcaatatatgcatcacgcattatccaaatagaaaacgaccaccactttaatttcaagatataaaaccaatacctaaaatgaagaaaatttatatatgcatgtgcatctgtaatatataatcaaccattaattatctatatataattacgattcaccaatattaattacataatctcaaacgttatacgtacgtattatttagggttgaaaacaaaacaaaatgtcatgcgtatatgaactatacatatgcgtcattagctcgttcttcaatctaggtttaatatgaaaaataattttttcttcataaatatctttttcttggagcattgttttttttttcttttttctttttttcttggagcattgtatttgtatgagagttcgctttcatctttggatcctaagaatataacttttatgcaaatagaaaggacacagctattgtgcttaggatggtaccctcatcgtcctatctttagacattaaaaataaaataccattgattttgaccttaggtatataatttgtatatcgaacccgtggaggtcgcatttgcaacgtgaatccataacgatataccaacagataaaccatatctctaattgtcaatgaaatgtacaaacatatatcccttattctttcatcttagaacatatttttaggatctcttgaacggttgattttgtttgttgtgatcgaggatatgttgttaattgttatttgattgttggtgagtatggagtgttggtgggtaatgggtataagataggcgattaagatgcaaagaacaaacctacctcggtctcattcgatatttgtgctcgttctttagattaaaacatagtcgcaacaacatataacaaaaaaaaatctgtaacaaaacaatgggtttgttttataatctaatgagtaaatgtacatgaatcaaccaaaattactgaatgcccaattttagttcaacatgagttaaaacagattttaaaactaatataaaacgtcgtcaatttcaaattctaatggttggatcgatttaaaagcccaaatataagaaggtgatcgttaaaggcccaattaaattgaatccctaatatatcaagtgagagtgttaatcgtcgtctctctcttcaaccatttcccggcttccgcgtttttgctttgtagcgccggaccggagaagataaaacccttgctccgccccactcacaggaagttctacatcgacctgagttctcgtacttcgtcgtatcactcgttcttcctacgatg

SEQ ID NO: 11075 - DNA, 3000 bp, Unknown
  misc_feature (1)..( 3000): cDNA_ID_2705289_gDNA_ID_2214478_Annot_ID_133165 3000 nt of promoter + ATG
ctagattgaagaacgagctaatgacgcatatgtatagttcatatacgcatgacattttgttttgttttcaaccctaaataatacgtacgtataacgtttgagattatgtaattaatattggtgaatcgtaattatatatagataattaatggttgattatatattacagatgcacatgcatatataaattttcttcattttaggtattggttttatatcttgaaattaaagtggtggtcgttttctatttggataatgcgtgatgcatatattgcatttcagactttatatgaagatggtcatatcttcaaaagtatcaattcatcaaatcagctttgatcttaagctgttttacttttattttaatttcctttcgttaaattttaatctgtaaacaatttattgcaattctcgtaatcccaaattctgaacttctacacccagataatccttataatatgtgtcttaatcgctattatgcacgtgtgtagtgtagtttaagctcatacacaattttgtgttcaaaaaaaaaacctcatataaaatttagtttgtgcagacgacttgaaagtgaagtaataatatttttggacatagaataactagatagactcttgacaatgattttcaaatggtagatagacttttgtgaccaaaataagatactgaaaggcgatgttgatgtctcatgattagaacaaataaaaagaagagaactatattttccatgtaatgaaataagtgaaatacaaaaaacacttaagatctactatagtaaccaaaaacgctttcaaaaccattaaaataatattttatttttatcggcaacacaagtacaaatgtaaatcgtgggcttaaacaaaaagtgaatccgtgtttacctatttgaagactataaatgtgaaataaacactcgtaagttatagtttgatggataacacgtacgactcgtacttttgtttgtgtcttacgtaccgataatgagatctcgagcatgtagcctgtagtctctacacacatatcttctcatattaatttttttctgttatggaccttatggttattagaataacaaaagtgtacgaaagtgaaatattctcaattttgaataacaatgcattgaccctatgctcaaactgtcacaatcaaagcatttttctatatgaaatcattttcatattttttattaaaaaaaatgttcgaagttggttaaacattgttttcgaattttatctgatatccctaaatattttcttaaggcaaataatatgcttattgtccaaagacattttgtccagtagcattttactttagatatcttctattttctaatactttactgacctggtcgaaatctttttctctcctttgcgggaaatcatgagccaagtcaataaaattagcaaacgagataaaagatagaaaaatgcatatctaaattaaaaacatagaaactaattccacgaatatagggcttaatttaggacgattttcagtcaaaaacgtcaaaatccacggaacaagaattgggtcaaactcattgaccggtctaaatagtttcctcctacgtgagatcctttacccacgtcaacaccattatatctacgtgggctttccacgtcatgtgaagaggagaatcgagggtatcacatttttgcatcaagtccacgctggaatatattataaaaattatgtgaaaataatttgtacatacactgaaacacacatgcattagtttagtatatacaaatatatacatacacataaaaccaaaagtatatatatatatgtatgattgttacgtgaaactcccataacctctttttttccagaaaactataagaatttgaatttcttctctgtccaaacagaagaacctttgttctgtttttaattcaattacctctttgttttttcagtttttgttgttttttcctcccaatatttgaatttcttccatggattttcttgttcatcatacatcactcattccaatattattccacaaatcatccttgaagcctcgttcattaattttcttgctataattcatattttctcgggaattttctttattttcccagaaagttttcgcattaacattggagatatacaaagaacacaaacatgttgcaagacatgatctcgtctcactctcacgatcagctttccatcgtaattctcttctcattattgctttcatttttattcatgcaatgcgtagatgtttttgtctttgaaattttgcttacatgtatagatcatataaactcgagtctaatcttataaactgattaatttttattccgtagtcttttattcggcaactaccctataatttcagctagtttttcttttttggtgtaacgtcattttcttctacttatattccatttgatcttcttataaattgcttcattcttttcgcttttctttctttgttattctctccgcacttcaatttgtccttccatgcgatttttttttgaacaatcattatcataattctcattggcatacgattattacttataaaccaatagaaaatcgtcacatgatatggaacaatattgttctacaaaataactgtaaccataattcactatatctatcgtattttagtatagatttttattctcatcaaacgaaaaatgctagatttaatctctcaccttggattttatgcaaaatctacatattacgtgaatttcactaggagcattgtttgttatcatgatgggtttgtatatgatcatgatcataatgggtttcacacatgttctgatattttatgaagtgccctttactttttctttgtgggaaaaaaatctggatgttggttcataccaggcaattttaaattattttgtcaatacgaaaaggaaataccagaatcagaaaactttccgtttatagaaactccactcttctttactttatctttttagctattggaagtaattggaacacttcttcttaacatgtcacataaaagaacag

SEQ ID NO: 11076 - DNA, 3000 bp, Unknown
  misc_feature (1)..( 3000): cDNA_ID_2705285_gDNA_ID_2214478_Annot_ID_133166 3000 nt of promoter + ATG
cgataaatacagttttataatcttacggtcgaataaatgcaaagtgatttctttttttcttttttgacagcgcaaagtgatttcattgtttggttccttaatttatcgtataatcgaagtgttcagagcaaacaaaacttatcctaaaagtccaatgagttaaaaatttcatcatggctataattactcttttgaaaattaaaacatccgatcttgatctatatagatgatagacttacacaacttgatcacgacacaagtcttatcaacttcgagtctattttataacttattttccagaacatctacacgtgtgtcaaaaatcaaaaatatcgatagatatgattttcgaccagacacactaacgaactataaaatccaagaaataagactaaatcacatgcatgaagaaacatgtattctggttgatgcttcacatttcctttttaaaaaggttaatgagattagtgcaaacaaatggaccggatttggtggaggagaatcttagagtatacaaaccagagcatcaattttataatacgtacggtaggtcgactgaatttacacgtatatttaaagtcatatagatatatatttacaaacatataatcttctagatgaataattgaactgacatttacgatcttcaagaagaataatacacatatgtagtggaactaaatttcactatactattttatcgaaatttacgtatttgaattttgaaatttaaataaaaatgtaagtgaaggtgcaaccaaatggtcgagtcaaccatgtgccacaagctcacggtccggaatgagacaaaacagttttgtaattttgttgggttggtccatatattctcaatattcgtagataaaatatcaatatatgttctaaagcctccaaatgtcaaatattttaatcatgtataaaaaaggcaaaatatgtattgtagggtttgttttaaaactttcaaacaatatataggtttaatttaacctttgccattattgtatacggagctacctactttggaagtcgaccgttttctaacaaatcactcaatatctatctaattaaaaacctaccatttttataacacaatcatacaatttaaaaacctcttattttctggttgaatgtttatattagtcaagtcagtattgcatgtttagtacaaatttgttaaaatttaacaacaatcaaattgcaaaactaactagagaatttagaaactttgttgaaactcgtataataaatacatgcttgaaatttaagaaatttcttcttttgatgtgtaactaaatcttattacaattaatactacttttgtctttttttcttattcgtatcttttttttttccttaaataatggcctaactcgatccggtcttggtaaacatcatggacacttgtataaatttcaatatcaaaattggtcatccaaaattttctaatgatcgggctaatttcgttagcaaaagagttatatactaatcaactacatataagaacgtccaaatcaaaacctaagcacatgaatttgaatcgatccactacatcatccatacaattaacataaaaaagttctaaaaaatcaataattgaaaaaagaagatctaatgaaaaaaaaaactttaatgaaaataaaataaattaataaagaataaagaaagaaaatagtgaaaatagaaaaagtaaatagtagaagaaaatgggggagttaataatgtgggcactagtctctgaaacagtaacttctactactaaaaactcctgctttttcgccaacaagtagccatcactaccttccttttgattccctctctctctctcgatcgtgcccaccagctcactcaccctcctaaatccacactttaaactaaaaaaccctaaatctcgagccttgacacaagagagaaaaaagaaacacacaacacaaagaagtgggtccgcatttgtaagaatcaccattccttagtagtggccatagtcaagtgtcaccacacacacaccaaaaataaagacgttccttttttctcttcgtctccattggtacttacttactagtcagacattaacgtgcctttgtgaaaaaccaacccatctctttccctctctctagaaacccagagaagaaaactcttgcttccaagcttttcccactcataattgcttattagaaggagaaattttgcttcttttcctctgcttcctcttaacatagaagaaattggagacacggaaggaagaagatcgcaacaatccagaattggtggaggagattgcttcgatctaatcacttcttcttccatcctccaggtatagattggtttttaaaaatctgttcttggagttattactagtaactagcttgtgggttcctttttactagattggctttggtacatgaagtgattcagatagagaattttagtttctaggtcactcctgagtaaaattcctacctttctactttttctctgttagcttgagttaggtgcttattcttcaaatgtttctttcgagcttggaaacttcatcaaagttttagctttttctgtgattcaattaatggctacatctaaaaattcaagcttttctttgattgtcaatattgtgtagggttcttcgtttttagctttttgttgcttttaggtaagagattaggtcatatttaaagaccttgacttttccgcaaattagttttgttagcattaagagtctcaaattcagcttctatttgaaacagtagatttctgtatagtacattttgggattctgcacaattttgatttttgacaatattacaaaatacaaaggttgttgaagatgtcttgtgtccaaaatagttaaaatcttgttcacttttgacttaatatgctcacttgttctgttcatgtttgtctttcagattacttggaacttggaagtggtctttcttcaatctgtataagaagatgggaagttgaaatttgctcggctttgatttgagtatagcgagcggaacg

SEQ ID NO: 11077 - DNA, 3000 bp, Unknown
  misc_feature (1)..( 3000): cDNA_ID_1808535_gDNA_ID_2214478_Annot_ID_183228 3000 nt of promoter + ATG
aagatgcacgtgcttttgcagctgctttagatgcttcttttgagtcaagttttgccagcttccatggattgatccttacttgttgacgctgaggtggcttcttctgtgaaagtgagtcgggatctattgtggatcgtacaggtccaggctccaaatgctggataacatcgtcctggcaaaacaaaatttattatacaactgaagaaagcggaaaacagaagagatttggtgtttttacctgttggtccacgaatatgtttgggggtgtacacaaggaggcaccacggtattgaatgctcaatccgagagagcttctagcactcgtggctgtcacagctgagcttgcaggtgaaggatactggcttgtttggtctagctcatctacagatgttccaagtggttcagtttgcgctctcagggcaacaacatattcatatgttgtgattccctacagccacaaaagtgacatatcaacgctcagctttgtgtttccttatgtgtttgtcagtggagcgtagaattcaaaaaatggtgcaagaaaaagtatatacaaaacctttcggatcaaaatcatatggaaaaagaaaagttccccaagaggtatcaaagccagtaacgagagagttgtacaaacaacctgcagaatgagaaagcaagctcaagtcggaaactaagcattgatagaaaacagaataaaccagtattttctttgagaatacttaccacaacagcggcaaatggaggacgggagaacccaagcccaagcttttcagttataagatgttccatcgccttttggtccacgaaacatcgaacaaatacagtaacaccaactccaaattcagctataagctgacaccatatttgcaaagtcatatcatatggatatgttaaaatattatcagatgagataaagcgtaggcagaaacaaccttaaaataacaaactgtgttggaaacatacccaaaagaagcttgctgccataagacacacaaagctgatgtagtttttctgccccacacagttattcagccactaaggcaaaaagaaacttaacatatcagtttaaattgctaagtcagaaacccaacaaaaacaataaaattttcaagttgcttacccggcaatggtgatcaaacccatctacacacttgccacaacttcgacagtgcttgctaaacatacgtaccttcaagaaaagaatgtgctgttacagtacaagatgcaatgagaagcttctaaccagaaggtaaaaatgtactatacctcagcattgcacaatgagcagaacaaagcttcttcttgttcgtttgattgctcttgttgggtatctctacggcaatcttgtattactaaacaaccacaaatgaatcttcctatagcactacagcaacctgagccgtgtctaatatatggcccaccatcaattgctgaagcattctctgcaacagagacatcactataagaaagaagtatccgatttatgtaagccttatacacaacatcatcgggtagagaacgtaccaggaacatagttactgttctgtgacttatgagctggagtgttatcagccttcacaaagattccaggatctgcaggatctataccagtgcatcggatgtaaagaactaaaaccgaaaacgcctgtaaaatcattatgcaaactctatgaataaattgccatagtgatgagagatgtgagataaagaacaagtttaatgcaactgagagcttagtgtaacaatgtttcgttttaggtcttaccaggaaagagtaaacaccaatggcaatatattcatagagtttgtttccaagaaatggagcaaagaaggcatagtaagcgacagttagcaagaaaaatacagttatggcaacaacctgcacagcaacatgagcaacagaccatgttagataaccatatacataaacttaaatgtgtgttttatccacaaacacataaagcagaggaaaaagaaaagattttgaaaactatgtgaatactatatcacaacaaagtaaactaccagatacgaacaaaacatttgatgtcattttcaaaaggattagaaaaaggaacaaacttgtcacaatagcagattacgacaggaatttcccaaatcgttaaaaccaaagtcaaagacagaacccaatcaatactctcagtgaagtattgtaaggaaaaaaacctgaaatgtgtgagctggaagttgccatccatgtcttctcgccattgcaatgaagaaacccacaacccctaattaatttatctcgggaaaccagataaaccctagattactagaggaaatatcctaaacctaaaaaccttgaactcgttaaaaaattgaagatcaatagattttcgaaattctttttttccccctaaactcagctcctacactaacatcatgagcttgaccgagtgtatagcacttgattaagtcgactagtgaggaaaatttcaggacttaaaaggttcatctgcttgaattttatcaatcagagagtgtctctcggggacgaagtcacaggcagttagagatataaatgaagaacattaaggactggtttagacttacacaagaattttctttttatttctgaaattcacaaaaattcgatttgttaatatatttatttttaatttaacagttttctaatattaaatttgttaataaatttttaattcaatagttttactcttgttcaaattatctcaatcaaacattaaatgttaatgtcaaatagaaacatatttctccctattgttttttctatctttataaatgagattatatagtataattagcaaattacaggatgtttgtccataatggggagaaaacaaataaaagtataaaaaacaattcctgatcaaattagttaagttaaagtgtatacgtggcaaaccattatagctagctgggtttggaagaagtcagagacgccgtgtcgtttctcatctcgccggtcaacttttgagagagagaagaagaaaaatg

SEQ ID NO: 11078 - DNA, 3000 bp, Unknown
  misc_feature (1)..( 3000): cDNA_ID_3034366_gDNA_ID_2214478_Annot_ID_183227 3000 nt of promoter + ATG
tcatcaattaatcagccaaaacaataagaatttcttttggaaaatctttcaaaaacatgcattgaaaatataaaacgataactaatttaatacaaaatttaatttctaaaacataactaatttagaaaggagtgagtgatatttaaaaaaaataaagaaaaaacgaaaatgttttttttgtgggacaagttaaaagtggtagaacatcaatttattagaaacaaagagagtgtatttttctttcttccccatcgggaaaccaaacccaatttatttatatattaaactcgtacaatataaaatcttttatatttaactaaaaattcagtaaatatccattcttcgtaaatatttaaactctattttttctttttaaaaagatcaatttacatcttaaattcaaaatataaaccataatatattatgtacatattaatactgcattctaaacaatttcccaatataaaaaataaaaatatatagaggtaaataacttatcataactactttattgatggcctttataattagtttctgctttggtagaattttttagttcagcctttatctcgttatctgcatgtctctaattgagctttgttgctaagttttagcttttttttttcttatgcgatcactttgctggttgttgtgttggttggttcggttccttgtacctttgatgtatcctctatttctctttttatctaggttaagcttttttattaatgaaatattaagtttgattggaaaaaagaggcacattaatagaaagttagctttgttgtttaggttttatttaatatatgtacgtgtgtcatatgtcataggtaacaatcttactatttgattattaagccggtttttgcgtgacggaactcttcttgtatttgccatcaagtgaaagaaagaggaacatctttgccatagtttagtttgcactctctattggtagcttgagttttcagctattcgaatgtggccttctacacctgcttcccttctatttgacatacttatcatgtggtaagctaacccatccgtcaacgaggaagtacaccacatatagtaagtatatatattagactatctagatattttgttaaagattttatgtaaataacttataaaatatattgttattgttttccaaaacaaataaactagttgacacatacttcttaagttcattgttaatttatataatacaacaacctaaacccatggtgatgattacctttagatcactaaaacttttatcaaaaattttgcctaattttcagtagattccatcagagaaacagcttttctacaaaaaaatttcaccaccaaatctcttttctttaaaacttatcaccacaaacacttgtttttctactaacttttttttaatattgtaaaatcttacaatattttaaaagttaaattttgcttatttcacgtcaatttatatgtctcttacaaaaataacaatatttctgcatcaacaatattttcgagtcattaatatatatgttttacaatattgtaaaagctaatgttttttaataaatcttaaattcattgtcaatatacaacaacttggacccctagagatgattacctttagatcaccaacacttttatcaaaatgttttcctaatttttagtagattccatcacggaaactgttattctgccaaaaacaattttacaccaaatctcctttctttaacatttatcactaagactttttcactaacttttctttcaatattatgaaaattaaataataaattttacaatattttaaaagttaatttttgcttattttccacgtcaataatatatgtctctttaaaaaacaacaatacttagcttaaaaagtattatatttctagatcaacaatatttccgggtcattaatatctatattttacaatattgtaaagctaaaaaaaaaaaaatctatcttgcgtgtcaataataaatgtctcttactaagaaaatatcaagattttgtctaattactaattagaaaggaagcactaatttttggggtgaaaaaatatgatttctggacaattagataaaaaacaaaaaaataattggactaaataaaaataaaagataaaagtgaaaatatttaaaaaaattggggataataatccaaataaaaagatttggtcactgggacagattccgcactatatatatattcttgtctaaagaaaataaaaaaccctaaaaaaaagaggcagacagagagatctcctctttgtctttttactttatctcctgaagtttcgcctcagtcatctcgtaagttttctctctctttctcattcaattcaatttttaatgtaatttcttgtttgatttttctattttcttcgagaaaacaaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatggtacaaatcttgtagttaaacactgaattgtgtccctcgtgggcgttgttgctttgatttatggccaaaagtttcaaacttggatatggtacaatcttgtagttatacactgcattgtctctcttgggtgttgttgttgctttgatttatggcttaaagtttcaaactttttcttggagatggttcaatcttgttgttgaaagttgaaacactgaattgtctctcttgtgcgtgttgttgcttagatttatggctaaaagtttcaaactttcttcacttcagagcttcttgaatggaaactatggttttgtggttttggttaatcttctgctaacactttttgccctgttttggtttgggaaagtgagaagaaa

SEQ ID NO: 11079 - DNA, 3000 bp, Unknown
  misc_feature (1)..( 3000): cDNA_ID_3034370_gDNA_ID_2214478_Annot_ID_183226 3000 nt of promoter + ATG
acaaacaacacatctctctgcttagttttgtacactcaaaaccatccttgacaattttttgagcgaaaaccttttgtcttgagaacagactaattgctgtcagctcattactgatttcattcaataagcaatgacacttacctttagatcagtgttttgaagtttctttaagacctaactttgatccaacctctacttatccaatgttagatacattgatgcggaagatagagtgaaggtgagttcagagaaattgcagaagttgggttggacttaccggccgttggaggaaacacttgtggattctgttgagagctaccggaaagctaagcttgtggactgaaaacttggaaagaagagcaaaatagtgttttagcttcatatgttatagttatagtgttccattctgcacacacacacacactctctcatcgtttactcaataataagagttgtgcattcaccatggatttctgagtttttgttattttctttttagatatcattacttttattaccaatctacaattttctttccataatattttacaatatctctctattgtatatgttgttccaatttctaccgaaatcttactttcaaaggataaaacacacaaacttttatctcaattggtacgtcttgtttctgtataaatttgttaatcattgtagaaaataacataacaaatgtggatttaagctgaacataaatattaatgctttttccgatgaataaaattagtcgaacaaaagttgagatatggagctgaagcagagatggtcaaagtcaaacaaatagctaccatttgcacaaggaagaatcttcttctcatttgggtgatcaaaaatggcggttgtgcagaaaggaaaggtttgtgtaaccggtgccggaggttttttgggttcttgggtcgtcaatcatctcctctctagggattacttcgtccacggcactgtcagagaccctggtactactctcctcaccttttatctctccctctgtaaattgtcaacctttattctctcgcatttctagttcatcgaatttttgtagctcagcctggtcaaaattgattctttcgtctactttctaaggttttctattcccaattctttttgtagctccgatgtttctgtctacagacagaagattaagccttttgagtttgtctattgttctgatgaagagtttcgcatggttcttgttataggtaatgaaaagtatgctcatttgaagaagcttgataaagctggtgacaaactcaagctcttcaaggctgatttgctcaactacggctctcttcaatctgctattgctggctgcagcggcgtcttccatgtcgcttgccctgttccatctgcttcagtccctaatcctgaggtgaggatttcatttttacaatctcattggtggctatatgcattgtctcactatggtttcactggttttgcaggtagatttgatcgcacctgcagtggatggtacgctgaatgtgcttaaggcatgcgttgaagcaaaagttaagcgtgttgtgtatgtttcctctgtatctgcagttgctatgaaccctatgtggtcaaagagtcaagtgttagatgagaccgcttggtctgaccaagattattgcaaaaaaactgaggttaataatgcatcttgaatccctcatctcacttttttttcttcttttaaatctgactttcgtccctctggcagaattggtattctttgtcaaagacacgagcagaaagtgaagctttcgaatttgcaaaacgaaccggacttgatctcgtcagtgtttgccctacccttgtcttgggacctgtattgcagcagcacacagtaaatgctagtagccttgttcttctcaagcttcttaaaggtattataaacaagcctctcatttcatctgggattgttagaagcagcaacttggtatatgagttggtattgattttatacttaagtgtggtgcagagggttatgaatcgcgtaataaccaagaacggcatttggtagatgtgcgtgatgtggctcaagctttacttttggtttatgagaaagcagaagctgaaggaaggtacatctgcataggccacacggttagggaacaagaagtcgctgagaagctgaaaagtctttatctaaattacaactacccaaagaggtaagcaaacaacagctgcacatctctctacccaatttgagtgaaaacctttaaaccttaataagctgtttttgttactttcatcagtaaacagtgtcacttacctttacatcaatgtctctgaagtttcttttagaccttacctttgatctaaattctacttatccaatatcagatacatcgaagcggatggaaaagtgaaggtgagttcagagaagttgcagaagttgggttggacttaccggccgttggaggaaacacttgtggattctgttgagagctaccgcaaagctaagcttgtggactgaaaactgggaacgaatagcatatgagtgttttgggtccatgtgttaagtgttcctatctgcacacgctctttcatcttttactcaagaataagagttgtgcaacatattttccatcatgaacttctgagtttttgttactttcttagacaccattacttttatgaccaatctacaattactccttccataactatgttccaatatctctttgatacgttccaatttctacctacttacaaaggataacttcaccattaatacatgaaatcagtaacgcacaacttcaccattcgaattaacctctaagcctagcgtagcagatgcactacatcttggctgaccatgggactaaaaaaacattcgcaatatttaacaactaaagccaggttaatggacctgtattagggcccaaaccaggcccgtttagatatccgactttttttttaactttgcccatctcgatagctagattctcttttccctcttccttctccggcgaagttgcgttagttaaacagagagtc

SEQ ID NO: 11080 - DNA, 3000 bp, Unknown
  misc_feature (1)..( 3000): cDNA_ID_1808370_gDNA_ID_2214478_Annot_ID_183225 3000 nt of promoter + ATG
ccattgattgatgcccaactatacgaactggtctaaggttcttctggatctcttctctgacaattgcttgactttgatgatgattcgatttggaactgaaattgcaagaaaagtaaaagcaggcgatttgattttgattcgcatttgcttggtgaacactgccaaaggctaaaccggtcgccgagacggttaatctgatgtttgggattgacacatcatgcggctgttgtttctccacgtaacatttggagacccgctcaaatatattgtgggccggagaacattgttttaccatatagggcccatagactttgaatatgtgtaggtaaataaaatacaatctgtggaacaaaaatggcaaaaatatttgaagtcagcaggattggttaacaatttgagcacagaaatacatttggtaacatctgagcatatcattcatatcatatcgctgtcgaatttgaaggaaaaaaaaaagactaaggaagtggatatattggtgaatgctgatgatgagaaaacttattattatatacgaaaaatttactaaagacagcaatattccaaaataatgatagggaagattctgagatggtgtgtggtcagtgtggaggcactacagatggtcaaacagtagcatacccacctggctatttggacaaggacaaggaagaagaaaaatcgagaaccatcttctcagccgattttagtaaccatcttcttgtttgctccgaacaatcaagagatcgaaaatggctgatgttcacaaaggaaaggtttgtgtaaccggtgccggagggtttttgggttcgtgggtcgtcgatcttcttctctctaaggattacttcgtccatggcactgtcagagaccctggtactgaatcttctctccttttactctcttcctctgtaaattttccgcctttattcactctgatgtctcgttgacttgtgtgtgcgtgcgaagtagaaagtctgttcccaaagtttgatttttttcttaatctactttctaggtgtttagattcgctagtttctgttctctcgacggataaaagccttagcttttgatttttgtttgttgttcccaaatcattttagtttgcttctcttcttttagtgtagttgttgttgttctgatgaagagtttcgcatggttcttgttatagataatgaaaagtatgctcatttgaagaagctcgagaaagctggtgacaaactcaagctcttcaaggctgatttgttggactacggctctcttcaatctgctattgcaggttgcagcggagtcttccatgtcgcttgcccggttccaccagcttcagtccctaatcctgaggtgaggatttcacttcactcctgtaatctcactggggatatataacatagtctcactctgcttccactggttttgcaggtagaattgatcgcacctgctgtggatggcacgctgaatgtgcttaaggcatgcattgaagcgaatgttaagcgtgttgtgtatgtttcctctgtagctgcggctttcatgaaccctatgtggtcaaagaatcaagtattagatgaggcatgttggtctgaccaggaatactgcaagaaaactgaggttaatgcatcctcaatccctcatctcatctcacttgttatatatcacatcttttttttgctgacttttaaattcctctggcagaattggtattgtctggcaaagacacgagcagagagtgaagcttttgaatttgcaaaacgaaccggacttcatctcgtcagtgtttgccctacccttgttttgggacctatactgcagcagaacacagtaaatgctagtagcctggttcttcttaagcttcttaaaggtatacaacaagccttatcattcacatctgggattgttagaagcagcgtggtatacatgggttggtgaatctcgggttttgattttacttttgtgtggtgcagagggttttgaaacacgtgataaccaagaacgtcatttggtagatgtgcgtgatgtagctcaagctttactcttggtttatgagaaagcagaagctgaaggaagatacatatgtacatcccacacggttaaagaagagattgtggttgagaagctgaagagtttttatccacattacaactacccaaagaagtaagtaaacaaacaacacatctctctgcttagttttgtacactcaaaaccatccttgacaattttttgagcgaaaaccttttgtcttgagaacagactaattgctgtcagctcattactgatttcattcaataagcaatgacacttacctttagatcagtgttttgaagtttctttaagacctaactttgatccaacctctacttatccaatgttagatacattgatgcggaagatagagtgaaggtgagttcagagaaattgcagaagttgggttggacttaccggccgttggaggaaacacttgtggattctgttgagagctaccggaaagctaagcttgtggactgaaaacttggaaagaagagcaaaatagtgttttagcttcatatgttatagttatagtgttccattctgcacacacacacacactctctcatcgtttactcaataataagagttgtgcattcaccatggatttctgagtttttgttattttctttttagatatcattacttttattaccaatctacaattttctttccataatattttacaatatctctctattgtatatgttgttccaatttctaccgaaatcttactttcaaaggataaaacacacaaacttttatctcaattggtacgtcttgtttctgtataaatttgttaatcattgtagaaaataacataacaaatgtggatttaagctgaacataaatattaatgctttttccgatgaataaaattagtcgaacaaaagttgagatatggagctgaagcagagatggtcaaagtcaaacaaatagctaccatttgcacaaggaagaatcttcttctcatttgggtgatcaaaa

SEQ ID NO: 11081 - DNA, 3000 bp, Unknown
  misc_feature (1)..( 3000): cDNA_ID_1033921_gDNA_ID_2214478_Annot_ID_183224 3000 nt of promoter + ATG
tccgccgtgttgtacggtggttgagaccagaaagtgaggtatgagcggcaagaaggtgggccgttacatgtgaatccgttggttatgttgtcgtagacacggacctcgcaggcgagctggtggttgttgacgtacggttgctgagctttcgccggtgacacggcaaagaagagaaggaggaataaggtgactgagagcgcgtggagtgtacacgcagccatgttttgtggtgttctgatctgaagagggattctcgtgagctttctcctgatttaaacagagaggacgatgatgaaccaaaggagacggcgaagacttatttagtcaatggaaacgcgtcgtatgtgttgactttttgtgacgtttctcattggtcctaccgtcaaaatgataatatgtgggattagaggagattttggtacgtcttctagaaagttgaccaggtcagtaaatttgttcagtaatagtcttaagctgaatacaaaagtgaactaagtaatactaatcatgctaaatgcccttaagctacgttagctctctcatggacataaagatggtcttggtctcttggatctcatgtgaaagagacacattgtctcagccaatacgtgttgctaccgtttttccttccgggtactcaacccatacccattctcgacgtgataaacaacttaaagatggtcatggactatttctcgtcaatctaaataatcttctctacaattttcaaacttctaagttggcgttgttcctagaaggaaagagattcatttggtttgcggtatgatgctgttggaaactcttaccggcaccacgattttctcatcatcctactatacggaagatttagtttcatcgtttcgatatgaaaactgtataactagattaacctatatcataaccaaactacagttagataaaataatgggccaactattaaagcgatccatgaacatggcttttggatagcaaagtcatgaaaggtttaccaaagaacttgcaacgcattacatatggttccgacggatacaaattcggttagaagactacatcaagtcatcaacaagcacaccaaactgatgaatctaaggacgcaaagcagaacaaaccaaatccatctgaccaactcatagaacatccaagataaggacactaaagcatatagctccaataatgagtcgaggcaataacttcaatactataatccacaacaaaaaacagaggtccattgtcaatcgccatcacatgatataaaactaagttatatcccggggaagtaagctttccattcacgatcgaactaaagaacaagacagacatgcttttctaatatgacacgagaaaatcacccatccttgtggcagagcacaaacataaaccaaccacagaataattgcaaggacctgaaatgatgcaagtcgatgcatctcaccaatttaaagggtaaaaaaatttcgaatccgacgtatataagtttacagcatcggtgttccaaactggcaaacttcaaaaaaaaagttactaaccatgaaaccaattggtgccaaattgaacagagtaaaaggaaatgatagaaagtttggagtcaaaacgaagtttcagatccatactcaatctcacaatgcacataaaatccttcagagatggtttggtaacaaaaaaagtttccatcttttattcgttgtaagttacaactatagtgtctatacatgatcattagctataaggaacaaaactgtagaagctaacttacaaccaaatgttcaaacttaacagaaaattcaatcttctgacttatcagttccgttcttgtttccatatatcaaaccagtaacctacaaatagcataagaaaaaaccattgatactctaaacgaagaatccacaaatgaatactaaactactaataaatgttggaaatttacctgagggtcagcgattggtttcctcttctcaacgtattgattagtatcagccattgcaagagctgccctagcctaaatcaaaccagagataactgtggaaatgagactagaggattcaataaaaacacaaacttttttggatgtgcaaaaaaatcaaaattggtacctcttgttcctttttaagatcttgttctggcttaatccagagaaagtaagcaatagttccggcgacgacccaagaagcggcactctgaccacctctaagacctcccatggaattaccgatgaaagatctcacgtttccaattgatcttctccagctgctagccattgattgatgcccaactatacgaactggtctaaggttcttctggatctcttctctgacaattgcttgactttgatgatgattcgatttggaactgaaattgcaagaaaagtaaaagcaggcgatttgattttgattcgcatttgcttggtgaacactgccaaaggctaaaccggtcgccgagacggttaatctgatgtttgggattgacacatcatgcggctgttgtttctccacgtaacatttggagacccgctcaaatatattgtgggccggagaacattgttttaccatatagggcccatagactttgaatatgtgtaggtaaataaaatacaatctgtggaacaaaaatggcaaaaatatttgaagtcagcaggattggttaacaatttgagcacagaaatacatttggtaacatctgagcatatcattcatatcatatcgctgtcgaatttgaaggaaaaaaaaaagactaaggaagtggatatattggtgaatgctgatgatgagaaaacttattattatatacgaaaaatttactaaagacagcaatattccaaaataatgatagggaagattctgagatggtgtgtggtcagtgtggaggcactacagatggtcaaacagtagcatacccacctggctatttggacaaggacaaggaagaagaaaaatcgagaaccatcttctcagccgattttagtaaccatcttcttgtttgctccgaacaatcaagagatcgaaa

SEQ ID NO: 11082 - DNA, 3000 bp, Unknown
  misc_feature (1)..( 3000): cDNA_ID_3034373_gDNA_ID_2214478_Annot_ID_183223 3000 nt of promoter + ATG
agacagaaacatcggagctacaaaaagaattgggaatagaaaaccttagaaagtagacgaaagaatcaattttgaccaggctgagctacaaaaattcgatgaactagaaatgcgagagaataaaggttgacaatttacagagggagagataaaaggtgaggagagtagtaccagggtctctgacagtgccgtggacgaagtaatccctagagaggagatgattgacgacccaagaacccaaaaaacctccggcaccggttacacaaacctttcctttctgcacaaccgccatttttgatcacccaaatgagaagaagattcttccttgtgcaaatggtagctatttgtttgactttgaccatctctgcttcagctccatatctcaacttttgttcgactaattttattcatcggaaaaagcattaatatttatgttcagcttaaatccacatttgttatgttattttctacaatgattaacaaatttatacagaaacaagacgtaccaattgagataaaagtttgtgtgttttatcctttgaaagtaagatttcggtagaaattggaacaacatatacaatagagagatattgtaaaatattatggaaagaaaattgtagattggtaataaaagtaatgatatctaaaaagaaaataacaaaaactcagaaatccatggtgaatgcacaactcttattattgagtaaacgatgagagagtgtgtgtgtgtgtgcagaatggaacactataactataacatatgaagctaaaacactattttgctcttctttccaagttttcagtccacaagcttagctttccggtagctctcaacagaatccacaagtgtttcctccaacggccggtaagtccaacccaacttctgcaatttctctgaactcaccttcactctatcttccgcatcaatgtatctaacattggataagtagaggttggatcaaagttaggtcttaaagaaacttcaaaacactgatctaaaggtaagtgtcattgcttattgaatgaaatcagtaatgagctgacagcaattagtctgttctcaagacaaaaggttttcgctcaaaaaattgtcaaggatggttttgagtgtacaaaactaagcagagagatgtgttgtttgtttacttacttctttgggtagttgtaatgtggataaaaactcttcagcttctcaaccacaatctcttctttaaccgtgtgggatgtacatatgtatcttccttcagcttctgctttctcataaaccaagagtaaagcttgagctacatcacgcacatctaccaaatgacgttcttggttatcacgtgtttcaaaaccctctgcaccacacaaaagtaaaatcaaaacccgagattcaccaacccatgtataccacgctgcttctaacaatcccagatgtgaatgataaggcttgttgtatacctttaagaagcttaagaagaaccaggctactagcatttactgtgttctgctgcagtataggtcccaaaacaagggtagggcaaacactgacgagatgaagtccggttcgttttgcaaattcaaaagcttcactctctgctcgtgtctttgccagacaataccaattctgccagaggaatttaaaagtcagcaaaaaaaagatgtgatatataacaagtgagatgagatgagggattgaggatgcattaacctcagttttcttgcagtattcctggtcagaccaacatgcctcatctaatacttgattctttgaccacatagggttcatgaaagccgcagctacagaggaaacatacacaacacgcttaacattcgcttcaatgcatgccttaagcacattcagcgtgccatccacagcaggtgcgatcaattctacctgcaaaaccagtggaagcagagtgagactatgttatatatccccagtgagattacaggagtgaagtgaaatcctcacctcaggattagggactgaagctggtggaaccgggcaagcgacatggaagactccgctgcaacctgcaatagcagattgaagagagccgtagtccaacaaatcagccttgaagagcttgagtttgtcaccagctttctcgagcttcttcaaatgagcatacttttcattatctataacaagaaccatgcgaaactcttcatcagaacaacaacaactacactaaaagaagagaagcaaactaaaatgatttgggaacaacaaacaaaaatcaaaagctaaggcttttatccgtcgagagaacagaaactagcgaatctaaacacctagaaagtagattaagaaaaaaatcaaactttgggaacagactttctacttcgcacgcacacacaagtcaacgagacatcagagtgaataaaggcggaaaatttacagaggaagagagtaaaaggagagaagattcagtaccagggtctctgacagtgccatggacgaagtaatccttagagagaagaagatcgacgacccacgaacccaaaaaccctccggcaccggttacacaaacctttcctttgtgaacatcagccattttcgatctcttgattgttcggagcaaacaagaagatggttactaaaatcggctgagaagatggttctcgatttttcttcttccttgtccttgtccaaatagccaggtgggtatgctactgtttgaccatctgtagtgcctccacactgaccacacaccatctcagaatcttccctatcattattttggaatattgctgtctttagtaaatttttcgtatataataataagttttctcatcatcagcattcaccaatatatccacttccttagtcttttttttttccttcaaattcgacagcgatatgatatgaatgatatgctcagatgttaccaaatgtatttctgtgctcaaattgttaaccaatcctgctgacttcaaatatttttgccatttttgttccacagattgtattttatttacctacacatattcaaagtctatgggccctatatg

SEQ ID NO: 11083 - DNA, 3000 bp, Unknown
  misc_feature (1)..( 3000): cDNA_ID_3034386_gDNA_ID_2214478_Annot_ID_183218 3000 nt of promoter + ATG
ggacgaaattaaaataaaatgataacacaagggtcaattttatctacagtcaccaaattaaaaatcagattaagatacattaaaaagtcattatctcacaaaataaatcttttctttgctctttcatttgtagctcctctctctctccggcgctaacgggatgtcctcaccataacgccgttaagtctggaacccgtttgaacggaattatcaaaacgggaaggaatattccgtttgaatggctctggaacagttaggattaggagtgagcgccgttgacggtggagagaacagtagcgcgccgtcaaatgacggtggagatgacggcgttaagacggcgagacttcctcgttggacgagacaagagattctggttctgattcaagggaagagagtggcggagaacagagtccggcgagggagagcggcgggtatggctctcgggtcgggtcaaatggagcctaaatgggcttctgtttcgtcttactgtaaacgtcacggtgtaaatcgtgggccggttcagtgccggaaaagatggagcaatctcgccggagattataagaagattaaagaatgggagtctcagattaaggaagagactgagtcctattgggttatgaggaatgatgttcgtagagagaagaagcttcctggttttttcgataaggaggtttatgatattgttgacggtggtgtgattcctccggcggttccggttctttcgcttggattggctccggcgtcagacgagggattgttgtctgatttagatcggagagaaagtcctgagaagttgaattctactccggtggctaaatcagttactggtaaaattcagatcaaagtttaagtttttattttgtatgttcatcagaatgattccatttcttatgaagttcaatttttttgatgaagatgttatagacaaagagaagcaagaagcttgtgtagcagatcaaggtttgtttatctctctgtgtgtatttgcttgatctattgctctatatgctaatctcaaactagttttagagctctagagtgtgtttctcttgagtcttgactatgtagttatgttgtcatgtagataaatgatgttttcgtattctaaaatgcatctcaaattgtgttataaaagtagtttaacaatcttccctatggtgtgtgatcttttcgtttatgttgaagggtctctatgttcttgtttttatactaaaatgttgagtttgaacttgaaggtagagtgaaagagaaacagccagaagcagcaaacgtggaaggtggatcgacatcacaagaagagaggaagcgtaaacggacatcttttggtgaaaaggaagaggaagaagaagaaggagaaacaaagaagatgcagaatcagttgatagagatactagaaagaaacgggcagttgttggcggcacagcttgaggttcagaatttaaacttaaaactagacagagagcaaagaaaagatcacggtgatagcttagtcgctgttctcaataagctcgctgatgctgtggcaaaaatcgcggataagatgtagatttagtaaaagttagttgtatatcactttggccattacttctcattcttcttcttccttttttttcaatcatttatcaccattgttgattgaatattgatgccaccacaagaggttattatacacatcttatataaacattgagatttatacgggtttaggatatcatttgccttagtgttaccttttgactgatttgaacatcttgatgtgttgatgatttgttgcatagcatgaaattgagttttcatctttcttgcttcccctaacaacaggattaataacataatattaaatggtatacgtagtcatatgacccttgaacatatacaaatagttactcaattggttagaaaatgactttggtatatgcagattgaagatctgccactttatgttgtttggtaatctgatagctactttgaaaacaatttctgtattttaacttcttcttttataatctatagaaattaaattgaaaccgtatctaactcgaaccaatttttttgtctggattgtagtgcaacatgaactatatttaacatattatcgtgagcttgaatttgaaaccaaaagttgtactaataccaaaactcagtgatgcaaaatatcaaataagttcccatattactttggattatctttcacaaaatagttgttatgcacataattccagtccaaatttgtttttttcgtcagttataataaaaagacaagcaacagtttcataaaagccgcacgacatatttgaccactgaaatttatgtacgaacttcgacttccatagaggtaagttaactgacaaacttttcgagtcaaaaactttggatcatcagacacaaaactagtaaagaaaattcacagagatgtctactttcgtcatttaaaatacccctcatctggcgccaatcacacgtcgcgctgacataatttacctcgttcggatcgctgacgtgtacggtctagattaaactccttctctcaactagattctccttcttcttctctctctctcccttcgtctatatttcacattctcttcaagtttcggccttcggagaaaataataagcatctcaaaatttggatctggagaagaaaatttgaaaactctcttgttctctcaaaggtggtggtagatctcgaattgggaattttcgaaattgtgaatctttgaaaaaaaaagagttaaattgacaaaacatttccttaacttgaatctctgttttttgaatcgtttaaattagagaagaaccctaattttttctgttttggagatctcttctctggaccggggactaaagtgggcgattttcgaattcaaggtttttgtttctgaatcgggtttggattcgtttttgagcaaagttttgagatttttacatgcttgtagctcgatctggttgttctagaaccctaattcgaatgggcaacgatgaaaacttgatggtaatg

SEQ ID NO: 11084 - DNA, 3000 bp, Unknown
  misc_feature (1)..( 3000): cDNA_ID_3034390_gDNA_ID_2214478_Annot_ID_183217 3000 nt of promoter + ATG
cgtctaagttattggtaatggatcattattaaccgtaaaaccacaatggactatatactattaagggtaccatcaattggtaaatgactgaatggaatttggcacgtcatttcattctgcaggtactgatgcttttgatgaatatttagaacacacaaaaaaaaaacttttaagaactcagaaattaatcctcaggatctctctatgcttttgcaccatttgggtaatcgattcgattatgtgaagactataataaccaaaaatgctaattttaaaagaccaaaatgattgtatttctagtgaaagtcaaatcttccatataacaaaatcttgcacgcagcctctaccgagttgatgatttggagtttgaaattaatgtaataccttggtttaacaaattcaatatatatagtatatattctattaagggtgaatccttccgagagtatctttgctaaatttatcatgaatatcaaatatatcatagtattatcctattgttagcatatatttgatacactaaagataaagagaaaagggagagacaaaaggtatgaaattggtgataccacataagaagtggttgtgttataggcatgcggctctttaatttaatagtccccaccacatcatacacttttgccccatttctcgaatcttaatcaaacaagctagcttttgctaactatgggagaaggtggtcttgtgaatcatatcacatattgatttctaattatgttaatgaacttttcttccaaagtttagacccttttcaatctgacctaagtctttttgtgtaacttccaaaccaaattagcatggtatattatatacaaacgcacatcaagatggtagtaacacaaaagtgtcgtaggattgaaagacacaactttttggtcttgggattgtttttttgttttgtgtgtgtgtggatcttactgtttagcagggatatccaattaagtacaaataactcaatattaatcacatgttcatagaaaactataattcttttcccctgtctaaagtttacagatttagctgtttcaaaatgtacattattcaataatactatgtacatcattcttaaaacaaagagcaggtccatgataactcaaatttgaatccaataaagttaagatattgaaaagcaccacttggcttaagtaattaaacaaatgcaaagccaagagaccttaaaacctcaaggcagataaagcaacagagagatctgtcgagatgagttagtctgttttacagagaagattaatctttatttatcactcaatggttttaaactgtagtgattcagatagacaaaataaatataaaaaaattgtaacaaatagattttatggaaatagtttggtttacattggattgttctttttcgtttttcggttaccatttgaaccgaatatatttttaacacataagaaccgaaagtgtgaatgtgtgtgcgcatttctccttgtaattcgtgtattaaagaacacaatgtaataattattttgttgctaaaaaaagtgatagtacttaaaacttagttagtaaaggtgtttgccaaaaaaaaaaaagttagttaaggtaaaagggaattgagtatggaaaatggaagatcagagacgagaggtgagaaggtggggatgggccagtaacactcttttagccaacctatggctataaaggcaaaagttgttttcagtttcagaccaaattgaatttgtcttttacccatttctacctctctatttcatttccctaacaacttaaattgttataattcatttttctatggtcaagaaagataatgcatttaggctgtgaatggagcatgcggagcaggaggatccagttgcaagatggggtggattattgattatttgttgccatttacataagttatgttctctagagtgtgtttaggaaaataaactgacttgtcaaacatgtcattctttcttaaaccttgttcgcatccgcggtccatcaataaatgatccaaatagtattggatcaagttagcagagaataaaacgcaaaatcttacgttaactctattttgtacggtgtaactttcaaaatttggtgtagtatttctttgaagcttaacttctagtattagaaggaccttagctttatttgagatactaagcataagtttcaaaatgtatttatctgaaattcaaagaaactcttataggtaattgaactaatgtacacactattcagccttcggagacatacttgtgtcacacaaattgtgtgcattggtcttgcatatgcaattgggagaagctacgtgctcttataacacccacatattttctctattatttgtcctcaaatttcttgagcgttttttttctcttccacgcctaaaattttatagaaagaggaccacattcaagtccctttccaactttttattattatttagaaatggtaaatatgagtgagtcttttgggggtttgagtgaaagtccagccacgccaagctccatttgctgattactgcttaaaaacatcaccaaccgtttcttaattaccttcattgtttactcatgtttattgtgaatggttcattataaaatttctatgacataataacttgaatagctagcatcatctcttgaccaaaaaagaagaagaagctagcatcacccaaattagtcaatgattcaaaacgaaagttttagtacatataagaagaaaaccaaacctaaaactatgagtagtggtagtaaaaccatttcaatatgtttacttgttggaatgccatcataataacaataaaataagaaatgttttaagaaacttttacctgtgaatcacgcggcttacggcttttgcagagaagaaagatatttacaaatactcgattttcacaaaaataaaatacaaaaggtgatttcttgatataaaacccaaaagtcatctttcttctctattgacttgagaagaaccacaacaatgcctcgcctacaatgcctaacaatg

SEQ ID NO: 11085 - DNA, 3000 bp, Unknown
  misc_feature (1)..( 3000): cDNA_ID_2995213_gDNA_ID_2214478_Annot_ID_183214 3000 nt of promoter + ATG
cttatatttttataaatcgatcacacattatcactttcatctcatgcacgtatagtcacgattacattcaatatacgatttttcacatagtctaatgcataacacatcaatcttcttgctaagacggtcaccttttacatattcatctaatccattcatatttgaatagagtgaatacaacaaactataaccttaatccaataaatatttataagaatatgttatatgtgagttcaaatctaaaactcgatggctagcttgaggtttggtgcatacatcgaaagtcaatagcaaacaggatgatattttcaggatggaatgactatacgacagcaagtactaacctcgaaaatgaaatgaatctggccgtgagatgacaatttaaaatagctaaagcctaataatgcaatatgatgggtggagcaaaataattgaagaactaaagatttttattttagagaaagtcaaccaaattataaagaaagtaaatgcaaaatgtcaacatttgttttaacacattagagtaaagtattttttatgtgggcaaaggctctcgatctttagctgcaattattaaatttgtgaaaactatcatatattgatgcctcacttcactcatcttttgaataataaagccaagaacatcacgtcaaaaataaaaactacaaaagtcaagaccatgatcaccatgttcctactttcatcctaaaaagtttacgaaacaacaatacacaaaggaatgaaaaagatgagaaaagaaagccaataaatatagttttctcacccaaacaattgaagaccatgtgatatataactatataagatattaggtactaacatgaagcatgctatatctatatagtatggtttaatagaatattaggtagatgtatgtataattaacttcagattgcataacgtttattattgaactggtaaaatcgagggaaaacaaaaaaaacttaccattcttagttacgtacatacacaaaacatgcaaagaaagataactacctaactataaattacgtttttgttgttgctgcaaaaatacaaaaaggaagataaagagaaggaattgtgatagaccaatatatacagtggcaataacatttttacaccataccattatatatatagggaataaaggtattgtctggaggaaaatgacgtttccgtaaacaaaataatgataaaacaaaaatagtgaaaagagtgaaagagagaagtgcaaaagggaatctgttggaagtgtagaaagagaaagcgacgaccacttcaatccagtgttgttctttctttcttttttcctagaaaattaaagatattgctttttaccaaataataattttatcttggtggtagaaaggtttgcaagagttgtaatatacagaaagagagacaatgggacctaagaagggaatctctgaggagagacagagatgtttcagatcgaaagagacgccaaattgtgtctgtcactctgttcttgtgtgtgggtctcctctccttccttccttatcgaatccatattccattttgcttttttttccctagaagatttttaagaatccgaattttaacataatcttttgtttagtataattcactttccttcttttttaattactttttaagggttctttaaaggttgtgtttagttaaattttcgtttctctattatgaattcaagtgatatagagaataaagatttaagtgatatagatgataaaagttcacttgttaaagaatagttgaatattgaagtcctttatggtttcgaaaccgaatttacaacgtgattttctgtaggttttctacataataaagaatcaaaattcgtaaaagtaagaatatagaatatccattccaagtgagtttgaaacacataatagctaagtaacatgtgaaaaaaccttagggcataggaaaatagcaaaggttggatgttttgtttctcgcaccacataatgggcaatgattgtaacaccattcatcttctattcatataacaacacaagtacacaaccaataatgatttgtcacataggtgaaagcgacacatgtgtgggaggaaaattatgttcgctgagcttgatgaatcaatgagagaaaacatggctttaagagatgaatcaaagatggatgtaaaaggtaaaaaacacatcctcatccgattgaaaagtggaaatcagtaatttatttccaacgtttactatattccaaacctatggacaaacatcttgagttttggacaattcttagagatatgttattgatattcgactaaaagataataacctttctaaaagagaccaagaaagcaatctcgttaccaagataccaatgtcaaaaatagaatgttgttattgacattcaaaatgacattgcacaatgtttcaagatgtgctacaacagaacttgcaagatttttggatatttggatacttggtgtgaattcatggctggatttaggatatgttcctagtatatatatattgacttatttgttttctaaattgccaaataatgatcatctggaacgatttacgagttagtaaacttcgtacatgtgaaatattctccttatcgatcatgtcgttaacatcctaacgtcccatccaaataatgggcttagaattgggcttagcagaaacatgggctaaaatccttgtgcgtggatctgaaagaaaggcagccaattaatgtgcctaaatccatacactgtaatgcagccaattatttctcaagtaattaattacctatgtaaatgcaactttatttccggtacaacagttagatattttcaattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatg

SEQ ID NO: 11086 - DNA, 3000 bp, Unknown
  misc_feature (1)..( 3000): cDNA_ID_1806994_gDNA_ID_2214478_Annot_ID_183212 3000 nt of promoter + ATG
atccaccaatcaagcaagagcatcaaaacagcgtgagaagaaacaataaaacaagacaattattcgagatctattgattcaatggacgagaatgacgaatctaaggctgatctctaacggggaaggagaaagatcgtacctttgcctgagaattgaaaaaggtgggatggatcagattctgctactctgggattgtgttcttcgctctctggagttagaaatttctctttctctttaaacggctctcgttttagaaaataataattgtgttaaacgcctaaaacgtaacggaagtttctgaaaagccctaacatttagtatctttcaattacacccatttcatagaaaatgtagaaaacacacagttttattacatgcttgtcctgcggaccggtcctgacatatgaagttacatttgttgttgtaggtgtttcatcttgatatatgagattctcaagtggataaaatttgaaaccaaacaaggctttataccgaatttttttagataacaaaataaaaagtgaagagattatgtcgggtcagttgggtctatagtactcgagtattgccacataatagtttccatttcgtttgttgattttccaatcgcttggtcaaaactttagcatgttagttcattatccatagattctaggggttggtttgttttcatctaattaagaccgtaactcaaataaaatgatagttcactttgataatattttgtgaaattgtaataacctggattagtagaaatatcctggattagtagaaatataaacgagtaattgactatcacaataaagcttaacaagccgagtgagtaacaagtatgagcaagtaaagtatcatttcttgacatgtaattttcatttttcgtaactttctctacaacccaattattgaccgcaactaaaaataatattatgttgagacatacaacaagaacatatggaagagaaaaaaaaaaaaaaaaaaagtcgatatggatttcgttgacgacaaatccacattgtattatttggacaagagacatgacctttaccttctcctcacgcaaccggcatttgttgaagtctcccattgtccctcctttgggccctacctttaatgccaaactaacccattgtatttggtattctacataaaagttgtacactaatgtacgatacgattcaactacattaaccgtatgttaaattatatagtattcacttgttgataaataaattatgtttgaacacaacaaaacttagtttctatatccgctgctgttttgttatagtcgtcattcgtacgagtaattctttatgttccgcactaatcacgcttcttttgtaccacttagtatgtgattttctcattcgtggtctttgaattgtattagaggcaatttagtcttttgtgagattaggaggtgtgtacggaaaagtgtgtgagacaaatgaagttaatgtggaggagatctatagtgggacaaagcaattgaaagtcgctttagaagcaactaaatgccctcttgacttctccattctccttgcgatttacgcatttacctaattgcatcttttacttgtttagcttgttaagttcttctacaacattaccacttttgctctcttaagttattgcaacttgacaatttgttataccctttatcaaaaaaaatacctggcaacttgtttgagctcctgaattaatcacatctcttaaaagacgttttgcgagtataacatgagcttttctttttatagattcattcaccaatcaaatataaaaactataacacaattaaaatgccatgtagctaggtatattagcaagtcgtagaacagaaatggaaagacttgatgaaagcacgtcaattcaatttcatctcctataaataaattgttgtaggaagccaaccgttttggaatttcttttctttcgttttacgtaagactatatagattcaataacgtgttggtttagaaacccatacttataatggttgacaaaaagaagaaagaaaaaaatataaacatatacgctaaaagtgtttaccaaataacagggttatgtaatttattatctggattaggaaaagatgattggaccatgcgatggagtagaggaatctgcagggcatttgtcactttcatggaccccatgaaatcacatctcttttaattgaataatcgaaatccagttgcatacgcatctttgtctacgattggtcgtagcacatatacgacatatgccataactacaaactaacttaatcttctaataatattgttaacgatcgttaatactaaaaattactaatatattagtcgtgttatctatgtgttatgaggtgtgttaattgttgatgcataatgaatgaacatgatctctaatttgtttacctcacactatgtgattcaagggtggaagtcgttggttagcaaacattagtgtctcaggacaagatagctcaggacaagatgtccgagcggttcagaatcagtaatgtttttttccggagactctactcgttgagtttttgcttgtactccctggtgtttgtgttgtgatgtagttttgttgttttacttagtttttgatcttttatgtaatttgtatttcgctgtaacttcggtaaaaaacttgtgaaaatagtataagtacttaacattgatacaaaaaaaaaaaaaaaaaaaaaactcatgaggtcttgttatatatatggtgatcacatctttaaagaaaatgttatagtatttgttttagtttaaacaattttttatgtgccaaaaacattattaaaaagagagcaataccctactctaaaatagtaaagctaccaaattcaattcattacgacatggctcaaaagaaaaagtatttcgaatattatacgatatcaaccccattatcattgctataaaataagccaaactttacctctccattttcaataatctctcatcttctttcgtctctctttctacggttcaaacattaaaaagatag

SEQ ID NO: 11087 - DNA, 3000 bp, Unknown
  misc_feature (1)..( 3000): cDNA_ID_1019997_gDNA_ID_2214478_Annot_ID_183209 3000 nt of promoter + ATG
attttttgcctttgtccttcatttttgatcagttcttactgtgattttcggctgagtagttgtaggaaagtctatgaaaaatgactgattatcaaggctgtggactttgtccttctatttggccttgtacatcagtaccatgcattttactatgatttctgagctatgttatggttaccatccatgaagcaggttttcagacggttgctattttcatgcagaacggtgaattggagaaaaaagagccagccgcaaatgcagtaagtgacaacgtggaggactcatcaaacaaggtacaaataattgccctaaatttgcttcttacgacagtgggtaaaactttttatatcgaaaatgagtgtagagtgtcttttaaatatctcttaacgtattcccttttgaaagtactgtaattgtatatgtcagtgacccttggtttatagttcagatcaaatttttagtttgtgccatagtttcgataccactgtaatttgtaatctcttgctctagagacaaaacatcggtatttctaaatttgacttggtcctttccattcatggttcatgatgtggggcatatcttggaattttgttgcatgtttttcatgctgacagcttttatatccttttccgtttaattgtctgtcagtagaatatcaattttgttagagttaacaacaaaggaataaaacatgtggctggatcaacttttttgtaagtttggctggtagtaggtgttatgatcaaaagcttgttcatagtggttcaacctggaaagccaaatgtcagaccaccttattataatcttaaagtgaaaaacacgcagagaatagaagtgcagttctctccgcagctacggcatctttgtggttgataatgttgaaagcttcactgtatttgcttgctatactaatttctttttctgtcaagcttgatattgagcctagtgtacttgttgcagatcttcattggcggattttcaaaagctatttcatctgaaatggtatgctgaactgtaattctttgaaaacatttgacacgttcaatcttctattgtccccatttctatcgtttcaacttctaggattgtctgattcctctttaacgtttttccagcttatggagattgtcagcgtctttggacctttgaaagcataccggttcgtgagcaacaatgatctcaatcagcgatgcgctttcctagaggttagaatgtacttttatttgtggccaagatacccccatcttagtctgccatctcgatgtagttcttgtgattgtttcatatctttaatttttcattttccgggtagcatgggaaggtgttattaccttgtaacttttacagagtaaccatgaatgtgactgtagttccaagtatattcatattaaccagccctaactctttttaaatctctatatttcagtacactgatggatctgttaccctcaaagcttgtgctggtctaaatggtatgaggttaggtggcagtgtaataacagccgtttgtgcatttcctgatgcatcatccgtagcggtaattcagtgacccaactttgctttcgttagttcatgttgtgtttgtatgggtgacattgaacagaaattcctttagttacttgtgagagtggtgtgtgtacgtaatatgtgttgcaggtgaatgagaatccaccattctatgggatacctagccatgcaaaaccacttcttggcaagcctaagaatattctaaagctaaaaaatgtggtaagcataattggtgtatcctttttcttgtgaatctttcccaaataaactatgtgaggctatattaacattccattctttcttgtttgacaggttgacccagaagatctcacgtcgttttccgagcaagaagtgaaagaaattttggaggatgtacggttagaatgtgccaggttaagctctgagatcatcttcccatgagtccattgagcttttaaaagctagtaaattaagaaaataggcctctgggtcttgtcatgatgcaggtttggggttattaagtcgataaacatcttggaacacaagagcaaagatatcactgtttctgaaacaaatccattgttgaacttagaatcaactgattctaaagaaatgaatgtgtcagtgatcgaggagaaagatgaaggatccgagaaagcggaagatattgcagacaatgtagatcttgcagaggttgtcatgccagacagtttgacaggtgaagacaagttatgtgaaccgtgctcggatactgctgctgaaacaagcactcaagaaaatgaagatctacactccactgaacaagagcattgtgaaaagattgttgaagaaagtgcgcaggccgaggcagagaatccacaagaagtagcatcagtgcgtaccgtgaagacaagatgggatgctggcgacaagatagaagaagaacaagaagaagaccccgaggatgtatttgagacgggttgtatcttcattgagtacagaagaccagaagcgacatgtgatgcagcccattctttacacggaaggctatatgataaccggattgtgaaagcagaatatgtttctaaagagctttaccaaatccggttcccaagtgggtaaataatcccacaacaagtgagactctgtgattcttctcatctttaccacataaccggttcaaaccgagttcagagatacatagcatctacaatcaaaaacccttcaaaaatctctttgtaatcgttgggattgatcaggttggattattcatcaccacctgtgtctcgttacttttatgtattagagaatccaagaagggaaagatgaaaccatactattgtgttggtggctatatggaccggtttgcttactgaaaaattgttgtgttaaaagagaacgtaaccttctgaatgagaaagcgtctttcattttctacaaaataataaataaaatgaacccaatctccttctttatccaaatcctccttcgaagcagaagtaacagcaaccaaaa

SEQ ID NO: 11088 - DNA, 3000 bp, Unknown
  misc_feature (1)..( 3000): cDNA_ID_3034406_gDNA_ID_2214478_Annot_ID_183208 3000 nt of promoter + ATG
gcagatgattgattgttacattcaaaccctagcgaaagtcgttggaaggtataatcttcagattatatatgttaattgtctaggttgctgttgaaatataatgaaaaatgtatgaaaaaatctagggcagaaaattctgtttactttgtgtatttgactctgtatagtgtttgttgttggtttttggttagtgaggaagaggcgaagaagcgaatctacaatgtttcatgtgagaggtatttagggtttggttgtgagattgatgaagagacatccactaagcttgaaggtctttttacttagaacttgtttcttatgtttactatgtgttaactgataataaagaagagtattcttaaagtgttactttgtttacaacaggtttaccaggtgttctgtttgtgcttccagattcctatgtggatcctgaaaacaaagattatggaggtaattgttctgcctactattcaagtttaacctatatgtttgctttatttctccaaatgaaatctttgctagtgccattgtcattgcaaattttgagtcttagtgtgtgcctctcttgaaacatgaaggaaatatttttataagtccatcttggcaaagctaatgagtcttttggctatgattagctttgaatgctaatggactgacatcgtctattttctcttaaccgatttgtgcagatagttaataatatatctaactgcagtctggtttagatgaaaacatatattgcatgcaactctagagtgcttttctcttggaacgtgaagacgtgttattgattatcagtccatcttggcgaagctaatgagtctttgggctatgattagctttgaatgctaatggactgacatcaaataatttttatctaagccgacttttgcagatagttagtgtaatatctacctgcagaccggtttagataaaacatacattgcatctcctgagtgcttcttgtttcaattagtccattttggtgaacctagtgaatctattggctctgtgtgcgcactaaattaatgacatgaccagttgagaagataaaatatatacgcactgatagtatctgtgtgtcactctccctagccatgtaaaagatagttcaaagttcatcttggtaaagttaataattcttttttagcaatgtttagtttagaatgctaatagacttgtatcagtttcttcacttggtgtatgtgtggattttgaatagcaacatgattaatttcctggttgagaaaaagtatatatgtaaccataataacccggtatagagatgattggaggttttagtaaagaaccatggaccagaagtccttcttggcaaagctagtagctttctgccatttctagttttgaatgttaatggactcacatccagattcgctctttcttgtgctgtgctctttatattgaggaagcatggactcaattacgagagatacaccagctttacatttctcaaattaaatctcaactatacagaagaacatttactgtgatcgaattctgatttattcttaatcgttgtcgttgacttgcagctgagctgtttgttaatggagagatagtccaacgatcaccagagaggcagaggcgggttgagccacagccgcagagagcccaagatagaccgagatacaatgacagaactcgttactctcgccgcagagaaaacacaagatgaactgtaactgaagatggtatacatacacctaagctaagccagtatgaggatgatgatgatgatgatgataatggtggtgaggatgatgttactgccgccacacgagggctctgtattccagtccgttgcagttaatggaccgggcttactttggatattgttgaaattctaagttttgtttctatgtaacaattttatttaataatgtaaattgaggtttcactgttttaggaaattactttgggtagaagattagttttcttttcaagaacaattcatgtgggaaatggtaaatttattttagtaatcttttagaatgctgaagcatgctaaaaagagacgattactcttgtggtcaatctgtggaaaagcaaatacaatttggggttaaaaggaaacaatgtcaaaataaaagggcgatctgatgatatctccaataaataaggggaaaatgaaaaagtaaacaagttgattttaaaatccagcggacaaaatctgatgtgagtttttttcttttaatctctcgtccccgaaaaaaagttgacgaaactctctaccggaggcgctagttttcgccgtcggcgaggcaatttaactttccggaggtgcgacgcttctactccgcttatttttttctgctcttgttatttctcgtctcatgtcaagcttctttatgccttctctttgggtgtaaatagttggattagtcgcgaaaaaatcacgattggttcttcatttcgatgtatattagggtttgtgtgagcatatgattgctgagaagtagctagtaattgaatgtttatgtggttagtgggtaggagaatgggctgtggagatatctctactctgcgccgtctagttctttaggtcgtggattacttaatgcgattagattcaatcggatcgtagttctgatctattcgttcatcttgaagtttctagtcaagtagttaggaaatggtgttggtttttagaggcgcagtcactgtttcttgtacaatcagttaaataacttgctttttctggtggttaggagcttgttaaatgtgatcgaagatctatgatatgataaaaaaatctggaatagtattgtgttggtaggtttctgtttctgtgattttggctccatgtatcttgtaattttgaagttcctggtaatgatttctatgttggacgagggagtggaaactcatgaattcagctgtgcattgccttataattgtcttttgttctcattctattagtttgtgatttatgtctgctgatgattgtgctctctgctcattatctcaagggaataaagcagg

SEQ ID NO: 11089 - DNA, 3000 bp, Unknown
  misc_feature (1)..( 3000): cDNA_ID_2705277_gDNA_ID_2214478_Annot_ID_183206 3000 nt of promoter + ATG
ataaataaataaataaacgaagctgatatggaaaagtcttctctttctttttttttttttggtaagtcgatctctctttcactcactttaacccaattggccgctattttccaaagtctgtttatttttttaatctctctctcttctctctcacccaatttcacaaacccgaaaccctaattttctcgggacactgaaatttttacagcttctttcctcttcttcaccggggagatttgtcggtactaaatctagggtttttgggtatcaccggagggttgaagagagagaaaaaaactcacaatggaatcagatcagggaaagctatttatcggcgggatttcatgggataccgacgagaatcttctgagagagtacttcagcaatttcggcgaggttttgcaggtcactgttatgcgagagaaagctactggtcgtcctagaggattcggattcgtcgcattctcggatcctgctgttattgatagggttcttcaggacaagcaccatattgataatagagatgtaagcaaaaatcttgtttctcaaatgggtctttctaaattttgaatctttatagtaaaaattgatactttgaatcttgttgttgtcgaggtttgattttcatctttgatggatttaagttgtgttaatttcttaggttgatgtgaagagagcaatgtctagagaggagcagagtcctgctgggagatcagggacttttaatgcttctaggaattttgatagtggagctaacgtgaggactaagaagatattcgtgggaggtttgcctcctgcattaacatcagatgaatttcgggcttactttgagacttatggtcctgtgagtgatgcagtcattatgattgatcagactacacagcgtcctcgaggatttgggtttgtttcttttgattctgaagattcggttgaccttgttttacataagactttccacgatttgaatggtaaacaagtcgaagttaaaagagctcttcctaaagatgctaaccctggaatagccagtggtggtggtcgtggcagtggtggagctggagggtttccgggctatggtggttctggtggaagtggctatgagggtcgtgtggattctaatagatacatgcagccgcaaaacactggaagtggttatcctccttatggtggttctgggtatggtactggttatggttatggaagcaatggtgtaggttatgggggttttggtgggtatggcaatccagctggtgcgccttatgggaatcctagtgtccctggagctgggtttggaagtggtccaagaagttcatggggcgctcaagcaccatcgggttatgggaatgtgggatatggaaatgcagctccgtggggtggttctggtggtcctggttcagcagtaatgggtcaagctggtgcatctgcaggttatggcagtcaaggttatggctatggtggaaatgattcctcttacgggactccatctgcctatggtgcagtaggggggcgatctgggaatatgcctaacaaccatggtggcggtggctatgcggatgctttagatggctctggaggctatgggaatcaccaagggaacaacgggcaagctggttatggtggaggttatggaagtggtaggcaagctcaacaacagtgattgaagaagaaatactactagaatgtggttttatcgctgaccttgaaacctcctgctttccgccttaaccatgtcacgtctttggcggttagaccaggaggtggacctacgctggattatctcttttgttagtttctcaataagttgttttcaggcaattccggatactatttcctatcaagttgtagtttttaagtttgcgtgcttatttatatttgtcgctttggaatggttttctttctctgttatcctctagtgtttgtgtttaacgatacatcctccagattatcattattcatctcccttttggttcattcatttttgttgaatattccattcacagattcttgcttttgcatctcctctgtttaggggaagatgatttgctcagtgttcaatgtgatctaagaaaagtgtttggtagagcaagagctgcaataaatcactttgagattgcgttgttacatgaaggtcgtgttggcggaaacttaacagtcccaagaactttaaaatattgtcttttgtcagacaaaacctgactaaactggtctgtttggtggctgttcaaacatgacgtttctaatccaaaccggcccgtctctaaatcattttctctctcttacggtaataagttatcttctctactgcattccagtttttgcaaatcctgcggctaatctaacacttctgacatgtgagtaaagcaatacattgtagctagtagttgttttcccccagttaattatgttttaaacactcgctcagtgaaacctcttgagtttgtaatatatattttctttcaatacattagatttcgtaaccattttggaccgacagaagaaaagagattaccattatgtcttttttcttttctatatacgataactaaaagtctaaagcgtatttctcttcgtataggtaaaaatgtagattgagacattgagtagcatctacattaaagaaatatatacaaaaactggtatattgtgctggcaacaatctagtacatatatataaaagattttacagatgagatttggatggacaaaatttactcgaaataggaaattagctaattctagtgttatttttatttgtgagtattcctaattttactcgcatcctctatgattctctcaatacagattttttttgctgtagattacctttttccaacttgtcgccttcctcctccacctcctcagtttctccagttttatttttacgtttgtcttataataacacaagagatatgtcttttcctttcctctttcctctctcattgagcaatctaatttcataaaatcccgtaaagttttcctttccaccctctcccctcctccgcc

SEQ ID NO: 11090 - DNA, 3000 bp, Unknown
  misc_feature (1)..( 3000): cDNA_ID_2705281_gDNA_ID_2214478_Annot_ID_183205 3000 nt of promoter + ATG
gtataatatgcagcaatttattattttttctcttcttcttatagtacttgatccaaaaaagttgaaagatcacaacttgtatcaagatgtagttgcagaaacaaccagtgggaagaatagccctaaaagggaaaacaaatacaaacctccatccatacacacacaaagaatcagaaatgctacaaagacaaacaaacaaaacacagtttttcttcttcttccttcttgttaaccactgtgaaacctttacctgttctccatgttggtgatatccacaattggggatctcttcgatgaaccattcgcatgaagactctttggtgaggccaaccaattggaaaggctagtattaacgattatctccttcagtagtggttttgcttgatcatccatatcctcttcaacattctctttcattacccgtttaactttcactggccttgctttaaccgctttccactgagcaagattctccactggattcaaaagaggagccacgtcctgctcattctcttcttcttcttcttcatcttcatcatcagcatcatcttcatagtcgttttcattatcggtgtaatagtcttcatcttccaaatcactctctccataacccatttcatcatcttcatcctcaaaactatccacacagttgtggtatctatagtttgaaggatacacagatctactgcttagatcctctggtttcttatctatagccgaagatcccttgcttcttcctcctttcccctcttcatcatcactgcaagcattctcatatcttgaaggtacaataggttcataggtttgtacattcaagtcaaatctgactctcttcctcgtcttcttagtcaccttcttcttctcctcctcctcccctacctcactcctgacacagtaaacataaaatagccatttcaattgataatctctgctaaaattgggtttcattttggcttttcataactcagattaagaaaaagtttcagtttttaagtaaatccaagcccctaagacattatacctgaggttcgaatttgagatcttttcagggttatctgaaacagtactgaaatctgtcggatctgaagaaagcagcggctcatagctacagattctctgcaataaaggttaaggttcaaatcagagtaatggaaaaaaacctaaactttaaagagatagagtaagaagaaagagtgttattttacttattgtggaaaattgaaaaaagcttacttgatctcgaggaaggatcttcctaatggaatttctgcgttttttgttggaagagagaccgaaacaacccataaaacatcccattggtggtgatgtttctctgtttcggtttcgatacttgagaggaagaagaagaagagagatgattagttgtttactttgttgcctcgttgaggtgttttgaaaagagagaaataggaacgttggggtttcaaacggatgaaagtgacggtgggctcacggagtttatgccgtcttttctttatgaagatgagacaaaattaattattggattccttttctatttttataacattttatgccaaaataaaagcatttatttgtttctatgcacaaccaaggaatgttgggccttgcggcccatttcaaacagtttgttgttaatgtgctttttgacttttgaggtctgtaaagacagatttaggcctacgtttatgccttttaagttcaacgttcactctaaacaagtggtgcacaaattttgatcaccttgcgcaatatgattatgaatatgtgaaaactgaaaacagcttaagttaagtttgattttagaaatgttagttatcaccaaaatatgaaaatatcaggctataactatctaagaactttcttttgagattcctcgatccaatttttatttaataggaattgttttctaaatttataattttagagtttctaataatttaattttttttttgcgacaaaaatattcttaagagttaagagaataacgttgatgactagaaaaaaaagagagattaatgttgcttttttttttttggtcacagcataatgttgcatttaagagttcaaatttgcagtactagcatctatacaaaataacatgattaattggtttcccttgtaagctgaatttgtagattacattgtattctttgattatataaattcttctttaataccacaccctcacaaagtttgccaaatgaagtgtttattatttttcggatcaatgaccttcttaacatacatttgaattaatacgaaaatgtacgattcttagcacattccacgttgtttgattttttttgtaaaattgcagatatttcatttcttccatcaatgctcgatatatttcgatgagagaagtagaaagattgctttgatgagctcgatttgagatatggtttttttgtcgattaatgcttttatatatatatatatatatatatatatatatatrawagtaacaaattttaatacaaaaaatcaaagacttaaaatgatctaacattttttctcaaataataaggtcattgatccttatataacatggaatcactataacatttataacctacattcttgctcatatatctctctccttttttttccaacatattaacgactaataataaaatttatcaaccattttaaatctctaaatggaacttattattacatgactaaaaaataaaaataaataaataaataaacgaagctgatatggaaaagtcttctctttctttttttttttttggtaagtcgatctctctttcactcactttaacccaattggccgctattttccaaagtctgtttatttttttaatctctctctcttctctctcacccaatttcacaaacccgaaaccctaattttctcgggacactgaaatttttacagcttctttcctcttcttcaccggggagatttgtcggtactaaatctagggtttttgggtatcaccggagggttgaagagagagaaaaaaactcaca

SEQ ID NO: 11091 - DNA, 3000 bp, Unknown
  misc_feature (1)..( 3000): cDNA_ID_1807236_gDNA_ID_2214478_Annot_ID_183201 3000 nt of promoter + ATG
tcgattatatgtgctcttacaaaatgaaatatatatgatttggacatgcagtactcggtttcggatccaaatattgtgcatgtatcgacgtcgacgttgcttgagacacaaggagcagtgacattgaaggagatttcaagttacacttatgaggtgattaagaatattggagttggtgtgattgacatcgttgatccaccaagattagggtttcaattgacccttggcctaaaccttgataatataccacgtggcaaaggtaagcttcaatattgaaatgtactttttcccgctacttagttattataagtttttttcatatttactcattcaaatgcagaagcgattaaaatcattacaaggatttctgaactacaagcgataatattaagtagccaactaaaagagatgctgagaagtttaaattttcaagatgattcacgatcgatcaacaacatgcccatcaggattgtttatcacccaagtgaacctttctacgtctttaaacaggtttattttaccgcgttttattcgtttatctgagttacatccaactaaatataataatggatagagaccaacgtctaaaatttatcgaataactataactataagaataagtctttgaatgttttttcagccggaaaaaatcacggccgtgtttccgatgaattttaaagacaattcggatgtggtcatcgccacgtcattcttccaggtacaactaaaatgcatacaatcaatgggtgggactagagttttgcattgagacgtcactaaggtttcctttgtcaaattttatctttttatgttaaaaacaaattggacaatacatataaaaaggaactagttgaagtgggaagccaaaaggatatgggaaaagccccacaatgtagttggtcgccaattcctcctctccaacttagaggagaaccggttcaagacttgaccaccaattctggttttgtatcatttggtacgttttgtgtcattttatctgtttataaaacttaatccaacatctttaattagtattcttaaatgtcaaagttcaaacaattctcattgcagatattacttcacggcacattgaaggaaagagactggacaaaacggtttggaacttgctaaatttctacgcatgcgctaagtaccatattaaggtacattagttctagtttttcaaataaaatataatagattttgtgttcttgtaattgaaaattttcaacctcgtattgtttaaatagtgctcgagagggtacatacagagacggatgagaaaaagaatggaaactttagttaaggtatttttatcatatattacgtacacacacgaatctacaacaatagttgacatttcataaacaaaataacgtatgtttgtaaatttacattatatacgtagctgctaaataacacaagcctagaagaagaagctgctcaaaatggtatcctttttttttgttacctttaaccttacttaggtttgtatatataaaaaagttatattatcattttttcttttccattctctaatttctatatagaaaacggaagatgcaaatacgtaaaggagtttgtgaaggtaccaaaaggtaaattgatgatgaaacaaagatgcaaggagatgacaaggagagtgaagataagcaagttccggatcaaaatcaacggttgtgctcggtttcgattcaatcagcggtggatatctctccccaaattctcttcgaaaccatcagataaatcatacacaaaattggactaagtaatcacttaacttggaaagtctcaagaaagaggctcggtgttgttgttttttttctttgtcaacatgctttaaaattgaattcggggagcaatattatacgttaatgaatatcttgacaacaaaaaaaaacgttatcagataaacttatggatataatttggtaaaccaaaaataaacctaatcaaaagttggcattgaatgcagcatgttacgtaagagctttgtacaagtaccattcactctttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagagaatg

SEQ ID NO: 11092 - DNA, 3000 bp, Unknown
  misc_feature (1)..( 3000): cDNA_ID_1021787_gDNA_ID_2214478_Annot_ID_183200 3000 nt of promoter + ATG
cgaaaccatcagataaatcatacacaaaattggactaagtaatcacttaacttggaaagtctcaagaaagaggctcggtgttgttgttttttttctttgtcaacatgctttaaaattgaattcggggagcaatattatacgttaatgaatatcttgacaacaaaaaaaaacgttatcagataaacttatggatataatttggtaaaccaaaaataaacctaatcaaaagttggcattgaatgcagcatgttacgtaagagctttgtacaagtaccattcactctttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagagaatggcaggagaggcagaggctttggccacgacggcaccgttagctccggtcaccagtcagcgaaaagtacggaacgatttggaggaaacattaccaaaaccatgtaagtgtgaatgtccaaatttatgattttaatgtgtaacaagcgggaaattaagtggttacgttaaatgaaactacaaaaacatccaactattaacatgacaaatcgtatattatccatttttaaaagttatggtgaggacatgaacatgtttcaaattaagtgtacctttcaagatttgtagtgttcaacacaagtcacaataacttaaagaaaaaatgtaattttcttgaaaaagatacataataatctaacgtacaaaaatgaaaaacagacatggcaagagcattagcagctccagatacagagcatccgaatggaacagaaggtcacgatagcaaaggaatgagtgttatgcaacaacatgttgctttcttcgaccaaaacgacgatggaatcgtctatccttgggagacttataagggtaattattacttgttatagtctcttcaaagacttcaatcttcagaaaaaaaaaaaattcaaataattgtataaaaattgcaggatttcgtgaccttggtttcaacccaatttcctctatcttttggaccttactcataaacttagcgttcagctacgttacacttccggtatggaaaataatccagagacccttcgaatttaatttgaattttattattattttgtgattttaatttatgttgtgatcaattttatgtaaaaagagttgggtgccatcaccattattgccggtttatatcgacaacatacacaaagccaagcatgggagtgattcgagcacctatgacaccgaaggaaggtaacattaacatatatgtaaaatataatatccaataattttaaatagaattttcatgatactcaattttgtaaaattgcgattgtttataggtatgtcccagttaacctcgagaacatatttagcaaatacgcgctaacggttaaagataagttatcatttaaagaggtttggaatgtaaccgagggaaatcgaatggcaatcgatccttttggatggttagtactaaaaacattattggttattagttgatttttttgaatgaaatttattagttgattttacatacacggtaataagttaacactaaatcctaacgaaatctgctaaatttgttgtgttggttatggcaggctttcaaacaaagttgaatggatactactctatattcttgctaaggacgaagatggtttcctatctaaagaagctgtgagaggttgctttgatggaagtttatttgaacaaattgccaaagagagggccaattctcgcaaacaagactaagaatgtgtgtgtttggttagcgaataaagctttttgaagaaaagcattgtgtaatttagcttctttcgtcttgttattcagtttggggatttgtataattaatgtgtttgtaaactatgtttcaaagttatataaataagagaagatgttacaaaaaaaaaaaaaagactaataagaagaatttggtattgttcatttcatgattaaaatggttcatgggctatcatgggcctaaaaggccttttccataggtttaaaccctaatcctttcttctccttcatttttctacttcgatcagacgccaaacatcagaagccctagagcttgagccgtcgaaaatg

SEQ ID NO: 11093 - DNA, 3000 bp, Unknown; identical to SEQ ID NO: 11076
  misc_feature (1)..( 3000): cDNA_ID_2705285_gDNA_ID_2214478_Annot_ID_183199 3000 nt of promoter + ATG

SEQ ID NO: 11094 - DNA, 3000 bp, Unknown; identical to SEQ ID NO: 11075
  misc_feature (1)..( 3000): cDNA_ID_2705289_gDNA_ID_2214478_Annot_ID_183198 3000 nt of promoter + ATG

SEQ ID NO: 11095 - DNA, 3000 bp, Unknown; identical to SEQ ID NO: 11074
  misc_feature (1)..( 3000): cDNA_ID_3034418_gDNA_ID_2214478_Annot_ID_183197 3000 nt of promoter + ATG

SEQ ID NO: 11096 - DNA, 3000 bp, Unknown
  misc_feature (1)..( 3000): cDNA_ID_1442932_gDNA_ID_2214478_Annot_ID_183196 3000 nt of promoter + ATG
gcacaggtccctaaacactttccttaaagaaccaactaatacctgttttcctttctagctttgcctgtatgctatataacagaaatgattatatatatttacaagaaacaattgtgtggattatactttcttcatgagcattttcatatcagctaaaatccgtggttcggtgtatggttagagtacgagctcctttactcatgaaagcctttgtcatattccttgtttttattcaggtatcagatgattcaaagaatgtagattacacggctgctgcttttcatcccgatggtctcattctcggaaccggtacttctcaatctgttgttaagatttgggacgttaaaagtcaggtaaaaactatgggcttccaaactatatgacctattaaaattattaattgtgtacagtgttcttcattatagttttcatttttttggttgataataggcaaatgtggctaagtttgatggacacactggggaagttacagctatatctttctctgaaaatggttacttcctcgcggtgagtactttgaacaaaatacgagaagagagaatacagcttaagttatgcttacatgaatgattttctttttgtcctggaattgacagacagctgcagaggatggtgttaggttgtgggatctgcgcaagttaaggaacttcaaatcatttttatctgcagatgcgaactctggtacacaactatcgtatctgtttctactcattttgttgatagagaactttctatgtattataagctcgctttgattaaacctactttttttttgtgtgcagtggagtttgatcctagcggatcttatctcggtattgctgcatcagatatcaagtgagtacacatttgaaaatagtgatcaaaacatccaaagctcagctaaagaaaatatccaaagagaccaagctagcttgattaatctgcacgttgggttaacacaatttatgtgttttggctgcagagtataccagacggcaagtgtgaaagctgaatggaaccttatcaagacactcccagatctctccggcactggtaaagtcccttacctaactccttcaatgatcacatagcgataatgttgctaatttcgaagcccttacacttgcaggtaaagctacgtgtgtgaagtttggttcagatgcacagtacgttgcagtcggttcgatggaccgtaactacggatatttggtcttcctggtgatgaaaaagccaacgtcgatgatgactctgcgcaagactcgtgaacaatccgtaaaaaactcagacagaacattccaaatgtccatctccagtgttatctcgctcaaatttctcaagttctgttgtatcttacagtatttgcagcaatgggggagaatttcataggtgcgggtcatgagtgagtggtgattgtgatcatcctcgctacctcttggaattcaaacaatgacactcacaaaccctcgagttttcttataggctcttttaatcgctttgtaccttcaatatatgtaccaaaaaatgtgttctttctgttgccaaatgaattcagacactaatgaagatcccaaaccgatggtgctaaaccgcatttggtattatttaatctgttctagacagtggtggtctgcttagtattccgtattccaacaaatgatttcagctggtctctgagaacaaaattttaactaaatgttaaagaatacccttgactgtacttggtcaaaaatcactgggcacaatatttacatttatccacgaatatcagattcgtgattccttttgcaattccaggattagtttaacttcacgcaaaagataatgttttgtaataccctttctttattgtgaccaggattgacaattcgtgttaaggtataaccacgtgtttcctcacaattctaaagaatgcttatgtttctccctgtctatattatttttttaattttgtctgaaaatactaaaataacttgaacaaatcatcgtataaaaactacaaaatacataaactaagcttaaagaaatacctacacgatgaactttttatatagtaattagtaacaactacaaaatacataaccttactagctactgggaaaaaaattgtccagttttagatgatcagagtaaatataatactaattgtcttccattttaattattgtcgaaaacgtgttttcataaagtaactattattgggtttcattactaaattctaaacatcaaatggaattgaaaccaaaagagtagttattctaattttaaaaagttaggtgttgaataaacagtttaagtgaaatctaataatcaaagactgcaatacacacaccaagctcactgtactgtctttagactggtcagtggtggctgaagaaagaaaagagtgtttgattgttatattaaaaaataaagaaaacaaattacgctcccttctctacagactctctctatcctaatcctatttctttttccacatctcctaaagaaagagaaaagagtggtcatccatccatccacagcctcttacaaaatctctctctttcaccattaacaccaaattcagaaaactcagaagaagcaaaataaagagcttttactgatccaccaaacacagaatttcataaactcccaaaaaagttaaattccaaacaagccccacaacaacaacaacaacaaaaaagattttaatctttctcatttacccatatcctcaaaattcccacaaaaatctttcctccaataacataacaaaacaactcttcttctacaacaaactatgttctgattttttagtttcttcttccacacaatacaaaagaaatggggttttattcactgaagcagcttttgttactttacatcatcatcatggctctgttctcagatctcaagctagcaaaatcttcttcaccagagtacacgaacctaatctacaaaggttgtgcaagacagagattatcagatccatctggtttatactcacaagctctctctgcaatg

SEQ ID NO: 11097 - DNA, 3000 bp, Unknown
  misc_feature (1)..( 3000): cDNA_ID_3034430_gDNA_ID_2214478_Annot_ID_183192 3000 nt of promoter + ATG
tcttccttcacttatggcatttattctgcttagtaaccttggagcatccattactgaagtttctcaagacgctcttgttgcggaatacggtttaagatatcagataaatggtcttcagtcttatgcacttatggcttcagcagttggaggaatccttgggaacttactcggtggatattgcttactcaagacacctcctagaatcttgtttcttgcttttacagctttgttatctcttcagctcattgtttctttatcttctaaagaagaatctgttaacttgccacggatcggagaagtaactccagagataagctctgttttggggatcgtaaagaaacagtttttggatcttaagggaattgttcaggtagatgaaatctcccagcctttgatttggatagtatcttccattgcattggtccctcttctctcaggatcagtcttctgctaccaaactcaagttctaaaccttgatccttcagttattggtatgtcaaaggttattggacagttgatgcttctctgtttaactgttgtttatgatcgttactggaagaaacttcccatgagggcgttgatccatatcgtgcaactcctgtacgcgttttcattactgtttgattatatcttggtgaagcaaataaatctcgcgttcgggatctcaaacacggcttttgtgctctgtttctctagtgtagcggaaattcttgcacagttcaagattcttcctttctctgttttgctagcaaatatgtgccctggaggctgtgaaggatcaatcacttctttccttgcttctactctgtgtttgtcatcagttgtaagcggattcactggagttggaatggctaatatgatcgggataacatcgaagaattactcaaacctgcctgcaggaattctgatacagtctttggcagctttggtgcctttgtggtttattcattatgttccaatgttagagcctggttttgagagagaagggaagagagctatgagtaagaaaagcagaaggaatagacgtgtagggagagtcataggtcaggaaagttttgcttaccggcgggaaagagaaacataaacaagaatcagtctgagttatagttagagctagttcttcagctgacataacattgtttcttgggaggagaagattttgtgcccatgtaagtaaggatggatactgatgttggtaaacataaaagtcccaagattgacaagaatctcataaatccaatcaaagcaatgttatatctcagttcacaccaatcttgctgcagcaactccaagaatctccccactgtttcattcatcgttcttggtttggagacatgagatgtcatttcttccaagacaagccaacgcacagtgtaatatcttgtactaggataacaatgacctagaaatgaaattaaagttttggttagaccattttttgaatagtaatgaaattgctatgtaatgaaagaaaatttaggatgtgaattaaagttttgattagaccattttgaatagtaatgaaattggtatgttattttgtaagagatttacggttttcagaaagattgtttgaatagatttattagcaaattggaatattcagtggctgagattaaagattccgatgatcttgtggttgtgattttaggaacctagtaaattaggaggtgtcactttagggattaatggttttgcatagttgatttctctatttaagagcaactctgacttctctattgcttcattactcgaaatcctatgttcctccttggctcttccacctccgatcacctaccacaacaagtttttctcctccttttttcgagtctttctcttccccttttcaaaatttttgaccatccatcatgtttctatatcatgaagggaaaccatcatcgtcacaaagttcattctttccgagtaacacttttggtaagatttctaacacatatatcacgtttaaactatcctctagagtttaaaataaatcatatatgttagacattgttcaacattaaaatatggtggaggcaatagatccaaagtttactagaccacttatttttgccgatcaacgacggtcaatggccaagtcatattctcaaatttttttctagtagtgatccgaatactctgaccttctctcctagtctaaataggattctaggaatctatctttgacatcaaagattttgatatgaacatctaagtgagcagggtccaaaaattaaatattagtctaaaaagtgtaattttctttataatttattttttggataaaaaatgaaagtttttgtaagttaatatattgatataatcactttcaaagatttcatatatcaatataaggaaatgaatattcttttatgttataaaagatatattttatccaaaagtgataagagcacttgaatacaaatgtggattgtactggcatagaaacaaatcttttatatattaattgagaagtatatttcagagtctaatggtaaaattttaaggaaattaccaaataaatgacattagaaattaaatacaaataatttttcatttattttcctttaatttaaatagaaatgtatagttcctttttgcttgaaaaaaaataaaatataaaaggaaacatacatttatatttaaattaatgaatataataaaatatattgtatttaatggaaacgtcattttggtaactttcttataaaaaaaataagattctagtctgaaatatattttttaattaatatagaaagatatgttttaatgttagtacaaatcacattaaacaattttgaactattaaaatttaatgtagacgattaagatcaaagttaaaaaaaatatctcaaaaagatcagtcatttcctctataaatacgtgattttagtccattgtcaaaacgtcaaaaacttgtacgcaaggatggaaaaaccaaataattagtacagaagaaaatatttgtctcttaagtcttaatagatccaactagccgaagaa

SEQ ID NO: 11098 - DNA, 3000 bp, Unknown; identical to SEQ ID NO: 11071
  misc_feature (1)..( 3000): cDNA_ID_3034442_gDNA_ID_2214478_Annot_ID_183188 3000 nt of promoter + ATG

SEQ ID NO: 11099 - DNA, 3000 bp, Unknown; identical to SEQ ID NO: 11070
  misc_feature (1)..( 3000): cDNA_ID_3034445_gDNA_ID_2214478_Annot_ID_183187 3000 nt of promoter + ATG

SEQ ID NO: 11100 - DNA, 3000 bp, Unknown; identical to SEQ ID NO: 11092
  misc_feature (1)..( 3000): cDNA_ID_1021787_gDNA_ID_2214478_Annot_ID_133167 3000 nt of promoter + ATG

SEQ ID NO: 11101 - DNA, 3000 bp, Unknown; identical to SEQ ID NO: 11091
  misc_feature (1)..( 3000): cDNA_ID_1807236_gDNA_ID_2214478_Annot_ID_133168 3000 nt of promoter + ATG

SEQ ID NO: 11102 - DNA, 3000 bp, Unknown; identical to SEQ ID NO: 11090
  misc_feature (1)..( 3000): cDNA_ID_2705281_gDNA_ID_2214478_Annot_ID_133171 3000 nt of promoter + ATG

SEQ ID NO: 11103 - DNA, 3000 bp, Unknown; identical to SEQ ID NO: 11089
  misc_feature (1)..( 3000): cDNA_ID_2705277_gDNA_ID_2214478_Annot_ID_133172 3000 nt of promoter + ATG

SEQ ID NO: 11104 - DNA, 3000 bp, Unknown
  misc_feature (1)..( 3000): cDNA_ID_2705273_gDNA_ID_2214478_Annot_ID_133174 3000 nt of promoter + ATG
tttggatattgttgaaattctaagttttgtttctatgtaacaattttatttaataatgtaaattgaggtttcactgttttaggaaattactttgggtagaagattagttttcttttcaagaacaattcatgtgggaaatggtaaatttattttagtaatcttttagaatgctgaagcatgctaaaaagagacgattactcttgtggtcaatctgtggaaaagcaaatacaatttggggttaaaaggaaacaatgtcaaaataaaagggcgatctgatgatatctccaataaataaggggaaaatgaaaaagtaaacaagttgattttaaaatccagcggacaaaatctgatgtgagtttttttcttttaatctctcgtccccgaaaaaaagttgacgaaactctctaccggaggcgctagttttcgccgtcggcgaggcaatttaactttccggaggtgcgacgcttctactccgcttatttttttctgctcttgttatttctcgtctcatgtcaagcttctttatgccttctctttgggtgtaaatagttggattagtcgcgaaaaaatcacgattggttcttcatttcgatgtatattagggtttgtgtgagcatatgattgctgagaagtagctagtaattgaatgtttatgtggttagtgggtaggagaatgggctgtggagatatctctactctgcgccgtctagttctttaggtcgtggattacttaatgcgattagattcaatcggatcgtagttctgatctattcgttcatcttgaagtttctagtcaagtagttaggaaatggtgttggtttttagaggcgcagtcactgtttcttgtacaatcagttaaataacttgctttttctggtggttaggagcttgttaaatgtgatcgaagatctatgatatgataaaaaaatctggaatagtattgtgttggtaggtttctgtttctgtgattttggctccatgtatcttgtaattttgaagttcctggtaatgatttctatgttggacgagggagtggaaactcatgaattcagctgtgcattgccttataattgtcttttgttctcattctattagtttgtgatttatgtctgctgatgattgtgctctctgctcattatctcaagggaataaagcaggatgaacgaagttaataagcaaaaggaaaatcgtgatggacatgaaacacttgtaaatgaagaaggatctgctgctcgaacaagacctacaagtgttgaggagattaggctaaggaggaagaggaaagagtccttggaaaatgtgaaggaggaaactgtaggagcagcacagttactgggttacgatcttgttgaaaaggcttctgactatcatgagtccaagaatttgaggcgtgaagaacatgttgaagacagttcaagaaaggaaaaagaagccatttctagatgtagggaagaaaaaatagaaaaaccaatgaaagaggaccctgtgggagcagctcagttacccgataaaaatcttgttgagaaggttcttgactgtcatgagtctgaaaaagggtatgatagatccgagaaactgagtcatgaagagcttgttatggacagctcaagaaagaaagaagaggctatttctagttctagagaagaaaaacttgataaaccaataaaagatgatcttgttggaacagctcagttactgggtaatgatcttgttgagaaggttcctgaatatcatgtgtctgaaaaagagcatgatggatccaagaacgtgaggcgtgaagaacgtgttaaggacagtttaagaaagaaagaggacataacttctagttctagggatgaaacaccaatgaaagaggatcatgtgggagcagctcagttacggggtaacgatatcgttgagaaggtttctgacaatcatgcatctgaaaaagggcatgataaatccaataaagtgaggcgtgaagaacatgttaaggacagttcaagaaagaaagaagactacatttctagttttagagaagaaaaatcaagaaaagaggatcatgtgggagcagctatgttactgggtcacgatattgttgacaagttttctgactatcatgcgtctgaaaaacggcatgataggtcgaagaaagtgaggcgtgacgaacatgttaaggaaagctcaagaaagaaagaagacgccacttctggttctacggaagaaaaatcaatgaaagaggatcatgcgggagcagctcagttactgggtcacgatattgttgagaaggtttctgactatcatgcgtctgaaaaagggcatgatagatcgacgaaagtgaggcgtgaagaacgtgttaaggacagctcaagaaagaaagaagatgccacttctggttctagggaagaaagagtagataattcaacgaaagaggaccctgttggagcagctcagttactaggtaacgattttgttgagaaggtttctgactatcatacgtctgaaagagggcatgaaagatccaagaaagtgaggcgtgaagaacgtgttaaggacaattcaagaaagaaggaagaggctatttctagttctagaggagaaaaaccgattaaagaggatcatgtgggagcagctcagttactgggtaacgatcttgttgagatggtttctgactatcatgaaactgaaaaagggtatgacagatccaagaaattgagccgtgaagagcgtgttaaggacagttcaagaaagaaggaagaggctatttctagttctagagaagaaaacctagataaacaaaaaaaagacgagtctacttcaaatagaaaaaggaaagcagaaggagagtgttctacagctgaaacagaatcaattgaagaacatagtaaggatagacgaggaaagaaagaagaaactaattctaattgtagggaggaaagacgagataagaagatgaagaaggaagaccttgcttcaaacagaaaaattgaaggagaaatccctacaactgaaacaaaaaca

SEQ ID NO: 11105 - DNA, 3000 bp, Unknown
  misc_feature (1)..( 3000): cDNA_ID_1019997_gDNA_ID_2214478_Annot_ID_133175 3000 nt of promoter + ATG
ctttgtccttcatttttgatcagttcttactgtgattttcggctgagtagttgtaggaaagtctatgaaaaatgactgattatcaaggctgtggactttgtccttctatttggccttgtacatcagtaccatgcattttactatgatttctgagctatgttatggttaccatccatgaagcaggttttcagacggttgctattttcatgcagaacggtgaattggagaaaaaagagccagccgcaaatgcagtaagtgacaacgtggaggactcatcaaacaaggtacaaataattgccctaaatttgcttcttacgacagtgggtaaaactttttatatcgaaaatgagtgtagagtgtcttttaaatatctcttaacgtattcccttttgaaagtactgtaattgtatatgtcagtgacccttggtttatagttcagatcaaatttttagtttgtgccatagtttcgataccactgtaatttgtaatctcttgctctagagacaaaacatcggtatttctaaatttgacttggtcctttccattcatggttcatgatgtggggcatatcttggaattttgttgcatgtttttcatgctgacagcttttatatccttttccgtttaattgtctgtcagtagaatatcaattttgttagagttaacaacaaaggaataaaacatgtggctggatcaacttttttgtaagtttggctggtagtaggtgttatgatcaaaagcttgttcatagtggttcaacctggaaagccaaatgtcagaccaccttattataatcttaaagtgaaaaacacgcagagaatagaagtgcagttctctccgcagctacggcatctttgtggttgataatgttgaaagcttcactgtatttgcttgctatactaatttctttttctgtcaagcttgatattgagcctagtgtacttgttgcagatcttcattggcggattttcaaaagctatttcatctgaaatggtatgctgaactgtaattctttgaaaacatttgacacgttcaatcttctattgtccccatttctatcgtttcaacttctaggattgtctgattcctctttaacgtttttccagcttatggagattgtcagcgtctttggacctttgaaagcataccggttcgtgagcaacaatgatctcaatcagcgatgcgctttcctagaggttagaatgtacttttatttgtggccaagatacccccatcttagtctgccatctcgatgtagttcttgtgattgtttcatatctttaatttttcattttccgggtagcatgggaaggtgttattaccttgtaacttttacagagtaaccatgaatgtgactgtagttccaagtatattcatattaaccagccctaactctttttaaatctctatatttcagtacactgatggatctgttaccctcaaagcttgtgctggtctaaatggtatgaggttaggtggcagtgtaataacagccgtttgtgcatttcctgatgcatcatccgtagcggtaattcagtgacccaactttgctttcgttagttcatgttgtgtttgtatgggtgacattgaacagaaattcctttagttacttgtgagagtggtgtgtgtacgtaatatgtgttgcaggtgaatgagaatccaccattctatgggatacctagccatgcaaaaccacttcttggcaagcctaagaatattctaaagctaaaaaatgtggtaagcataattggtgtatcctttttcttgtgaatctttcccaaataaactatgtgaggctatattaacattccattctttcttgtttgacaggttgacccagaagatctcacgtcgttttccgagcaagaagtgaaagaaattttggaggatgtacggttagaatgtgccaggttaagctctgagatcatcttcccatgagtccattgagcttttaaaagctagtaaattaagaaaataggcctctgggtcttgtcatgatgcaggtttggggttattaagtcgataaacatcttggaacacaagagcaaagatatcactgtttctgaaacaaatccattgttgaacttagaatcaactgattctaaagaaatgaatgtgtcagtgatcgaggagaaagatgaaggatccgagaaagcggaagatattgcagacaatgtagatcttgcagaggttgtcatgccagacagtttgacaggtgaagacaagttatgtgaaccgtgctcggatactgctgctgaaacaagcactcaagaaaatgaagatctacactccactgaacaagagcattgtgaaaagattgttgaagaaagtgcgcaggccgaggcagagaatccacaagaagtagcatcagtgcgtaccgtgaagacaagatgggatgctggcgacaagatagaagaagaacaagaagaagaccccgaggatgtatttgagacgggttgtatcttcattgagtacagaagaccagaagcgacatgtgatgcagcccattctttacacggaaggctatatgataaccggattgtgaaagcagaatatgtttctaaagagctttaccaaatccggttcccaagtgggtaaataatcccacaacaagtgagactctgtgattcttctcatctttaccacataaccggttcaaaccgagttcagagatacatagcatctacaatcaaaaacccttcaaaaatctctttgtaatcgttgggattgatcaggttggattattcatcaccacctgtgtctcgttacttttatgtattagagaatccaagaagggaaagatgaaaccatactattgtgttggtggctatatggaccggtttgcttactgaaaaattgttgtgttaaaagagaacgtaaccttctgaatgagaaagcgtctttcattttctacaaaataataaataaaatgaacccaatctccttctttatccaaatcctccttcgaagcagaagtaacagcaaccaaaaatgacgaca

SEQ ID NO: 11106 - DNA, 3000 bp, Unknown; identical to SEQ ID NO: 11086
  misc_feature (1)..( 3000): cDNA_ID_1806994_gDNA_ID_2214478_Annot_ID_133178 3000 nt of promoter + ATG

SEQ ID NO: 11107 - DNA, 3000 bp, Unknown
  misc_feature (1)..( 3000): cDNA_ID_2705265_gDNA_ID_2214478_Annot_ID_133179 3000 nt of promoter + ATG
ttgttaacgatcgttaatactaaaaattactaatatattagtcgtgttatctatgtgttatgaggtgtgttaattgttgatgcataatgaatgaacatgatctctaatttgtttacctcacactatgtgattcaagggtggaagtcgttggttagcaaacattagtgtctcaggacaagatagctcaggacaagatgtccgagcggttcagaatcagtaatgtttttttccggagactctactcgttgagtttttgcttgtactccctggtgtttgtgttgtgatgtagttttgttgttttacttagtttttgatcttttatgtaatttgtatttcgctgtaacttcggtaaaaaacttgtgaaaatagtataagtacttaacattgatacaaaaaaaaaaaaaaaaaaaaaactcatgaggtcttgttatatatatggtgatcacatctttaaagaaaatgttatagtatttgttttagtttaaacaattttttatgtgccaaaaacattattaaaaagagagcaataccctactctaaaatagtaaagctaccaaattcaattcattacgacatggctcaaaagaaaaagtatttcgaatattatacgatatcaaccccattatcattgctataaaataagccaaactttacctctccattttcaataatctctcatcttctttcgtctctctttctacggttcaaacattaaaaagatagatggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtacagaaattgaaaaatctactctagggtttcattcaaattcaatatttgatggtgtatatgcatgatgatcacaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatgtaagagaatcaaattcaaataaattagattcatcaatcagttggataaaaacttggctaaaaagtgtattttaatgtgtttttaaaagggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatagattaacaaacttgggaacaacttctattaactttaataaattagattatgattgtttccaaagttaattatgcaatccaggagtctttcttggttttggtaattaatagccatattttatagcttatctaattgtatcaaatattgaaaactggttgatcaaatatctaatttgttaatgagtgtcaattaacaacaaggaccaaccatctagctaacaattcaagcaatcaaatcagagactaacactacattaaagatcactcttacaaaaaaaaaatgtggaacatttttttatagaaaaaatcatatacccaaacaacacaaattcatttattttgatatctgaaaaagcattatatgttaaaaatagaaaatgcataatgattatttctttcaattgttgggttgtttctaagtttttggacaacacttttttacccatactgtaaaagatcacaacattgataagaaaactctcatgtctggttgaaataaattagtaaaaggttagaataaattggtttaaaggtaaattaatattttagttttggcacaaattaacaaatcaattaatttttgtttatttttaactaaaacatcattgattatctatctatatccgattcaaccaatataaaataatttatcaaatataaatcacccaaaatcaataataaactagataattttgcaatggaagtcgaaaacatcatctcatttaaaattccaaaaaatcaaataaaggaatattaatataacatagacaatttagtatgattttggttttagttaaacatatctttgatcttcaaattttttttatttttttttcggtttgattgaaacttacttttatagtttgattttcagattgattaagaatgaatcggtttgataaaactctaatgtaaatggagtaattattgtaatattcaaaagcctaaaccatttgctgccatcattaattgcacttgctgacgtaattataagcgagaataatatgatcccaaaaagaaaattgataaaaaggacgaaagagaatcaaagagacgacgaagtcaaggatcaaagccttaacttttcctctaaaacaatcgcttttttatttttctaaatttctctctgttcttttttcctctggttttgattttttcctggcattattattagggtttttttcatacgttgttgaaaatggcgtagttggagaaaggagacgaatcgatcatctacctacttgcccattctttgtcgtcgtttttcgattttccttgattcgccggagaaatagcgtttccggca

SEQ ID NO: 11108 - DNA, 3000 bp, Unknown; identical to SEQ ID NO: 11085
  misc_feature (1)..( 3000): cDNA_ID_2686517_gDNA_ID_2214478_Annot_ID_133180 3000 nt of promoter + ATG

SEQ ID NO: 11109 - DNA, 3000 bp, Unknown
  misc_feature (1)..( 3000): cDNA_ID_2705261_gDNA_ID_2214478_Annot_ID_133181 3000 nt of promoter + ATG
gattctttattatgtagaaaacctacagaaaatcacgttgtaaattcggtttcgaaaccataaaggacttcaatattcaactattctttaacaagtgaacttttatcatctatatcacttaaatctttattctctatatcacttgaattcataatagagaaacgaaaatttaactaaacacaacctttaaagaacccttaaaaagtaattaaaaaagaaggaaagtgaattatactaaacaaaagattatgttaaaattcggattcttaaaaatcttctagggaaaaaaaagcaaaatggaatatggattcgataaggaaggaaggagaggagacccacacacaagaacagagtgacagacacaatttggcgtctctttcgatctgaaacatctctgtctctcctcagagattcccttcttaggtcccattgtctctctttctgtatattacaactcttgcaaacctttctaccaccaagataaaattattatttggtaaaaagcaatatctttaattttctaggaaaaaagaaagaaagaacaacactggattgaagtggtcgtcgctttctctttctacacttccaacagattcccttttgcacttctctctttcactcttttcactatttttgttttatcattattttgtttacggaaacgtcattttcctccagacaatacctttattccctatatatataatggtatggtgtaaaaatgttattgccactgtatatattggtctatcacaattccttctctttatcttcctttttgtatttttgcagcaacaacaaaaacgtaatttatagttaggtagttatctttctttgcatgttttgtgtatgtacgtaactaagaatggtaagttttttttgttttccctcgattttaccagttcaataataaacgttatgcaatctgaagttaattatacatacatctacctaatattctattaaaccatactatatagatatagcatgcttcatgttagtacctaatatcttatatagttatatatcacatggtcttcaattgtttgggtgagaaaactatatttattggctttcttttctcatctttttcattcctttgtgtattgttgtttcgtaaactttttaggatgaaagtaggaacatggtgatcatggtcttgacttttgtagtttttatttttgacgtgatgttcttggctttattattcaaaagatgagtgaagtgaggcatcaatatatgatagttttcacaaatttaataattgcagctaaagatcgagagcctttgcccacataaaaaatactttactctaatgtgttaaaacaaatgttgacattttgcatttactttctttataatttggttgactttctctaaaataaaaatctttagttcttcaattattttgctccacccatcatattgcattattaggctttagctattttaaattgtcatctcacggccagattcatttcattttcgaggttagtacttgctgtcgtatagtcattccatcctgaaaatatcatcctgtttgctattgactttcgatgtatgcaccaaacctcaagctagccatcgagttttagatttgaactcacatataacatattcttataaatatttattggattaaggttatagtttgttgtattcactctattcaaatatgaatggattagatgaatatgtaaaaggtgaccgtcttagcaagaagattgatgtgttatgcattagactatgtgaaaaatcgtatattgaatgtaatcgtgactatacgtgcatgagatgaaagtgataatgtgtgatcgatttataaaaatataagtatgaggctatgtgatctggttttgattgagtgatttgtggatctcaattaatgtttgtagacgagaatgatcttctagattgaatgagttgaaagccgtggtaagtcctagttatcattggatgaaggaggagatttatagatttttggatgtttcgagtagatattaaacagtagaacatagttggatttaaattttagtaaaggcttaatggctttaggatattataaagttgatcatgaacaatatttaggttggacggttcaagtttctcatgaatcaaatattcaagtgctaattgccgaaaggaaatactgaaccgaattcgaactgaacaaccacaaaaaacagctaatgtaaatttgtttgagaatatttttgataagaacttgaatccaattcgaaaccgaaattgtaccaaactttttatattttatatcacatcaaagattttactttgaaaaccattattgataacaaaaaatccaaaaactcaaactaaaattcagattaaacaccggtttaccatctagggaatgggattaatataacataaaaaatactaagttgtttcatttaataatcaagtaagattttgcaatgctaaagaaaaacgaaataacagaataaaggaagttccggcattcttttcgatatctacgttgatagtaatatttaatttaacagagtttttccttctttctaaaaacaaaaatctcaggtttaccaactttaacccttcccaagatttttcaacttttattctcctcttattttaaaccggccactaaccgataacaccacgcgcctaaaccctcgcgtgtgaacctaatggtcatacgttttcaagaacacggtaacacggacgtgagacaaaagtgcgagagagcctctgtggtcactttggtctctctgacagctacgggtccactttctcttttacccaaatatccccacgcgcttcttttacttgcgcgtgaactttcaaaaccaaccaatgctaaatttccgaaactacccttcactctgtttttttgttttcttcgttctcttaagattagttttctcatcacaaataataataaactcttttcttttgtttcatctctttcttcttctctgcgtctttgaggcaagaaaaaaagagaagatgaaagcacccaac

SEQ ID NO: 11110 - DNA, 3000 bp, Unknown
  misc_feature (1)..( 3000): cDNA_ID_1808053_gDNA_ID_2214478_Annot_ID_133183 3000 nt of promoter + ATG
agaccacattaaacagttacttgacgtctaagttattggtaatggatcattattaaccgtaaaaccacaatggactatatactattaagggtaccatcaattggtaaatgactgaatggaatttggcacgtcatttcattctgcaggtactgatgcttttgatgaatatttagaacacacaaaaaaaaaacttttaagaactcagaaattaatcctcaggatctctctatgcttttgcaccatttgggtaatcgattcgattatgtgaagactataataaccaaaaatgctaattttaaaagaccaaaatgattgtatttctagtgaaagtcaaatcttccatataacaaaatcttgcacgcagcctctaccgagttgatgatttggagtttgaaattaatgtaataccttggtttaacaaattcaatatatatagtatatattctattaagggtgaatccttccgagagtatctttgctaaatttatcatgaatatcaaatatatcatagtattatcctattgttagcatatatttgatacactaaagataaagagaaaagggagagacaaaaggtatgaaattggtgataccacataagaagtggttgtgttataggcatgcggctctttaatttaatagtccccaccacatcatacacttttgccccatttctcgaatcttaatcaaacaagctagcttttgctaactatgggagaaggtggtcttgtgaatcatatcacatattgatttctaattatgttaatgaacttttcttccaaagtttagacccttttcaatctgacctaagtctttttgtgtaacttccaaaccaaattagcatggtatattatatacaaacgcacatcaagatggtagtaacacaaaagtgtcgtaggattgaaagacacaactttttggtcttgggattgtttttttgttttgtgtgtgtgtggatcttactgtttagcagggatatccaattaagtacaaataactcaatattaatcacatgttcatagaaaactataattcttttcccctgtctaaagtttacagatttagctgtttcaaaatgtacattattcaataatactatgtacatcattcttaaaacaaagagcaggtccatgataactcaaatttgaatccaataaagttaagatattgaaaagcaccacttggcttaagtaattaaacaaatgcaaagccaagagaccttaaaacctcaaggcagataaagcaacagagagatctgtcgagatgagttagtctgttttacagagaagattaatctttatttatcactcaatggttttaaactgtagtgattcagatagacaaaataaatataaaaaaattgtaacaaatagattttatggaaatagtttggtttacattggattgttctttttcgtttttcggttaccatttgaaccgaatatatttttaacacataagaaccgaaagtgtgaatgtgtgtgcgcatttctccttgtaattcgtgtattaaagaacacaatgtaataattattttgttgctaaaaaaagtgatagtacttaaaacttagttagtaaaggtgtttgccaaaaaaaaaaaagttagttaaggtaaaagggaattgagtatggaaaatggaagatcagagacgagaggtgagaaggtggggatgggccagtaacactcttttagccaacctatggctataaaggcaaaagttgttttcagtttcagaccaaattgaatttgtcttttacccatttctacctctctatttcatttccctaacaacttaaattgttataattcatttttctatggtcaagaaagataatgcatttaggctgtgaatggagcatgcggagcaggaggatccagttgcaagatggggtggattattgattatttgttgccatttacataagttatgttctctagagtgtgtttaggaaaataaactgacttgtcaaacatgtcattctttcttaaaccttgttcgcatccgcggtccatcaataaatgatccaaatagtattggatcaagttagcagagaataaaacgcaaaatcttacgttaactctattttgtacggtgtaactttcaaaatttggtgtagtatttctttgaagcttaacttctagtattagaaggaccttagctttatttgagatactaagcataagtttcaaaatgtatttatctgaaattcaaagaaactcttataggtaattgaactaatgtacacactattcagccttcggagacatacttgtgtcacacaaattgtgtgcattggtcttgcatatgcaattgggagaagctacgtgctcttataacacccacatattttctctattatttgtcctcaaatttcttgagcgttttttttctcttccacgcctaaaattttatagaaagaggaccacattcaagtccctttccaactttttattattatttagaaatggtaaatatgagtgagtcttttgggggtttgagtgaaagtccagccacgccaagctccatttgctgattactgcttaaaaacatcaccaaccgtttcttaattaccttcattgtttactcatgtttattgtgaatggttcattataaaatttctatgacataataacttgaatagctagcatcatctcttgaccaaaaaagaagaagaagctagcatcacccaaattagtcaatgattcaaaacgaaagttttagtacatataagaagaaaaccaaacctaaaactatgagtagtggtagtaaaaccatttcaatatgtttacttgttggaatgccatcataataacaataaaataagaaatgttttaagaaacttttacctgtgaatcacgcggcttacggcttttgcagagaagaaagatatttacaaatactcgattttcacaaaaataaaatacaaaaggtgatttcttgatataaaacccaaaagtcatctttcttctctattgacttgagaagaaccacaacaatg

SEQ ID NO: 11111 - DNA, 3000 bp, Unknown; identical to SEQ ID NO: 11083
  misc_feature (1)..( 3000): cDNA_ID_2705255_gDNA_ID_2214478_Annot_ID_133184 3000 nt of promoter + ATG

SEQ ID NO: 11112 - DNA, 3000 bp, Unknown
  misc_feature (1)..( 3000): cDNA_ID_2705251_gDNA_ID_2214478_Annot_ID_133185 3000 nt of promoter + ATG
atcatccaagacaccttttgctatctacgcagatgcagtttcagacaccacatcagggaatcaaccagagtcagacaagtcaagaccagagtttggtagttggctcatgcttggaggcagagcagagaggaacaaagaaaacaattctttacctagaaaatgggcatcattcaaggttttccctctaccctcctaaacaaaactatctcacttggctcatactatctctataaattgatcactaactgcatttatatttattgtcacaggttcctcagaaacccattgtgagaactgttgcagcagcatctgcttccacctttgaggtttttgtcgatgaagaagaatgtacagagtaagtttgactaatttttcagaagttttctgaacaaaacatgtttccaccattaacatgattctgaaatgcagagaggaagaagaaaagaagaagaatgatgaaactatctcatcatcatcaaacgttctgccccttaatggcggccgtgagataaaaaagtaagcaaaaaaattcccctaaagattcattcaccaaacaaatattatatcatgacttggtagagatctaacaatggttacttaaaaaaatgcagagaaacagagctgctacgacagaaccctttaagacatttcccacccaacagcttcctacgatgatgatattggactttcttctctacacgatcttatggtttgagatttgagcttttgtctataaagctccttgtgtgtttttgcctatttggatttgtttttgtgatgtactgggatatactatcctactatgtaccatgatgtgcctttcatgttttgaaattaatgtgacttgtcttgtttcaatccttatatgatttgtttctcctaaagtaatcattctacaaaaaaaaactttatatcaatttccactaattaacctagattaccacttatgattaaacttaaggaatcattttaataatgccctaaatgtggccaagtcattggtttatatggcaagtgactttgtgatcccaataattttttggtctagtcgtctaggcaactagcgtacctttgttttagaaaaattctagagtttcattgtaaatcaatggatacgtatggatgggtacaaactagaaaagataatcaatccattgggcatttcttccatagaaaataaagtggctttaaacggatgggagggggcataaaacataatcaagcattaatagccatttaaattaatgattaaaaacgaatgatgcgattttggagatagactttgagtggtaaacaagggcaaatgaaaaaaaaaacttgggaattttatttggtgttagtggtaggggcatcatttcatttcacaatctaccctttaggggttttaagggttccctttaatgcaaagtattgcattaagtacgtagctaaacatttatacgactgagtcaagatttctaataaaacaaaaaacaaattctatgcgtaagatgaaattctatattcaaacagaaatggtatttacggtatcgatgtctcttggtttttattttattggctttagtttcatgtcctcttactagcaagcttgaacaaaacattggcattggttctctttctccatctcaaagaacattatggtttaatcttgatttgatttatacatgtttacccttagtcatgtgtgtttcataaatcatatctccattttggatttgatctatttcatagaaaactttgctctatagttctagagctctagagtttctctttctacttgtcaaaaatcataaaccttaacatgtagtagtgatatctctgtttttcttttcttcttacaaaccttaaacaacaaacttttttttatcatgattttttttcttatttttaaaccctcaaaagtgaatatattgatatatctatctctactcgtcagcaagctttcctcatgcttctctcgtcattcatttgctttttcataatgatgttgtcttattgtctacattgttttaaggaacggttagctacgatttgtttatacatttaagtaggctcagaattatgccaacaaaagatagtttcagagtttattgcaacaaaaaatagtttacaaaaagggtcccaaaacccatttaatcatttaaatgatttagggtactgttactaattatgatatgtgactgttgaaaacttctacaatgtttatagcattttttgtaatggaactcccaaaaaccctgagggctcttaaagatcactaggttattaaagcagagactcactaatattgtcattatcttaagctgacaaaaacgtagaaaaatccaaaaaaataaatggcggaggaaattgaccaaaacgcatatataaggattatggagtaaaagcaacttatggtagttggagagaaattaaccaatagaaatactcaaagggcgcgtttattgccataatctacgccccctccatatttacacacaaccatatcataatattaccaaatatgaaaattatatgtgcattatctttattacataaacaataaatacagtttattattaatataagaaaaagataatttttgattttatttttagagtgatcttggccgtagaaaatgaggtgatgaaagtgatgtgtcaaaaaaatcaggaaatagccatatcaagcatgtaatccctaattacggtctaaaggaattaaagattacggtctacttaaattcaacatatctacatgaaccttatgaaaggcttaagggacgaaattaaaataaaatgataacacaagggtcaattttatctacagtcaccaaattaaaaatcagattaagatacattaaaaagtcattatctcacaaaataaatcttttctttgctctttcatttgtagctcctctctctctccggcgctaacgggatgtcctcaccataacgccgttaagtctggaacccgtttgaacggaattatcaaaacgggaaggaatattccgtttgaatg

SEQ ID NO: 11113 - DNA, 3000 bp, Unknown
  misc_feature (1)..( 3000): cDNA_ID_2705247_gDNA_ID_2214478_Annot_ID_133187 3000 nt of promoter + ATG
acttgtctgactctggttgattccctgatgtggtgtctgaaactgcatctgcgtagatagcaaaaggtgtcttggatgatctgcaaaagacaaagttgcttaccatagtgagttgcagaataatttaaaggtatgagttgatagaaaatgcagataatgaaaacaacgagaaatatagaaccaatcaaactacttactgatttggctttagctttttggcttgtgggttagaacttcctaacgcctgccttcttgcatctacagaaaacattttcatgtaagatagcttaccaaaacatttcagtggtttccaagttaagttaatgtgactcactattatctcccctggacaataaagtgccaaagcttcttgacggtaagtcattattctcctttggttcctgctggtaggtagaacattaattatgattaggaaaaaccttagtccataatgaatagatataaagtgttacaaagagacaaaactttttacttcatcagctgtgttggaccttctcatcgttctcaccataaacttcttgtacgcgtcattcaacttttccactggctttgcatccctgcacaagttcccactttcaaatcagaccaataacttggagccgaaacatgaaagtaagattacatatctgttcatttacctagagattccaagattgaagatctcattagcagttttgaccttattcttaaactcaatgtgcaaagcataagctatatagtagacagcatgtgtctttccaatctcattgacctccaaaaacttgtaaatcacttccgcatcagcgcaatgctccgccttcaaaacacacacaaaaactatgagtactctctccataacaaagaaagaatcatctagagggtttaattaaagatagaatcattacatattccaaccagactttaagataacgaagatcatccttgtaacgttcagagtgccaaaatttacgaacacattgctcatatatcactaacagtcctgaacattctcctcctggtggaaaagcctcttgtacccattttatacaccttccaaagaaaccaattaagaagctcagtttacaaattggtcacagcataaagattggttcaagaaaaatttcaatttttcaacaacccaatcaagaatgataaaaggaactcactctatccatggagataaagggtcatctccttcatactcatcaatggcttcaatcaaattcctaattcacaaaaacaacacaaaattagacaagaatcgagcgattagactaaaacccaagagcaaagatgtgagattgaaatcagtacctgcgtttctcgatgagattctttctcaattggtggtcagagtgagatttgagagcgtggttgagaataccaacattgcgacctctcttcaatggccggacgttctccttgaaaagctcccactcgtatccagtctcctgcttcgaattaagaaactctgcctctggatctgaaacctgaaccttcgtttcggctgccatcgtcgtttcttcgagcaaattttgaatatcagagagaatatagccgttagtttactcaatgagagagcttcgcaactttttgctttgatgtacgcatactcggagcgtatagacgcttttgatgggcctaacttagatgggccatgatttgatttcttaaacccattaagtggccatctaaaccgaattgtgtatactcctactacaaataatcgataagagaagaaaaatgacaatgagcgaaagtaaaatagtaaaagaaatgacagaatacacttcattaattcaattggctgaacaaaataacacaataatccagagaaaattatttttactgttttgttttcttctaaattagatggttttggtcttttggagaataacaatcaaagcaaaagataaaagagaagatgtactctttttttaccttctttaaataaattacgagcataattcactttttgacttggaagctaaaaaaaagttcatccacaaccacaagatgctctctgtctgtcggttcaacaagggatgatcacatacattgcgttacacgctaaacctagtgtgctcaattatgaattcctaaacaaaacgtactcaagattagaagttgtatacaaagtctgtttttccattgtaacaacttccaccgacaataaaacagtaacagtttattgaagaaaatgaaatgaagaaaacataataaaagaattgatatttatggtatccttcagtttgggaatgtgacacacatgatctcctttattgacgtttaagtttggaaaaaaaaacaagtctttaaatgcatgcaatcgtattcgcaatcaatatacattttgcttgttattactaaagtctaaaactaaaagccttttgccgtacgtttaagaattccataactggaagaacaaatcatgtttttaattcaaatgtttaaaacaaagtctacattcaaaggaatttagaacacactttttttttttactttttgctgggaattcacaaactctttaacgagtctattcacatttcacctttccgtgcccaaactcattcgatttctctaaccgaaactaaatcatcaccaaagaaggtacaccgttacgccaacttgcccaaaggaccatgtgtccccaccatgctgccaattgggagccagcaatacataaaacagacttgatccaactttttacaagttagatgcagtgtctttttcgtaaatcataatagatccaagcccattctcgtataacctccaccacatcactcctcatatcatatgtgagacagccacgagtcttctaatttctacacgccgtgtcggcaaagcctctcgtcacttctctctgacgcttgtcgtcacttttgaatttttttaatttttaaataattgataaccgaaacggtgcgttttactcaccgtcgtcgggaaaaaaaacatgaggaaggaagttttgccgccggtgttatcaaccaccacagt

SEQ ID NO: 11114 - DNA, 3000 bp, Unknown; identical to SEQ ID NO: 11081
  misc_feature (1)..( 3000): cDNA_ID_1033921_gDNA_ID_2214478_Annot_ID_133189 3000 nt of promoter + ATG

SEQ ID NO: 11115 - DNA, 3000 bp, Unknown; identical to SEQ ID NO: 11080
  misc_feature (1)..( 3000): cDNA_ID_1808370_gDNA_ID_2214478_Annot_ID_133190 3000 nt of promoter + ATG

SEQ ID NO: 11116 - DNA, 3000 bp, Unknown; identical to SEQ ID NO: 11079
  misc_feature (1)..( 3000): cDNA_ID_1807490_gDNA_ID_2214478_Annot_ID_133191 3000 nt of promoter + ATG

SEQ ID NO: 11117 - DNA, 3000 bp, Unknown
  misc_feature (1)..( 3000): cDNA_ID_3034366_gDNA_ID_2214478_Annot_ID_133192 3000 nt of promoter + ATG
aaaatgttttttttgtgggacaagttaaaagtggtagaacatcaatttattagaaacaaagagagtgtatttttctttcttccccatcgggaaaccaaacccaatttatttatatattaaactcgtacaatataaaatcttttatatttaactaaaaattcagtaaatatccattcttcgtaaatatttaaactctattttttctttttaaaaagatcaatttacatcttaaattcaaaatataaaccataatatattatgtacatattaatactgcattctaaacaatttcccaatataaaaaataaaaatatatagaggtaaataacttatcataactactttattgatggcctttataattagtttctgctttggtagaattttttagttcagcctttatctcgttatctgcatgtctctaattgagctttgttgctaagttttagcttttttttttcttatgcgatcactttgctggttgttgtgttggttggttcggttccttgtacctttgatgtatcctctatttctctttttatctaggttaagcttttttattaatgaaatattaagtttgattggaaaaaagaggcacattaatagaaagttagctttgttgtttaggttttatttaatatatgtacgtgtgtcatatgtcataggtaacaatcttactatttgattattaagccggtttttgcgtgacggaactcttcttgtatttgccatcaagtgaaagaaagaggaacatctttgccatagtttagtttgcactctctattggtagcttgagttttcagctattcgaatgtggccttctacacctgcttcccttctatttgacatacttatcatgtggtaagctaacccatccgtcaacgaggaagtacaccacatatagtaagtatatatattagactatctagatattttgttaaagattttatgtaaataacttataaaatatattgttattgttttccaaaacaaataaactagttgacacatacttcttaagttcattgttaatttatataatacaacaacctaaacccatggtgatgattacctttagatcactaaaacttttatcaaaaattttgcctaattttcagtagattccatcagagaaacagcttttctacaaaaaaatttcaccaccaaatctcttttctttaaaacttatcaccacaaacacttgtttttctactaacttttttttaatattgtaaaatcttacaatattttaaaagttaaattttgcttatttcacgtcaatttatatgtctcttacaaaaataacaatatttctgcatcaacaatattttcgagtcattaatatatatgttttacaatattgtaaaagctaatgttttttaataaatcttaaattcattgtcaatatacaacaacttggacccctagagatgattacctttagatcaccaacacttttatcaaaatgttttcctaatttttagtagattccatcacggaaactgttattctgccaaaaacaattttacaccaaatctcctttctttaacatttatcactaagactttttcactaacttttctttcaatattatgaaaattaaataataaattttacaatattttaaaagttaatttttgcttattttccacgtcaataatatatgtctctttaaaaaacaacaatacttagcttaaaaagtattatatttctagatcaacaatatttccgggtcattaatatctatattttacaatattgtaaagctaaaaaaaaaaaaatctatcttgcgtgtcaataataaatgtctcttactaagaaaatatcaagattttgtctaattactaattagaaaggaagcactaatttttggggtgaaaaaatatgatttctggacaattagataaaaaacaaaaaaataattggactaaataaaaataaaagataaaagtgaaaatatttaaaaaaattggggataataatccaaataaaaagatttggtcactgggacagattccgcactatatatatattcttgtctaaagaaaataaaaaaccctaaaaaaaagaggcagacagagagatctcctctttgtctttttactttatctcctgaagtttcgcctcagtcatctcgtaagttttctctctctttctcattcaattcaatttttaatgtaatttcttgtttgatttttctattttcttcgagaaaacaaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatggtacaaatcttgtagttaaacactgaattgtgtccctcgtgggcgttgttgctttgatttatggccaaaagtttcaaacttggatatggtacaatcttgtagttatacactgcattgtctctcttgggtgttgttgttgctttgatttatggcttaaagtttcaaactttttcttggagatggttcaatcttgttgttgaaagttgaaacactgaattgtctctcttgtgcgtgttgttgcttagatttatggctaaaagtttcaaactttcttcacttcagagcttcttgaatggaaactatggttttgtggttttggttaatcttctgctaacactttttgccctgttttggtttgggaaagtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccg

SEQ ID NO: 11118 - DNA, 3000 bp, Unknown; identical to SEQ ID NO: 11077
  misc_feature (1)..( 3000): cDNA_ID_1808535_gDNA_ID_2214478_Annot_ID_133193 3000 nt of promoter + ATG

SEQ ID NO: 11119 - DNA, 3000 bp, Unknown
  misc_feature (1)..( 3000): cDNA_ID_2705350_gDNA_ID_2214479_Annot_ID_133200 3000 nt of promoter + ATG
cacatcgattactcgagatattgtttaagagttactactctctttggataatgaactagaataaaagataacattctctcttaagtctctatttatccttccttgcactattgtagttgccttctagcagttgaggaagtagctcggtaaacaaataaaacgattgaaaacctacccaagttcttgtaaagtgatactggtctatgatctgtaagaagctaacttgttacaatgctttcttgtttgtaaggttggtgctaaggatcaccagagatttcaagcatcatatgccaccattcttaaggcccacatgactgctttgaagaagagggaaaggaaagaccggaagaaatcgacagaggcagagaagaaagaaagcacttcaaccactaaatctaagaaactttgatttctccttttgtgtttctcattgatttgcaattgctgcttaagagttgaattttgaaagctattgaaagatctaaaagattttgacttgtgttataatagagattttggtttgcatttgcttttccctcgagaatgttcatcgtgtataaataaaccaattccatacaaatgtacgaacataaatccaattcaaagaaactgattctaaatttcaaacactaagaaaaaaaactcaattgttattatggatctcttcctgttcctaacctagtaagatacctcatcagaatttgattccacataagcttcatcagaatttgaatcaacataagccttgataacacgtctgtacttctcagggctatcataccaggttggtgtgttgatgatcgccttttctagccaatactcatcatacactctttgcctcgacatcttctccaagaatccgttccaactatccatggctcgggtcaatcgaacagtcttaggtcttcccataagaaacctaatgtaatcccttgcaagcttgaccaattcctccccagtgataatgtatgtgtactgcaaaaacaaagatatattccatcaaagcaagatacgatatttgaagttcaaatctttcctgaaatttgtgtcatttaccaaaaagatgaagcctaaggtcgccaaaaccacttgcaaagtttcatctgcgatcccagcaagaccaccatcttctcctcctgacccttcaggacgctcctcaccatttccaccaccgccaccactgcctcctccacgtggaggcatgttgccgccactgtcagtatcataaaagtctttcttctgtatctgctctcgcaacatatcttcaaccgatttcttccccatagctttctctattgctttccatggcgatatctgataacaaaattcattacaacaatcactaagaacaaaattgaaaaaataagaagaacacacttatcatcagcaaacagaacagcaaagttcttagaaacaaacacaaaagaaatcactctccagttgcaaagtaaattcatttacaggcagaagaacttaacatgaggaaaaagcatctgacctcatcactaccatcaggtttatctttcccaccaaataagcacacagcagaactttgtttcgatttcccagtaggtaaacgacggcgatgatcaagaagaggcgaaaactgagtagacactgcagcagtagctcgaagagtaaacgaggtacgcgggaagtgatcaaagcgtactgaagacctaataggtacactggagatgcaatttggtcgtgttatccttgcaggatagtaggatggtcgaaaacaattagcctgagtaaagctcatcttttatcccaatgtttctcttaatgcaatcactttctgaaaagaaaacaaatcaacagcaaacaacgaacacaaccaattagaacccaacattgaccaaaacaaggattcttctgggcatgttcagaatttgagtatatccatttctaatccaaattcggagaaaagaacaaatctttgggataattatatcgtagtcatagaacaataagcaatataagtaaccagaaaccaataacttcgaatgtgatagaatataaaggcactggttcggtaaatataaggtaagaacactgagcaagctcgcaagaaattggaatatcatagagaaaggagagtaagaaaccataaatctaccttttcgaagctttgatgagacagagactttcgaaaccctagtttcgcttggagagaaagaattcaattttttttcccctttgcgtcgtcctgaaacacaacggaggagccgaaactctgtgagagatgaagcgatcgacaaaagtttttatctatcttgaaagatgcagcttaacggcgtcgtttttcacttgagctccgatggttctagagtctctagaccagggttggtaagactaaaccgctttttattgatatgctggtttaattttgacgcatgactatttggaaattgcaataattgagttggatttttctaattttggttgattttgatttataaatagaaacattttggcttcactagtcatttttctcacaattccatacaatttttgttaaaaatcaaagtaagactttaaaagaacgttctaaatgctatattagttgaccaaaaaaaatgctatattagctaacaatatcgtttgagctaattaacaaaaacttggaactattcaatagaaaaatctcaaacgtttgaactaatctaaacttgattatctcaatcaagtttttatgagaatgattttcatccaagtaacttggctctttaaaattttgattacatattcgtttttgatctgatctatgaccgacatggaatttctcataacgacaagagaaaaaactgtgtcattgacttttgttaagtggtacaaagtggcattgactttgactcagaaaaagccaatcaataatcgtgaaagatgtctaacactgatcaatatttcaatttgaatagaccaaatttacactataaatacatcaacacaccttcttcatttcttcacacaacaccctccatacacaaaatg

SEQ ID NO: 11120 - DNA, 3000 bp, Unknown
  misc_feature (1)..( 3000): cDNA_ID_3038701_gDNA_ID_2214479_Annot_ID_133201 3000 nt of promoter + ATG
ccagaaaaaaggttgaaatttagtaaatgcgtttattatggattggctgatagcctgatatacttcattctgtgacaaccgattcaaacaacacattggtacattaggatacaccgcataatcttttttattcgacacctttagttataaactcacacgtgaacgaccacacttatactatgaaaccgtgtcatacgaaccacattttaacatctttagcaactaagatttgctccaggagtgatcccaagcgtcctgcagaactccaagtaatagtttactctgctctgcacggctgcaggacgcctaccgttgcattcaccaccattgatcttcctagtggtggctccaaagccttggtccaagactggacgaacatttaggttccagaaccacatggcacactgaaaggcaacttgggggctacgagccaccatgtctggatcagtcaagagagggagtccgaggaactttccagctgcaccgtaattgtagttccatgtgatttggattggaccgcggccgtagtagtcttttcccggtgtacaagggtacgcagtgctcggtgagcagtatttccctctagctatttcttctttgtagcaaaaaccttgcataacgtaaaagaagatcgttatttataatagagaatgaatatgtatgaattttaatgataaaagaaatgatttgttaacttacccaagaaacattatggtgcttaattagtgtaataatattcttgataataataattcattaatttgcttaattaaataattagtatacatgcattcatgtagtagaactagaagggtttataaagaacttacttccagattcatgagaaaactgagccaacatagcggcaatctcacgcttagcgacggttcctttataggcgtcgaacgattgggcagccgcaatgaaagcctggcgagtgtagaaccctttcgctggacagccatttccgactttgctcatgataccatcaaaaaatgctggtgtgacaacattttcaattgtatcacgaggatcagcgtttagaccgcctgcaccaccgctaggagttggtgggataggtgtggttgaggagctgcaaggtccacttcggcacccggtaccacagtaggcatctgtggtgccacaatatccatatctactgcaacataagttggctgcacatccggttgtaccgcactgttgcgaaaacacggtttttgccatgatggttaaggtgaagagaaaaaggatgaaagcgtttttcaacattgctcttagggtagccattttgtgtatggagggtgttgtgtgaagaaatgaagaaggtgtgttgatgtatttatagtgtaaatttggtctattcaaattgaaatattgatcagtgttagacatctttcacgattattgattggctttttctgagtcaaagtcaatgccactttgtaccacttaacaaaagtcaatgacacagttttttctcttgtcgttatgagaaattccatgtcggtcatagatcagatcaaaaacgaatatgtaatcaaaattttaaagagccaagttacttggatgaaaatcattctcataaaaacttgattgagataatcaagtttagattagttcaaacgtttgagatttttctattgaatagttccaagtttttgttaattagctcaaacgatattgttagctaatatagcattttttttggtcaactaatatagcatttagaacgttcttttaaagtcttactttgatttttaacaaaaattgtatggaattgtgagaaaaatgactagtgaagccaaaatgtttctatttataaatcaaaatcaaccaaaattagaaaaatccaactcaattattgcaatttccaaatagtcatgcgtcaaaattaaaccagcatatcaataaaaagcggtttagtcttaccaaccctggtctagagactctagaaccatcggagctcaagtgaaaaacgacgccgttaagctgcatctttcaagatagataaaaacttttgtcgatcgcttcatctctcacagagtttcggctcctccgttgtgtttcaggacgacgcaaaggggaaaaaaaattgaattctttctctccaagcgaaactagggtttcgaaagtctctgtctcatcaaagcttcgaaaaggtagatttatggtttcttactctcctttctctatgatattccaatttcttgcgagcttgctcagtgttcttaccttatatttaccgaaccagtgcctttatattctatcacattcgaagttattggtttctggttacttatattgcttattgttctatgactacgatataattatcccaaagatttgttcttttctccgaatttggattagaaatggatatactcaaattctgaacatgcccagaagaatccttgttttggtcaatgttgggttctaattggttgtgttcgttgtttgctgttgatttgttttcttttcagaaagtgattgcattaagagaaacattgggataaaagatgagctttactcaggctaattgttttcgaccatcctactatcctgcaaggataacacgaccaaattgcatctccagtgtacctattaggtcttcagtacgctttgatcacttcccgcgtacctcgtttactcttcgagctactgctgcagtgtctactcagttttcgcctcttcttgatcatcgccgtcgtttacctactgggaaatcgaaacaaagttctgctgtgtgcttatttggtgggaaagataaacctgatggtagtgatgaggtcagatgctttttcctcatgttaagttcttctgcctgtaaatgaatttactttgcaactggagagtgatttcttttgtgtttgtttctaagaactttgctgttctgtttgctgatgataagtgtgttcttcttattttttcaattttgttcttagtgattgttgtaatgaattttgttatcagatatcgccatggaaagcaatagagaaagct

SEQ ID NO: 11121 - DNA, 3000 bp, Unknown
  misc_feature (1)..( 3000): cDNA_ID_1399134_gDNA_ID_2214479_Annot_ID_133202 3000 nt of promoter + ATG
tgagtgacagcgagtaagatcctaacttctaccttggctgtgtcttgtgtgattctatctactgaatcagaaacaggtgaagtgagctgatcttctttaaccaccttttgcactgctccattagcaatacttcttgctagggactcttcaaatccagggggaagctcttcatcaagttctttgatctaattttaaacaaaaaacatacattaactcagcagctttaatatataaacaaacatagcttgactagttgtagaagtacaacatgtagattgttgagagattaaaaacttaaaagggtacaccgcagaaccttatctaataaagatttgatctcgacaagacgggcaaggaccggatgatcacggatgggctgcccttcagacttgagtagaagataaaatgttatagattggcaataggtaagtagcagaagctgcttaacctccaggtaccttgctaaaccattcaacgaaatttctccttcctttaactgcaaggagacataattgcataaatttctggaggagtcacaaatcccttctttcgaactagggtgatataaagtggcaatatagaaacatattgaaaaaaattgtgaaacagtaaagaggtttaccttattcataacaggatttatcttactctcaagctcttcaactgcatcgttcaactcagacaaaagaccaactatttccggagcagaactacacgaaagacatatcacgtgaatattattttacataacatgtaagaaagtctaatacaaaataaactaagttaatgaaaaatttagaaccagaaaacatcaacattacctatatactacatccatttgctcttcttttgacaaagagtttatgtctttcttgatctcttcaacatgtgtatccttatcacccttctctttcttatctgtgatggattttgtagcctgcttacctttgtcagaaatttcctgccaaacataaaccagaatggtgcgtcaatgatctaagcaacaggatagttttcaactacatgatagtaacttgtaacacccatgacccacctccatggttaattctctgtcgctatcttcttcactatcatcgtctaacccagcatcagctgctgttatggatccaagttgttctgcccgtagtcgtatgacctcttcttcttccgctttaatgtcttcatcatcacttgataggatcttcaaaatcacatcaaaccagattagccacttacgtagagtttgtttcagagttaacagaatattaacaaaaggaatctagcttttaaaagaaatggaatcgaggcaaataatcagtgggttgcagatgtcgacacttcttacatcaaaatccacattatcaccactatggtataggccacttcttccgccccatgtgctccttttgtcttcctctttatccttatcatcatcagccatttcatcgtcaccatcaccaaactttgccctcagatatttcttctgcctaatcactgaacaattaaggccccgatgagaaaacgaataaggcacttagaaaaggagtagctacaggtataccattcagacagagtagatgcaacaactaactacatatagtaaacatgacataagaaggcatccttacttttcgcagtaagtccattctcggcctcctcttcgtcttctgtatcttcatcctcctcactttcatcatccacaccctataatccaaacaaaactgaaattgaaagggaagcaattgaaagaatcgaagcaaaagatgtctagaaacataagccaaaaaacaaacctgtaaatcaaatacaggttgcacatcatcttcatccgattcatcagtatcatcattaacatccaagggaactatatccctctgtttatgaactgtggacaaaaaaccaaacatcagacataaacttacaaaatctcaaacaatgagcaatctatcacacatatctcatcagaatcgttaattaagaagaaataagctagtaagcacttaataataaggacatagtcattccaataatcaattaagctttaggaaacaaaagaaaggacaaatttttcgaagtgggtagaagtttacaggcgtcaatctcgtcgtcgtattggtcttcgacgatatctttgcgagtttttgtgcttttgctacttctcttcaaagtccctccttttttccccattgttgtgttgcagagcaggttctggggataagcaaacttgtgcaactttacaatcccttatcgaattagggtttccccttcacaaatatcagctcgacggcaacgattacctaaagtttctacgacggggaacaatttagaggatatcaatggtgtctgaagaagaagctgagtttcagagaaagagaacgagaacgtatcgttaaaaccctagtaaggttttataaattactgggcctaataaggcccattattatctaaataagcccatatttaaatggtcctttagtactaagagtatacccgtcttttgatttgtggcgacttcctttttaccgaagagactcctccggccggtgagttttcggacgcagatcatcatcagattcttgtctctctctggtcagtttcatagtttttttctaagtttgaattctgattcttaaagctcgtggcttttgagctgggtttgttgacttgatcggatttgacgcctcctaattgttgcgaattgaattatattgtttccgtgttgtgatttgtcagaagctttgacgatctagggttgtatatcaatggtgtcttagcgtagaattgagtagaaatccgaatgatttgaagaaattgtttcaattgtgcttagattttatgttgcgtattccatttatatcgacaaagttctaaactttaagatctaactcttccctgcacttgcattgtgtttatggttttctctctcagttatctgagtgataagaagtattttcagtgcttgaggatctgcaaaagatatccatctgcggtttaacaatg

SEQ ID NO: 11122 - DNA, 3000 bp, Unknown
  misc_feature (1)..( 3000): cDNA_ID_2705361_gDNA_ID_2214479_Annot_ID_133206 3000 nt of promoter + ATG
ggttatagtgggaaggaatgtgggaagaatcaattagttgaaatattttattattcttgcttgaatgtattccaaagtataattatatgcgtttttaacactaattagtaaatcatttttccaagtccctaaacgatacattacatttgattcgcatgtcttcctcttagaccaagaacaaggtcgagttttttgtcaacagaaatcttctccccgaaacatgaaacaacttatagagcaaaagataaatattatgaactttaattgcccaagcatctgtgatccagtggtgggagaagatttggggaagggtgaaactttcagagctgggttcgatcctccctggaaacaaaaatcacatttgtttggaaagtctgtcagttgggctttagcccaattggtttacctggtagtcagaaatgcaggcggcctgactaccccctggcattagtcggaaagcatccaaattcgggacagacagtgtggtggtctttcggggagaagtccactctgaagtatttcggtgcatttctactgaggctgaccggatcagccgataaagtttataaaataaaataaataaatgaactttaattaaccagaaaatgtagaaacaaaaaatcttactaaacctatgaccaaaaaaaaaaaaaaaaaaaagttgtggagtaagaagtatgaagcgttttatccaacatatcccagaggagaacagtgattggtcgatgtcacgtgaaataacatttggcaaatagtgcacaaattaatgaaggcaagaaagtgagaccagacgcgagatgtgagcgcgtatgaagaaacatgatgagacaacaaagagaatcaacctcgtctatgaaaatttcttcagattctcttctcattgcgataccaaacaaaaactcgtagtatatttttgttggtcgtttttgtacaaaatatataaaaagcaaactgtcgcaattatggtttgtatattatacaccagataaacaaatcagaatctctccactaaacctaatatattttaaaattttgataagtctatatacttttttggcggggacaaccggatagttcttctttgagacttctggcttttttttctcttgatgataataagaaactgtatgaatatttgaaaatgccttatgacgttttcttaccaaaaaaaaaaggcaaaggaactacaaaagatagcttaaacaaatttagacaattcatgtggccttaccttaagtattttagtgatgatacgattttaaaattattagtgccattctatcatgttctatactatataaaatattcattcaatattgatttcatagttaaagtttacaccaaaaaattgacatcacatcctatcagctacggaaatggttaccaacacaaaatagtatatctatgtcctatatatatataggaatttaagacaaagcaatattagtctacttttggaggagatgaaaagttacaagaagtctccctataaaacactattaatgaaccaaaaacaatctactaatcaaacttatagtctactagaggtactttgttaccgtttggttagggatgagtttcaacgtttgtggtggttacaatgaaggtaaaagtaataggcccaagacattgagtgataaagtgactaactctttctctttcttcatgatgataaatcgatttgattaattccaaaaaggaagtaggaaagaaaaagtttcgaaattcatcgcaataccaactagacccagatccaaagttgcagacttttcaaagtaatttacccacacacactctaaaaaggatgggttagagaagactaattatttttcttaatagccaattaaaatagtatttctttattgtgtgtttgcgttagaaaaagatatgagagctgagagagagagagaggaagcagaggatagacagagagaaaagggaaaattaccagacaagagttcttctttcttctctctgcctgcttctttttcctctcttttctctctctctctctttctttgtgaaaatctagaagaagagaaagctacaaaaatctcaacatcgaggtatgttattcgtgtttgcttacctaggagatgatttaagttctgtttcttgatttttcactttctggttttctggggtgtttcaaaagatctgtctttttttgttctctttgatgtctctagtcttgttgggatgtgaaacacatgattttcgaggagtagagagagacagagagaaattaagggaaagagctcacttgtgtgacttgttctgtgagaaaattctctaagcaaaattctcaattttttcagcttctttctaatttatgcatattaaaattcagagcttttacacttgaaagttgtcatctttgtctcagtctctctctctctctctcgtttgcatagaagaaacaatttttgtgttgatttagtcagttcacctaatctgaagagaagttaaaaagtttggctaagatttgtcaaaaagttaaaacttccttttcatggaagctcaacaacttaatctctttggcagtttccttatcttagtttctttggatctgcctttgattttctttcatttgtcttttaactgcagtttccaatttggttcatgcaggtaagagttttggctacagagcaaccatgctaacttgcgccttctcccaaaatcttatccactaatctcggtaagcaatacttctgttctgatgatcaatacacaactgtactagtcttgaagtttctccatgcatagatcttagaactaccataaaggttaatcctttgagcctgaaacaaaggtttgagttctgtttgattgtgacaggtaaggaaagtgatgttggcaaaatggtgaagaaaggaagttggttttctgctatcaaaagggtttttactccacattccaaagagaagctagccaatgtaagctggttactccttactggattttcttagcttgcaaaaatgttttattacagagtttttg

SEQ ID NO: 11123 - DNA, 3000 bp, Unknown
  misc_feature (1)..( 3000): cDNA_ID_3100848_gDNA_ID_2214479_Annot_ID_133209 3000 nt of promoter + ATG
taatgtcaccttatcatcaccagaggaggcttattacccgaacaagcctcttctttcattgaaccaagatctatcaccctatattttggagaacatgtatgtgggcttctcagcctcaacggggtctgttagagcaatgcattacatgttgagttggtttgtacatggcggcgttgatgttccaaacctggacttgggaataccaacatttcctccatatcccaaggaaaaatctctggtttatcggattgttttggtgaccagcttggcattggttctctttgttgcgcttgttgcatcagctttaagtatctttttctacaggagacataaaaaggttaaagaggttctagaggaatgggagatccaatgtgggcctcataggtttgcttacaaagaactctttaaagccacaaaaggtttcaaacaacttctaggcaaaggagggtttggtcaggtctttaagggtacacttccaggttctgatgcagagattgccgttaaacgaatttcacatgattcaaaacaaggaatgcaggaattcttggctgagatatcgacaattggtcggcttagacaccagaacctagtcaggcttcagggttattgtaggtacaaggaggaactctacttggtttatgactttatgcccaatggaagtcttgacaagtacctctaccacagagcgaatcaagagcaactcacttggaatcaacgtttcaagatcatcaaagacatagcctctgcactctgctatttgcatcatgaatgggtacaagttgtaattcatcgagacatcaagccggcaaatgtcctgattgaccaccaaatgaatgcaaggctcggggattttgggttggctaagttgtacgatcagggttatgatcctcagacatctagagttgctgggacattctggtacattgcaccggagctcataagaagcggaagagcaaccacagggacagacgtctatgccttcgggctgtttatgctagaagtctcttgcggtaggaggctgatagagcgaagaacagcctccgacgaggtcgtcctagctgaatggacattaaagtgctgggaaaacggagatattctcgaggcagtcaatgatggaatccgtcacgaagacaatagagaacagctcgagcttgttttgaaattgggagtgttgtgttcgcaccaggctgtagcaattaggccagacatgtctaaggtggtccagatcttgggtggtgatctgcagcttccagataatctactcgatatagtcaaagcagagaaggtcagaatgtggtctgagacatctgagagtgtacttggtgttttgacatcacaagggtccattggtaccttgacgttaacggaaccttttacctcccggggacgctgagacgtgatgctgagttcggtcgtgaaatgatatatgacatgtttgtttgtaaatattttatgttttcgattgatgacaaaggagtcagaaaggacacttgaccatcacggaagcgatgacttccgtcggacggtaaaaagtgatggtcgaggtttggtgagaaatctaaaaatgtgacggtgtttgcttgataaatatctttattttggtgattgtattgaatgtatcgttttgatttctgtttatacttatatcggcggtggaataattacacatgacctgaaaagtatgcgtttgtgtttacttttatgttgtagtacttgttgtgtttttcagctatgaaaagtctacatatttcttctgtgtgctaacttattggataaattggatatttttaagagatctaatgtttacacaaacgtatggtgaacaccaatggggatgtttacacacacttatgatttatgactgaaagagatgttaatcgaagtatatactccattgattaatgttaatcaccgaaagagatgttaaacaagcattaatgtttacacttaaatgtgatggaacgaaaacaaagaataagtttaaatttgttgtcatggtctcaatgaaaaaccgaaaacgttgtgctatcaaattactcaaaacgttgagctagctaaacttggcagaaaagtatcgaatgatgctaaaatgcaaaaaaccattaaacccaatgtacggtttatagagttttcatatgccaagtgggacatccacgtggagatcctatgccacttgtcccctctctgtctctttcatgcttcaaacttatttggcttttacgtggattctcacgcccgagtacgtcgattattacaaaactcacataaattaatataaacactttatattttgttttgacctttttaccccttctcattgctcatcaattttcatagatctaataccaaattatcacacatataggagagtcatctaacaattagcacaagtcatgagtgaaagagactaagcatgaatcataatcatctttgacataggtgctcaaaagtaatcaattttttcaactttactattcaactcaataaaagaatttttaatcaacaattcttttcaagatgtatcccttttttttcttgcaactttttctcaactatattaatatttagtatactgctacttagctactcgatgttttgatgtatcattgatcattattgttgactaataattatttgatacaaatattttaccgacatatgtaagaacaatagtgtcaaaattgaagcatctcaagggtattttagaacagatacccaatttatttatttttataatttgtcaccttgtttttcacacacaaatgacaatatgacgtcattttccttattagaataatttttttaacaaaaaaaagaattatttattttcgtctctcttattgcttgctacgctcaacgctgtgcataagcattctctttctgtggacgaaactaaacctgagagaaaaagccagaagaaccaaactcagaccgagagatagagattgagggagagctctagctctgtagaaaagaaggattcattcatcatatccagaa

SEQ ID NO: 11124 - DNA, 3000 bp, Unknown
  misc_feature (1)..( 3000): cDNA_ID_1025215_gDNA_ID_2214479_Annot_ID_133213 3000 nt of promoter + ATG
tgagaagtaggctaagatggaaatcatgtcaagagagaatgagactgctttgtcaggtcctaggccgatggaatggtctaccgtcccacacagtgcttctcaaggacctggtcccaatggcaagaaccggacctcgagcttggaagcacctatcatgttgctaagtggacatccgagtgctgtctataccatgaagttcaatcctgctggaactctgattgcatctggatcccatgacagagaaatcttcctctggagagttcacggggactgcaaaaacttcatggttttgaaaggtcacaagaacgccatccttgatcttcattggaccagtgatggctcccagattgtatcagctagtccggataaaactgtaagggcttgggatgttgagactgggaaacaaatcaagaagatggctgaacattcatcgtttgtgaattcttgctgtcctacacgtagagggccacctcttatcatcagtggatctgatgatggaactgccaagctttgggacatgcgtcaaagaggagccatacaaacatttcctgataaataccaaatcactgcagtcagtttctcagatgcagctgataagattttcactggtggtgtagacaatgatgttaaggtttgggacttgagaaaaggtgaagccaccatgacacttgagggccatcaagatacaatcacaggtatgagcttaagcccagacggttcctaccttctcactaatggaatggacaacaagctctgtgtgtgggacatgcgtccttatgctccacaaaaccgatgtgtaaagatctttgaggggcatcaacacaactttgagaagaacctgctgaaatgttcatggtcacctgatggtacaaaagttactgccggtagctcagaccgtatggttcatatctgggacacaaccagtcggcgcactatatataagctcccaggccataccggttctgtcaatgagtgtgttttccacccaaccgagcctatcattggatcttgcagtagtgataaaaatatctacttgggagagatctgaatttcaaagctgtgaaacctttgcaactctaagtggaattgaagtctttagaatcgacgatgtgctttgagacattttgtttattgaaagaaaaaacgaaacattgctctttggtacaagtaatcaagatttgttatctcctgtaatatcttcattacgctctttatcttcttctactttaacagatgaggtcatcattttagttctccttaaaattgttatctttggtattacaatcttgcagtatcttcgattagattcttacagattcaagcagtagcaagtataagcccagtccagtaaccaactaacgcatataagtctttagattcaacaatgtgcttaagaaagtttgtctattgaaagtaaaaagcgaaacagtgttactgctacaagtgatcaagaagaagatttgttatctcctgtaatatctttatgctcttcatcttcttctactctaactttgcttccacagcaacctcttcttctatgttcttcaaccacagttttttttacaatgctgtctcttttctctgcaagctccaatcttttctccataaactcagaattctccttccaaatctctccattagtgtaaacctctttcttccatatcggaaccgatgccttcaactcgtcgatcaagaacttgcaagcatctaaaccatctgcacggtgaacagatgagaccgcaatgagcacgctagtttctccaacaggaactggtccaagacggtgagcaacagcaatcttgtggatatcccaagttgatctagcagttgtacagatcgagctgaggcatcgtgtggccattggcacatatgcttcataccttaactccaacactgtcttgccctcgaacatgtctcttgtagtgcctgagaatgtcgcaatagcaccagcttgaggggcactgacataatcaatgtacttaacaacatcgactttgtgaccttcctccaagatctctataaggttcttctcctctgcagacatctttgatccaatagtaaacctcgatacaatcgatgttctaggaagagtaaaccaagcttagcagatgatccgatagcaaattctaacctgcaattggaggaaataaacaaccatgactatctcatcacctatcatccaaaactaatcaaacagacaatttgtttagtcaaaggcaaacagagcaaatgaggaacctttcttgcgcaatctaatggcaatcacatcttactaatccagaaatggaagagtcaaatcaacaaagtaggagaatagtggaccaatgaacaaactcaaaaaacgatgtctcaaatcggattaagaatttgccaaatcggtcaatttttattgaatcagacaaaaacagcaaaggcacaaaactcgtctacaaaactgaccaaagttcgagtttttgtaagattgaggatcgaatggatagaatcatagaaagacagagataacgacaaagaagaatcgtctctttcagtaccttactacactaaaagtttgtaataactttaacagctacccagaaattaaaagaaggcaaagaacaaaaagagatccagaaagattttatctgacctttgagagtttggtagggctgcatgatgaagaagaacatgtgctctatattcaccttcttgttggatcagactagtaggttggtgagattgtaaaaaacaaaactttactaattcaatttcaaagtctcttcttttctccagatactctgttttaccattcaaggaaaaaggataaatcttgtagaaagaagatgccaaaatgatttttttatttagaaattaaacagcgacgtcgttttgcagctacagtgcgatcatctaatcagtcagtgtcttcaagtttaaaccgcatctctagtctctctctacttctctctgtgtacaatattcggaaagtgaggaagatacactgaagcaaaagagcaagtcatg

SEQ ID NO: 11125 - DNA, 3000 bp, Unknown
  misc_feature (1)..( 3000): cDNA_ID_2705315_gDNA_ID_2214479_Annot_ID_133217 3000 nt of promoter + ATG
acaccaagaagtatcatgaaacctgcacattctaagtaaagcctacaaaagcaaaaggttgcaatgtttattctcaagccgcaagtaaataaacacagatcattaagaaatcgatatctctctaaaacttgttgtggttttgcaccagagacgaaaaaaggacttcaagtccggttacagagatctcacagattcaattttgacataaagcaaagcaaccactaacaccaaatttagtactagcagctcgattcgtctcaaaatcgaaacatacatgcatgattcacctcccattatattacagacagtgaagagttcaagaaaaaaagcttgatagataccaaaattccagcagaagacttcatagaacgaaattacttaaaagagtaaccctacatagaaagaagttacgcaccgaagtcaaaggaaggggagggaggcacgaatcgctcggtgtcgtcgcaaaattaccggaaccctaaacccagagagaaaaagctcgcgagaaagaggaagagagagattcagaaattaaacaagtctgtatttaattttggtttatttgcaaaatattgataagaccctattttatgacggaatgaacccgatactattctttttgtcaaaataacccatctcctgcatgttttttgggctgacaaattgggtttcttttgattgattttgacggcgtagtaacagaaatttatggatagccacaccttagcttagaccaaacgtttaggtacaaagagtatgataaagttgagaacttaagacaatgtcaagaacatcaaaaccatgtcctgatcatacattctcttgtttaatcaatgtattatagattggactgagactcaaacacagatgccactcgatgtcagaaacgagccactttcgtgacaaaagaagcttggaaagcaaagataaataacgggtttggttggacatatcaagccagtgaggattagaccttagatggaaccttggtgtcagtgtccacctgtttttggccttcgaacttgtctatagccacttgaagctcgtctgtgccaccaaccgccctcattgtgtagaagtataccccaaaaacaaaagctgtcaagccaccagctacaaccgtgttcttgccttttgggcctaggtaactaaaacctggaaatcccgccattacttcaaagtctttaacctgcaagatccaatgtgtcacatgttacagaagagacccaagtatcagaagtattagattatgttatatcttcaatatcacagtttcataaatactaagatgaggaataacaagagagaactctgaagcatgatataacaacttttgattactctttttaacattgcagaagtgactccagaagccctgaggcatcgcaggacattgacatattgttcatatagtgaaaaacagattacacagattgaatacgacgaattttcgaattgttatacttatacctcatcctaagaactactacgccaagagtaagtgatagtactcacaacgagatcaaagatgagtacaatcatggtatgaatgaacaactgaaagttgcaaaacatttcagcaaaatagaactttcttctgcatcataatggaaacggagagaaaatcaattggtcacattcatgcccatcagtctaacataattgtccacaaaatcagcgcacttccctttaacgagtcaatcaaccataaatcatcaaccaaagcaaaaataaaggcaattagaaacctaactctacatctatacatccaaagctaacatcttttaaacgcaggctactgttactcaaccaaagttctcaaaaccagatcaaaatgtcaaaatgaaaggagagcagaaaatatcaatcaaaaattggttctttaagcaaattactccaaagtccacaaaattaaaatggaatcgaaaggaacctggtgatgaaggtttgatgatcactcgaaaatccgaaagatacaacaaagctgatatttttttcttctacagagaatcgtgcctaaatgcgacagaagcctaaagtttccctatttagttgacaactggttcggtgacgcttagtgtcgtggccacttaccaatctatcgaaaaccctaaacccagtaagagctctcgtgtgaaagagggatagaggcagaaagcaagccgtctcgagttcgaacccaactgtataacacaagagaagagatttattgcttcattatgtaaaaaatattgagatgatccttgtaattttggaatattatcaaattgaaccaccatactttttaaaaatccaaataaccctcaaccaagcatgtttcatgttgtggcctcattcacactatacgactatcaagttcatcgaaattcttgatagagaactttaaatacttaaatagttaatttagatactatctaataacttttggcggtttataagtttttgtgtttttcaatctacataaaatttagcgatttttcatgttacaaaaataatctcaaaattaaagtacaacccaaaaacataatatcaatgataataactacatttatctatgattcattttcacccaacatttacattcaaaaaaatgctgttgttacttgttaatgataacgattaaggaaggaagtcaatggaacaaaaaaaaaaatggtgataagtcaatgtaaaacgatgccgtttgtaaccataacagtgttaaacatgagaataaaggatcaaactttgaacagtggcttgcttgcttgcttacacacacgggtcaagtgaagacccaaaaaaaaataaaaaaattaatagatccgtacgcacatgactttcacttcttgtctctcagatctgttttgaccccaaaaccaacgaatatcaatttctccaatttcattcataattcactcaccccaaaattacaaaaaaaaaaaaaaaaaaagattttccatttccctcttctcgatccaccaccaccaccaacctcaaaagctttcatctttaccggtc

SEQ ID NO: 11126 - DNA, 3000 bp, Unknown
  misc_feature (1)..( 3000): cDNA_ID_2705392_gDNA_ID_2214479_Annot_ID_133218 3000 nt of promoter + ATG
tattttgcaaataaaaccaaactatacacgagcttatacaacaaatgtcacatttaaacatagtttctttaagaaaaagaactaatcatttctagtgaattattcaagtgaaactaaaaagaaaagaagaaaaaaaaatctagatgaagcaagctaaagctattgtagcactttagctttggctttcctatttttgccaacttttactcttttttatttagttttcttttactttttttcccacaaaaatccaatcctatgcaaaagattttgcctttcacgtcgtttggagcacgattcactctaaaaggtacgttttctcacaagtacccccaaaaaagttgcatactcaatatacacacaagctaatagtataaatcacttgcttgaagaatttgaaatcactgacgaaaataataagctccttttactttcttctctagtttcaaaacgttaaatactttatattgtttttgtttgtcaacgtactttatattttacaattttcaatacataaatcatagctttttattatctccaaagttgttctctttaaagaagaaactccaatcaaaaatctcacgtttgaatgatgatgcaaacaatcacatttaaattctacaataaatagtgatagagataattcattatttcatttgtacagtttggttgtatgatttgattatggtgtgtatatcttagttgaaagggtaacatcgtaaattaaatgttactttgaaaaccggaacaggtaatagtcggtgaataagagggctaacaaaagagagaagaagactgacacgtgtacataaagaaaacaaagtgggatgactcagtgaaacgttatggatttgcgtgattcacgggtttacagtaaaatgttctcgtcgtctagctctctctctgtacgctctttttgtactcagtttttgttgctccgactatttctcaccgacggttttgttctacgtcgtcgttttttgtttcacttgtagtgtataattgtttacacttattagtgttatcatgaagactaaacaatagtttaatggtggtcagaatgaatctttttttcaacagagggaatgttttgcatagtttattaactacatagcttaactttattgaccaaaccttaagtggaattttcaaattgcggttaattgtagttttggagaagtaatagatgaaaagttgtaaaagttaagacaacttaaaataaagagaagtacaagtgaaatttgaaatttctaagaagagagaggagaatctttggagaagtggaacatgatgcaaatcccaatactttttgttacttgaatacttgtaatttatagtactattcactgtcagtgaatactttttgaatatcgaatatttttctcatattgtatagtaacaaaattaatcatcaactaagacctaaatatgacattacatggtttgatatcagaacatcaaacttcaaaacactagtccaaaatgtatttgagcaattaagttgaaataaatacggttaatgtttttgttatcacattcttaactttacattgcacgtaagattataagtttggatattcaagatggacaataaatttagattagtaccgccgaccaaacaaattcattacccattttccttgtcacgatattatatcaattggctctgtgacattgaattgtattgtattgattgcattgactgaagctaacatttcggttgaactatataagtctaaaatcactaatcagtaatccaatgcaatgcagtaattagtcttcattaattatgcaaaagcaaaacacttaaatgtcatctatttaactaaaagtatcgtttcactaacttttctagatttgaaatgttgaaatacgttaatagatcagattcattatatgctttatgttttagataacttaaagtttgttggaaataaacatggcttaaaaaccaaaaataattaagtattttgccatttagagagaacttatttattcatgaacacaatcagtaatattgaggaaaatctattttatgttatgtgtttaggtgtatagtttgtaaaagatgttaagtaaaatgtaaaaataacaataagaacatttttgttttttgtatgttaaatgtatcttgtttgtctcaataaatttggttctttattgcagaaataatgtggttgtgttggaagaaaatttctgacttcgctcgctattcagtacaacaatccagaagattttgatgagccattatattttcacaatttcagctaaaattaagtagtctcttctttcacattctccatattttaacgatacttcaaaagtaaattcaaagtacaaaaacaagaagaagaagaaaccataaatgtttaactaattgtggcagtgaaagagtcacaatcaaaatctttttatcttactaattggtgatataaatataattaacagaaatcttgttgggaaagaagatgttcattattaattattacagcaatcattatgatcgaaaatcgatatttcttctaacaattggtccaaccaaacaacatatcatttaattttttgttctcaaacaaattaatgatcgaattgtatttttaattatcaattattcggttttacagatacaaaatttaaagcctttttggataagagaaaacgtggaaataaataaaacacgaactaccatttctcaatcaaatcaaatactagagagacgttaaatactaattcgaattaagtaatgacacctacttatactattccctccaatttctctttctaaaagagtccctcgtaaagaccaaaccttttttatcactctctctctctatctcttcatcgaccagaccaaacgcttcttcactctctctctctctctctctctctctctctctctctctctctctctctcttttctcttcaatgtcagattttgaatgccacaacaacaacgagccctaaaactagttgtgtgtgattgggggaaaaacgttgcaa

SEQ ID NO: 11127 - DNA, 3000 bp, Unknown
  misc_feature (1)..( 3000): cDNA_ID_1809253_gDNA_ID_2214479_Annot_ID_133220 3000 nt of promoter + ATG
acttatttgtaaatgcgtcacatgtcttcttcgctctgttcggctgcttcatcgagcggaagtctctagccaattaccgtttgttcgtggactcgaggttcgttgttcttagatttcccagactcatctgtttctgcaatccatttcaaagtttctctttttacttaatccaagtcattcgcgcatttcctaattggtctgaggtttagggttttagggcacatagttttgtttgattcgggagtaatcgttgagatgctacgagtttggtattcaagatgattccttttctcaaggtctttatgtaatttgattgatttatggatctcgaattgctgacatgaatttgttgcttaaagttgttggctttgtgggatattctgaggggtcttgtttgatttggatctaatttggtgggcagatattgtggtttcttagcaaagaagatgagtggagttggagagaaagcttctggaacaactaagacacctgctgatttcttgaaatctatccgtggtaaaccagttgttgtcaagctcaactctggtgttgattatcgaggtctgtctctctctctttctgcattttgtgttctcctctaagatgtatccagttcaaattctttttttttttgccttgtgtgatgatatcttatagtttgcttctgattttcggtggttattaagctatcggaagtctatgtaaacttctttatcactttgggtttagatgtctcaatgcctttctttctcgccatgttactggaacctttggatgttggtttacagaatgactcttttctttgtctaagaactgcttgcttgattctcatttgatttgaaagtcccatctctgaagattcatttttgttgagcttgcttgttttttccctatcttgtctctgtgtttgagaaggaataatacatttcggcttgagatatttgctttggattttgagaaatataatctagatgagcaggaaattaacatacggctttgaaacatatgctttttggaatttgagaggaatattagattcagatgatagctttgtgaattgagagagcttctctcatgagataacagacccaaatgtggttgaatttgagatgcatttactcttgcttctgatagaatatggactctcaccttgctatggagcctttatcacctgaaattaagaccttggtctcttgaactctataatataacttacaggactaggagaacttctagcttgaatatctttctttggtttatctacaaaagtcagacttattctttctttggcatatcatgttgtatcaatctacatatgacactttgtctctcttcttgtttgcaggcattcttacttgtcttgatggatatatgaacatcgcaatggagcaaaccgaagagtatgtaaatggccagctgaagaacacatatggcgacgcttttgtccgtggcaacaatggtaaaaaccaaatcacattcatcatcactctttaaatcggtttagtatgtttttttatatccaattctgaaaaatatgctctatgttggccacagttctttacatcagcacaacaaaggggacattgtcagatggagcatagctctctttcatcaccatgaatgttcatcttcttctctacctctggcatatgacaaatgtaggatttgtagcaaccagagtttatcaccactgcatgaattcgacatgtctttttcttccgcaactcagtttgtgtctaaatcatctccaaaattctgagatatagctagatttttatttgttatgaaattttttttaatcactgttggtctttggagcctaattatcgtgttttgatgacgcaatcactgcgtcacaatctgatgtcatcttaacaatcattaatgtattttttttttcttttctcgtaatattcttaattattcttcgacagcaaaggtttaaaaactccttatttcaatcattaatgtatttatgatttgatcgaataacaataatatagcttattttgttctattctatcgtatttgattcttctttcgttttttttttgtttgacttaagaaaccgattgtttatagtagtaaacatttgtttttaatgttgctcgattccagtgcacatgtccaggctagacacttgtcgttataaaggttgctttggttcaatattgatccactagagatgttacaactattgttgacatctgagattgtgtgataagaaaatatgaaactggatttagtgaaagttacaatatataatcatacatcatagataggaaataaggaaatgtcagatatacttgaagaatacatcaaatagacaaggtcctttttcttattgtcgactattatagagccgtacagaaccttttcacgtctttagtaattagtacattctccatttcggctctctcttattttttttccatctcttttacttctccaaataataacaataaaagcttcgattttgtgtgtgtttgtatttacatcttgacatcgatattcttttcatcaattttttaccaaaaatgtaataaaaacaaaaaaaaaccaacgctgaacacagacatggtttctccatccgtttatattcatcgtttgtatgtttacttaacaacttatttcaaaatagtacatatcatggttgtgtttttaaaaaaagtatacagaacagaaaagcacatggtagacaaaataatgaagccaaaattaatacaaagaagaagttcaacttgtatttattaacacattttctttccttgtcaaagacatgcaaattggttttgttttcttattcccattttttttttataataaaaagaagaagagtaaaacaaaaaaactatcatttcttcttatcgcaaaactcttatctaagcaagaaaccgacaaaacctatatctacatatattctcatcaacatctcttgagacatattcattttggttaaagcaaaagattttaagagagaaagggggagaagtgagagag

SEQ ID NO: 11128 - DNA, 3000 bp, Unknown
  misc_feature (1)..( 3000): cDNA_ID_2705321_gDNA_ID_2214479_Annot_ID_133222 3000 nt of promoter + ATG
tattccagaccaagcaacagttgctttgtgtacattattatcacctatttaaaaagaggttcagacacaacattcatcgcctgtgactgtgatgctcaaacacaaggattatcaaagattcaaagttcaggtacagtcagaacttactggctcaggaaaagatccaaacttcgccaacaaagatgaaattgatccaccaggaacaattcattgatccaccaggaacaaactgcatcataatattcaacgaatcactctctcttacagtacccaagtatctctgcaaaaacaaagataataagaagaatgcatgtggaacagacattaaacatatgaaaaatagctgaatggattcgccaactcacaacaatgttcggatgtgaaagattcttaagaagttgtacttcttcctcgcgagccaccagaacttttgtttcaactttagctaggcaaatgaatagaaactcttaagtaagcagcattttagatgaaagtgaggcaccaatgatggctcgctaaatcttatactcagttcaatttctcattattgtccaaaaaaggcttaaataagcttcgggccttacctcctttgtgtccaaatttgtgccgttcttcatcctcgtcaatgtagcctttaaaaagttttaagtgttcaaactcacaagcaaaaggccaactcttctttctacctgaaaatccaactatcaagatgagatcgcacatagtttcaataagagcagaataattttggtgtgcagcttaaatatgttccctaagttcactaggccaaatgggtgacaataaagtttcacaaacaacaactcatacgagaagctcatctgtacaagaaaacagaaacatgaatgggataatggcagtcatggttttaaaaacataaaacttgcaatcatatattgtaataacctcatggatagaactggaagggtgagacatttttgacgactttgggggtctaaaatgctgaacaaccgatgtttttaatccactacatacttgaaggtaggagaagagttgaagatgacattggagcagaagcactatatggggttcagatgtaacatttccatgtccaagtgcgtttctgcagagagcttcaagtcatcaaaaatcaccaaccaccactaaatgtgaactttatagttatctaaaattatcactaccatcagatatcatctagaatcaatcgtaactaaaaaaaaaaaacaactttcaaaaactagataataacatataggagctagcaacatgtatactatttcactttttttagagtttctaagccaatcagaaggctctatttcacacccactcgcacaaagtgagcgttgagcgcgtgagagcaattctgtgggtgtacccctttccaaaacacgcctttttcaatcgacgcatttgtctccaaaatcctcgtcgcgtgaatattttgtttgttacttcttctctatgtaaaccgaaccgcaaatcaattctaatttatttcaataccatttaaacctaaccgaaatcaattgaaattagtaatgactaaccgcttgtcctcatcggaagagtgatctaaagctagatttttcgagagagaatctaaggaaattccgacaacagaagaagggagtataccggagagctcgccaatcaccgccggagcgatggagtaaaattggtacgattttgaaaaagagaagcgtggtggaagaatttcggattaggattttgatagtgtgtaaacgacggtggtcgatccatgagctccgacgacggcgaactttactggcaacgttgtttagcatagtttaattggatatagtgcccatttagtcaggcccattaatatttattcggcccattgttttcctttttcaaatagaatcgtctgtgtgggcttgttttcatattttcgacaaataagaggcggggagaaattttcccaattgaaaacaatttattcttgttcctctcttgaagaaagtctttagggtttaggattttattccacaaacttaatatatggtgttttggctggaaaactaaaaaaaatcaacggttgggatctctgctttcttttcgccaaaaatttactgcagcaccttctccataaacaactttggatgtttgctcttaatatagaccaagccagactatgaaagtttatatttaaagaaatgtcccattctcgaaatttttattttgagtttattttcagtttagttttatatcaaaccgagatattgatacttgcatgcaaattagtactccaagttctgaaccctttatgaactgctagtgcttggctgctattcttgctttatttggtttaccaaatgcatacattatttttttggctttgttaggtttaacatatacatcacttgacatttgatttttgatttttttttggctttgttaggtttagattttttttaatatactaaggtttagaatttttttataacacccatatttgctattataataaacattttgccgagatcttattctaactatagagcggtagaaaatttcacttattgacttcctaattggatatttctatttccttaaattttaaatctcttacatatatattcacaattgatttcctgcaaaattttaattatactagttgcaactaaattaaaaatgttgtcgagatcttttattctaactacagaaccgtagagaatcttctgactttgttattacgtcccattttcatttccatgtgtctatgtactctccatcttcccaaagataacacaataaagtaaaaagaaataaaacttaaaatccaagcttttcacttgtcacccttatttagtttttttttggaccattttcttttcttgctctgatgaaaagctgttgtcttctggaagaacctcacaagtctattaatatatgtatattcccaatatccctttattcgttctgcggaaagcaaaagattgagagcgacagagagagataacgagagagagagag

SEQ ID NO: 11129 - DNA, 3000 bp, Unknown
  misc_feature (1)..( 3000): cDNA_ID_2716869_gDNA_ID_2214479_Annot_ID_133223 3000 nt of promoter + ATG
aaagttaaagaacttgaacatgcatgcgctatgattttttatataaatcactaaagtagttaagttagtgaatattaaatcatagtgataccaaaaaaaatacataaaaggacaccacaatcctaagaggtaataaatcttcttcttcttgttttcttcattccataattaattaatccaaaaacgagagccaccaaatcgatccataatcaaaattttccaattaaatcaatccatataactatctctgtcgaaaacgactaatctaatttcgtacattaccgtacactaatgcagtcatctaaggaaacttatcttgcgaataattactattatttcattaaaccaaccaaattttattacataacaaattacccggttatctaggtacacaagttgacacaatggtagatattaataaaatcaagaaagttccatataaactaatcattacgttactatcgtaaatcctataaattcccatctcatgtaccttcttctacaatatccttcatccttaaaacactaaccttctctgaaaaaaatccaaaaaatggtttataacacttcatgccttattcttcctttggctctcatcattcttgattttaccttaatctcatcattagcccatccgattccaagcacactcaacgtcttatcctacggagctaaaccagacggctcaaaagactcaaccaaagccttcttagccgcatgggacgttgcttgtgcatccgctaatcctacaactataatcgtaccaaaaggacggttcttggtcgggaaccttgtttttcatggcaacgagtgtaagcaagcgccaatatctattcgtatagcaggctcaatcgttgctccggaagattttagaattatcgcaagctcaaaacattggatctggttcgaggatgttactgatgtttcaatctacggtggaatacttgacgctcaaggcactagtttgtggaaatgcaagaacaacggtggccataattgtcctaccggtgccaaggtatgcttgacccacaagaaacaacaaatttaactctcatgaggtttttaatttttttttttgttaatcttatttgtagagtttggtgtttagtgggtcaaataacatcaaaatcagtggtttaacgtcgatcaacagccagaaattccatatagtcatcgataatagcaataacgtgaacattgacggcgttaaggtttctgctgatgagaatagccctaataccgatgggattcacgtcgaatcatctcactccgtccatatcactaactcaagaatcggaaccggtgatgattgcatctccatcggtccaggatccactaatgtattcatacaaaccattcgatgcggtccaggccacggcatcaggtaacacacacatacatttcttgctccccatctttcttgatatttcactttctaaaatgttctcttgttttttttgtttgtgtgaactctccaacagtattggaagtcttggacgagcagaggaagaacaaggagtagataatgtgaccgtgagtaacgtggatttcatgggaacgaataacggagttaggatcaaaacatgggggaaagatagcaacagtttcgctagaaacattgttttccaacatattaacatgaagatggtcaagaacccaatcattatagaccaacactactgtcttcataaaccttgccctaaacaggtaagaatatttattaattaaccatatctttacacccataactcgatatattgactcatttaatctgtatattaatttctattattataggaatcaggagttaaagtatcaaatgtgagatatgaagatatacacgggacttcgaatacggaagtggcggttttgttagattgtagtaaggagaaaccatgtaccggtattgtaatggacgatgtgaatcttgtctctgttcatcgaccggctcaggcgtcttgcgataatgcaaatggatcagcgaacgacgttgtcccattcactccttgtctaaagagggagatcattataacttaactataaatggatcgctgaacgacgtcgtcccgattgctccatgactaaaagatgagttcatgtagatatatctgcgaacgacgttgtcctatttgctacttgttgtttgatcgttgagaatcttttttttttcttttttcttgttttgtttttgataatttctttgagaatctttgtaatccaaactatgaagtaatgattaaattttggttcgcatactacatatagatgatttctgtagtaattgtgtctatagatattttgagagatatggaccaaacaacttgtgaaaaagtaacataattggatgaaatagaaggtgatggaaatatatgggtgtgaattaaagtaaaacataaactaactggaaaatgattagtatacattaatggttgattaatagccgacccattaaggcattaactattcttatactatactataattaacctatggagcatatgagatttgatactattattacataaaaaattagtggagtagcaccatattttttagtttttaatatttaaaatttaccatcatcctctccacttcactaaaaaaaaagtcaaaaacccactttctccaggttgtattccattatattaaagttttatcttttaattagtttcatctatatataatctacatgggattataatccaatcaaggctttacctccaaaatagatattttgtgtaacgaactttttggttaatttcgtttatggataatagtctcaattaattacaaaaagatagaaaatttaaacggactatatacgatcgtttgtttgctgtgtgacttgtcgtcttcttcttctgactcaacctccattgaccaaccctccaaagacggcaatgtgggttttattcttaatccattgatctcttgttgtgaggttttttgagaatttgcgtaaaggaagaaactttttcaaaacttttttttgcatcaatg

SEQ ID NO: 11130 - DNA, 3000 bp, Unknown; identical to SEQ ID NO: 11129
  misc_feature (1)..( 3000): cDNA_ID_3038648_gDNA_ID_2214479_Annot_ID_183282 3000 nt of promoter + ATG

SEQ ID NO: 11131 - DNA, 3000 bp, Unknown; identical to SEQ ID NO: 11125
  misc_feature (1)..( 3000): cDNA_ID_2705315_gDNA_ID_2214479_Annot_ID_183276 3000 nt of promoter + ATG

SEQ ID NO: 11132 - DNA, 3000 bp, Unknown; identical to SEQ ID NO: 11124
  misc_feature (1)..( 3000): cDNA_ID_3038668_gDNA_ID_2214479_Annot_ID_183271 3000 nt of promoter + ATG

SEQ ID NO: 11133 - DNA, 3000 bp, Unknown
  misc_feature (1)..( 3000): cDNA_ID_1534269_gDNA_ID_2214479_Annot_ID_183265 3000 nt of promoter + ATG
tgtacttggtgttttgacatcacaagggtccattggtaccttgacgttaacggaaccttttacctcccggggacgctgagacgtgatgctgagttcggtcgtgaaatgatatatgacatgtttgtttgtaaatattttatgttttcgattgatgacaaaggagtcagaaaggacacttgaccatcacggaagcgatgacttccgtcggacggtaaaaagtgatggtcgaggtttggtgagaaatctaaaaatgtgacggtgtttgcttgataaatatctttattttggtgattgtattgaatgtatcgttttgatttctgtttatacttatatcggcggtggaataattacacatgacctgaaaagtatgcgtttgtgtttacttttatgttgtagtacttgttgtgtttttcagctatgaaaagtctacatatttcttctgtgtgctaacttattggataaattggatatttttaagagatctaatgtttacacaaacgtatggtgaacaccaatggggatgtttacacacacttatgatttatgactgaaagagatgttaatcgaagtatatactccattgattaatgttaatcaccgaaagagatgttaaacaagcattaatgtttacacttaaatgtgatggaacgaaaacaaagaataagtttaaatttgttgtcatggtctcaatgaaaaaccgaaaacgttgtgctatcaaattactcaaaacgttgagctagctaaacttggcagaaaagtatcgaatgatgctaaaatgcaaaaaaccattaaacccaatgtacggtttatagagttttcatatgccaagtgggacatccacgtggagatcctatgccacttgtcccctctctgtctctttcatgcttcaaacttatttggcttttacgtggattctcacgcccgagtacgtcgattattacaaaactcacataaattaatataaacactttatattttgttttgacctttttaccccttctcattgctcatcaattttcatagatctaataccaaattatcacacatataggagagtcatctaacaattagcacaagtcatgagtgaaagagactaagcatgaatcataatcatctttgacataggtgctcaaaagtaatcaattttttcaactttactattcaactcaataaaagaatttttaatcaacaattcttttcaagatgtatcccttttttttcttgcaactttttctcaactatattaatatttagtatactgctacttagctactcgatgttttgatgtatcattgatcattattgttgactaataattatttgatacaaatattttaccgacatatgtaagaacaatagtgtcaaaattgaagcatctcaagggtattttagaacagatacccaatttatttatttttataatttgtcaccttgtttttcacacacaaatgacaatatgacgtcattttccttattagaataatttttttaacaaaaaaaagaattatttattttcgtctctcttattgcttgctacgctcaacgctgtgcataagcattctctttctgtggacgaaactaaacctgagagaaaaagccagaagaaccaaactcagaccgagagatagagattgagggagagctctagctctgtagaaaagaaggattcattcatcatatccagaaatggctctaaagtttaaccctttggtggcatctcagccttacaaattcccttcctcgactcgtccgccaactccttctttcagatctcccaagttcctctgcctcgcttcttcttctccggctctcagctccggccccaagtcagtctctttctctccatcatcgtctctcttatctactttcgattctctctgtttcatctttgtttactgtgttctgggttttgcttgttcttatcgatattggatctacgttttctcgattttgttcagtgttatttgcttacatttgcttaatctcgagtgtgatttcaataaaagtacgttcttttaatctgggtttataagaatgggccatcctctgttctcaggtgattcattaatgctctttttcattgaatctgatgtttgttgattgttccctattattctcacgtttctctgagattgccccatctatcaaatcgttgcctttaccatatttattctgcatcagattatgtagattgctcgttgattggttgttagttaagattaacactagttatcttctttatggtataatgatctttagattggttaagacttaacagacattgaggaaagcttcttagtcaaagagaaagttttgttttgttttctctggtttagtaatttttaatggtgaaatgtttatccacttgtttcttactcatttgatgagttttctcttttgtattgacaagagattcttgaacgtatcagtttacgtctgtttatctttcttcaaagacattacgttggatatcacgcttcgtggcctttctctatgcatgcgtacttcgtggcttctctctttagtttgcgtccaaaattttcacacttttctgtaatttattattcattctttctctgttttgaagacatttggctctttatcttgtctttgtctgatcagtagtcactacatttgtttctttcacaatctttcttttttgcttcatattgaactgcaagaccaatccatgaatgcaaatataaaatattgtcttacggttaaccatctctaagtgtttgctagtcatgaattgtgaaattgtttcgcttcaaacatagaattagttgatttggaaatgtagacatgaatgcttatctaaatacaataaactgtgttcttgtttcagttgtgtatcagagatgagaccttgactggtaatttcaatggagcataattaaatgctaatgatacttattttctggttaatgcagggaggttgagagtttgaagaaaccatttacgccacccagggaagtgcatgttcaagtcttgcactcc

SEQ ID NO: 11134 - DNA, 3000 bp, Unknown
  misc_feature (1)..( 3000): cDNA_ID_3038688_gDNA_ID_2214479_Annot_ID_183261 3000 nt of promoter + ATG
tgtaatatctatattatttctctctctctctctctccctgtatatatagatcggtttaacctagttttatagcaaagctgtagacgagctttcagacgtcaaacatggctaaagcacaaatatgtctttgtttcatcattttcttatacctctggccaggtaatcacaactataatcatgatgttaattagtataatataattggtatgtagcgatgcatacatacgggtttatatatagatcatttaataatcttatattaattgtaatcttttccaagtactgtaacaatttagtttcatttccatgtttctcttacagaaggaaatttcatcaaagtcaccaaggcagatgtaagaacataagtgaaataaccaagttataaaatgttttgtttattctttttctttttttttgtcttttcttgtaatgaactttgggtttgatctttgttacagcgctcggccggagattggtgcgttgctaaaccttctacggataacgaaaggcttcaagaaaacataaacttcgcgtgttcgaaaatcgattgtcagattatctcggaaggaggtgcatgttatttaccagatagtatcattagtcgtgcttctgttgccatgaatctttattaccaagctcaaggaagacatttttggaactgcaattttgaaggctctggtctcatcggcataactgatcctagtgagttttctttttatatttttttcctctaaacaactatggaactattattatgtctgatatcatatcaatttttatttattttccacatttacaggctatggaagttgcatttatcaatttcgtaagtaaaacatatcaaggttcgatcttgttgcaagaagttagaggactgtatctgaaatttcctatttaaaatctaatgtttggatgttttaattggatttctcaacagttaaatgtttgagcctagatatgtgtatgccattgttaaagcaatataatttaatttactgatcaatacttcgcatctattcaatattaatattaactaacatataccagtataaatacattagatgtgaattgtttaatgtttttgcctataaatagatgtatagtactatagtttgattttcttgccaacaacacctaaacattaagttttctacagttttcaacaagagatatggctgtagatcacctaattgtgttgtgtttaattatcagttgagggtagatatagttttctaattgtgtgtaaatatttatatcttagcatcatatcgaccaaagattaatccatattagccacacatagatattgtgtaatataggtagggttaggttaggtcctaatgcggaaaaaagaattattaaatcacacacacgaccaaatgtggcagcatatgaaaacgggttatagtgggaaggaatgtgggaagaatcaattagttgaaatattttattattcttgcttgaatgtattccaaagtataattatatgcgtttttaacactaattagtaaatcatttttccaagtccctaaacgatacattacatttgattcgcatgtcttcctcttagaccaagaacaaggtcgagttttttgtcaacagaaatcttctccccgaaacatgaaacaacttatagagcaaaagataaatattatgaactttaattgcccaagcatctgtgatccagtggtgggagaagatttggggaagggtgaaactttcagagctgggttcgatcctccctggaaacaaaaatcacatttgtttggaaagtctgtcagttgggctttagcccaattggtttacctggtagtcagaaatgcaggcggcctgactaccccctggcattagtcggaaagcatccaaattcgggacagacagtgtggtggtctttcggggagaagtccactctgaagtatttcggtgcatttctactgaggctgaccggatcagccgataaagtttataaaataaaataaataaatgaactttaattaaccagaaaatgtagaaacaaaaaatcttactaaacctatgaccaaaaaaaaaaaaaaaaaaaagttgtggagtaagaagtatgaagcgttttatccaacatatcccagaggagaacagtgattggtcgatgtcacgtgaaataacatttggcaaatagtgcacaaattaatgaaggcaagaaagtgagaccagacgcgagatgtgagcgcgtatgaagaaacatgatgagacaacaaagagaatcaacctcgtctatgaaaatttcttcagattctcttctcattgcgataccaaacaaaaactcgtagtatatttttgttggtcgtttttgtacaaaatatataaaaagcaaactgtcgcaattatggtttgtatattatacaccagataaacaaatcagaatctctccactaaacctaatatattttaaaattttgataagtctatatacttttttggcggggacaaccggatagttcttctttgagacttctggcttttttttctcttgatgataataagaaactgtatgaatatttgaaaatgccttatgacgttttcttaccaaaaaaaaaaggcaaaggaactacaaaagatagcttaaacaaatttagacaattcatgtggccttaccttaagtattttagtgatgatacgattttaaaattattagtgccattctatcatgttctatactatataaaatattcattcaatattgatttcatagttaaagtttacaccaaaaaattgacatcacatcctatcagctacggaaatggttaccaacacaaaatagtatatctatgtcctatatatatataggaatttaagacaaagcaatattagtctacttttggaggagatgaaaagttacaagaagtctccctataaaacactattaatgaaccaaaaacaatctactaatcaaacttatagtctactagaggtactttgttaccgtttggttagggatgagtttcaacgtttgtggtggttaca

SEQ ID NO: 11135 - DNA, 3000 bp, Unknown
  misc_feature (1)..( 3000): cDNA_ID_3038697_gDNA_ID_2214479_Annot_ID_183258 3000 nt of promoter + ATG
ttgatcatcgccgtcgtttacctactgggaaatcgaaacaaagttctgctgtgtgcttatttggtgggaaagataaacctgatggtagtgatgaggtcagatgctttttcctcatgttaagttcttctgcctgtaaatgaatttactttgcaactggagagtgatttcttttgtgtttgtttctaagaactttgctgttctgtttgctgatgataagtgtgttcttcttattttttcaattttgttcttagtgattgttgtaatgaattttgttatcagatatcgccatggaaagcaatagagaaagctatggggaagaaatcggttgaagatatgttgcgagagcagatacagaagaaagacttttatgatactgacagtggcggcaacatgcctccacgtggaggaggcagtggtggcggtggtggaaatggtgaggagcgtcctgaagggtcaggaggagaagatggtggtcttgctgggatcgcagatgaaactttgcaagtggttttggcgaccttaggcttcatctttttggtaaatgacacaaatttcaggaaagatttgaacttcaaatatcgtatcttgctttgatggaatatatctttgtttttgcagtacacatacattatcactggggaggaattggtcaagcttgcaagggattacattaggtttcttatgggaagacctaagactgttcgattgacccgagccatggatagttggaacggattcttggagaagatgtcgaggcaaagagtgtatgatgagtattggctagaaaaggcgatcatcaacacaccaacctggtatgatagccctgagaagtacagacgtgttatcaaggcttatgttgattcaaattctgatgaagcttatgtggaatcaaattctgatgaggtatcttactaggttaggaacaggaagagatccataataacaattgagttttttttcttagtgtttgaaatttagaatcagtttctttgaattggatttatgttcgtacatttgtatggaattggtttatttatacacgatgaacattctcgagggaaaagcaaatgcaaaccaaaatctctattataacacaagtcaaaatcttttagatctttcaatagctttcaaaattcaactcttaagcagcaattgcaaatcaatgagaaacacaaaaggagaaatcaaagtttcttagatttagtggttgaagtgctttctttcttctctgcctctgtcgatttcttccggtctttcctttccctcttcttcaaagcagtcatgtgggccttaagaatggtggcatatgatgcttgaaatctctggtgatccttagcaccaaccttacaaacaagaaagcattgtaacaagttagcttcttacagatcatagaccagtatcactttacaagaacttgggtaggttttcaatcgttttatttgtttaccgagctacttcctcaactgctagaaggcaactacaatagtgcaaggaaggataaatagagacttaagagagaatgttatcttttattctagttcattatccaaagagagtagtaactcttaaacaatatctcgagtaatcgatgtgctgtttagtttactaatgaatagttcctacgtttggaaacatacatggttcgagatcataatcttgagataatgtgtagaacataccgaagtagaaacagttttctttccatcggttgctcgaataaggcatctgtattcaatggattctccaactgagctcagtttcctcttctgcaccttagacttgagagatgctgacacaagtaacaaaaatcatataagatatcttcaaaaagatatttcaagtataaacatataacaaaagtggaggatgagattttcaaagttacatcttttcaaagtaacccacacagaacccttctctttgcttttctcaaacatgctcgtgagttcattgaggaatggatccaactgtaatagaacctgcaaaaccaaaaaggatggcatcaaaaaaacgcatgatcagtcaaaacaatggcaaaaattagttttctttactccatcaatcattgaaccttacaatgtagcatcaatgctgaatcaaatcccaccaaacacaaatcagaggaaaaaaaaaaatctcacaaaaatcttcacatcacataatcctgaattagcactgagaatttaccattgttaaaccgcagatggatatcttttgcagatcctcaagcactgaaaatacttcttatcactcagataactgagagagaaaaccataaacacaatgcaagtgcagggaagagttagatcttaaagtttagaactttgtcgatataaatggaatacgcaacataaaatctaagcacaattgaaacaatttcttcaaatcattcggatttctactcaattctacgctaagacaccattgatatacaaccctagatcgtcaaagcttctgacaaatcacaacacggaaacaatataattcaattcgcaacaattaggaggcgtcaaatccgatcaagtcaacaaacccagctcaaaagccacgagctttaagaatcagaattcaaacttagaaaaaaactatgaaactgaccagagagagacaagaatctgatgatgatctgcgtccgaaaactcaccggccggaggagtctcttcggtaaaaaggaagtcgccacaaatcaaaagacgggtatactcttagtactaaaggaccatttaaatatgggcttatttagataataatgggccttattaggcccagtaatttataaaaccttactagggttttaacgatacgttctcgttctctttctctgaaactcagcttcttcttcagacaccattgatatcctctaaattgttccccgtcgtagaaactttaggtaatcgttgccgtcgagctgatatttgtgaaggggaaaccctaattcgataagggattgtaaagttgcacaagtttgcttatccccagaacctgctctgcaacacaaca

SEQ ID NO: 11136 - DNA, 3000 bp, Unknown; identical to SEQ ID NO: 11121
  misc_feature (1)..( 3000): cDNA_ID_1399134_gDNA_ID_2214479_Annot_ID_183257 3000 nt of promoter + ATG

SEQ ID NO: 11137 - DNA, 3000 bp, Unknown
  misc_feature (1)..( 3000): cDNA_ID_3038701_gDNA_ID_2214479_Annot_ID_183256 3000 nt of promoter + ATG
tacttctcgtggggaaatagaccgtttttccgtgaatatcctgatccgtatatattgaaaaaagtttgaattacttttccttcattttttaaactgtcaatatcttatttcattcaaatatgcatacattttttaggcctatttatcgatcggtcttagttatggaaattttacaactgttgtcatcatacaaatatacattactcggcagtggttccctcttaatattctcactttctgacacttagaaccatctggttacatttttaattattatatatcatccttacaagtgtctgacgaaatggtgaatcgagaatcactagaaggaaccacttagacaaataatcttttataaaatttaccatttgttcacactttttctttcattcgtaaagaattttctctgaagtttcagcttatgtaatttgttcccagggaaaaaattcaaacactatcctctgtaaaattggataaccattaaccagaaaaaaggttgaaatttagtaaatgcgtttattatggattggctgatagcctgatatacttcattctgtgacaaccgattcaaacaacacattggtacattaggatacaccgcataatcttttttattcgacacctttagttataaactcacacgtgaacgaccacacttatactatgaaaccgtgtcatacgaaccacattttaacatctttagcaactaagatttgctccaggagtgatcccaagcgtcctgcagaactccaagtaatagtttactctgctctgcacggctgcaggacgcctaccgttgcattcaccaccattgatcttcctagtggtggctccaaagccttggtccaagactggacgaacatttaggttccagaaccacatggcacactgaaaggcaacttgggggctacgagccaccatgtctggatcagtcaagagagggagtccgaggaactttccagctgcaccgtaattgtagttccatgtgatttggattggaccgcggccgtagtagtcttttcccggtgtacaagggtacgcagtgctcggtgagcagtatttccctctagctatttcttctttgtagcaaaaaccttgcataacgtaaaagaagatcgttatttataatagagaatgaatatgtatgaattttaatgataaaagaaatgatttgttaacttacccaagaaacattatggtgcttaattagtgtaataatattcttgataataataattcattaatttgcttaattaaataattagtatacatgcattcatgtagtagaactagaagggtttataaagaacttacttccagattcatgagaaaactgagccaacatagcggcaatctcacgcttagcgacggttcctttataggcgtcgaacgattgggcagccgcaatgaaagcctggcgagtgtagaaccctttcgctggacagccatttccgactttgctcatgataccatcaaaaaatgctggtgtgacaacattttcaattgtatcacgaggatcagcgtttagaccgcctgcaccaccgctaggagttggtgggataggtgtggttgaggagctgcaaggtccacttcggcacccggtaccacagtaggcatctgtggtgccacaatatccatatctactgcaacataagttggctgcacatccggttgtaccgcactgttgcgaaaacacggtttttgccatgatggttaaggtgaagagaaaaaggatgaaagcgtttttcaacattgctcttagggtagccattttgtgtatggagggtgttgtgtgaagaaatgaagaaggtgtgttgatgtatttatagtgtaaatttggtctattcaaattgaaatattgatcagtgttagacatctttcacgattattgattggctttttctgagtcaaagtcaatgccactttgtaccacttaacaaaagtcaatgacacagttttttctcttgtcgttatgagaaattccatgtcggtcatagatcagatcaaaaacgaatatgtaatcaaaattttaaagagccaagttacttggatgaaaatcattctcataaaaacttgattgagataatcaagtttagattagttcaaacgtttgagatttttctattgaatagttccaagtttttgttaattagctcaaacgatattgttagctaatatagcattttttttggtcaactaatatagcatttagaacgttcttttaaagtcttactttgatttttaacaaaaattgtatggaattgtgagaaaaatgactagtgaagccaaaatgtttctatttataaatcaaaatcaaccaaaattagaaaaatccaactcaattattgcaatttccaaatagtcatgcgtcaaaattaaaccagcatatcaataaaaagcggtttagtcttaccaaccctggtctagagactctagaaccatcggagctcaagtgaaaaacgacgccgttaagctgcatctttcaagatagataaaaacttttgtcgatcgcttcatctctcacagagtttcggctcctccgttgtgtttcaggacgacgcaaaggggaaaaaaaattgaattctttctctccaagcgaaactagggtttcgaaagtctctgtctcatcaaagcttcgaaaaggtagatttatggtttcttactctcctttctctatgatattccaatttcttgcgagcttgctcagtgttcttaccttatatttaccgaaccagtgcctttatattctatcacattcgaagttattggtttctggttacttatattgcttattgttctatgactacgatataattatcccaaagatttgttcttttctccgaatttggattagaaatggatatactcaaattctgaacatgcccagaagaatccttgttttggtcaatgttgggttctaattggttgtgttcgttgtttgctgttgatttgttttcttttcagaaagtgattgcattaagagaaacattgggataaaag

SEQ ID NO: 11138 - DNA, 3000 bp, Unknown
  misc_feature (1)..( 3000): cDNA_ID_3038646_gDNA_ID_2214479_Annot_ID_183284 3000 nt of promoter + ATG
aagataaaactttaatataatggaatacaacctggagaaagtgggtttttgactttttttttagtgaagtggagaggatgatggtaaattttaaatattaaaaactaaaaaatatggtgctactccactaattttttatgtaataatagtatcaaatctcatatgctccataggttaattatagtatagtataagaatagttaatgccttaatgggtcggctattaatcaaccattaatgtatactaatcattttccagttagtttatgttttactttaattcacacccatatatttccatcaccttctatttcatccaattatgttactttttcacaagttgtttggtccatatctctcaaaatatctatagacacaattactacagaaatcatctatatgtagtatgcgaaccaaaatttaatcattacttcatagtttggattacaaagattctcaaagaaattatcaaaaacaaaacaagaaaaaagaaaaaaaaaagattctcaacgatcaaacaacaagtagcaaataggacaacgtcgttcgcagatatatctacatgaactcatcttttagtcatggagcaatcgggacgacgtcgttcagcgatccatttatagttaagttataatgatctccctctttagacaaggagtgaatgggacaacgtcgttcgctgatccatttgcattatcgcaagacgcctgagccggtcgatgaacagagacaagattcacatcgtccattacaataccggtacatggtttctccttactacaatctaacaaaaccgccacttccgtattcgaagtcccgtgtatatcttcatatctcacatttgatactttaactcctgattcctataataatagaaattaatatacagattaaatgagtcaatatatcgagttatgggtgtaaagatatggttaattaataaatattcttacctgtttagggcaaggtttatgaagacagtagtgttggtctataatgattgggttcttgaccatcttcatgttaatatgttggaaaacaatgtttctagcgaaactgttgctatctttcccccatgttttgatcctaactccgttattcgttcccatgaaatccacgttactcacggtcacattatctactccttgttcttcctctgctcgtccaagacttccaatactgttggagagttcacacaaacaaaaaaaacaagagaacattttagaaagtgaaatatcaagaaagatggggagcaagaaatgtatgtgtgtgttacctgatgccgtggcctggaccgcatcgaatggtttgtatgaatacattagtggatcctggaccgatggagatgcaatcatcaccggttccgattcttgagttagtgatatggacggagtgagatgattcgacgtgaatcccatcggtattagggctattctcatcagcagaaaccttaacgccgtcaatgttcacgttattgctattatcgatgactatatggaatttctggctgttgatcgacgttaaaccactgattttgatgttatttgacccactaaacaccaaactctacaaataagattaacaaaaaaaaaaattaaaaacctcatgagagttaaatttgttgtttcttgtgggtcaagcataccttggcaccggtaggacaattatggccaccgttgttcttgcatttccacaaactagtgccttgagcgtcaagtattccaccgtagattgaaacatcagtaacatcctcgaaccagatccaatgttttgagcttgcgataattctaaaatcttccggagcaacgattgagcctgctatacgaatagatattggcgcttgcttacactcgttgccatgaaaaacaaggttcccgaccaagaaccgtccttttggtacgattatagttgtaggattagcggatgcacaagcaacgtcccatgcggctaagaaggctttggttgagtcttttgagccgtctggtttagctccgtaggataagacgttgagtgtgcttggaatcggatgggctaatgatgagattaaggtaaaatcaagaatgatgagagccaaaggaagaataaggcatgaagtgttataaaccattttttggatttttttcagagaaggttagtgttttaaggatgaaggatattgtagaagaaggtacatgagatgggaatttataggatttacgatagtaacgtaatgattagtttatatggaactttcttgattttattaatatctaccattgtgtcaacttgtgtacctagataaccgggtaatttgttatgtaataaaatttggttggtttaatgaaataatagtaattattcgcaagataagtttccttagatgactgcattagtgtacggtaatgtacgaaattagattagtcgttttcgacagagatagttatatggattgatttaattggaaaattttgattatggatcgatttggtggctctcgtttttggattaattaattatggaatgaagaaaacaagaagaagaagatttattacctcttaggattgtggtgtccttttatgtattttttttggtatcactatgatttaatattcactaacttaactactttagtgatttatataaaaaatcatagcgcatgcatgttcaagttctttaactttgccgatcgctagaacagtatccgtactttcgattttctaacattcacctatactcgtttggtaagttaacaaagaatcattagtcattcaaattgcatatcaagataataataacttattggtttttttaagtaagtgtaataagaaattattcgaatgattcgtcaactttttcggatagattccaaaataatggttgataacgagaattgatttacttatagcaaaaacaatctagaaatgtgaatacacattcaaaacaacacatataaggactaagtatattatattttaaaaaacaaaattgtgaaatacagaaaacatgcgcatcaaacaaagg

SEQ ID NO: 11139 - DNA, 3000 bp, Unknown; identical to SEQ ID NO: 11119
  misc_feature (1)..( 3000): cDNA_ID_2705350_gDNA_ID_2214479_Annot_ID_183255 3000 nt of promoter + ATG

SEQ ID NO: 11140 - DNA, 1388 bp, Unknown
  misc_feature (1)..( 1388): cDNA_ID_2706761_gDNA_ID_2214480_Annot_ID_133226 3000 nt of promoter + ATG
tgctgtggtgattgagccatcacaaaacgacagtacaatgacggaaggaaatttgcagcagcgtggaaacactgtaaacaagcgagactataactttagtttagatttgttttttttttgttttagccggacgtattttgtttttatctaattatctattcttttcattagagataaattagtataaaatctaaaaataacataacataaatgcttttatttaatatttggtagcatatgatatttcatttacaagattttattttgttttaaaaaaacttttgatttataagaaccgatggccatggtatgtcaaacgttgtaatgaaatgatagcttttctaatcgctgcggctttggctttcgtatcgattcgatacatcattgatgcactcatgcacaaaacaaatgtggcagtggacttcacgtagctgattatgtgcaaatattgctcagattctttaaagacatgtggtagtggacttcaattgatctgttcatatattttactttggcctatgcggagtcctacatcgtatcttgtgctttcgtccctttttacataaaacggcttgctgaggcgggcgatatccatcagccgtcaaaataacaatacaaggggcaactctttgttttgggatttgataaaataaaactatgttatgattttttgaaattaaaaaactatgtatcatcacctatctaaatatatatataaatatttacataataaattcagaaagtgaaagaagtcgccgaacgaaaacatttaatatatcatgaaactgtaattgctatgttttatataaagatggtttaggctacttacataattcttttgatttacttaattgcgacagtaaatacatttacatcaactaaaaatttatttgttatttttctttattttactcaaaattttttttgatatatttatagaaaaatacaaatagcagtgaaaataaaatttctacgccacatcggatccaaaccggagcagtgacaaagcctaaaacggatgcagacaaaaaaaactatcactctctgtaatacctcaaagttattttctaatgatatttataagcttagagttttccctaccaaaaaaaagaagcttagagttttttcttataagttatagtaattaatatcgactaatgtttttgttatttgatttaattcgttggaagctagaacggtctcttctttcttatttaccgttttacccttcgtattttgtgaatgtaacagagttccccgacaacgacgtcgtttcaggctctactataaaaaaacgacgctgtttttttcaagaagattatcattcgtctctcgtcgtcttggaaaaagattctttgaaagtcccgcccaaatttaagacgacgatg

SEQ ID NO: 11141 - DNA, 3000 bp, Unknown
  misc_feature (1)..( 3000): cDNA_ID_2717124_gDNA_ID_2214480_Annot_ID_133227 3000 nt of promoter + ATG
ccaactgtgtccactgttttgtcacctgaggtaagtcataactgttgaacgtctcaatttgtgcttaatatttcacattctgctttaagtataaacttgattgtatatgtgtgtgttttgcattgaaagattattgagaaggagtctgaaattggaggaaaacttggcgagcttgactcatatgagattgaaggtggggaaacaaagggagaaatattgcagaatctggccgagttccaattctcttgtgtaagtaaccaagaaagtttaacttgatttatggtatttcagcatagaaagaaacataacattttggttgtttacgtaaattctactaggtgatgttcaatgcggttctggagaatgcatgtagtgagatgggagcaagaatgtctgccatggacagctcaagcagaaacgcaggagaaatgctcgaccgtctcaccctcacatacaacaggactcgtcaagcttctattacaacagagcttattgagattatctctggagcttctgctcttgaagctgctaaataagcccatccgtgttagttctcttttcttcgctttgatatttacccccaccttgaaggagaagagtgtgttaaaattttactgaatcagtttcctttgctggcttcttgttgagacctaccaatgtttgctcaacgatttttaataaacatacctgtaatttccagcaggatttcgaataattgcattaacattttgttctgattcagactcgcttcctccagagtctgtagtgttgttttgtgcaaacaccatgtactccggtttatttgatatttttttacctgagccaatattttgtcacttcgccaggttttgaagtttgaaactttgaataatcccacaaacaaatctaaacaatatatccaatgcagtgtatgttgtcatgctagtggatttctagaattttggaattatgtataaacaatctgatgttagaaagtttaaactgatgtgaatccaatcatgtgaaacaaattttatggctcaatatctcctcttgatcgaggtccactagggtatccagagctgcggatatttgagatatctggtaataaatttaccggaggcttgccaccaaattattatgagaattggaaagcatcatcactcacgctaaaatcaagaagggggtttatatatgatatacactaagaatgcttacggtagcatttcttatacctatcaagattttatagatttaagatacaaaggtctacacatggagcaaaagaggattcttactttatacagcgctattgatttttccggaaacagacttgaaggacagattcctgaatccattggtctcttgaaggcactgattgcactcaacttatcaaacaacgctttcataggtaatattcccatgtctatggccaatcttattgagcttgaatcattagacatgtctagaaacggactatctgggactattcctcaaggactcaagaccctctcgtttttggggtacataaatgtgtcccataaccaactcaagggtgaaataccacaaggaacacaaatcactgggccaccaaaatcctcatttgaagggaatgcagggctttgtggtcttcctctcgaagaaagttgcttcggaacgaaagtgccaccaatacaacagtcaaagaaagaagacaaccaagaggatgcaaaagtgttgaactggaaagcagtggcaacagggtatggacctggagttttttttggattggcaatagcgcaaatcattgcttcatacaaaccggagtggctcgtcaagataattggtcctaataagcgtagaaaccattaagatttgttagtgtttgatttttgaatgtatgtcaaattgttacttgttttgcgtatgatatttgaatgtttgtcaagtattccttggtcttgtggtgaagcaggttctctatgcttcattcagctttcctctgtatcttggaagagaaaaatactagaggccgggaacgggaatcacgttatggattttttggtctctgacaataaaaagtagaaaatccaaactcttgttattgttatcccacaggaggaaatccgttcttgttattttcatcattggattctatttccgtgtaaaagtaactttttcccctaaaaacaagcttctctattttgtaaacaaaaaaataaagaaacagaggaaggagacgagagggagaaacagagcaacatatgagatctgtttcctaatgaataaaatgcatgagagagagggaccgagactgagactgaagtgtggcggtgagatcatacggagcgtaaaaaaaaaacaagaaaaagatagatgttcccttttctgtgttttcttggatcccaagtaaatttttgatttcgttcacactctaagttcaaatggattgaaaactacgtgtgttcgtcgctagattcagtttttttagactagacaattcttcttcttcttcttctttctttttggattcttaagttccgacaaaaaaaaaaactagtcaatctcgttttccacacactgaacctggtccctagaccctaggcacatatatattcctctaatcaaatatttcaacgttaacgaaattatgttcagaccaggagaatgtactactaatagacataaactctttgtgatctgttcataattgggtttgtttagaataaatatttcctcttattcgtcagagtagataacacattttccacgacgtccttgtcgtttaggatttgatttcggaccttttgactccaagaaaacatgtcccatgcgttggacaaaaaatagtgacatgcacatgcatttggtattcagactttatgattcatttcccactcaaagacttcacttagctctaacttcttctaagtcaacttgtagctccaaagcaaaaccacataccgtttatttataccaatcttctctctcactttccttaaaccataatcatttaattttcctaaaatagttctcatcatg

SEQ ID NO: 11142 - DNA, 3000 bp, Unknown
  misc_feature (1)..( 3000): cDNA_ID_1022712_gDNA_ID_2214480_Annot_ID_133229 3000 nt of promoter + ATG
ttcttcttcttcgtcttcttccttgggatattttgttggtggcgcaacgcaacttccttggagaggaagaccacagagacctacattcccttcaaatgatgattcagcttgcccactaaactgtggtccctgtggtatttcacctttgagttggttatgagctacacttatgtacgccagaaatgagaggctcccgagttctcttggaatattccctgatagttgatttcttgacaggtctagtgactcgagctccgtaacatttgccaaagacataggaatatggccagtgaaggcgttgttcgataagttgagcgctatcaattccttcaacagaccaatagactcaggaatctgtccttcaagtttgtttccagagaaatcaatggtgctgtagaaagtaaggactttcccctgctccatgaatagacctttgtattgcaaatccattgtatcttcatagatataataagcattcttgtagtctcccatataaatacgcccatcttcatttatcttgggtgatgatgctttccagttaacaaagaaatttggtggcaagcttccagtaaagctgttatctgacaattcaagtatccgcagctcgggaaacgcgagaggacctcgatcaggaggagagagatggccgaagaatctgtttgaacggagagtcaagacatgcaaattgggtagcgccttcagccagaaaggaaacgtgtcttcaattctgttgttgtcaacactcagaaacctcagagaggagcaattcaaaagtgattttggaagcttcccggttagtcgattatagccaacgtcaagcgtctgtgtcttagcaccgctatggaactcgtcaggtatacttccttccaagctgttcttcctgaggtttactacttttaagttactcagacattgaggaattggaccggtgaatttgttgtaggatagatcaaggacgatgagagagcttcggttgcagattgagagaggtatgttccctgtgaaactattgttccacgcagacaagtagatcgaaccgagtggtggagtaggaaacgctcctgtcatggagttataggcaaaatctagtaactgcactgatgagttaagtaaaacttctgaagaaccttcgaaaccagtcaaagaattgttaacaagatttgctatgctaagacgaggaagcttccaaaaccactcaggtactttccctttgattagattgttggaaatgtctatatgctccaagttttgaagggtcttaaagatgtttggaaactcgataatgtcgcactggatcaaaatcaagcttattaagctcaatggaaactctgaatctgaacttaaactggctggtaataacctattttgacgaatatcaaagaccaacaaagatttgagaggagcgaagacgcgtaagtcaattgggtgacttatgtttagggaagcaagttcaagatggttgaggtttatgagctttgagataggctctatgatttttccttcaaattggttaaacccaagggacaaacgaactagcttagatgaagaagaagagtttgggacatcaatagaaccagtgagatgattctttttcagatcaagataagacaagaaaggcaaagtgggtagtaaatcaaaaggtatggctcctgagaattgattgtaagaaaggtctaaaaaggaaagctttgttaggtttcttacaggtgggaaactaccagtgagctcattatgggaaaggtttaaatgggtaagcaagataaggttactaattgaggaaggaacttgaccagtaaagctactagaggcaagagacaaaacctctaatctggtgagattgctgaattcagaagggagtgaagaggaagtgaagttgttgtgagagagattaaggtaacgaagctgatgcaactcaaagagactactgtttggtttgagagttccagtgaagcaaccacttgggagctgaagcttcgtgaccgcaccagtcgtgttatcacactggactccgtttaagtagtcactgcggttgcagccgtcagattcaaactcattcttgaattggattagagcttggatctggtcaggaagacaagcaagagcgtcggtcgtcaagaagcttgaaacgaagacgatacagtagagtaagagtagcgagcaaaaatgcaaacgcatggtgtttgtgattgaaccaacaagttgaggaaattattgaacccaaaaaaagacatatcaaagatttgctatatatatgttattttaagccgcctttactaaatatgtggggtttaaatgtcacgtgaaatgtctacgagtcacatttgttcatgaagtaaattccacgtggacatctctgactatataactgggagttatagttgactgttaaaattggcttcaaaatttagcaacaagaggaaatcaacactcagcaatttactctcattggatcaaatgaacgcacattaatatgacgtaacgatgatgacaattctgtttaatagtatcttattgtttacagatacagaaaaataaattaagtgggcctttcaataattaataggttggtgaaatgttaccttctcttgatatttttttaattttcatttattatgagtatgttgcgttatgaaacaactcgcattaatttggttatagattggagaaagaagaagtcatggtcaaaactcaaaaatgtaaaaggaaacaagacgtgtatgacgacgtgattgataatctgaggagatacctttgggccttataagatgggccgaaaaagtaatagtattagcctctattcggcccgattaatttcaggggaaattttggtaataaagtggaaacgacgtcgtgacaaaactactgtgtagactgagaaataaagaagcccttgattttgcccattgcagtcatctctctcgaatctctctctataatccgatctgagaaatttcgccggagctaggttttgttgtttaccgatcaatcctttaatcaatg

SEQ ID NO: 11143 - DNA, 3000 bp, Unknown
  misc_feature (1)..( 3000): cDNA_ID_2705418_gDNA_ID_2214480_Annot_ID_133235 3000 nt of promoter + ATG
gttttacttggcttagtcttcgattctctacgcgtttcagcgtcaagttttctagatctctaaagctttcgtgctcgccgatataaatctctaatatcggtcccgtaagatcgaattagattcgcgtcgttttttaaggaaccaaaataatggcgcaacaatcgttgttctacagtttcatcgctcgcggcaccgtaatcctcgtcgagttcacagatttcaaaggcaatttcacatctgtcgctgctcagtaccttgagaatcttccttcctcgaacaacaagtttacctacaactgcgatggtcatacgttcaacgacctcgtcgaaaatggattcagtgagtcaaaatattgctcgtgatgtgtttgtgattgtgttttcgattagtcgatttattcattgtttggattagatttctttttacctaattgagcatttgagaatcgagttcttatgtttggtatatctctatgacttatctgagtcgagttcttatgtgtttaccgtttggtataatttcaggaatagttatgtattgggtttgataattaattgatgttagatctataatcagtgatatgtttggtggatctatttaagcatctatgcaattcttattatgaatctatgattcttggcttctttgcgtgtagcttttgttttcatgaatttggctggtttttcaaatgagagttgtttgggaaatttgtggatatatatcgctcgagtaaattgcattggtgtattgtgtttattatattgctctgttttaattaaacttagttgggttttgatgacgttggatatggtccatatcatatggactctttattatattttttaagtttcttatgagggatatgtttgtgcagcctattgtgttgttgcagttgattctgctgggagggagattcctatggctttcttggaacgcgtgaaggaggatttttataagagatatggtggtgaaaaggctgcaactgatcaagcaaatagcttgaataaagaatttgggtatgtgttttttgatctatatgattggtattgagaagtttgtattattcatgtcaatgacagactcctttttggctgctctaaaggtcgaatctgaaagagcacatgcagtattgcatggatcatcctgatgagattagcaaccttgctaaagctaaagctcaagtgtctgaagttaaaagtttaatgatggaaaacattgagaaggttcgattctgacccttttttctgttaatggtataattttatgttttaatctatttccagtagagttaagctcgtatgagttaagtgtcatgatcttttggttccttaacctttaaattgatgaggggaatgtccagttctgggttgtataggcatgtatgctgaccgtttttacattgtggaacacattcatttgcaggttcttgcccgtggtgtgatatgtgagatgctgggtagttcagaggttagttctcttaggcatatggttctaagttccatacacatagatatgcttgagttgccagttctctcttactaatgttgtcttgggtttccaacttttaattgaactcgaaactgtcacagtcacagccgcaagctttctatataaaaagaactcaaatgaaaaggaagaagtggtttcagaacatgaagataaaactcattgtccttgcaattatcattgccttgattctcatcatcatcctctcggtttgtgggggattcaactgcggtaaataagtctggaacatttcttcccggcgttatcgactgcgctctgtgcttcccaagatctctgagaatatcttcattcagttcgttgtgctgctttctttttgtggtttctaatttctaatttctgctatgtcctttctacttaggttgtacataaatattatacatatatgtatgtcctttcttctttgaaattggttttgtataggccatatatatgtatgaatgtttttgctattactggtactgacactgattcttgcgaaccaatactgtgacgagatttaaatatgtaattggcaacttacaaattgctctggtctgttgatgtcttaatgaaggctctagttgcgaatttgcagtgatggtgataacggtgtaacatagcctagattggagacgagtctgtttggtctgaccggttcagcagagtctttttttttttttcgtccttcagcagagtctccggttagttcgtttctttcgttgctgccacatcacctcgctcgaacctttctcttctgcttccctaattacggaaacgattcgtctgatttcgattcttctaaacgattagtcggctagccatgttgaagacgacgcgctcaagttctcgactactgaaatcgaaacgacctgcggagacacctccgacgccggtccgaaggcttctggactggaggtgatttggcgtctaaccgatggatagctgcgactgcgatgcattgttaaggaaacagacagagatgagtaatccaaatgcacctgtgacctgctttggtattgtttctgattcccctcctatgtgaaattcaatgcttgttaaattagggaaatttggtaaagctaaacccttggtttctagctttagagtctgatattgtattagagagagtgtttttatgtgtatctttgttatcattttcgatgatttgatctatctagttttctcacaatgttatacacaatcttttaaccattgataagcaaccttcattgagatagagagaggcaaagcacaaagaaaggagatttcagaactcaaaagatttcagttttaagttttccttataatagaaaaggatctattaaccgttgaaattctaaagcttttacatttccttccaaactcattcctctgttttcttattttcctcttttcctaaatcaggtttgtcaaaaaaaaataaaaaaaaatgggttcagtttctctctgaagaaaccaaacgacccaaaacaagataattccataattgtaatg

SEQ ID NO: 11144 - DNA, 3000 bp, Unknown
  misc_feature (1)..( 3000): cDNA_ID_2705422_gDNA_ID_2214480_Annot_ID_133236 3000 nt of promoter + ATG
aaattttctacaaataccccaaaaaagacaatttataaaattattatccaaccacatgtaataatctttgatgacttttaagttttaaattttaatagtagatttagataatataggaaccaattattcaaaggtcaaagttcaaactagcttatccaaattcattttcgctgataaaaatacgttgaaactatcaaataacaaaataccattacaccaacatcaccaactttttaaaaccccacaagttgattatttgaatttgcttttaggtcctcaagttcaagattgtttcaatttgcacaatctgcataaatctttctgaaatataacttttttgccctctaaaactcaagggtttgatttttcttcttcaactacgttaagatttctcctacacttttctttttcaccgtattctcttttagtcctcgattctctacgcgtttcagcgtcaagtcttctagatctctaaagccttcgtgctcgccaatataaatctctgagatcggtcccgtaaaatcggattcgcgtcgtttttgagtaaaaaaaatggcgcaacaatcgttgatctacagtttcgtcgctcgtggtaccgttatcctcgttgagttcacagatttcaaaggcaatttcacatcaatcgctgctcagtgccttcagaagcttccttcttctaacaacaagtttacctacaactgcgatggtcacacgttcaattacctcgtcgaaaatggattcagtgagtcaaaatattgctcgatctgtaagcgtagcttgtttgtgttttgatttatccattgtttgaattagattttttgcctaattgagaaatatgaatcgagttcttatgtttggtatagtttccagtaataattatgtattggcgttgataattaattgatgttagatctatggtaatcagtgatatttttggtggatctatcaatgaatatttgcaatttttgttctggatctattgattctttgcttatttgcgtgtagctttcgatatcatgaagtttttggcattagtgtattgtgttctttatgtaactctgttttactaaacctaattgggttttgggtgatgttgatggcggatatggtctctttatgatagtgttaactttcttatcagcgatatattgatgaatctattgctttatctcttaatatagagtttaaaatggaccggttttgttttcgtttgtgcagcctattgtgttgttgcagttgattctgctgggaggcagattcctatggctttcttggaacgagttaaggaggatttcaacaagagatatggtggtggaaaggctgcaactgctcaagcaaacagcttgaataaagaatttgggtatgtgttttttgatctctttgattggtattgaaaagggtctatgattcatgggcatagttattgatggacttctttttggcttctctaaaggtcgaaactgaaagagcatatgcagtattgcatggatcatcctgatgagattagcaagcttgctaaggttaaagctcaagtgtctgaagttaaaggtgttatgatggaaaacattgagaaggtttgattctgacccttttttctttttatcgatatagttttatgttgtaaaccttttcgaacagagttcagcttgtatgactttagtaccaggatcttatgattcgtaaagcataaactgtagagaggaatgttttattctcggttgtgaagacatattctgttgttaactcgtttatgcattcgtttgcaggttcttgaccgtggtgagaagattgagcttttggttgacaaaacagaaaaccttcgctcacaggtttgttttctaaatggttcaaagtcaatagacccacacagagacatgcaagagtttgcagctttctcttactgattgttgtttcttgggtttctaactttaaatttgaactcgactttatcacaggcgcaagattttagaacacaaggaactcaaatgagaagaaagatgtggtttcagaacatgaagataaagctcattgtccttgcaattatcattgccttgattctcatcatcatcctctcaatttgtgggggattcaactgcggtaaataagtctggaacatttcttcccggcgttatcgactgcgctctgtgcttcccaagatctctgagaatatcttcattcagttcgttgtgctacctttttgttttgtttttgtttttgtgatttctatattctcatactatatgtttcttcttagattgtacttcttgaaatttgttttgtataggctatatatattatacatatatgtatgcatgttcgacaatctgcaatgttgctattgctggtactgacactaattcttgcaaaccaatatttggacgatacttgttcttggcaatttactaatttctttggtctgttgatgagactctagttgcggattgcagtgaggtataagcatagtccacagccggttaatattaaatggagatgaatatgtaattaacacggtttcgtctgaccgattcaccagagtctccggttagttcattaagggtttgctcaaacgctttctcctctgcttccctaatttcggaaacattcgcctgattttctgagattttggaatttcttcgaattgattgccatgctgagctcaagatttcgactgctgaaatcgaggcgacttgcggagccacctccggctgatgtcgcggttatgtgtatttgcaggaaatgaaagtgatctccttattgcggcaaatcagccacttcctgtcgactaaaactgtggtgcagcatgtaagaacaaatgcaagttcggacaaacgtgttgtcttggtcagtggttttacttggcttagtcttcgattctctacgcgtttcagcgtcaagttttctagatctctaaagctttcgtgctcgccgatataaatctctaatatcggtcccgtaagatcgaattagattcgcgtcgttttttaaggaaccaaaataatg

SEQ ID NO: 11145 - DNA, 3000 bp, Unknown
  misc_feature (1)..( 3000): cDNA_ID_2113979_gDNA_ID_2214480_Annot_ID_133237 3000 nt of promoter + ATG
aaaccatagagacttgaattaatgagaatctctcaactctcaaccaaaccttaagaaatccacagccgagatatatctttataaactctgtcctcactaatggttctttaaccaacttacaagagctctatcttgccgcagtccgtccttttcaaagcatatcaatgtctacattgtgtctatataattataaaacgctcatgaacagttgctaatacttgttaaaactctcacaggagcgcgttgtgttgctacattgttgcacgagatgaaacgccgtggtaaagactgccgttttggagtagtgtcaatgtgcattggtatgcttctcactcgaataattcattgtgaatttggtgtctgaaatatgtgtctgagggatggttttactgatttggtaaactctggcagggacggggatgggtgcagcagctgtgtttgagagaggagatggagttgatgagcttcgcaacgcaaggaaagttgaagcgcaaggtcttttgtccaaggacgctcgctagagaggaccatgcaccaaaaccgtttttcacctcacctctctcttttctggtcttcttgtcactttcttcagatattattatagtttcgaataaagcacacaaccaatgtttgcctgagtcttgtgttgttcttgaccaggtcatgtgtttagtattttttttaagtgaagggggataatctttaaatcttttatatgtaagaatattgttcttctcgaatttcatcagttgttgcttctagaaattttagattttttgggtggcagccatttctatatttcgatggataagtcaaacgttcataaagtcaagggttctgccttttgtttgtgtttcatgattttaccttgaatttcattaactaaaacagtgttaatagtaacagttggggtggtggcgcagttggctagcgcgtaggtctcatagctactgagtgatcctgaggtcgagagttcgagcctctctcaccccataattttattttctcatagctatttatataacgttccttctagtatttttttttcttttcgttatagtatcttgtctttgataccggagacgttataacggcagtataagacgttataatcatgttccaatgcatcccctcagttttgtgttaaaaacgagccatcaatgttatcatatatggaaatcattattgaggctttgaccaattaattatgcgaattgaccgactttgatcactatacagagcaaaacaaatccactgaatcatttatttgtgtaggttcatcttttttgggcaccgtattcatttcttattccatgaatttgacggagtaattttgattttctttttcgagtaagaatctggtcaaatattcgatgaacctctacaaaaaaaattaacctctataaaagtgtagattaaccaagtgtttcatcacaaaccatttcaacgtaaacgaaacaacaactactactctcaactttacactctcttgataagtctcgatgatgaataacatgaagctcttgatcatcgctgtgatgatcatctcggcagctttgcttccagcgcttgtggtcggatctcgtccggtaaaatgtgacaattgcatggacggtggagaaaaagaagagatcatgaagatgagttcaggtgtagatgtgagccataggatacttcaagctaagagatttatagattacgaagcattgaagaaaaacttaccagccaaaccagatggtaaaccggataaaccggataacaaataccgacgtggttgcagtgccgctacaggatgttaccgctttacaaattaaacataaaccacctctctcttcttcttcttcttcctttcgttggtgtgttttattttatttttaattagtatttccaatcacatttcttattattatattttattgcaatttgtaagcctttgaggcattatctcctagagagttagaataaacttcgtttagaaattgtcatccttttctcaccaaatgattgacgagtgaaaattgatctcatcgtaaagtatttttgcggtcaagttcaaacaaattgatcccttctctcgcaccatattcttgttttattttatttaaacgatcgatatatttccaaaccattcctccaaaactatcacacattcacacctaccaatttcaactttaaatacaaaatatagtcttgttgtaaatataagatacactttagaagtgtacacgtgaaattcaggtatatatattacaatagtaagcaacctctaagtacaattaaatcaagaaaaaaatagatttgaattaataggagcggacatgggatgcatgtagaattgtagattatcatttattatggtgactagaccattgaactttcctataactttgaaaatattcttatttagtcatttaatttagattacaccaaaaccccaaatatgccaaattttctacaaataccccaaaaaagacaatttataaaattattatccaaccacatgtaataatctttgatgacttttaagttttaaattttaatagtagatttagataatataggaaccaattattcaaaggtcaaagttcaaactagcttatccaaattcattttcgctgataaaaatacgttgaaactatcaaataacaaaataccattacaccaacatcaccaactttttaaaaccccacaagttgattatttgaatttgcttttaggtcctcaagttcaagattgtttcaatttgcacaatctgcataaatctttctgaaatataacttttttgccctctaaaactcaagggtttgatttttcttcttcaactacgttaagatttctcctacacttttctttttcaccgtattctcttttagtcctcgattctctacgcgtttcagcgtcaagtcttctagatctctaaagccttcgtgctcgccaatataaatctctgagatcggtcccgtaaaatcggattcgcgtcgtttttgagtaaaaaaaatg

SEQ ID NO: 11146 - DNA, 3000 bp, Unknown
  misc_feature (1)..( 3000): cDNA_ID_1808741_gDNA_ID_2214480_Annot_ID_133239 3000 nt of promoter + ATG
tggtaactccggtaatgttaaaatcctcaacggagaataagttgaaatgccccattttgctattgatggaccttagaccgttgatcttcgatgatttaacaaaagcaaacccaatgttcatagctagtgtacgacaattagtgtttttgttacaatcattgagaggccaagaataagatccttgaccgtcaagtaatccaccgccagtaacagtgagattatcgacgtacttgaaaagtatccattcttcttggttgatggcgtaaggattacgaggagccaataaagttcctctgataaaaaaagttatagagcttttgcaaggaccagagaatgttacttgacggagatagaatattccggaaggaatatagaccgttgatcttccgtaactccattggcaagcttcgttccacgcctttgtaaacgcaaaagcgttatctctttggctatctgcgcgagcaccatagtttctgacgtcaaagatttttggttggccgggatattccttcgtggaagcggcgaggaagaagaagagagaaggcacacacaaaatcagaagaaccctagacgccattctctcttctttggtttggtaacccttttttggttgaaggaaaataaagcgtttaggcttcttatttatagagttacaagataagaatatatgtatttatttaacaaatatgggaaacgcaatctttactatcacccatatggaaaatacttaggaataatattatgaaaggatccttttaagatggaataagatgattttatgtacatatatactactaataaattatgaaataaatgtaggattcattctttttctacttctttttgcatatccgcttgaatctatataaatctgtataagttggaatgttttgactgtatattgtgtcacattacattatacattacagttccacgtggtattttttatgatttattaaatttgtatgtgttaaataaatttatacttcattcatatagataagaaatgtatactttacagtttacatgtgtatttgttattaaaaaaagataatataaaagaataagatatgggaatgtttaccctaaaatcatatataagagattcaattatctttttatctcatttaattttgagtcaggaaaaaatatatatacagagaagaaacaaaattattaaaaatgtaaaatttattggttaacattttgtctttacaaaaaacatagatatgttaatataacgaatatagtaaatgatagaataaagatatttagtatggttaagtaagaaaattaacattttcaataatttcgtctcttctttgcataggatttgtttgccaactcaaagtatattagataaaaagataagattgaaaactaaagttgataagatattatattgtttcacaaaaattagacattggatagatgtttaagattaaataatcttgttagaaataaaactgaagtctatgatgttgcatgtaagagctaatacagtaaaataaaattataaattaataacatggggaataaaatattttattgatttatataagtgttaatttttagatgtagtaaaaatattgaaaatgactttttcacaaaaattaaaacaaattcaaagaaaaacaaataacatttttatccaattacgttatatattatattcgtccaactttgaaccggaaaagtttattaatttacaatgattattaaattgacaagtattaatatatagatgtttcactctaataggttaaatggacaactatatgcgaaaatattagggcgatattacaataatcacaatgtaaagatagacaagcacaatgtaaagctgatcacgtacagttttgtttcttcctcttcaatgttaatctctccattcagttagagttaatttctagtctgatacataacaaaactacaaagtttctcgagtttttttgttatttgataactctctacacgatctaatttcaatattacatgtcggaaaacttccggaaagtaccacacaaatgtttgtaagattgagtaaaattgagtaaagagagctttaatctcccatatttgcaagtcgatataaatttggtatcacggcgtgtaagagatcttgacatgctaaccttacgcagatgtgcattgttgcagtgccatattgtcattattggtaatatatatgcctaagtaaagttcatattgataaaaattttattcaaacactattgcatctgcttgtcaatcgcataataacattattaattgaaaatgtagttttcactattatacaatatccgttcttatttcgtttaaaccggccgagcccatagtattgcaaactatcacaccatatgggctttaactttacgttggtaaaacgtaaaaagaaaatagcgatcaagtctcaagaagggtacttttagaattaatagcaactttaaggcgtaaatagaagtaatacaaatagttggggttattatgtaaatatgaagaagattaagatccagaagatggaaatgaaaaacacggcacgcatttcaaagcccaaaacgggcgggggcaaacgtcacgcctaatcttatcttcttctatcacactctcagcttatctatgactatgactctcatcatcaattatttcacactattaacaatcaccaaaccagtgtgaacattttaattcataattagagtaaggtcattaggctaaaaactgtttgatttggattttacaactataggataagaacttgtatcgctgtcacagatgatattttttggtcgtttaagcaaagaaatattacgaaaaagagatattttttattcttacttattttgggattatcatttacccggaacgggcaaagcggtgagtcatcttaccttataaatgatcacaaacccgaggactgtgagttttcgtgtagaacaaatccttctctgagaaaaaacaacagatccgaattttatctttaatcagccggaaaaaatg

SEQ ID NO: 11147 - DNA, 3000 bp, Unknown
  misc_feature (1)..( 3000): cDNA_ID_3038996_gDNA_ID_2214480_Annot_ID_183315 3000 nt of promoter + ATG
ggctgtggcgggtccagactgttttgagaagcgagctgctcggttattgtgagttcgagtatatatgcaggtggctcgtggtggcgacgggagagaatgctgagaaagtggtgccggagtttgagggtttagaagattttggtggtgatgttcttcacgctggagattataaatccggcgagaggtaccgcggaaaacgagttctcgtagttggatgtggaaactcaggcatggaagtctctcttgatctatgcaatcatgatgcgagcccatcaatggtcgttcgaagctccgtaagtaaaattcagtaaattatacccaccaagttacgaaaaacagagcaccctgattcttagtagctcctctgtttaaaacagagcatctgatagttatactctgtttttccttgttcgatcaggttcatgtattaccgagagaagttcttgggaagtcgacgttcgagttaagtgtaacaatgatgaaatggatgccggtttggctcgtggacaagactcttctcgttctcacaaggttacttctagggaacaccgataagtatgggctcaagaggcctgaaattggaccgttagagctgaagaacaccgcaggtaaaactcccgtgctagacatcggagccatttcaatgatcaaatcaggaaagatcaaaatcgtagcgggaatagctaagtttggtccgggaaaggtcgaactcgtggatggtcgagttctgcagattgattcagtgattcttgccactggttacagaagcaatgtcccttcatggcttaaggtagacaaaagtattatctttttcagatttttgtctcaaaagataacattttataggaccatagaataccggtattgatagttatgggaagtttgataaaaactaagacgttgattggtgattgatttattgttatgcaggaaaacgacttgggtgagattgggatagagaaaaacccatttccaaaagggtggaaagggaaggctggattgtatgcggtgggattcaccggaagaggactctcaggtgcatcgttcgatgcaatgagtgtagctcatgacattgccaatagctggaaagaagaaactaagcaacagatcaaaactgtcgctactcgccaccgtcgttgtatttcacacttttgattttcactgtttatacgaaaacatatatgagaagaggtaaaaaagagaggatcgatagtgttatgtgatgtgaaaatcaaagagataagcccactccatgagagtataactgtgaaatgtgtttgagcttattttcttgtaaggaggatgtggctccatgtatttaacgtattctttaacattccaacttatcttttgttagcaaatgtgtttgattagagctgatctagaaagtttaaaacatgattagtttaaacaaaatatatgaacatgtgtctgaaactgatttcgtcattgacagaaataagtgaatgagggaaaaataccgaaaacattcctccgtaccgtaccagcaatacatgaactgtgtatgtatcatttctcttattatacgatggaaatatagagacaacaaacatcaaggttctaaaatgcttaaacaaacattcattcatcatcatcaaaaggagccattgaaattttaccagacatcaggacgaagctctccggtagctggaggcatccaacgaccagaattgtacacgttttcaccgactttccatccaggaacatccttcatcacatccgcctcgtattctagatacttcttccactcagacacaaacctatttacaaatcaacacgtggtgatccaatgtgagagtttgtaccacacaagcaaacataacttcttttgtgaatcctacctttcatcttcttcagcttgaagaatcggtagaattgctctacgtgcagcgtacttctcttccttcaacgccctatcatcacagcaatcttcattaaaactttggagttgatacattgtgctcattttgacacttttgtcatcattatgcaattgagagtctaacaatagaagactattagagaatgtcacttacacacaccaagaaagataacactgtgttgtcttattcgttgcaaattactccaaatcgacactaatcaagctaaataactcacaatgtgaccatctaaaaaccaatatgcaactaaccactagtatatcatcttgcaatttgattgctttcttcatcacagctcaagagatcgttaattagtaaccaatttcgagactaaccacacaaatttataagcatcaatcccaaattgtcttaagattcaatcccaaattactcaaaatttcacaatagagaaaagcctaaccaaactcaaattccacatctcattatctaattacctgcggattttgttgccctgaccaacttggtacatgccccaagcaaaagcaccggaaacggtaaggaaaatagccatggcgctaggtcccgtgttggagatccggcgagcatatcggaccggcgcgaatccaccaggtggtggaccatcctgaagcaacggcatatccttcacactcgccattcctggcttcttccttatcatcgcctccgtcatcttcttcctcgattgatccccaaatcgatctttgattcgttaatcagtgtgtgttctagggattctgagaaagacaatcagaaatgaaatgaaatgaaaaatcttttttttggtgactttttttttaaaatgttgtaataatgaactgggctttaaaaggcccatattaaaatagtaccgggtcaaaactcgaaccggatccaaaaccggaggctaaaactcgaccaagcaatgatgagcttggagaaaacgtaaaaccctaaaccctactgcttatagaatcttcgacgatctgcttcatttctcctcatctacgagtgagagaatttgtcaatttagcttctttagttcggtctgatctgaattaattgcaatcttctcggttgtgtgagagaatcaatcaccatg

SEQ ID NO: 11148 - DNA, 3000 bp, Unknown
  misc_feature (1)..( 3000): cDNA_ID_3039000_gDNA_ID_2214480_Annot_ID_183314 3000 nt of promoter + ATG
gttttaatatgttttgaatttttattaaaccacgcagatacgatccatggttgaagcaagcacttctgattatgacaaggagaagttgcaagaaaggttggctaagctttcgggtggtgttgctgtactaaaggtaatgtacacctcttgtgaacatcagactaataggctattaatgcattattagtttattactaatgtcgagattactcatatgggtttttagattggaggagcaagtgagacagaagttagtgaaaagaaagatagagtaacggatgctctaaatgccactaaagcagccgtagaggagggtattgttccaggtataatctatcccaaatctaaaacaaaatttggttgaatcccttaagaaaattgcgtgagaagagaattatattactttgtgtgtattacaggtggtggtgttgctcttttgtatgcttcgaaagaacttgagaagctttccacagctaactttgatcagaaaattggtgttcaaatcattcaaaacgcactcaaggtgtttctctcatcacattgttcatcctcgctagcataaacagcttctagaatcttacacacaaaatctttctttgatgcagacacctgtttacacgattgcttccaatgctggagtcgagggtgcagttgtcgtaggcaagcttttggaacaagataatcctgaccttggttatgatgctgctaaaggttacactcttatatgcattagataattcactttctatagttcttgatccaccttgttatatatttccctatattccgaaatctgaactagcttcttttggcatttactttcaggagaatatgtggacatgataaaggctggtattatcgatcctttgaaagtgatcagaaccgcattagttgatgctgcaaggtacacaaagattgaaaattggttgtccaattttgtattttattgcaatgttttgctaatttattctattggttagtgtttcgtctttgttgacaacgacggaagcagttgtgactgagattccaacgaaagaggtagcatctccgggtatgggcggtggtggcatgggcggcatgggtggcatgggcggtatgggaggaatgggtttctgaggagaactataaaccctgagtagggttctttggaatctgttgtgagagatgctacggttggttcatccacaagacactaatgtattctttaatcatgattggtagagagagaccttcagattttccgtgattttcaattcacaaacgatttataaactattttgaagaagatccttttccgattcatgcaaatttcttccaaaaataattcagattagagagttcagtgaaacatcaagtaggttgtgtttgcgcatatggaggagattccttagttctcgccaactatcaccaaacccttatatcttattaacacgatatttagctgtttatttatatgtggttcaagtaacagactacttatttcaaataaaaaatggaaaaagcttttttcatagaacgaaacaaacgatatagtgtagtttaaagtatgttacccgaaaaagaaagcaaatctacttaacacggtccacaattcgcgtggtgaagaaggttataattgggtcccaaaacattcatttccccccaaaaaaagtcataattatgaaccaaactctttttgtcttcacgtctttgtccgttccataaccatagcttgccctacttattatagcagtaagccataatcaaggaaaccgtatttgtatgtaacttaatattgtggattgattacagcttggagggaattgattcaatttggccagttggtcaaacgcaatggtataagtccaccgaactagatggcaaaaacaaaaacaatttgagaatgttcttaaaagttccagttcaaatgtgttgtaaatagtcaaattccttttacgaacgatataaaagtagtcaaatagagatagggaataaagaaaaatacttatctagatgatgaattagcttaacgagaaaactattagtatctgttttggcaagaaaattttatgtctcggttgattacacacactttttagttaaactacaagtaatcaatcatagattttactttaagaaagttccacaaacacgacgtggctgtccattataacataacctcgtggtcatggaatgtttcgtcttattttatttttaatattacacaatgttcaaagttctcaattagcaagtttcatgtggtgtgatgaaaatcattaaccataaaaaccaacactcaagcggaaatccaactctcttaaattaaaataattcactcaaaattttattttcatttggagataaaaatataaattggtcaaaagcaaaataaagatagaggtcatcaaatcgtacggctagaaacagaagtgcacagagttattacgatgaaaacgttacacagaatcattttcatacaccaaaagctctttctttttgtattttaaatcgagtttcgaaccgctctgcttcttctttactctctgcgtgattatcgtgtgagaacattgaactcacacttcaactctcaagcttcttcttccttcgccttcttctcattcatttgcttctgtgtctaattttacatagcgaaattccagccatagccaaaaaaaaaagggtcagattttttaaacggatttttttctctctctctcaattactgataatgagtctaattgagagtttctcttttgacctgttgttcttgttcttgtctttagattctagggatgttcttaaagtcttggttgattacattatgatccttctagagtttgttctgtgtcatcaatctaaaccaaatcgctcatattcttacagaataaaagaattgatttagacactttttagaattttgtatacattggatcaagtagcattcaaaaaataattactgttctctacattttcagtacttacaggttctttaatttcagtttcttgtaggttttggcaatg

SEQ ID NO: 11149 - DNA, 3000 bp, Unknown
  misc_feature (1)..( 3000): cDNA_ID_2717109_gDNA_ID_2214480_Annot_ID_183310 3000 nt of promoter + ATG
gattaagtatttgattaagtatttgattaagaaagcagagcgtaatttactttatcgtttcttcattacataaactattgattatatctgtaatctcattgatacttttgtatacaatgattcatattaatgaaatatttttagatgaaaaaagaaaaaaaagatacatatatatatgtgtatatatatacatattttaaatacaaatgttatatttttcgaaattgtttatcggtttgcatatatagtcactcctaaattacattctttaattgtcgcagtaaaatattagttcatataaaagatacttactgggaagattcatgcgacctacatcttccggattcatgcaaatgttaagaaaggaacaacttggttttgttaaatgtttcatatatcatttttaaatttgccgcctttaatttagttctaaccattgaggaaaatctaacaactataggtaaaatgttatttacttatgccaaaatgtttacgaaaaaagttatcggggtcccctaaagacccttttcgttctaataatttaagcgtttcatgtcaagcacatgaacctctcctaacgtgtttatattatactattatatctagtgtttatcactttccaaagttagaatcgaaagaaacaaaaccttaatgtaaattcattgtaagtttttgttttaagagtttttttttataacttttacacgttttgtgatctcctagctcaatgagcaatatagtttcacaattgcaaatcagagatcaatgaaatttttagttcttctatttttgtttttataaaactgtgcagtttagtgattccattagcaatagaaaaagttaagtaagttccacatcagacggtgattatctgctgatctagtctctttcattgaatagttttttttcctcacgatcgtcccgttggacccatattccccagtcacatcatgttgtccttaatacggtaatgtatcaacaattatgaagacttttgggaatttaaagcaaatatttctagtcaattcataatgttagttttacatcgttgctttaactcaaagcaatgctgtaaatacgttccttctcgattgaacctgactaaccggtgttttattaagaaaattagtttagaagacgaccatattgaattaaacgatcaataattttcgagcgagttgtttcttggattttttttcttttcttttaatatttatcaataaacgtatgactttgacttgtagtcttgtaccattgaatttgacttaagctattataatatactatattcatctcatattgtaattaatcaaagagacagaaatttctaagtaatttttgtgaagaaataagccaggtgattttcaaaagaatgaatagtaattaatgtttaggaagctgaatcgtagcaatatgtgcacgacctaatgttttaacaaatttgtcaagagtttttgatttagacttaagtaccaatagatctacagtttcaattggatgaattaattgtaagtttgtaaccatgacgttcttttctcacaacactcgcatgccacatgtataagttggtgatgaacaatgtccaatggggaatggggattagccaagtttgtccagcattataagctgaaggattggcttacaattcttaaaatttggtgttggttggtcctgaatgtagactcttgtttcaaaacaaaaaatctactgcagaaattttgaaaatgtgcatgaaacttaaaaagaaaataaacaaacccacatattattggctttagcttaaatggaaaaaaaattgaataattggaccgagaaaatttaacaaaacttaataaaaatcaaacttatataattgaaaacaaagttaaaagactttatattttcaaagtctcgtaccaatcacccctaactttgagaaaaatgaaaattatgatctatctatcaatccggtctaaataatgagaacctaagctgtctcaatcaataaatcttcaaaagctattcctctgggaaaagatttagctgagaaataaaaattctatcactttcccttggcctaaaaaagtttgccactttctttcccacaagttccttttttcaattagaaaattgatgttcttggcactgaagaaaatggccaaaagaaaaacccacaaggcacacacacaagcttctcacaatataagaaagagagagaaagcacacacagtagagagagaaggcatgccttgtcggccattagaacttcaagccaaagcaaaaaccttacttatcctttctccataaaatcaaaatccttattggaatatacactaattgattctcctcatcactatctctctctcttcactttttctttccttttctagtttctctcttttaattcttgggattgtggagctttaaagttcctttttttgaaccttttgagtttctgattctgcttgattccagatcataaccatgatctttgttgattccagaactttagctttttgatttcattctatcaaatcactgaaattttcatttgaggaatcagaagagtaagtttttgcgatactctcatttgtcctcagctgcacaaagtaagaaatcttaaagctttgacattttttgaaaactttagttcgtttcgtaaaggttccatttttttgtttcgtgcagctataacttccgataagattgatcagttttgacctttgtgcttggtggtttcttctatggattcacattggtaagcttcttcgttattcattctctagtttccattcatttgaaatgaactgaaatttgaatcctgaaaccaaattaatcagaaccaatgctagatctaaggcttcgttgcttaaagctctgagttttgcattatattgtctctgttaaattgaaaagatttgattttttttaaaactttggtgtgaaaagaaatgtgaatctctctataattgcaggtgttgagggattatatagtgtttctctttgttgagaggatcaatg

SEQ ID NO: 11150 - DNA, 3000 bp, Unknown; identical to SEQ ID NO: 11146
  misc_feature (1)..( 3000): cDNA_ID_1808741_gDNA_ID_2214480_Annot_ID_183308 3000 nt of promoter + ATG

SEQ ID NO: 11151 - DNA, 3000 bp, Unknown; identical to SEQ ID NO: 11145
  misc_feature (1)..( 3000): cDNA_ID_2113979_gDNA_ID_2214480_Annot_ID_183306 3000 nt of promoter + ATG

SEQ ID NO: 11152 - DNA, 3000 bp, Unknown; identical to SEQ ID NO: 11144
  misc_feature (1)..( 3000): cDNA_ID_3039010_gDNA_ID_2214480_Annot_ID_183305 3000 nt of promoter + ATG

SEQ ID NO: 11153 - DNA, 3000 bp, Unknown; identical to SEQ ID NO: 11143
  misc_feature (1)..( 3000): cDNA_ID_2705418_gDNA_ID_2214480_Annot_ID_183304 3000 nt of promoter + ATG

SEQ ID NO: 11154 - DNA, 3000 bp, Unknown; identical to SEQ ID NO: 11142
  misc_feature (1)..( 3000): cDNA_ID_1022712_gDNA_ID_2214480_Annot_ID_183298 3000 nt of promoter + ATG

SEQ ID NO: 11155 - DNA, 3000 bp, Unknown; identical to SEQ ID NO: 11141
  misc_feature (1)..( 3000): cDNA_ID_2717124_gDNA_ID_2214480_Annot_ID_183296 3000 nt of promoter + ATG

SEQ ID NO: 11156 - DNA, 3000 bp, Unknown; identical to SEQ ID NO: 11149
  misc_feature (1)..( 3000): cDNA_ID_2717109_gDNA_ID_2214480_Annot_ID_133241 3000 nt of promoter + ATG

SEQ ID NO: 11157 - DNA, 3000 bp, Unknown
  misc_feature (1)..( 3000): cDNA_ID_3038996_gDNA_ID_2214480_Annot_ID_133245 3000 nt of promoter + ATG
cttctcgttctcacaaggttacttctagggaacaccgataagtatgggctcaagaggcctgaaattggaccgttagagctgaagaacaccgcaggtaaaactcccgtgctagacatcggagccatttcaatgatcaaatcaggaaagatcaaaatcgtagcgggaatagctaagtttggtccgggaaaggtcgaactcgtggatggtcgagttctgcagattgattcagtgattcttgccactggttacagaagcaatgtcccttcatggcttaaggtagacaaaagtattatctttttcagatttttgtctcaaaagataacattttataggaccatagaataccggtattgatagttatgggaagtttgataaaaactaagacgttgattggtgattgatttattgttatgcaggaaaacgacttgggtgagattgggatagagaaaaacccatttccaaaagggtggaaagggaaggctggattgtatgcggtgggattcaccggaagaggactctcaggtgcatcgttcgatgcaatgagtgtagctcatgacattgccaatagctggaaagaagaaactaagcaacagatcaaaactgtcgctactcgccaccgtcgttgtatttcacacttttgattttcactgtttatacgaaaacatatatgagaagaggtaaaaaagagaggatcgatagtgttatgtgatgtgaaaatcaaagagataagcccactccatgagagtataactgtgaaatgtgtttgagcttattttcttgtaaggaggatgtggctccatgtatttaacgtattctttaacattccaacttatcttttgttagcaaatgtgtttgattagagctgatctagaaagtttaaaacatgattagtttaaacaaaatatatgaacatgtgtctgaaactgatttcgtcattgacagaaataagtgaatgagggaaaaataccgaaaacattcctccgtaccgtaccagcaatacatgaactgtgtatgtatcatttctcttattatacgatggaaatatagagacaacaaacatcaaggttctaaaatgcttaaacaaacattcattcatcatcatcaaaaggagccattgaaattttaccagacatcaggacgaagctctccggtagctggaggcatccaacgaccagaattgtacacgttttcaccgactttccatccaggaacatccttcatcacatccgcctcgtattctagatacttcttccactcagacacaaacctatttacaaatcaacacgtggtgatccaatgtgagagtttgtaccacacaagcaaacataacttcttttgtgaatcctacctttcatcttcttcagcttgaagaatcggtagaattgctctacgtgcagcgtacttctcttccttcaacgccctatcatcacagcaatcttcattaaaactttggagttgatacattgtgctcattttgacacttttgtcatcattatgcaattgagagtctaacaatagaagactattagagaatgtcacttacacacaccaagaaagataacactgtgttgtcttattcgttgcaaattactccaaatcgacactaatcaagctaaataactcacaatgtgaccatctaaaaaccaatatgcaactaaccactagtatatcatcttgcaatttgattgctttcttcatcacagctcaagagatcgttaattagtaaccaatttcgagactaaccacacaaatttataagcatcaatcccaaattgtcttaagattcaatcccaaattactcaaaatttcacaatagagaaaagcctaaccaaactcaaattccacatctcattatctaattacctgcggattttgttgccctgaccaacttggtacatgccccaagcaaaagcaccggaaacggtaaggaaaatagccatggcgctaggtcccgtgttggagatccggcgagcatatcggaccggcgcgaatccaccaggtggtggaccatcctgaagcaacggcatatccttcacactcgccattcctggcttcttccttatcatcgcctccgtcatcttcttcctcgattgatccccaaatcgatctttgattcgttaatcagtgtgtgttctagggattctgagaaagacaatcagaaatgaaatgaaatgaaaaatcttttttttggtgactttttttttaaaatgttgtaataatgaactgggctttaaaaggcccatattaaaatagtaccgggtcaaaactcgaaccggatccaaaaccggaggctaaaactcgaccaagcaatgatgagcttggagaaaacgtaaaaccctaaaccctactgcttatagaatcttcgacgatctgcttcatttctcctcatctacgagtgagagaatttgtcaatttagcttctttagttcggtctgatctgaattaattgcaatcttctcggttgtgtgagagaatcaatcaccatgtatcggcttgtctccaacgttgcttccaaagctaggtagatctattcgactttttggttttctttgtgtatatgattccaatgctgctttattttctgtgaatttgtttctgattggatcctcgaaatcggaaagttgcgagaaactgttgggaattgaatcggattttgatcggattgaattgaatatttctctgccattggagagtttagcatcttctattttctttgtatttctggaagttgcttcatttattgatgggatttatttttctttgtttcaacaggattgccagaaagtgtacaagccaggttcgtgttcttcattttgtatctaatttgtggtttagccgtttgtgggtatgtattgatgtgaatttgtgtattgttagattggaagcaggctcaattctactaggaattatgcagcaaaagacataaggttcggtgttgaagctcgggctttaatgcttaggggtgttgaggatcttgctgatgcagttaaagtcactatg

SEQ ID NO: 11158 - DNA, 3000 bp, Unknown
  misc_feature (1)..( 3000): cDNA_ID_2707826_gDNA_ID_2214481_Annot_ID_133250 3000 nt of promoter + ATG
agattgtttttgcacattttcgtcgtaaccgcacttagctaaaatattcatactaatgagctgcgtccctactcaaagcgtaacgtcactttgtcgatacgaattaagaacgtagaatgtcatgatctcgtacatcaatacatcatgttcattggagtattcgctatgctcgagcaatagtcttttaatgctgagaagatcatgattttctactcgaatgctaacccagccaaaccggtttatctcgtctcattatccatatgctgaaatataaatttatatacaataagaataagtttcatatgtatattctcaaacattacagtataatgtgatctagatcctaatttcaatatgaagatatatctagtttagatagcatcaaaccattaacagttggattacagaatcaattttaacgatacaacaccttttgcacatgtatttatttccttgaaaacgtttaacttgtcttctcaatgacactctagttttctagaaaaaaattcattgctctttttcctctagaaaatttgtctctccagggcatgtatttaattttcttgctcttttttctcacaagtatgaatccctactatcataaacatatataatctctgttagttcctgaagaagtaagattaagaacattgagcttataaggtcatctcgtacatatggtgaaagcatccataaccataaatattatagcatgctctaaaaatacgaatatcctttgaaagaacaaattgaatgaatgagcaatcgacacaggagcaaagtgaatcaactttttagaaaatgtccaagctaactagaaaatgctaatccgtaattttgataatatcacaaccagttcttttggcccctagtcaaaatctgtaaacagagagaaaagtttgaagcttcgtacttgctttgcaagttacatgccaagagggtaaaacacatagagaagaatccacctacttgaattttaatgatctataatactgataaccaactagaactagagtggcaaacacaaaccgaaaagtgatgatctccttgaataaccctgcctccggatgcttcgaaaacaatccgcaactagatgtcctgattttgtaatcccgatgatcatgtcctgagtccaaacgaagtggtaccaaatcctcgagataaggagatataacagaaatatctgaggagagacagcaaatctcatttgtctcggtattatatttaaacaaccgcttgtgattgtcacaaaagacaagattccctagcttagaaaccgtcaacaccgtgaaccaactagactcccatgggtggttaataatgatactggctaaagttatggagtaagtcttgctccatatttctttgtctacatccatcaggctcagtatctctagctcccattctggcgcaccgtttgttttagttatggctagacggtcatcaaggttcaccatctgggcactcatggtgcaacacgtagatggaacggaaacattgtggaactctagtgtgtgaagatccaaggctaggattccgaaacgctaaacattttttaaccagtagattgacccattcacacacactgacttccttcccacgtcaatatcgttaggaggtggattcagttcactccattccccagtttcaacatcaagaacctcgcatttttccacaggactaaaacacatcctcaccactttatagctaccattaaatttgtctctaccaaatcccatctcccaattccccggaaaggaagtgaggtatagttcgtctgcaatttcacgaaaaaatcagacaaaaacaatccaaattttaactgactctttaataaaccattaaacagatattacctctgaactgaaaacgaatacgatcagagggcacgtgatgattagggctacaaggaaatctccggagttgtctggtcgatgggttcaaaacgttgatccaacctggtgctgggatacacaccaaaccctcacatgtcagagagggtcgtgtggcgtcaatatcgcagtgtaaatagaccatctggatctcttcctcaccttcgaatcccaactcagtccggtctccaacagccagaattttctccttcttctcaacgttcaaacgcctctccgcgaaactcttcgattccaggattgatctccattgttttgagacggttttgaatctgaggattgattttaaaggcaatccaaggaaaatttcttcaagtagatcgggaactacgtaaatcatcatcgggattagggtctttttcttcttttctctacagaactaaaaactcatcgggattagggtcttttttatacacaattttttttttttctagttttaacggaaacccccacaaatatttcattattactatttagcccagtcaatttccaaaagattaatttaggtcacctctctctctctctttccctatctcttggcctcgtgctcgtgcagctgaagatccctgctctgattcgtcaaatccagtaagctaaatttcctcttaattttctggtctttaattactttatactccatatgaataatttcttcaatcgaatttttcatctttgggtcttaatttttttctcaactgattcagctaacattagtgattagctatttgctggatttcttcgattgcttgtcgtctctatgtttcaattgtattatgattacgacacattcttgttctgatcattgtcgatgaaaagggtaaactttgaacaatcttctattacataaaattgaaactttttccaacatttctgagattttccaaatcaaattctcggagttgaattgaactctcaagtagcttacataatattcaaacttttgattatctaatcaaatctgtaattcttccttatctatgtggcagtggaagatgaggatgatccaaccacaaagaacagcaacaacacagatgattttgctatagagcctcgtgaagggattatatttgaatccgaggatgcagctaag

SEQ ID NO: 11159 - DNA, 3000 bp, Unknown
  misc_feature (1)..( 3000): cDNA_ID_2705440_gDNA_ID_2214481_Annot_ID_133254 3000 nt of promoter + ATG
acggatctcgtttttaaggacattaacaagaacaacagagctttcccaacttttcaaagaacctacacaatgtttagttaacttgatacaattaattatgatacataaataaaagaagatatcagatgctagtgcatgtgaagcacataccttcattttttaaaggagcagtttctgacccagagagcccaatgatatcagcaacacttacttttccctgaaacaagatgatggttacaatgcaaaggttaggattttctatacatccttactcttgtccgtggtattataatttataaagcatggaggcagccaaaaacgattcttgtttttcactttttaatgaaaatatataaagatcaagcaaactgggcacttctagacatactagttctaacatagcggacttacttacaaggttcataaagaaaaaagtatgatcgctttctgattcacattttagccaagaaaagctaatgtatccactcttaaaaccagcattagaatatcatcctaccacgtcattgatctttccagcaatcacttcttcatgttaaatcttgaataaaaggtttgacaagcaaagtttctttgcctaggctctcaaaaagccaagtgtacacatcagtttttaacttttatgtctacttccttacagcttggaggtgatgaactatattcaaaaattgcatttgtagtaccttgaaaacttgtaaaccgagcgcatctagattctcccctgaatacctgtgatgagctactgtctacaggagaaagaaacgaaaagagaattagcatagcagggtattatagagtctactccattctcaaaatgaaagaaactcttcattcctaaaatgatgatgatgataaaaatcgacaatgagaaaaaaaccttagaaggtatgatctcaacagctggtgttggaagctgcaaatccttctctgataatgcagacacaccgcctcggtcttgaggcagcaaacccggcaagcattgtgcaagcaaagatggtgcacgcattcttgagctttgagttctcaataacgctcaaaatggtcacaatctaaaattagcaaaaagatcaaaactttagtaatactattgtcactttgaacatctttaactcgaaaacttaaaccccaaaacttagacatcatgattttcacctaacgtcgatgcaatcacatgattcacatgaatagatacataaatgcgaaagcaactttgaacatagtgacaaccatagagaacttagcagtcaaataaaggtcaaaattaaaactttctgattcaaaactaagcccaattgcgagatctaggcgaatcctaaaatccacatccctactgtgaaaatgaccagcaaggatcaaaatcaaaaacaagaaaccatcaacagaacatgagttcttacaagacataatgaatcaaaagtttgactttaatttcaataataaacgaccatgtaccgtatcaatggagtatcaagagaaacagacaacaaagaaactgaaatttacttacagagtaaaataaattaaaaagagaaaacgagaagtggaggagtggaggagttctcgacacgaaatttcgattcagacggcaaaaaatgagattcttctataacacggcgaaaatctagggatcaaacaaagcaaccaggggttgaaatttcggagcaaagcgatctctcacacgttttaaagtaagaagaaataaaagaaatgtttttaaaaagaaagaaaaattctaaaaaggaaagagcaaagtttggccaacaaaaaatcgaagcttcggttcagacccgctggtctgcttttgtacacctgttccttaactatttataattctagtcctttttattctttgcagttcatggaactcaccactttctttcgttcctctggtcgtcgtctgatttctcgcatttatatttctcatttcctggaaaaaatggagtttattaattaatttctccttatagaccaattatatgggcctttaaaaggcctctattgtatggcaatgggtcaacaaactctacctataaacggatttgttaaatttaggcctttattacataccaatgatattttaccaatgaaatatttgtataattaaatttcatattatcataggataaaaaataaattatcacattaacgcatgttgaacaaaaattttacatggattatctttctttctatttttgcggagtaggttgtttaagtatgtttttgtcctttcaagaatttgtcagtttataacttataagtaaaattttaggtacagtatatatataagttgtaaaagttgataggtattcttgtaatcaaggtttactatcaaattttaaactaaaaatggttaatcattcatcaacacatgctaattatgtttagtatgggtagatgtgcctgtagatagagtgtcctaggagagtgtggtcacgcgcttacgctaaacaaataatatatcctctgtctttgctacacgtgtataaacagcagcaaagatgaaacgtgattaaataaaataagaggttgagaaagcgagtagaagatatttagataaacgcgggagtgcaattatggtttgtttgttggaattaagagacaaccttatccagagtaagctcgccacgtgtattaaaaacattattattgtctgttagtcacagtcgagtaactccagataatcttctctgtctcatttctcgtcgtctttttaaaaacgttttactttccacggcgaattttggtctgattccaaattcttccctagtttgaaaaatcttctgtattctgaaaagagattttatgcgtatcgctgaaataggaagaaaacagattcctttccatttcccaaattttgtcattgagtcttggcatttcaaccaatcgcaatttattgaaattccggcgagtcattagatttttttggattccgtttcaaggtacggtgctttttcgcagattgagaagagcttaataagaaag

SEQ ID NO: 11160 - DNA, 3000 bp, Unknown
  misc_feature (1)..( 3000): cDNA_ID_2717154_gDNA_ID_2214481_Annot_ID_133255 3000 nt of promoter + ATG
cacaaactaaaataaatttataactataatatcaaacatgtgagtaaaaaataaagaaaaactagaaaatcaccccgtgataaataaaataaaaaggatcagataaaagaagaaaaatatgtatgtggtaaatgaacaaatgataatgatgggaatgggaccaaagttgaacatgaatgtcgtgaagaccagagagtgggtgtgaattgtgaaatgtggtgctgattagttgagccgaataagcaaaaaggaaatggggacacgtgagttgttgggtctctcttcttgtctctatttttagtgagcccctctcttttcttctaatgagcccctttaatttcttatcataactatccacgtggcgtctcccctgccttttgtcttcttctctttgttcacatgtgattcgcttctgtttccacaacatttataatcccttactcttctcacatgctttggtaattgtttccatcaccacaattattgacttaaactactttttaaaagtgagataatatttcacttgcttctgatggttgttcacgaaacaaaacttatctgatggttatactgaggaggggaaaaagaactttatttcgtttgtatgtatctcgtgatccttctctttacgagttacatgcactagagattagtggacgtaatttgcgatcaacttcgactgtataattactttatgtgtttatgaagttactaacttttcttttttgttgaattctgaaaattacaattcgaatgaaagaacattttgtgcctatataatcaccatatggttgattgattactcaatgagcattagtagcatttattatacactgatcgcagcgccatataaaccaccacaatcatttggagcctttcgttctataggtacaaaacaataagatgggaaactaaactagtgtcctctcttatcctgcttttattacatttgactatgtaacccacatcatcaatagaagaataccataatggtttggcatcgatacccatgtcatgtgaccatcaccaaatctgaatgtcatctttacttaacatgacacgttcatgtgcataggtgttttaacatgacacttttgtctccatttgacgccggcgcaccatgtatatctatcaaagtcatgttaatttgtcaatgaagccaattagctcatcaaaagctggaccacgatcattttcgttcataatttcatttttctctccactagaatattcaagaagcaatcttcttttggcttctacaatatttcttctttttgatttcttatgttgtgtattttagctgtttacagcaaggatctttcgaacaaaagctttatatgaggattggttatcaattttaaataattagcaaaaaggaagccgtttatgtaatcagaactataaattattttatttagctttgtcatttgctacttttgctaagtaaacagatcaaccaacccattatattacgatactcgtaataagtcacaatatgtcaatttcttacaataatttaactgaatttatacatataggtctagagtgaaattagaaaataatttgcgatcaatacattacaataacaaaatttatgtaatgtattttacttacatacataaatcaaggatggatgctcatgatttcgtctctaagatttgcttcatctcactgacatttgtcgatcaagctataggaagttaaagaatcacacttttaatttgcttgccaatatctacaaagatcaaataaaataaataaaaacaaaatgttgttgcggaatctaaagtaacttgtcgtattaaaaatttgtttttaagtcgtagggaaatgtaaaactgacgtggcgcatctcgaggccaacgacttattggcaggccgaaggtgaattgtttataattagatttgtaaataaatcactgatactagttcgtctttaacctacataatatttctttattaaattaagtagtacatttttaattatgttttagttgctgttgagtacaataatcttgtcagtaaaataattgcagcaacctaacgagtttggagcaacgacttcttgttgcggccgcgagaagttagatgtgaaaactgaaaatgtgtgcatacacataactactatgtatgactaacatatttaaacaataaaaatgtatgactaccatatgtaataataaaagaaatatttttgattaaaaaacatatttttaatataatatacatacgagtattattgtacgaatttttttatacttttagactacattttcttttgttttatggataattttttattatggtatgtaagtcagaagaccgtttaaaattttaaatagacgaattggtagtcttagttttttaaaatcatattaagttcaagtgacgtatgatggtacgtaatttcgaaaatttcgtttcatgctgagaaaaataactagcgatgagttgtatcaatttgtttatttgtcaacagagttagatttttttgtcttttctcgacgcaatacaagaagttactcacttactctccaactcctccatacggtagcaaagtctagttctaaactacattttgatgaagaagtaagaattttcaaggttaatttataaaaatatgcagattacaaatcaaatgctaattttgtatgttacgcttacggctaaaaaagcggtgggaataataattcgcgaaaaggtgctctctgacgactgattcgttgatctagattctagccgcacatggtgggccatactctccggcccagtatacacacatccatgacatgtcatcatatattatatcataacatacatacacataaattgattagtgaccacatgattagaaagagacaaaaaataattgccgcccgataataataacttctttataaagcaactcttcttcttctttctctcttcactttctctctttttaacctttttctaattaccactttcttctccatatacaaaaaaaacagagaactcaca

SEQ ID NO: 11161 - DNA, 3000 bp, Unknown
  misc_feature (1)..( 3000): cDNA_ID_2705433_gDNA_ID_2214481_Annot_ID_133261 3000 nt of promoter + ATG
taatgtaggcaccatgcaaaaggttgctctgctgtttcttataaacccaacaagcacccgtgtctgacttaatgccatctcaagaacccaacaactactctaaaaccatcattatcgcatccttatcaccacaagaaaaacaaatcaaaaccaaagaatccaaataatattatgtcgccaagagtattgaatcatgaaactatagagaaataagtttcatgggtcttcctctggcatttgatctaggctccaagcggcagtcaggtcaccattaaaagtggcgcctgctgttgactcgataaaaatggagcctttatctcgtaaaacaaaaacattcgaaaacgcacagatctataacaagtttcaaacgaaacgatacatgattgatgcggagaaagagagagaatcgagattatatagtagtgactgtggggaggagaagcaaaaccctagcattttgaactgtgagaataacgggcttttaaactgtctttattaagcccaatcactcattacttgggcccatcatagtcatctatatatattcagaaacgatggcttgttgaaccaatctcacaagtcacaagtcaaaatgacgtagttttgacttcgagcgatgtatttgcatatttggtaaggttttgcaattgtttataagaaaatcagaaatttttgagagatccaactgaaaaaaattaacatctatattcattcatacccataatggttatcacaaatattattatttattatcaaaattcatatatatgttaataaaagttgggttcataacataaaaaacactttcactaagtttatatttgtatctacgtattttttttgtttttgttaaccaaatttcatacacccacactctgtgtagaccaaaaacaagtcctcaaatttcatatataggcctgcctaaaggccaaaaaagttttgttgcccatttacaaacaaaaattccaaaaatgttaaaattttgagccatcaatttttctatttctaaacgtatataattaacaataaaagcgatattcaaataccatccacaagaaacttttaacaagttgtcttaataagtaatttactatacttggaagcttggcttaacatataaatacactaatagttaaaccatattcaacagccagaatattcaaaggaaaaagaaaaagaaaaaaaaaatacattactagaagaaaaaaatgacgtttgaaaagaaaattgtgattgtgtcaatggccatatttttaatgatagtagcaacaaccgctaccgaagttgatggtcgaattcatgtccgacggagcttagctgattttggtggaggttgttgcaacgtttttattcacacttgttgttttcctaaacattgacttaatcacttttaaatatatattacctcgtaataagtttcttctcttctttttcttttctcttaggagaattgattaactgtataaatattcagataagtggtggaccattgaacataatatacgtatccaaacatgttattcaggattgttgcatgtaataaaactatatagttgagagaaagataaaccgtccccacatacatttttttgtcttaaatttttcctttatataaccgataatagttatctatcgaatttagattctcacctagagcaaacaaaaatacgtttgtttttgaacgatcgaatgttttggccaaaatattcgatctagttacgaaaaaatccaatggttgtgtaaattttatgaccatcaatcagtagtgattaaatatatcaatggaaatatttgtatttttatgtgaaaatgttattttatatttaaataagacaactttttcttagataatcaagttttctcagccaaaattcaaactaattaattacaaaatatatatacgatggttatgtgaattttgtgagtatcaattcatagtgatcatgaaatcaagggttaatacaaaaatattggttttgattcctgattacatatatacactgtaagcctatccaaaccttttcattcaacaaagtctccaacttgaatctcaatgtgggatactgaaatattcacacaaaactctccaaagaaaacacgcacgtgtcacgtgtgtgtgcgtgtatatatgaaataaaatatttacatgtatgtgtaagaaaagcaacatcagtgaatactttaggtttagattaattacttcatgaaattatctttgtgccccacacaagaagtaaaacatccaacactacgaatgaagcaagaatagaagccaagttttgtccttaagactctaatcgcaaatcgtctcttggtcgtaccttgacgcacttccgaaacccatcgttcggccgactcgttcattcctttcattgacttccgaagcttctctttgaaactgaatctctctgatcccatcaagtcgtagcttgccaacacaatccgtcttccgtcccgataacatttctgagtgtagcgttctctctggtcatggtgcggcagcgttacataggcgtacatgtacgtttgttccggcatcatgaatataaagcaacgtaagaagagtgatgtagtgtgtatagcctctcttacatatatatgtatatatatatgtacgagagggagagttgggtgagattttggttgaacaattatgaaattgcgtttgatagtggttggtgactgtgttgcaccaaatatggaatctcatgttatttggtcatacgcaacacatgtgaccataatgtgactgacctatgtgcaagccgccatgtactttgtcaattggttaaagaaatcttcaatcctatttaatacatagaagaaacatttggacaatctatttttagataatgggaagagtaatgaatgagcttgccacgtcatcgccgagtcatttctaagctttttgttttttctttcgttctttctctgtttatacgaatgaacgcttgtgttccttaatcctccttggatcatcctcctaattactcagtgatc

SEQ ID NO: 11162 - DNA, 3000 bp, Unknown
  misc_feature (1)..( 3000): cDNA_ID_2705429_gDNA_ID_2214481_Annot_ID_133262 3000 nt of promoter + ATG
caaaggtcttactattagttcatcccattgttgcgtttttgcgtctacgtttattatcttattatacctggtagtattccttgagcttgatgcattcttagttttccttttttggaggaatgactgtcttagtttttaaaatttcagtttatactcgggagtggtgaaaatatctctgatttcacttactcggagaacgtttctcatgcacatatttgcgccgttaaagcattagattcacagatggagtttgtggctggaaaggtaacctctttgagtcaaagtgtatttgccaaatcactcctgaaagcgcatgaactttatatgtgatgaatttttactgtgccgactttatgtaggaattttttatcacaaacctcaagccggtcagattttgggactttgtaagccatatagttgaaggtctgggatacccaaggtaaataagcatccgaacagtttttgatacaatgaaacttgctgtgaactccttttatctttctgtttcctgattatcaatgtagcatgggaaaaaggctcctcagaacttctgaacctaccttgaatgttcccttcttaaagcaaaagatcttaattttctgttgatagatgtcctggagacatgtctagaagaaccgtttcgagaacagccatattcaattagtttttttagatataaactatctatacatggtgattcgctgatatttagtattttatacatggtcgtatatgtttccttctcctatgtcttaaatattgatcattttgaaaagttttagatccttagagctaactttctggtttacctgttttgatatttttttttcctctttaattgcagaccatccattaaacttcctgttcggctggttttgtatgttttctcacttcttaagtggacacatgaaaaggagggccttgggagtaattatgacacagcacatcagtatgctctgttagcttcatcaacgagaacttttaactgcaatgcagctaagaagcatcttggttacacacctgttgtgacacttgaagtgagtttgttggatagtattttggctttttgcatattcagctgcttagtaccttccttggatttattagctcttgttggatttgtaggatggtattgcatcaacgcttcaatggttctctcgggatcttgagaagtctgatgacacaatcattcaatctactgcagatcagcttcttggttgtgggaaaggttagaaccatctcgctattaacaattataatgcctttttgaagtgttcttggctaagtattcagttgtattgcttgaagtccgcatctcatctagctatggatatgatgatgcatgttcacaaggcttaacctggaaagaatctatctctattttcaacttagatttgtttgcttctagatgtctagaacatgctgaagtatctgcttggttaatttacatcttcttccagtccatgtaatttcatgcgagttccaactttatttcatgcacatataaacaaactcaaagcgaatctggtcaatgcaagcttttaatattaatctctttaaactgacttagcttttcatctctatgttctcatgcagttgcagacatcttgctgtggagaaatgagaagaaaaccttcgtttcttttcttgtcctaaacttgttttattactggttcttcttttctggaaacacatttacttcatctgcagcccaacttctgtttatatttgctgttgctctctatggagtctcttttgtgccgtcaaagatgtaagtattggttccagaactttaccattatagaaggcagtgaaaataagttgtgataccaaaattgtcctatcaaaggatgatgcacccatgtatatatatttcacctttgaaatctatatgcaactaagtgacagattgatttattttgacagtttcgggtttcaagtcaacaaaatacccccatggagatttgagatctccgaatccgctgtgagagatcttagtagtgatatcgtagttgtctggaatcaaggagttcgcagttttaaatccttaagcagtggaggagactggatcaagttcttcaaggtacaattctactctttatgctcaccaaacatgaaaaatatctcattgctctcgtttcctaaaacaaaacataaaaacagattgcaggatcactgtatctcctcaaactgattgtatcccgttcattggcagcatttcttttcacaggtactcgaacaaagcttttgttttcacacttcataaacatgattaacaacttcataaacatgattaacaacttctttatccataacattttctctacgctttgcttggacagttatgtcgttctcattcaccggtttcttcatctacgagcaatacgagcttgagctctaccacctagcccggatattcgtcgaatgcttaacatttattaaaaggatggtgatacctgtttctgatgcttcatctaaaccaatgttcatgtgaagcttccaaagtcctccactaaacgaacaccaacaatcccagagactaattgcagttattagatgtcttatgtacaaacattatgctatcaggatgtaatcttcactgagaggggatggatatatgattatttacgaatttgccataactactatcaaaatgcaccgttttgatccggtttccaaaaaaaaaagaaaaaaaaggaaagtatccttatatatcctttaaaagccgccgcttcgatattccctggcctctctttctctcacaatctaatcttcttcgtcttcaaactcaatctagggttctcttctcctctctgtaggtaggattttgaacacccaaatctctcatcgaatttttcttgctcaacgtatcatcgcacaattcgtctctcgttttccgtcacgtggataatcgaaatctcataatcccaaaggtaaaacaatcaattctgggattggaattttggatccataggatcgtcaattgaaacaatcccgatg

SEQ ID NO: 11163 - DNA, 3000 bp, Unknown
  misc_feature (1)..( 3000): cDNA_ID_2717144_gDNA_ID_2214481_Annot_ID_133263 3000 nt of promoter + ATG
ggttttgtggttggtaccagatttagccttttttgagtttattcagattttcactataccgatcttcgtttgtgtgctggaaaattgtttctgtggattcctttgaatgtgtgctagtgttactgattcgatcataaggctcaattactatctgctattgactggtttggtgaaactggcggttgaattatctattataagcttctatgggttttttttttttgtcaactgtgtttagtagtctttgtttggctatcttatagtactattttgtgtcagattatgatttgttgattgaatttcatgaaacagattggaggtcagctttgtgtgtggcctggtttgagacaactttgcctcaggaaaagcttattatacggagtaatgtggttattatccatgccactgaaaacattgcgtggagctagaaaaactcttaagattactcacttttgtagcatttccaacatgccatcctcattaaaaatcgaactggttagtatgcttttcatcttgaatctactggttgaaacaactctgtaacaatctgctgaagatattattaacgatctattttactgagatgtttcaggtgccctgcagtaaggacaactatgcttatctgttgcacgatgaagacaccggaacagttggagtcgttgatccttctgaggctgcacctgttatagaagcattgagcaggaagaattggaatttaacttacattttgaatactcatcatcatgatgatcacattggggggaatgctgaattgaaagaaaggtatggcgcaaaggtaagaggatactattttctgtttaaaactgtatgaccttgtttcttgtgttgtttctgctctttgcgcaagttagccctctttttattttgtttccttggagtgtctcttgcctctgatagctgtgaaacattgagctctacaatacaatggtttggttttgagatgtcgtaaagtattagtcttaccagaaaaaatggttttttggacctttttgttttgcacctttgtcgagttgttcttttcgtttttgcttcttttatatatactcaagtgtttttatgtgacttatgttgccgacaggtgattggatcagctgtagataaagatcggattcctggaattgacatacttctgaaggatagtgataagtggatgtttgctggccatgaggttcggatacttgacactcctggccatacacaaggtttgtagctgccataacctctactgtaaaatactaagaacacatctatacagtcaaatattgccaacgttagaaacctttggtggatcacatattagtatcttatttgtcattctaatttgttatcctcaatacattactgtgtaactgctctccttttttatcgttctagtgtagtacaactagtaattaatgtatacttggtgccatgttttatcacttaactgtacttattctcaagcaggccatattagcttctactttcccgggtcagcgacaatattcacaggagacctgatatatagcttatcctgtggtaccctttcagaaggtacccctgagcaggtaacatcaatttcaaaaagcaatatttcaaccttctcgacccttgcactgttatgattattttcttgtggcaaaaattgtgccaagtgatttgtggttttctaaatcatgtttctttttcaaccttcatatctttttactgttatggttactttcttgtggcaaactgtgctgagtcaaatggtatagactttatggagagatcacttgggacttgggagtactctaataaccgtacattgtagtttctttcacagaagcaaacttattgtgctctgtcctttttaacgagaaaaccttttttgccttatgactcagatgctttcatcactccaaaagatcgtgtctctaccagacgatacaaatatatactgcggccgtgaaaacacagcagtaagttccacgcacataaatactcttaattcacattgttcaactctcttttatatctcctccatgatacagggcaatctcaagtttgctctatccgtagaaccaaagaatgaaactcttcagtcctatgcaactcgagtcgcccatcttcgcagccaggggctcccatcggtaaaacctcttatctcttccctatctcctctttctctctaaacctctctctagatttcatttacttacggatttgttgtctgtagattccaacgactgtcaaggttgagaaagcgtgtaacccattcctcagaatatcgagcaaagatatccgaaaatctttaagcattccagactcagcaaccgaagctgaagcattgcgtcgtatacagagagccagagatcgtttctgaaaacttgggtatattttcttatttgtatagaaaaatttgcaagtcaatcatcagctgcaaagatcaatattttatatgttttgggctttcttcagttatcatttgaagttgtgtattcaacacaaaaaaatctaaatatttagtttaaactcaattattaaattatgagattttcaagtgtaatgaatgcttcaacatacatacacaagtgtatagatagatacggtttagtttctctctacaagtgcttaccaaatttctaacaatggaaatcatatgtttggtggattgatggaattggctcaccaaacgtgaaaacgcaaccgtgcgtctacgatttaatattagctttactagatttgtttgtaaccaaggaataattatacagataatttacataaattaagtcaaatccatagatttatggcaaaaaagtgtgaatattaaattataattacacagccgaagaataaaggaaaacgctaaaaggttgcgcgagtggagagtctgcccgccaagcaacccctagtattcagctttttgtgcactgatccaactcgactcggcctttttctctgagttgactcgaccgagaaaaggcgatagagctggggtttaattcggcgataacaatg

SEQ ID NO: 11164 - DNA, 3000 bp, Unknown
  misc_feature (1)..( 3000): cDNA_ID_1408073_gDNA_ID_2214481_Annot_ID_183359 3000 nt of promoter + ATG
agtatagggtctgagagattcatgttttcctcttctttttcaggctgtaaacttacggacagcagccattcctcgtcctcaggtaccatctgaattagaaaaaaactatctacaaaccattgtttctcgttacgttttatacctcaataattttgtattcgtgttttctagtatctttcaagtagtcaaagagatgccttagctgaaatacaagatgttcttcgaacagtatgtcatgcacacaagttgcccttagctcttgcctggattccttgtagaaaggatcaatctataagggtttctggacaaaaatctggtgaaaattgtatactttgcatagaggagacagcttgttatgtgaacgatatggagatggaaggctttgtgcacgcatgtttggagcattgtctaagagaaaaagaaggaattgttggtaaagctttcatatccaaccagccgttcttttcttctgatgtgaaggcatatgacatcagtgaataccctattgttcagcatgctcgaaagtacggtctgaatgctgctgtcgctataaaactgaggagcacttacactggtgaagatgattacatacttgaactgttcttgcctgtaagtatgaaaggaagcttggaacaacaacttctattagacagcctttcgggtacaatgcagagaatttgtcgaactttgagaactgtttcagaagtggggtcaactaaaaaagaagggactaaacctggatttcggagtagtgatatgtctaatttcccgcagacaacgtcttcagaaaattttcagacaatatcattggattccgagtttaactctactagaagcatgttttcgggtatgtcctctgataaagaaaacagtatcacagtatctcaaggcactttggagcaggtatgtgatttatgcaatttggttattctgtaaattttgtgaaacagttcgttaaactgaacactgatatttttccttacaacttttcataggatgtgagcaaagcaagaacaccagagaagaagaaaagcactacagagaaaaatgtgagcttaagcgctctccaacaacacttctctgggagtctaaaggatgctgcaaaaagccttggtggtgagacttccgcatatttccaagcatgggtttatttttgttagcacacaaactatctgaccctcgacttggattttcttctgcagtttgtccaactacattgaaacggatatgcaggcaacatgggatcatgaggtggccatctcgtaagattaacaaagtgaacaggtcactaaggaaaatacagacggtactggactcggtccaaggtgtagaaggaggactaaagttcgactcagcaactggcgaattcattgcagttagaccttttattcaagaaattgatacccaaaagggtctgtcgtctcttgataatgatgcacatgcaagaagaagtcaggaggatatgcctgacgatacttcattcaagctccaggaagctaaatctgtcgacaatgccattaagttagaggaggatacaaccatgaatcaagcaagaccaggtaagaacttctctatccataaaccatagatggagcgattagaatcttaatccattttcagtttttgcaggatcattcatggaggttaatgctagtggtcagccatgggcttggatggccaaagagtctggcttgaatggcagtgaaggaataaagagcgtttgcaacttaagctctgtggaaatttcagatggaatggatccaacaatccgatgcagtggcagtattgttgaacctaaccaatccatgtcatgcagcatatcagattcatcaaatggctcaggcgcagttctgcgtggaagctcatctacttccatggaagattggaaccaaatgagaacccacaacagtaatagcagcgagagtggatcaacaacgctgatcgtaaaggccagttatagagaagacactgtacgtttcaagttcgagccatcagttgggtgtcctcagctctacaaagaagttggaaaacgttttaaactgcaggacgggtcgtttcagctgaagtacttggatgatgaagaagaatgggtgatgctggttacagattctgatctccaagaatgtttggagatattacatggtatgggaaaacactcggtgaagtttctcgttcgtgatttgtctgcccctctaggtagttctggtggcagtaatggttatcttggaacaggcttatgacgtcgtaagacatagacacacacagttatgtattcccagtgaaagaatgttgtttatttctctagatattagtatgcttataaataggcatgaaggagaaagacaattttggtatagtggagttcagcagaaaatgtatatgttttttcgttttatatgaatcagagaataaaagttggatgttatatctacgttgctaatgttgtacctgctcacccatctttcatataagaaaagagaacacttttagttatccctgtgatgcagaatcgtattctttgttatctctccattcctgtggaaaccaacaaagtcaactaaatttcggtttaattggttggtttttaagtcaacgaggacttgattttagttgggcttgggcctataattgtgttcatcattgggttttttcccccttatcagtttaacgtccatatccatatctttttctttttttaacggcaaagttcatatccatatcttatgatgtgcctaaaagagggagaagatgcgaagacagaattttcatatttgaaagggttcgatatcgatattgggaaacgaatcaaggtcaaaaaactcagtctaatagttgaaatttaaaaattttattaattcaatccgattggtttcgttttgttatggttcggttctatatcatcaaaccaatcggtttggtcctaaagataattataaatattcaccaacaccagtgttaaacacatatcaacaaacctaaagttagataaacaaagagaaa

SEQ ID NO: 11165 - DNA, 3000 bp, Unknown
  misc_feature (1)..( 3000): cDNA_ID_1010640_gDNA_ID_2214481_Annot_ID_183351 3000 nt of promoter + ATG
aatttcgatctcttgagacaccaaaatcgctaaagaaaacttagtttacttaatttcctttgtgtttctttcttatacagctcacagacaacttagaccttttcagaaaaatccgggagaacatcaaaagccttctcaaagagtaagtaacataatcatcatttctgtaaaatgtcatcatgtataaaatcaagttatatcataattttatttttgatattacagtttgaatgagaatgtgtcggagacatggaagaatatgccatcatcattgccggagaagttgaacgatgaactatttcttggcctagataaagcaatcccatctacatcaaatctaccatgaatgattctatcttagctgaaaagcattagcttagaacacatgttttagacttatgtaatctgttgatttattaatcaaagacttttttttttctttttttctgggtttaacatattgaacaaaaaaatatatcaaactttctcttgttcagacaaaaaagaatcattttttttacaatgagaactatttcacaatggagtctaaagaactgaactttgctccaattgagtgaagatgattaaaattagagattgtctagatgaaatggtgaagttcacactcgattactgtgtagaattcgatatagggcttaccggggagttctgctccggccttctgtgcggcgaatcagttcttcacgacggtgaacgaatcgaatcgtcttcctacgctttgctacaccggttttcaggtgttcctgattatcccttgtacaaggttctagctttaggtctgctgaaatcaattgattctggttctttctgtggaacctttgagaaaatttcgttggggaaggaagtaatccggttgaaggagaaagaagatgagtggagcaagctgataaatcaaaagggttctgagttagtcaatgtgagtgagtcatagtcgattatacttcaaaaggcaacattggtactggggtaatcagagtcatcgatgcttagcttttggtttgcttttgattgttaaaagttttgttcactttgcaatattctaacaggccttgaaggatgtattttccgagcttcaagttcaagagcccttattctccctcatgaaaggttaaaacttcctctttttagcttggcaatgtcaatatcaagtggtaagagttcttgatcagatttttgggttgcttaatttaaatggatatattagatggcatcaaaacagttgaagcaaggtgttttgaagaagagtatgataggtaggagaagtgaaaagttattgagctggattacttctgtgtctcttgtgttcacaaatgttgtttggtttcctcagaattcggagaggaggttcaatggttatgataaataaatgtctaatgtttgaagttctggtgagatatatttgccgacatcatgcttttgtgttcctgcaaacgatttcttgtgattgattctcttaaatgttgatatataggaacttcaccaatatgcatccttttacgagctgttgaaagccgagagttcagagaaagtgtttcctggcactaaaacagtggaagaaggtaagcttttttctttgtctgatccttagccattaacttctgtttcaaagatttcaaatttttttaggtatgcaaatgtttaggaagttatatgatacggatcaagagaatttcaatggtgttgtggcaatccatcttagtaaatcagttgctcagccttgtgttgctttggctcacatactgtctgtgagttcaagtttttctcagccttctccttgtgatttatgattcttattattcaatgtttcttacaaaaacatcatttaaatggcagggcttgagttacactggcgtgcaaaaccttctcggtctatctcacacaactggatccatttttcatgctctgcctcctcctagatcgatgctactctcttcattcatgcttccatataagccaaaggtaccacaaaaactaagatatagttcgagagacatcgtagtgaatcttttggggaatggttaagctgtgttgtgtgagatcaaatttagaatctttcttttttcctattgttgagataaaaggttgtagattgagccatggagctagagcattagccaagcatgttgatcgaagtagcgatggattttggggtgttcttcagggaactggtaagtaacaaatttttgcaggacactgatgcatttccataattgagtcttcctcttccttttctcagattcagataaaaatgagcgtgcaatggacataatcaatcggttcattggcaattgttgttggatgaacatacatatcgttccaccacatggtgaagtgttcgagataagagtagctcaaggctatggagcacgttggtctcgagatggaaccaaagtatgtatattttgagacttgaagtatgtatctttcagacgtgtctgatcatcaattgttttgttgctgtttatttttattggcagttcattggatttcttgagccttacatggaggatggtcactccatggcctggaagcattaagaccgcacctgtaaacatctctgtgtctttaggactttgtgaactttctcttgtagttgaatcgttttttctttcaacaagtgtaaatttgtaacgcttcttttcttgtgacaaaaaaaatcaaattttttttttttctaagaaggattttgtggttgatcttgttatgattagggtatgaaaagaaaatatgaggaccaaagtgttaagacaaactgtaaattgggcaaaactgtgaagggacattaaagcgatatatgattgggccttaaagcccattgtttgataaatcgtccagagggtaaatatggaatttcaggtttacgaattagggcttcttgatacaaagtttttaagagatctctttatatcctcgcgacggcgaattcgctcgactctctctgtggacggcggctagtttcaaccaacagattcgagaatg

SEQ ID NO: 11166 - DNA, 3000 bp, Unknown
  misc_feature (1)..( 3000): cDNA_ID_2990399_gDNA_ID_2214481_Annot_ID_183347 3000 nt of promoter + ATG
tatatttgaaaaatgggtatgaagttaggtcctatacaaataatacaagggggggttcgttgtcaataagataggcacaactcttactgaactgaaataaactttagtattgaacaaactgatttttgttttggtttatttatctttcagtagaggtaatgattatataaaagattctcaacaaactaaaatatacacatcatatttaatatcatcgagatattatcaactaatgtataaaagtttcaatttatgatagttgatattaggatttctcataaataaacaatgttgataataatctaattaatgcttaaacaatgtttacttacggatcttaacattataactttaataaaatagtagagtaaactataaaagcaacaattaattgaattaactttaaaaatatagcaagattttagaaccacaacaatagtttgatactaaataagtaaacttctagagaggtaagcagatatacccaaatagtatagaggtaaacaaaactttggatatccaagaacctcgcgtcggaaacaagtggcatctggacgtgctgaacttggaattcgaattcccaagatcatgatgcgtatggcttggttttaacggaagtggggccaaattttcaacataagaagatataacacagatgttagaggagagacaacgaatctcatctgttcctgaataatatttgaatagcctcttgtgattatcgtagaagagaagattcccttgcttagaaacccacacaggagtgaaccaccttttctgccatggccaggaaaaaccaactccatgggctaaacttatggagtaactcttgctccacgagtaacccttgctccatccttttccttctatatccatgctccagatctctagtatccattcaggcccaacgttggtggtcatggccatggctagacggtcctcaaggttcactaactgggtttcctgcgtgacccacgtagccggaaggtggtggacaccatgatagctttcttcgtgaagatccatagctaatattatgtaacccgcactaatttgtaaccagtagattgatccattcacacacaccgatttacttcccggaagcatattatgaggaggtgacctcagtttgctccatacaccagtttcaatatcaagaataccaaattcataacaatcatgaaaacacatcctcactattttatacctgcccgtaacgttgtctctaccgaatcccaatagccaattttcctgcggtcctgcaagttgtaaatatttttaatttctttcactgcaagaaacaaacaactataatgttagattttaccttttactggacctgggccgggagggaatcgccggagttgtccagcggatgggttcaaaacgttaaaccaaccaggttcggtgatgcagagtaaaccgtcgcaagtcatcgagggttgcgcggcgtcgcagtgtagataaacgatctcttcgtccccttcgaaacgagactcagggaagatactcggccgcataaagtagttgcagttgtaagcagctaggattttccggtggtgcttttgaagattcccgcgcctctccacgaacaacttggattccaggattgatctccattgtcttgatacggttttgaatttcaggattgatttcaaaggcaatcgaaggaaaatatcttccaatagctcgggaactatgtagatcgagttagtgttttctcttttttcctccatcttttatgttttgtctgtcgtgctagatttctgacttctgataaaccctttaaatatcgacggctttcagttgcgtgtctgaaaaccggttttggtttggtaattttattcaattactaatttaattgagaataagcacatgtcggtcaccaatgatacttgttaatgcgttcgatttttttaatctaaagttctgaattaagaaaaacttaattacctttaggaaaatacacactattatgtcctttttgttagataaaacatgtctctcatgtaaagaaaaatgcaagaaaggtcgaaggaatgctttgaagtttttttaaaaacatatgaattgtcaaaaagatgtattaaatgttaaccaactacataagccaatcatatatttgaaagtgaggttctatacaataaatacaaatggttcgttgtcaataagatagagatatgcacaattcttaccgaactattttggtattgaactctatatattttcttcaactttcaattgagataaagaaaaaagataatgattataaaagaatctcaacaaactaaatatacacatcccagaatctagatattatcaactaatgttaaaagtttcaatttatgataactgatataattaatgcttttttttttcttacttgataagataaattttatatattctataaaaacccaaatgatcaaggcaagcgtttaatctaaattgaccttaaccaaatgagcaaatattgaccaaaggaaatcttttctatttttttgcgtttatcctaaaggaaatgtttgtttcatggcttcaaaagggaatataatttgagcaaaacaagtaaaaaagtaacaaattaccgttacagcaaaaacaactttaataaataataacagagcatatggtaacaactttattacccaattcaaataaagaaaataataaaccgtggtcaaatatttgtatgaattatatgagatagcacggaacaatttattgatgggatttagtagttgagctaaataaataaaaagcaaaaacaaataaaataaaacaaaatactaaagaaaaaaaaagagtaaaagctgtctctttagctctgacgttgtttcctgtcgaagtcgcagactcgtcatcacagctcaggcgagtaattctgagtttcttctatctacgcgcaatatctctcaaaggaggcctcttcaaaggtaccacaatcatatcctctcgtttctatctgaagaatcagagagaagagatatatagaggatg

SEQ ID NO: 11167 - DNA, 3000 bp, Unknown; identical to SEQ ID NO: 11163
  misc_feature (1)..( 3000): cDNA_ID_3039078_gDNA_ID_2214481_Annot_ID_183346 3000 nt of promoter + ATG

SEQ ID NO: 11168 - DNA, 3000 bp, Unknown
  misc_feature (1)..( 3000): cDNA_ID_3039086_gDNA_ID_2214481_Annot_ID_183344 3000 nt of promoter + ATG
tgtaatatatctattaaattaacacacaccaaaatcatattcataggattgggttcatgcctagtccaaatgggtggaggagaaaagcatgattcatgcactcgtacccattttttcttttaaaactattataaatggtatgtttatttttttgtactaaaaaaaggatgcttttaaaaatcctttaaaaattctaaacttagaggatgttattggtttatgattttaaaagagtttttgtgacttaaaagtgtcatgtaaaatatgttgttattcaatcataatttttaaaagtttgtaaaagttttgtgttattcaattaaaacaaaaaaatctctcaaaattcaattatcacagattaaacatcattcattattctcagaattcatattgtttttaaaaatttcataacaaaaaaactacacattttacgaactttatatttgtatatctacgtatatttttttgttagccaattttcatagaccaacattctttatcaaattgccacataattaggcacaggcttccgtctacgaagggctttgatgttcttacgaaattattcaaatcacattcattttatacagcctttttaaacatatttattttagtatttacatcaaaacatattgaacattcccgtctacttcatccttttaaaatcacattcatgttatacagccttctttatctaaacgacggaggaaaacaaaaaaacgaagatgcgcttttggttgcatctgtaggactggttggttcgaacacttgttaccaaagaacaaagcgtctctcttggtcaggcaagttttagctctcaaataaccaccaacgcaaaatgatcgcagtcaagactctttgactcttatcttttgtattaaagataaatgaacatgtgataagaataataacagattagatgttgcatgtaatactactagactagatctacagaaggatcaaagaaagtagtaccaaagtagacatcaataatgaaattgcaagcaaaacagaataaatgttgtctcctcgattgcaagcaaaacagaataattattgcaaattctcccctcgatcatcttgtgttagatatctgtgccgctgaagacacttctctcgaaaggattcgataaaaatcacagatacacatctcccaaactaacaacacagcacaaccaagcaatgcaaaagcttttcaatgatagaatccagctcccatatatcagcttctttaaagatatcaccggtaacaagtttgttacagttggacattcttttctagaatttccaggaaaaccaacatcctagtatcacacaaaagaaaactcaagttcatatataccatgaaaaaggtagatctgctgtttcttataaaaccaacatacacccgtgtctgaattaataccatctcaaaaacccaactactctaaaaccatcattatcgcatcaaattcactacaagaaaaaacaaaacaaaaccaaagaatccagctcccatatatatctaaatatgctataaaacatcaattgtaacagttttgttacagttgtatcaaatgagtgagtccattgttttccaatatttccaggcatatacaagaacaagaaaaccaacattatttcagggactaaaaatcattccagggctaaaagaagtgctctttcaaactcaagttcagataaatcatttgtatgtcttaaaagacaaaactgtagctgcttttaatttagaggaagacatgagaagacatcagatcaagactgcctccaatcgtgataagaagctaataaataatgtaggcaccatgcaaaaggttgctctgctgtttcttataaacccaacaagcacccgtgtctgacttaatgccatctcaagaacccaacaactactctaaaaccatcattatcgcatccttatcaccacaagaaaaacaaatcaaaaccaaagaatccaaataatattatgtcgccaagagtattgaatcatgaaactatagagaaataagtttcatgggtcttcctctggcatttgatctaggctccaagcggcagtcaggtcaccattaaaagtggcgcctgctgttgactcgataaaaatggagcctttatctcgtaaaacaaaaacattcgaaaacgcacagatctataacaagtttcaaacgaaacgatacatgattgatgcggagaaagagagagaatcgagattatatagtagtgactgtggggaggagaagcaaaaccctagcattttgaactgtgagaataacgggcttttaaactgtctttattaagcccaatcactcattacttgggcccatcatagtcatctatatatattcagaaacgatggcttgttgaaccaatctcacaagtcacaagtcaaaatgacgtagttttgacttcgagcgatgtatttgcatatttggtaaggttttgcaattgtttataagaaaatcagaaatttttgagagatccaactgaaaaaaattaacatctatattcattcatacccataatggttatcacaaatattattatttattatcaaaattcatatatatgttaataaaagttgggttcataacataaaaaacactttcactaagtttatatttgtatctacgtattttttttgtttttgttaaccaaatttcatacacccacactctgtgtagaccaaaaacaagtcctcaaatttcatatataggcctgcctaaaggccaaaaaagttttgttgcccatttacaaacaaaaattccaaaaatgttaaaattttgagccatcaatttttctatttctaaacgtatataattaacaataaaagcgatattcaaataccatccacaagaaacttttaacaagttgtcttaataagtaatttactatacttggaagcttggcttaacatataaatacactaatagttaaaccatattcaacagccagaatattcaaaggaaaaagaaaaagaaaaaaaaaatacattactagaagaaaaaa

SEQ ID NO: 11169 - DNA, 3000 bp, Unknown
  misc_feature (1)..( 3000): cDNA_ID_2707826_gDNA_ID_2214481_Annot_ID_183332 3000 nt of promoter + ATG
catactaatgagctgcgtccctactcaaagcgtaacgtcactttgtcgatacgaattaagaacgtagaatgtcatgatctcgtacatcaatacatcatgttcattggagtattcgctatgctcgagcaatagtcttttaatgctgagaagatcatgattttctactcgaatgctaacccagccaaaccggtttatctcgtctcattatccatatgctgaaatataaatttatatacaataagaataagtttcatatgtatattctcaaacattacagtataatgtgatctagatcctaatttcaatatgaagatatatctagtttagatagcatcaaaccattaacagttggattacagaatcaattttaacgatacaacaccttttgcacatgtatttatttccttgaaaacgtttaacttgtcttctcaatgacactctagttttctagaaaaaaattcattgctctttttcctctagaaaatttgtctctccagggcatgtatttaattttcttgctcttttttctcacaagtatgaatccctactatcataaacatatataatctctgttagttcctgaagaagtaagattaagaacattgagcttataaggtcatctcgtacatatggtgaaagcatccataaccataaatattatagcatgctctaaaaatacgaatatcctttgaaagaacaaattgaatgaatgagcaatcgacacaggagcaaagtgaatcaactttttagaaaatgtccaagctaactagaaaatgctaatccgtaattttgataatatcacaaccagttcttttggcccctagtcaaaatctgtaaacagagagaaaagtttgaagcttcgtacttgctttgcaagttacatgccaagagggtaaaacacatagagaagaatccacctacttgaattttaatgatctataatactgataaccaactagaactagagtggcaaacacaaaccgaaaagtgatgatctccttgaataaccctgcctccggatgcttcgaaaacaatccgcaactagatgtcctgattttgtaatcccgatgatcatgtcctgagtccaaacgaagtggtaccaaatcctcgagataaggagatataacagaaatatctgaggagagacagcaaatctcatttgtctcggtattatatttaaacaaccgcttgtgattgtcacaaaagacaagattccctagcttagaaaccgtcaacaccgtgaaccaactagactcccatgggtggttaataatgatactggctaaagttatggagtaagtcttgctccatatttctttgtctacatccatcaggctcagtatctctagctcccattctggcgcaccgtttgttttagttatggctagacggtcatcaaggttcaccatctgggcactcatggtgcaacacgtagatggaacggaaacattgtggaactctagtgtgtgaagatccaaggctaggattccgaaacgctaaacattttttaaccagtagattgacccattcacacacactgacttccttcccacgtcaatatcgttaggaggtggattcagttcactccattccccagtttcaacatcaagaacctcgcatttttccacaggactaaaacacatcctcaccactttatagctaccattaaatttgtctctaccaaatcccatctcccaattccccggaaaggaagtgaggtatagttcgtctgcaatttcacgaaaaaatcagacaaaaacaatccaaattttaactgactctttaataaaccattaaacagatattacctctgaactgaaaacgaatacgatcagagggcacgtgatgattagggctacaaggaaatctccggagttgtctggtcgatgggttcaaaacgttgatccaacctggtgctgggatacacaccaaaccctcacatgtcagagagggtcgtgtggcgtcaatatcgcagtgtaaatagaccatctggatctcttcctcaccttcgaatcccaactcagtccggtctccaacagccagaattttctccttcttctcaacgttcaaacgcctctccgcgaaactcttcgattccaggattgatctccattgttttgagacggttttgaatctgaggattgattttaaaggcaatccaaggaaaatttcttcaagtagatcgggaactacgtaaatcatcatcgggattagggtctttttcttcttttctctacagaactaaaaactcatcgggattagggtcttttttatacacaattttttttttttctagttttaacggaaacccccacaaatatttcattattactatttagcccagtcaatttccaaaagattaatttaggtcacctctctctctctctttccctatctcttggcctcgtgctcgtgcagctgaagatccctgctctgattcgtcaaatccagtaagctaaatttcctcttaattttctggtctttaattactttatactccatatgaataatttcttcaatcgaatttttcatctttgggtcttaatttttttctcaactgattcagctaacattagtgattagctatttgctggatttcttcgattgcttgtcgtctctatgtttcaattgtattatgattacgacacattcttgttctgatcattgtcgatgaaaagggtaaactttgaacaatcttctattacataaaattgaaactttttccaacatttctgagattttccaaatcaaattctcggagttgaattgaactctcaagtagcttacataatattcaaacttttgattatctaatcaaatctgtaattcttccttatctatgtggcagtggaagatgaggatgatccaaccacaaagaacagcaacaacacagatgattttgctatagagcctcgtgaagggattatatttgaatccgaggatgcagctaagatgttctatgatgattactctagacgattagggtttgtaatgcgtgta

SEQ ID NO: 11170 - DNA, 3000 bp, Unknown
  misc_feature (1)..( 3000): cDNA_ID_2705471_gDNA_ID_2214481_Annot_ID_133264 3000 nt of promoter + ATG
gtgattatcgtagaagagaagattcccttgcttagaaacccacacaggagtgaaccaccttttctgccatggccaggaaaaaccaactccatgggctaaacttatggagtaactcttgctccacgagtaacccttgctccatccttttccttctatatccatgctccagatctctagtatccattcaggcccaacgttggtggtcatggccatggctagacggtcctcaaggttcactaactgggtttcctgcgtgacccacgtagccggaaggtggtggacaccatgatagctttcttcgtgaagatccatagctaatattatgtaacccgcactaatttgtaaccagtagattgatccattcacacacaccgatttacttcccggaagcatattatgaggaggtgacctcagtttgctccatacaccagtttcaatatcaagaataccaaattcataacaatcatgaaaacacatcctcactattttatacctgcccgtaacgttgtctctaccgaatcccaatagccaattttcctgcggtcctgcaagttgtaaatatttttaatttctttcactgcaagaaacaaacaactataatgttagattttaccttttactggacctgggccgggagggaatcgccggagttgtccagcggatgggttcaaaacgttaaaccaaccaggttcggtgatgcagagtaaaccgtcgcaagtcatcgagggttgcgcggcgtcgcagtgtagataaacgatctcttcgtccccttcgaaacgagactcagggaagatactcggccgcataaagtagttgcagttgtaagcagctaggattttccggtggtgcttttgaagattcccgcgcctctccacgaacaacttggattccaggattgatctccattgtcttgatacggttttgaatttcaggattgatttcaaaggcaatcgaaggaaaatatcttccaatagctcgggaactatgtagatcgagttagtgttttctcttttttcctccatcttttatgttttgtctgtcgtgctagatttctgacttctgataaaccctttaaatatcgacggctttcagttgcgtgtctgaaaaccggttttggtttggtaattttattcaattactaatttaattgagaataagcacatgtcggtcaccaatgatacttgttaatgcgttcgatttttttaatctaaagttctgaattaagaaaaacttaattacctttaggaaaatacacactattatgtcctttttgttagataaaacatgtctctcatgtaaagaaaaatgcaagaaaggtcgaaggaatgctttgaagtttttttaaaaacatatgaattgtcaaaaagatgtattaaatgttaaccaactacataagccaatcatatatttgaaagtgaggttctatacaataaatacaaatggttcgttgtcaataagatagagatatgcacaattcttaccgaactattttggtattgaactctatatattttcttcaactttcaattgagataaagaaaaaagataatgattataaaagaatctcaacaaactaaatatacacatcccagaatctagatattatcaactaatgttaaaagtttcaatttatgataactgatataattaatgcttttttttttcttacttgataagataaattttatatattctataaaaacccaaatgatcaaggcaagcgtttaatctaaattgaccttaaccaaatgagcaaatattgaccaaaggaaatcttttctatttttttgcgtttatcctaaaggaaatgtttgtttcatggcttcaaaagggaatataatttgagcaaaacaagtaaaaaagtaacaaattaccgttacagcaaaaacaactttaataaataataacagagcatatggtaacaactttattacccaattcaaataaagaaaataataaaccgtggtcaaatatttgtatgaattatatgagatagcacggaacaatttattgatgggatttagtagttgagctaaataaataaaaagcaaaaacaaataaaataaaacaaaatactaaagaaaaaaaaagagtaaaagctgtctctttagctctgacgttgtttcctgtcgaagtcgcagactcgtcatcacagctcaggcgagtaattctgagtttcttctatctacgcgcaatatctctcaaaggaggcctcttcaaaggtaccacaatcatatcctctcgtttctatctgaagaatcagagagaagagatatatagaggatgcctgtgatctccaaagcttcatctaccaccaccaattcatcgattccttcgtgttctagggtttaatctctcttcctcttttttactcttctctttgattcagtctttgcttttgataattccgatctggttttgtggttggtaccagatttagccttttttgagtttattcagattttcactataccgatcttcgtttgtgtgctggaaaattgtttctgtggattcctttgaatgtgtgctagtgttactgattcgatcataaggctcaattactatctgctattgactggtttggtgaaactggcggttgaattatctattataagcttctatgggttttttttttttgtcaactgtgtttagtagtctttgtttggctatcttatagtactattttgtgtcagattatgatttgttgattgaatttcatgaaacagattggaggtcagctttgtgtgtggcctggtttgagacaactttgcctcaggaaaagcttattatacggagtaatgtggttattatccatgccactgaaaacattgcgtggagctagaaaaactcttaagattactcacttttgtagcatttccaacatgccatcctcattaaaaatcgaactggttagtatgcttttcatcttgaatctactggttgaaacaactctgtaacaatctgctgaagatattattaacgatctattttactgagatg

SEQ ID NO: 11171 - DNA, 3000 bp, Unknown; identical to SEQ ID NO: 11165
  misc_feature (1)..( 3000): cDNA_ID_1010640_gDNA_ID_2214481_Annot_ID_133267 3000 nt of promoter + ATG

SEQ ID NO: 11172 - DNA, 3000 bp, Unknown; identical to SEQ ID NO: 11164
  misc_feature (1)..( 3000): cDNA_ID_1408073_gDNA_ID_2214481_Annot_ID_133272 3000 nt of promoter + ATG

SEQ ID NO: 11173 - DNA, 1146 bp, Unknown
  misc_feature (1)..( 1146): cDNA_ID_2703868_gDNA_ID_2214482_Annot_ID_133278 3000 nt of promoter + ATG
tgaaaattttgactcaaatgagttgatgggtcaaatgggttgatgagtcaattggtttgatgagtaaaatgagttgggttgtaatggttaatggtttcaatggtttacccaattaacccatcaaattttgtaaaattgaattaaaccaactaaaatctctaaaccaatgccaatttaagtttaaccaacacatctaaaccaatttaataaaattaatatttttccaaatttcttaaatatacaagcgatgcaattgagaaaaaataaactcgtaatttttccaccaaaaaacataaacccgtgatttttccgccaaaaacgtaaacccgtgattttcccgccaaaaacgtaaatccataattttcccgccaaaaacgtaaacccgtaattttcccgccaaaaatgtaaccccgtgattttcccgccaaaaacgtaaacccgtaatttttccgccaaaaacgcaaacccgtgattttcccgccaaaaacgtaaacccgtgattttcccgccaaaaacgtaaacccgagattttcccgccaaaaacgtaaacccgtgattttcccgccaaaaacgtaaacccgagattttcccgccaaaaacgtaaatccgttattttttcgcccaaaacgtaaacccatcattttccggccaaaaacgtaaaaacctataattttcccgccaaaaacgtaaatccgtgattttcggtaccaaaaacgtaaacctgtaaaaagtggaatccgtaaatatcttaagtttgatgataatgaattaataatgataattatttattatttttttataataataattaattaaattattacttaaatgggttaacccatttaacgactcaacccatcaaattaaatgagttatgggttgactcaacccatttagcaaaatgagttgggtcaacccataactcatttaattctaaactcatttgattatgagttgagttgagttgggttacccattttgacacccctaactgcagtatatgattacgatgccacgtaatattgacgtcgttaattatctattcttctctcacaaatcaatcatcaattttcagttttcattaccatttcctcttcaccggggaaaattctgttagtttctttctccggtagttgaaagaaaatg

SEQ ID NO: 11174 - DNA, 3000 bp, Unknown
  misc_feature (1)..( 3000): cDNA_ID_2701875_gDNA_ID_2214482_Annot_ID_133280 3000 nt of promoter + ATG
atatgtgtgtattaatggcccagtgaaacagagccaatcacgaaactttgcttgtggaccactcttctatctttttaagggtgagaaacaggaattttatttactataggcccgccactagatgtaacctcctctttttgccagatcaaccaataaacatcttagtagtaagctcttcgctgtttgatatagtcctcagggatcgtatgcaatgaaatatcaaagttaaacaaaagttagattttagggagaaaaagcttatttaccacacatgttaaacaatttgaacccatttaagggtacatatgggaaatgttgtcaaacactactatagtggtgagatgcaaattataatactagaatatctcatgagaaatttgatgttctaaatataacataaaatggaatctaggcatgctctcttctaactaggcagtgtactagtctctcagaaatgatagcagaacactattatcagtaaagtgaatgacacaaaaacagcaaagatatcagtgtgtaacagaagatacacaatgatcattaagactttagattggaacaaatgaaacgtacatatcatgttataaaaatttcaaccagaatatgtcatggtgagtaaatagctacagattcctgaaattccttttcatgagtgctcgtaagggttttgttctattttcatgtgctcattgtgtttacttcctgtcacaactttcgatcgaaaacattaacaaaaattaggaaaggctcatacccataccaactatttgcttcaaacaattcgatgggtgtgattactttcatggatttatctatcatatatgttgtatactgttacatccttttcagaaatagaacaagccacaagaagataaagaagcataacagattaaagctgtagcttggttggccattacagaaggagtttcttcaactcctttattcttaatgtgtaaacagagaacagctcaacaattttgtcttcaggttcccaagagaagacgggagattcggctaggcttattaacgtaagaagagattcagacgacgttgggacaatcacaatgatcaaattccattctccgtcatctgaatcatcatacttcgcattcctctgttttgcgtacaatttacgttactcaattaattaattggaccggtttaagtcgattgttttattggcctttgttggttttggcccaacagaagaatgttttatgggtttagtttaaagcccatttggttaagtatgttagtttagttgaggcaagctgcaagtaaagtagttggtaaactctaaagctaggtttttaacctttgcttctaatcttagactacaaaccctaaaccattggccgcgtaaaaaaccattcctcgacttccgccgtcaatttctcctggataattgttctggtacgcgaataatacatagtatagtgccctaacataacatcgaccaaatcacattcaggttttatatatttggtttgcaaactgcaatggctacacaaagcaacaaagaggctttcttaggtggatttaagaaactcttgaatgaacaatggcaagccgatgtacgtctcaaggcaggagacagtgatgagactacatctattttcgcccacaagcttgtcttggtttctctacttcctcttctcttttatttatcatcatccaattatagggaaaagttacttattgtgtagcaatgtttttgagagtgtctcttacttgggatgtttttcattgttgacatgaatggaatattgaataggtggcaagatcagaggtgtttaagaagatattggaatcagacgagttcaaggcttcatctaaacagatggagacagtcaccctctcggagatgaaacacgaagaattggaggcttttgtggagttcatctatagggttgatggctccatttgttctgctagtctcaagaaacatgctcgttcactctttcatgcagccgacaaatatgagattccgcatctaagagacctatgcagaaacgagcttatatcatctttgaattcgtcgaatgctcttagcatccttgagctcgcccaaatcccttttgacaaagccctcaatgatcccgccttcactactatcataaccaatataagtacgattgctagtggtgatgagttcaagctgtttgtcgccaatcacccaaatcttgccgtggatataatgaaggcttctataactagactaagtactagcagaaaaatctgtggttactgtaatcgctactactaaaagaaccatagcgttgcttttgttgtttcctttctcattttttctttgttaaattgtttcatctctttttgataaatggttttatcattttcaagtgatttgacataattgtcacaatatcgacttcgcggatatcaccatttgcatagtatccatagtttgccaatttgtgtctaaattgtgccgcctctcagaaagattaatgagcattgggataagaaaagaaaaaaagcaaataatcaatcttgacactaagttttgatttgtttgatctcttagttcttcttatgtccaaaaggaaataaacagagagattgttaaaaagtttaaagctcaatttgagcaagcttttttttttttttttttcgtcgcaagcttttttagtgcattcctatcattctttcctgactataagtaaggttcctattttataaaatcttagctagagtcttttagattcttgtttagtgtgccatacacagaagtgcaagagacagtaagaagaggtaaacaaaccataacacaaaacttaaaattctgtattcgtctgataaagtctcctattaatgagtgcaaattaaattccgagttctaatgtattaatgtctccttgaccaaatccaaaagtcttgggaaaagaaagcaaaatagtaattttgaccgcctaggttctatatataataacccacaatcgttaactaaatcatatccacgatatatactttaaaaacatg

SEQ ID NO: 11175 - DNA, 3000 bp, Unknown
  misc_feature (1)..( 3000): cDNA_ID_1830584_gDNA_ID_2214482_Annot_ID_133282 3000 nt of promoter + ATG
tactaagatgtttattggttgatctggcaaaaagaggaggttacatctagtggcgggcctatagtaaataaaattcctgtttctcacccttaaaaagatagaagagtggtccacaagcaaagtttcgtgattggctctgtttcactgggccattaatacacacatatccacagtctttgtgtatacaaaagatgattatggttgtaaatagacatatggaaggacaaaacacgtcataatagaaagcttaggaacctatgaatggtggaaacagcaaggtcttgtcgcatcgagtaatctgtaggaaacattatctttaacagttaacagtacaatgcaccactttggcactgcctttgttatagtcaagagaaatgtacgaagtgagaaagaatctttttctattagtggttatacgtttaacccttaatgtctctcaatgtccttctcatagatatctaatagctaaaacctaagttacctcatgctcatgtttcaattctttgcaagttgcaatgtgaggccaacaaagcaagcctgtcaaatcgttttcagtcgtatccttaaccctcgtgcaaatcttttgtcatcatttaatcttcttttgtactctttgctccattatcacggctcttgaccatatgctaacaaattaaccgtcaggctttttgggtgtacctggacttgcttcttgggactgttcacagtctcggcgaaccgcgactgcataagattcccgcagaaccagaatatatcatgaaaagattcagtattattgttgaatatccggaattatgaactttagagtttgtgttatggttaacaattaacaaactttatttatgtaacgtaatctcacacattgttttgctacatttgggttagaaataagtttgacaatcctttgtaacacaatgataccattgagttattgcatctaaaaaaacacgtggtttcattatttggattttggacccaatgtcattttattgggcagtcttttacggtaaagtcaaatctcagaaatggttggaaatatttattttccattccttctttggttatgtttgttacgtgttgttctcagcatctcacgctccataatatctgagctcatcacataacaaaaccatttttgtcattttttcaaacaattttgggatttcgaaatggacccaatgtaaaagaaaaaatttccattaattctgtgtcctagaaaaatagttttgacatattttaaaattatttgaaattattaatatacctcgttttaatactatttactaaactataacaacttaatctgagttatgccaaaagtaaaaaataaacatcctattaagtgtcatgttaaaaagaatatatataataactatatcatgatatgtttgtgatatgaaagaagtaaatgtaaaaatgtttctagtttagtgatgagtttacgaaattacagaaaggtaagatattgcttcaatattaaagtggatgcattaagttccatgcatgtttccctttctctaattgtaatgacaagggacatcaaggcttaaatcttggggcaagatatcgcaagctttttggaccactatattttttttctccatcttccaattttattggatgcatcaaacgcgtctttggaccacagtcgcttttgattttcactgcaagcttcatttgttcatgcttgaaacagaatggaatgtctcagaaattttactattgatccaagatacttgatttgtcataaatttctaggtcggcaactactgcaagtgaaaaaggtcatcctcatacatacagttgttctatgacgagaatatccggatattttgtcttgattcataggactcaattttgaagatcatagtatcaaaaagaacttgaaacccgaatgaaatagtattcaactttccgttcttattagtttcactataaaaaaataacgaaaactttatttgtatttcgtacaaatccaattcaatagtgcatttattttttccatgtgctccttagatatactgcacgtgtagtattaaaatggttggatgtatttctggtgatgaggcttaagtagctcatagaattaggagacctaattaagtaactcggaaaatgtagactctaactcgcagtaatgtgaaatcttactgtattacactttattctgaaaatctagtagaaaacaccatgagttttttaatatgacgaaagacgaaactatatatacttgtaaacgtagagaactaaaatttatatacaatttagacattttttgttggaaatatttatgatatttttttatacaacttttatacgcctcttcctatgagtatttttagtattgtcggtcaatttcatacgaatacgcttaccatcattaacagaaaaaaacaaaacaaaaaaacgcttatttcatcaagcatagtacggcataaagtaatacaaaagaatatgataaattcaaaacggcttattaagtttttgttgttgttgttgagaggatggcataggtttattgagtgattcttatcattggatacctgttgctgaccagaattttcggccaaatatacataggacttttgttgtattttcttccatatttaaactataataaacaatgaaccaattaaaaaattgtatatgccatccaaggatttatactgatgatgatgatggtggtggttacatgaccaatgtgatgatgatgacattaatgaaaaggaaacaaaaaatctagcggtggctttatatatatcacatacttgaggagagtaaggcaatagctaaactaagcaaatctctaagacttgttctcattttgtttgttcaaaatcccattaaaaaaaaacacaatgcaaccttaaattatttccgtttagtctctctcttcacagtcctgacctctctcaactctcacaacattaccaaatacatcccataaaaaaacaattctttaaaaaaaaaatattttgatataaacagaaaaaacaatta

SEQ ID NO: 11176 - DNA, 3000 bp, Unknown
  misc_feature (1)..( 3000): cDNA_ID_4254819_gDNA_ID_2214482_Annot_ID_133285 3000 nt of promoter + ATG
cggcagcgcaaacgtcgtcgtttgattgattggtccatgccaccctaaatccctgccttttttgcaaaagctacacagaagaaactgcaattcccaataagcccgcaatcaacggcccaaatcgagtaatcagtcaaccatcccatacaaccgttctcacatgaaccttgtctttaacaccggtcaatctaaacaaccaaccaatcataattcaccacgtcatcacgtcgttataatctgtctctgtgtctctctcttcttctcactctccgagtggggtgatagtgtgactctgtaacgagaaagcacaatcatatcgattccttcttcaaaagctcttttgcttttttcatctccttttccctttctcttttcttttgtaattttattaattatgataagtgaaaagggctcctctttaaaacccttcgaattcgtccatctcttggttctttgtggtggcgatggcattggcagaggagcagcatcagaattatcatgtggctgaggcgattccgggtacgcctgggatccatgatgtcaggattcaacccggttctgagaattccgggttctgtgttgatccggttggtgtttctaatgtacctggaattaggagagttgggttgagagctgaaatcgatacttctcctccattcggatcggttcaggaggcggtgactcgattcggtggtcgtggttattgggttcctttcaagcttgatgacactttcgtaagttttgttctttctcagttttttcttcaatgtcagatcagtgtaatatacaaacacattaatatgcattgcatactaacatttgatgctttgatggtgaccattttccattgttctttacagtcgaatctcatgacttctgtggaagtatgtaaaattgagttcatgacctttgtgcaattcagtagcattacaatattgagattgaatataactcgagtctagaatttcataatcgaggttttagcaacatatatgtaagttgttgaaagcatcaagatcgtttaagctgttgttctgtctctgagatcatcatcaccattaagtgttgatcgtcgagtgtaaaatgcacacactgattttgtaacaatgaatctcggagtatctgtgtcactgtgtgaggttggattaggagttgagatatgattttcattttcttttggtttttgtcaacgttcagaatggtgaatttgacattaagagaatggaggagcatgcagcggagcttgagaaggatctgattgtgaaagagcttgaaactttggatgttttagaagctcttggatcaaccaaaaggatcgttgaagatttgaagcggcagcttcagcaagaagcactgagatgctctgaccaactcagttcagatatcaaagagatgaacgatgagcattgccatcacaatcccatgtcatctcctgatttgatcttgatggaattgaagcaagctaagatgaatcttggtaaaaccatggacaaccttgtagtgatccagtcctctgttgaatctctgaataagaaaatgaaagaagagaaagacttccttgagaagacacgggctaagctaacgtatgggtttggtggaccggtatctctagctgaggagttgagtcggattaaggtaaaaccacaggttcaagatgaaccgttaagggagcaggttaagatggttgctgaagccgatgaaacgggtttaaacctgcagaacaagaacagtctgagaactgcagagatgagattggttgctgctaggaaaatggaagaagctgcgaaagcagcggaagcacttgcgattgctgaaattacaatgttatcatccaatggtgaaagccaggacgatgattcggaattttgctttccagagcctccaagatctcctgtgacaccaagaggactcaggattgataatgacttctccacggataagagttcaagacgagggattttgaagaagcttgaggaagctactgaaggagttaaacaaagtaagcaggctttagaagctgcgttaaaccgagtagagatcgctaatgtgaagcaacttgcagctgaaaatgctttccgcgggtggacaaaagactcattgaaaggcgataactttacacctttgaatcatacccgacgctcctttttcagccatttgaacaagcatcacgagccacttgacattctcccaaagccagtgttaaagtctaatatctcaatgcgtgatgttctaaggcgtaagcaagttccaaaggaagatgttgttgctccccaaagacagagccttgaagggcaaataccgaggcgaaatgtgaatttgagccaaatgttgaaggaactaaagcaggatgtgaagttttcggcacggggagagaaagaggaggtacatgaagagaaacagtacgtcacgcagaggagaaagtttgggttcatacacattacacttccactgcagaagcagagcaagaaaaaatccagcctttaaaaacaaacacctcccactatttctatttttagtccttattaatgtgtttgtaattggttttcattttggtttgatatggtgttgattgcttttccggtcttttatatttgttgattttccaaaaaataaatatacaatcttagtctttaaataaaacataatgctttgaatctaatgagtaaacaacaaatttgatagtgattgtaaaacaacaatgaaaactgcagaaatgtgattactggataaaagctgtatcttagcaatgaaaccgaaccaaattgaaccaagatgattagaataaaccaaacaatgacgtggcagagatagtagctgactaggcaacgttgaatccacgtcagcagatctcttatcatcaaagttttttctatcttcttcgttcgaagacgttaaccccatctcgttgaaagagagaagatgctaagatctcaaaacagagtataacaacaccttgacctcgttgaagaagcctttgagattgtctcggggatctgaaaa

SEQ ID NO: 11177 - DNA, 926 bp, Unknown
  misc_feature (1)..( 926): cDNA_ID_3593818_gDNA_ID_2214482_Annot_ID_183402 3000 nt of promoter + ATG
tattgatataaaaatctactaagcattttatatgtaacgataacgacaaaatagtaaaatacatattagtctaaattttgtgtgtgtatatatattgatattgattgaatcggttttaaaattggttaagctagtttttggatgtagaatggttttggaaagtagttttagaagcaaatgtgtttggatcgtattatgtttcctaaagttcgtatatattaaaaaagttataaaggcttatttactattttttgtgaaatgtctaaaataacaaaaagtttaatgtatttccttttatttattgaatccaaatcttcaaacgttttttttccaatgttctacacatatgataagatgccgttggtaacgaacttttcgctccaaattttcaaaaagttttctaactatattttcacataaacccgcgataaaacattactaaaattaactttgaaatttaagtaaacattctaatttggatctatcaatattttttataaatagctaaaatgaaaataatattaagctttatacacaatattttatgcgattattttgttttagtaaaagatatttaatgaaaaacaaaaatattgttgaacaaggaattgtaatttatatgtttctatgtatatgtgaataagatcaaatgtaaaaagagaagtatatgatttgtgtgatcaaaagacagcttgaaagtttggatagacgaaaacaagggttaaaaagataaaagatctcacaaacgacgctgttttggagcctgttccgtgtttttttgtggccatcatcatcaccttcggacacaacgtgatatctgaatctctccctctctctctctctctctttcgctgtccgattccgacagatagacagagggcgcgaaacagagagaaaataagaagaagaaggacgatccagatatg

SEQ ID NO: 11178 - DNA, 3000 bp, Unknown
  misc_feature (1)..( 3000): cDNA_ID_1581498_gDNA_ID_2214482_Annot_ID_183401 3000 nt of promoter + ATG
atattgctctctttaataaaacctatatatgatggtactttatgtgttgtgtgacttactgtatgagtttacctaatttttttttttttgaatttaatgttaaattagattcaaaaagagaactgaacgtttttacaacaagtgcaacaattttttaaagaagctttgaaaattttaaatagaaactcttaatcacttttctcaatgtatcctccttgatgcaaaccaaagttggagtccattgttgtatctctgatcgccactgattttgagagccgaaagttgattgcgaatgtgtatatcaatccatttgataagacgactagatgggttgggtcgtgtaccatgtttacgctcattgcgttctctccaaatggtatgtatcgatgcttgcaacacatatctagcaagtaagcgctgcaactctgtcccgccactgtaaacctaattttacctaattaataaactttaataaacttttgcctaatttacctaattttgctctctttaataaactttttccgacgagaaaaaagataatagtaaacctttcccaaaaataacaaacatatacagtagtagttttcttacaaaaatccttgtttgttttctgccaaaatcaaaatacatttcttaatttgtagggacttacgaagtaacctatatatgggtaatcatttcataatcggttatcacttcattgattctgaaagtttcaccgcttttgttgatgtcgatagactgattgggtttcgcttccatgtttttattctttttttccatgggaccaaactttaggacttactttgtataattctaaacatttttcatttttctaatgaaatatttaccttcttagcaaaaaacctatatatgggtaatatggctgttttagttgatcacgtttaggcacttaagcatacaatagatatatagaagagtaactaaggaataggatgtataaaggattaaaggggacacaagaaaatgacgtatcaaagaaatgcatgagagcgttaaaacgtcgaagcggcctttgcatgtgcttgtaacatggtagggctatctactgacccacttactaatattttttaatgtattagtggcctgtctagtcaatccaggtaatttaaataactaagcatatacataattcgtatttaaaccctaacaattttggaaaattttgtcttaaaacttgattacatgaaaatcgcaaatttctgaaattcagagctaatcaaccactaaactgatatgttgccataaaaatttaagtgatcataatatatcattcaataaatataaaatgtactgacgacttacaaaaaaaataaaagctagttccacatgaagtatatctatatatgcctacacgaaatatacaataagaaatgagcacgatgtatgaaagaactagttgttgtcatatgcatagtatcaattcatcattggcatgctaacaagatcaattaaaatattctaaagaaccatgactattaagctcattttcaacaaaggaacaaaaaaacaaaatctgtagtagttgtttatcgaatatctatatactataaagtcgaaagcatcatatgaattaacacaccaattgttgatttggtgaatatctttatatagtcaacacccgctagttcgtaagattaaatctttgatatggttccaatttccaaaattttaaggtgatccgaacaaaaatagaagtgatacgaaagtctaaattctagactgtgcgttattcccgcttattattttagaaagtaaaatccggaaactatactaacaaggattgcagctgataaaaattacttccaaattccaatgtgctcatatttcaaaacaatgtgtacgcccttattttaaattctaatgtgctcataattaagctcatgtttgaatatgttcacttaaaccgttattttgtcatctgtaattcgactcctccacccacaaaatatttggataggctcccgacatggaggccatcactacgtaaatgcaacagtgacaaaataaagtataagaaaaacttgattatcatcctatgtaaatatttatatatctaagaggaaccgtgataagattcttaaactgatctaagtttttcaaagtaaattgcccgttgaacatgatgatgcattgattacaagtcttttgttgtataacttttaacacacaaaaatagtattttatcaacaacaaaaaaaaaaccttcaacaaaaatgtgaggtatgatcttatgagttatgaccaacgtaaaatgaagtaaaagacaaattaataaatacttaagtgtattgaagcatgtgcaagtatgggccacttgattaggaatcgaagttggtctaaccgcaacatttgcatgtggccacaaccttcaaagtcccttgatcttattatatcattaatgatccattcacatttttttcttttctaactgtttaattttgttgtccacaaacatattttacaatacatatataaatctggccgcaacaaaaaataaaataaatatatcttactctgctcaaggttaacggtggcatacattgttgactttgcttctagttatccacacaagtcacccatttggccatttctaaatttgatgttccatttcgttggagaaaaaaacccctatgtgtgtattaatgtatgaaagaataccaaaagataataaggatattcattgggatttaacgagaaataaaaggcacaattctctcgcaaattggtcaaaaatacgaataaataaatcaactaaatacccaaaaaggtgaaagaattagagacaccccaatgtacttcatatagtaaacatttaaatatgattatcgcttggcacaattattcactcgagtacccctatatatacccattccttccatttgtagattccatattattcacgattctcatcaaatcatctccgatactcacaaccgaaataactaacccctcctcaacaaaaaacaacaaaacatg

SEQ ID NO: 11179 - DNA, 3000 bp, Unknown
  misc_feature (1)..( 3000): cDNA_ID_4254625_gDNA_ID_2214482_Annot_ID_183399 3000 nt of promoter + ATG
ggagcaggagacgtacacgccgtctcaatcaaaggctcaaaaacacagtcgtggcaagcgatgtctagaaactggggacaaaactggcagagcaattcatacatgaacgaccaaagcctttccttccaggtaacgaccagcgatggtcgcacactcgttagcaacgacgtggctccttctaattggcagttcggacaaacctaccaaggtggtcagttctgatccaaaccatcatccacatctctctgttttgggtgctgacgtggctgcatattgctgaggtggctcgtaagcacccgcttaattagcttagccttttttttctcttatttacgaattattgcttcaatggttgtattttcattgtgcctacaaaaaagcaaggtttttttacatgtttattggatttttttcttctctttataagccaatatcgacgcccaaaagaatgaaattacacatgaattgatttaataatttcgaattttatttaatcaactacaaaggtttttttttttttccttacacaaagtgtttatatacacgattataaactatccggacaaaccggttcaccaaacgaaaatcaaatgtgtaaaccacattatcatctctaatagcaaccccgccaaaaataagccattgtatcttgtagtaaacttgtatgattgtatccatcacatcacaatttgatgtttatgaaatctttgagtgctttctcatctaatcaggcccataagtaggccattatcatcactattagtaatgggccaaaaccccgtgaatttggtcacgcacgactcaaatgagacgacaatggttgacctctggactctcgagtctccctggattactacactcgagctcgacgatccttagaccaacttcgtcttcttcctcgagagcttctctgatctccttcgccgttaataatttccacacgatcgcttcttcttcgtctactctctcttctcgcttgacaactgtatcatcgtccatggcttctggtgacgaaggagctgttttcaatttgtctgattctagccttcttaagatccttaaaggagacatcaccaagtggtctgttgattcttcctccgatgctattgtaaagtctctctctttctcaatcaattcaaaattctagggctggttttcccacaattgatatatttctaaaattagatggaaacttgagcgttggtgatgaaaatggtttgataggatcttgaattgtataattaggtctctcgaattttgctgcatgattagtttgacttaggaagtctgtttcgtcaggtcaatccagcaaatgagcgtatgttaggtggtggtggtgctgatggaggtatgttttaggatcctttgtcctgttcaatccaatgccattgtgtgattgtgctggtgtaatctgaaatctgattatgtatgtgacagcaatacatagagctgctgggccacaactcagagctgcatgctatgaggttcctgaagttcgtcctggagtccgttgtccaactggagaagcaagaattactccgtgagattaccctttttttaactcgtgtataaatgtagattgaggtagtttgaaattggtattgttgagtgatggaaaccagttggattgaaaaattggaacaggggttttaacttgcctgcatcgcgtgtgattcacactgttggacctatctatgactcagatgtcaaccctcaagaatctctcaccaattcgtacaagtaagcgtaaacactgtttctctcgtttactatacttgacatgtttgtttcctctggtaccaacaattcatcttttttcttgctacagaaatagtctgagagttgcaaaggaaaacaatatcaaatacattgcatttcctgccatatcttgtgggatttacgggtaaagttgtcacaaccagagacctaagttgttcatattgttttcctatttagtttttttgctcttagagtgagtatgatttgctactagaccaatccatctaattttttacctttagtgattgacaactcttggaaagtttgtgcaaggtgaaagtgaaaccttatgttcgaaatcaattgtttttgttagatatccttttgatgaagctgctgcgataggtatttcaaccatcaaacaattctctactgactttaaagaggtaaagataagtttctcttgtctagattgttgcacttcccgctaagtgactgacacttttttgatctcgtattcttattcttatcaaggtgcattttgttttgttcgcggacgacatattcagcgtatgggtaaacaaagcaaaggaggtgctacaaaaagcctaaagtccaatcaatggccgaagatacacaaaaatattccccaatccttcgcacaaacaaatcatttgctatttgtgttgcgttatgaatgccttgtgattattcgttacatttagatttggtaataaagaaaattcttgcatctaaaagaaaaggtttatcacttgactcccttattatgtcttcccatatgactagttatctccaagaccctgccaagtgaaaccgaaaaacctaaataggattctctcgaaaggtaagaagtgtgtaaaataagctgcttgcatttcttcttggtcttcctgagttcggagctgaggccatcactatgtttggaaagagcaaatgtaaacgcgagaaacacaaacagaagaaaacgttttatcatagaaacagaaaaaacaaaaggttaatcacttgaccactgaagattgcccgtgctcagcaaccatctctgagtgaggaacgaaaagtcactgccagtgtttattttaaaacaagagaaaataaagcctaagcccactatgtaaaagcccatcgtaatttaaggcccaataagtaacaataaagatcatctcctctatcgatgagaagcgagtaaaccctagcagcggacacacacttaagtccatcgacatctggagagtgagaagagaggaatagccaaagatg

SEQ ID NO: 11180 - DNA, 3000 bp, Unknown
  misc_feature (1)..( 3000): cDNA_ID_3039145_gDNA_ID_2214482_Annot_ID_183397 3000 nt of promoter + ATG
tcgagactatttggatattgtaattttcactaagttatctgagtaagaagaaccatatcgtttcatttcctatctatttattaaggttcaacttttgagctattgactggtaatggaaaatgtttgagaaagaagaaaacttggagacttcaaacccattccggttaattttcatcgttgatctgacatggtaaatactgaataaagcacatgcacactgtgacacctctactttaaaaagtaccaaatagataaactgactagaagattattttcttgtgatgcaagtaagaaacaaactcaaccaatcgaccttactaaagtatactcttctataaaataaagaaatttcttctcccccgtatgtaaattgaaatcaccagatggaagtcttggtatagagatatatcgatctgataatcttatcacggaagaagactttggtctcgattgcatatctctcacgtacgactctcgtttgtatgaatagaaagaacaaagacacacacaatttaacgagttcccaaggtcaaaccgatccttggtacatctcggctaggctttgccatagcaaattcactatccagttttttttttcttttttttatacatatgtacacaagagagatagagagaggattaggtcaaaagaagcttcgagaaacttggaatcaacgacctagatatctccttgttgtcttctgttgttggcgatggaagtccttgtgtaataaaaggatgtttcaagagctcagtcgcggtgggcctgcgtgaacgcatgtcatcgcatcgccttaagaaatcttgagcctgcggagagataacgtcacgcaaatgccatacgtaaaattcgtcaaagtactcctggataggtatagctccaaacatctcattaaccacacaccctagagaatatatatcaagggctggatcgatatgtcccggatcgatcagtccgtttggtacaaaagagtccgggggcatgtactcaacagtaccaagggacgtaggatcatgatcggtgtcaggctctttggatgaaccgaaatcagcaagcttgagatcccacggctctccaggagttgtggaagggaagaggagaacgttggatggcttgaggtcgcagtaaacgtaaccatgggagtgaagagcctcgagtccttctaggatcatacgagccgtgcgactgaccaaagactcaggtatcggctcttctttccgacggaaaccatatataaacctatggagattacctttggaggcgtactccatatagatgtagcaatattcgtagggttggatttgtaagtgaagcttgtttgaggcttggacgatgcgaggatgatcacggaaacgatgcatgatcctgagctccttctcgagaatctttttgagatgcatcggcgatgacttctttgcgtaaagtcgggagttggagtccttctcgagagagacgtaaccgaagttccctcggccaagagaagagagcttcgtcaacgaagactcgtccacaatccaatcatcatctctgcaaatttgttccatcatcatagtgaagcttttacgtattcgattgtctttaggttttcatcagtctctctatacctatatatatatattttctgtaggtcggtgcgtggttcgttttttcagttggagctaggacagattttccttttccaattaagaatctgaaatatcgtatacacgctttagttaaactatatcctcaacttatttaatatttatattatttaatgctaaaaatgaaaatttattataaattacaaattctaaatgttaaaagatttacactattatttattcaaaatgtgtatacaagaaatataaccaaccaataaatatagacaaattaaaagtaacataatttgttagcacaataatatatgaatattaaaaagcacatattgatcttaaatattcctaaatataaaaagaaactgaaataaataaacaaaactttctattaattttaatattttttcattttatgattagtgatttttcgtattattttaaattttacttttagaaagaaaagtaattgtaatcctagattcattggaatcgagtagatttttttagtaaatacatcatcaattattgttgatatatgatatattttctattcgaatatattttgagtcaataatattagttgttaaaacaattatgcaaaagtgaagtaaaaagatatatgtgtttatatatatatggggtaggaaaataaaaactttcaacaattaaattcgatatatatgttatttttttcacttgatattacttttttcccataagactaaaggaagactgataaattgatttcttaaaattttatttaaatgaaaccaaataaccaataatccaatattcaccaaattaagtttcctttttcgtattattttaattatgatagcttaatgatatcaattgttaatttttatttaaatttcctatcaaacggataaaagattacgaagtaggattatgttaaaagacaaattgaagattataatggatttttaaaggttataagattactttgttaatatttaagatttggggacaatttggaatatttagtatttgttttaagaaaataaaagattttggccaatttttcctaatgtcaatttagtatttttgtaccggctaaataatctttcgtgtagacaaaaatcaactctgaataaaataataataaacccaccagccgttaaaaaagggtgaaaaacatagtggagccctatccttctctctctctctcgtagccctcctctgttccatcttcttgctccgccgatctccctctgctctttcttcttcttcttcttcttcaattctgtttttatttatttctttataaaccttctctcttaaaacccaaattcaaaaaaatcaaacgaagaaaaatctccgagttagaatcgtccataatcttgagactaagtgagaaatagtatccaaggtgatcaaaca

SEQ ID NO: 11181 - DNA, 3000 bp, Unknown
  misc_feature (1)..( 3000): cDNA_ID_4262165_gDNA_ID_2214482_Annot_ID_183394 3000 nt of promoter + ATG
aaatatgggaaagaaaacacaaaaacattctgtcagttggtgacaaaaggaacattctgtcggttatacagtctttaaccattcaccaaagcaagttgtttataaattaacatcgaaaactatgcatattttggcttactggcccgttaacaaagcataaaaaaagtatttatcgttctctgttttttactgcctaaaatctttccagatttggaattacattggcttataaatgtacgttaatgagtaaacactaaatcacagcatcccatatcgccaactaagaaactcaattatctcccaagtaaattttacttaccatcaccaatctatcatcacttgttacccattttaccaagaaaaaacgaaaagtttctttcccataatatatatgccgccgattgccaagaaaaacaagattttcattcctagattgtgtttgcgggtaaacaataaaaagaagaagaaaatggtcaattggttaagaaactctaataagtaaaaacaaaatggtttcgtgtaagatcaattcgaattcatttttattttggcaaaattgcaaaaattaataagagttgatagtagacgacaaacattttcttgtacactaattactgtaacagtcacattattataatgaaagagggattcagcaatcctaaaatatgatttgtaatttcataatcattaattaaatcgcccaattttgaactttttaatcttaaaacttcggaaaatgattggtctatatttgtgcccaatatatatatatatatatatatataagtataaataataagttctattcttaagaatcattagtatatcctaaaacctgcttttggcaatcaagaaaataacttgcaaaaaacccatggcgaacctaatcttcactaaaacagactccagaaaaagagtgttccaagcaaaatcttgatgatataagagactccagaaaacaatcgtctctctagtgagcttcacatatcaacagtgtataagtttttgactagcaaaaaacaaatatcgttcacatttgactgatacatcatacaccaaactgaaaagacagcattccccaaatcacgtatagaatcttaaatcatataaaatacattttgttctttgctttgaaatatcaaatgttagtgtgatttgtcgtcatgcaacgcatgcatataatattaatttattatttgatttggtaataagtctctttatacatgcattgaatccaccgaccaagtctactatatgctttgaaagtttgaattatataataatagaaaagattgttgtgaagagcaagctgaatcgatttggagaattggattccgatctggttttataattgttcgactacaataatgtcaaatgggatagcaagaaaataatgtataaaggttgaaattgcgcaacacctaacaaaagggagagaaagaaaacaccccaaaaacaaaaaggtagaggaagaaacacataaaagaggagtgaaagagaaagaagcataaaaagaaaggaatagaaatagagcaccaatcaatgacttcaaattcaattatttcgaaacaaatttttaaatttatagattactaaaaatcaacaaacttttatagaataaatttgtaaatctatgattcattagctaaacaactaatttttacacactaaaacaattcagagatgtgtacaaataaagacatgtgttaaataataataattatttgtaaaaaaatgagatataaaaaagtagatgcaaccaaattttttaaaaaaaacctttaaaatgccataaaaccattctaaaagtttataactgtatatatagatttgttattaattattttatatgttgctattcatttattaaatatcatctagttgttcaccataatccataatagggacaaaatcttaaatacatttcatatcaatttttttctttcttacaatctgccaagttaaagaaattcacaaattataaaagagaaataataaggtagtattaaaaatttaatactagtgactatcaatagatagtaacaaatactaatataagtatatattaattacgcgttatatataccttttaacaaaatatattattgttgttgactgatacagagagaaataaaaaaaaaaacagtttcgatttttgttattgcaacaaaaagtttcggaaaatagagagaaaagagagtgagtgaggttggtgatgaccagattttgaggcttatcaatagtacaaagcttgcaaaatcaatggcgcaaattctgttggtaagtataagaaaaaaaagaaaagctttttcctttagatgtcatgtaactgtcgggagagcactcacgtgtttctgtctcttcacctgtaaatattctcgccacgtttgctctctttctttttttccccgagaaaacgcaaagacaaagacgtttttttaatttggctatagcatgtggaggctatgggttcttatcttgtatcgtcgttctttgtcttcaatatctttaattcaatgataagcagatcatctctttcttcactcctacacatcgattcacgtcatccacccagaaaaattcatacttcaattaaaaattctgtaagtggaaaaaacacagttggcaaaatgggcaaaagctaataattgatttatctccatttatggctaaaagcctaacactaggctctacacttttcaagtcttttcattttctgggtaattgttgttcaattttagagatttagggtttttgattgttcttctttttctgggttttatctaaattcgtggatatgagaatggcatgtgcgtgaatgtggcctactttgttttcttccttctaatttgggaacagagtttggttgtcctatttattgttactttgtaggtttcactcttttcgacattacttttcaattgcttcagattcataaatctatcttcttctttctttggttgttcagctttagcgtgttaggctgaacatttaagaacc

SEQ ID NO: 11182 - DNA, 3000 bp, Unknown
  misc_feature (1)..( 3000): cDNA_ID_3039153_gDNA_ID_2214482_Annot_ID_183392 3000 nt of promoter + ATG
ttttcgtcctcgatttaaatttagagaggataacacatacaaatattgatttcttttttaacattagcgtctgaattttctaatttcaattttggaaattaatttactaacttaaaaattttaaaaatattttactatattagaaaaagtcgttaacataatgaccgtttatatagctcgtgtatacagtaaactaaccgttatttctctaactaaaaaaccagtgattagatcaatgttaactttgaggattaaattgctcacttaaaagttaaaaaatattttactatattaaaaaagtcgttaacataataaccgtttgtatggtacatgtataaagtaaatggataatattaagggatgaccaaatttgacagcataataaagaaactaactatgtgtcagtttttttggtaaatgactctttttgtggtggggtaggggtgaggaaaagaccaattaatcttgtaaacttatagtttttacaatgatacatttctttatggtggtagagactccataaggttcagtgagaaaaagaaaagagactcagaggtggaattcataatcatcgtgatattattacagagtaagtagtctagaaagagagtcatctggcaaaagattaaaaaaacaaatcatgtaatttttaaaaataacatgaatcaaataaaaataacaaaagaaataatttggtatttatacaaaatcttatgtatttttaacaatagcatgtcaaaataaacaatagcatggcatattaaaaaatcacatgtaaaccaaaactatagtatgttaaacggaaagataccagtatatcataaaaaattacataaaatttagaaaaaaacccatgaaaatttaagaagtgacatgaatcaaacaaaaataacgaaaacaatttggtatttggttatggtcatcgtgatattattacagagtaaatggtggtagagaatatctataaagggaaaagaagttgacgacatagatccagggagaaagaaaatcctgcaaaaagaaaatagagaaaaagaaaactagggagaagatgagagagaaaatgataaaaaggatattcaagtaattctatatacatttccgacaagatactgttgtccatagttagttactcaattattttcggtttcatagtcatctagtgcatatacccaaagtaaattaccgttatttctctaattaaaaaaaaacggtcattaagttaatgttaacttagacaaaaagttgctaacttaaaagttcaaaaaaaaattaatatattcaaaagtcgttaatttagtgatcgttccctcgatggtacaagtagaaagcaaactaaccgttatttctctaactagaaaaagggtaatcaaatcaatgttagcttaccaaattaatttgctaacttaaaagttcaaaattattttattatttcaaaaagtcgttaatttagtgaccgttttctcgatagcgtgagtataaactaaaccgttgtttctctaactaaaatttgaaaataatatcattataaaataaaataatattatttttgaaaagaaaatcacttttaaacacaaatttggacctcataacattttctaaaatacatttgacttggaagaaaaaaaaagaaaagtaatataaacgtatccaaacactaaatctcattagccaatgtttgtaagagtatctgtacatcgtagatatctattttgtcatttcctctcttttagtcttttatttcattttacttttttaacttttttttctttttcctttgattttcttgtcttctctctttgaactcatgaggaagacgacgacgttgttaggaaaaatgaacaattttattggggttatgtgaaacgatttttaatacaaaagaaagaaagatgctgatttattaaattttggggtcattattatttaatttctatgacttatgaaacttccataaaaatttcattgacttttttttttcacatttttttaccggtagtcgtttcattatcatttacattatcttgtttatttattctccttctcatgtttagacgctaagctgccattttctccgccagagtaaagttctttatcctctttagctcttcactcttaaactaattaagatttggtgaaaacgattctgcttatgctcctttcgctttctctgttccattttggtctttaactctttcatttcttgtgagtttttttgatgagtttgcgtttgataatccaaaggcaaaagctttttctttacgcgttaaatttcaactttttcttacaaatgcatattgattacaatcctagaaccctaaacttgttaacaagtgttgatcttttgttcatcatcgaaagttttgatttttatgggtttctatgttgcagggtgagttaaagccacttgggttctgacggatttgttcaaaggaagcttctttgacgacgacacttggactaaaagcataggtacttttccgatactcctcacaactctaaaaatattttctccatttacgaggttgacgaggctttttttatttgcttgagttttagaaagctttagtttttagttgttgtcgcaatcattgccgtgtaagctgggggaaaagcgagtggatcagaattctttttgtcaattctttttttgggtattttccaaagtcttgttttttttttattctttggtttgggtttggctttgaggaagctaaagactgtatagggatacctaacatttgcatttactattcatttatcactctgttttgattttcttgtcttgcttgtattgttttgaagcaagattttgttcttgctctgttctgttctgtggtgattcaatttgtatggcttcatttctttggttggaagttgttttccttatttgatgtcatgtttttcttttaatgaagccatgattttttctctttgttctatggtttgtacttgtagatcttgcactcgttggggtgattctctttgttttttgttcaa

SEQ ID NO: 11183 - DNA, 3000 bp, Unknown
  misc_feature (1)..( 3000): cDNA_ID_1021968_gDNA_ID_2214482_Annot_ID_183391 3000 nt of promoter + ATG
atgaacatgcagcagataacattcttacattttgtaacaagaaaatacagtaaaggatatttgtgcatataacggggcagtgtcaagaactgatttgaagactaaattctatttgaaatattgttatttgagagcattttaagtaatggaggtgctatcagatgagcgacagaaaaaaggaaataagaacttgtatttgcttagttgacctatatttcttttgtttagatgtaaatttatatttcacatgactttacacttttacagagaaggaatacaacaaaaactgactttagacttcagatagcatgcatgcttgcgcaagaactaaaaaactaagcaagactgctcttataggtaaggtacttaacaaaagcatgtattctgtttggagactacttggaagagaatattctcatatagctctagttttcctcaatatcgtctcaaatttttagagctcctttacaaaattggtgatcaaatggaaaaaccataagaggatatattcaactatttattattttgtctgtagtatttatctaaataatttatatcaatattaagcattggataatcttaaacatttatttagatatagtttgaacttgtaaacttacacgatttttaaagttcgtaattgaaaaaggagtatacgtccaattgaaaaaacgaaccgaccttctgaaaaaaaaaaaatatatatatatatatatatatatatatatatatatatatcgtgtgatgcaactaccacataaaattactcagattacaaaagaaaaaaagaagacaaaaaacctaaagaagatcgaatacgtaagatggagaaacttggcagagatgatgaattgattgtggacgagtcttcgttgaaatccttctctcttctttgccaaggtaacttcagttacgtctgtctcatgaaggactccaaatctcgacgttgcgcaaagaagtcatcgccgatgcagcacaaacagattctcgagaaggaactccggatcatgcatcgtttccgtgaccatcatcgcatcgtccaagcctcaaacaagtttcacatacaaatcaaaccctctgaatgctacatctatatggagtacgcgtccgaaggtaatctccataagtttatatctggtttggaaggaaaatccgtaccagagtctttggtccaacgcacggctcgtatgatcctagaaggacttgaggctcttcactcccatggttacgttcactgcaatctcaggccatccaacgttctcctcttcccgtccaagactcctggagagccgtgggatctcaagcttgctgatttcggctcatccaaggaacctgattccgattatggttggatgtactttggtacggcgcctaagtacatgccaatagagtcttttgggcctaagggagtgatcatcgatccgagccttgatatatatgctctagggtgtgtggtttatgagatgcttggagctatacctatccaggactactttgacgaatattacgaatggaatctgcgtcgtcatatctctccggaggctagagatttcttaagccggtgcagtaacatgcatccacacaggcccaccgcggcatatctcttgaaccatcctttcattactcaaatacttccatcgccaacaacagaagacaacaaggagatatctaggtcgttgattccaagtttctcgaagcttcttttggcctaatcctctctctatctctcttgtttgcataaaaaaaaagaaaaaaagaaactggatagtgaatttgctatggcaaagcctagccgagatgtaccaaggatcggtttgaccttgggaactcgttaaattgtgtgtgtctttgttttcaataatcgtgaaatcttcattaagtgtaaaagttatacatgattaagcttaaatactagtaaactaaaccaaaactactaaccaaacttaaccacaactaaaccaagtatatacactctaatactccccctcaagatgaaaggaactttcatcttggacttgaaaacccaatgaatatgtgtcctccacaactttttttcaatgagagaagcatcaatggacatgaatatccatggcttgaaactgaaaataaacgttacgagcttccggtggtcttgttagtgatccaaagataaatgtgcttaagcgaccagaatcatcgacatgcgcttgcccaacaaagctaacatcgccacaactaaaccaagtatatacactctaatatttgttctttcgattcatacaaacgagagtcgtgcgtgagagatatgcaatcgagaccaaagtcttcttccgtgataagattatcagatcgatatttctctacaacaagacttccatctggtgatttcattttattacataccgcggagaagaaagatcttatcttatttaagtgttatactttagttaggtttattactcgagtttgtttgttacttgcataacaaaaaattactcttaagtcagtattttttctttgaaaggttttacctttttaccagtgtgaatgtgctgagttcaacactccttcatgtttaatctgagtatattttatattagtcctgcatattttatcggagaatatcttcatatattattattagagtgtacataaaattcaaggtttactctatattactctatccaataatttacatttgtctgttagattttgttggaaaaaaataactgtgatttacataagttttttttttttttttttttaattgatgaaagaagaaaaagaagaagaaagtcttctctagaaacaaaatccaatttttggtcagaatgaaaaagtcactggcaatgtttattaaaaaaaaaaaaaaaaaaaataaagcccaagcccactacatgttaaagcccaagaagtaacaataaagatcagctctcctctatcagagattagacgaatgagatcggcaacaagagcgtaaaccctagcagcagacacaacacgagttcatcgagaagcaag

SEQ ID NO: 11184 - DNA, 3000 bp, Unknown; identical to SEQ ID NO: 11175
  misc_feature (1)..( 3000): cDNA_ID_3039168_gDNA_ID_2214482_Annot_ID_183385 3000 nt of promoter + ATG

SEQ ID NO: 11185 - DNA, 3000 bp, Unknown; identical to SEQ ID NO: 11183
  misc_feature (1)..( 3000): cDNA_ID_1021968_gDNA_ID_2214482_Annot_ID_133287 3000 nt of promoter + ATG

SEQ ID NO: 11186 - DNA, 3000 bp, Unknown; identical to SEQ ID NO: 11181
  misc_feature (1)..( 3000): cDNA_ID_4262146_gDNA_ID_2214482_Annot_ID_133290 3000 nt of promoter + ATG

SEQ ID NO: 11187 - DNA, 3000 bp, Unknown
  misc_feature (1)..( 3000): cDNA_ID_2701883_gDNA_ID_2214482_Annot_ID_133291 3000 nt of promoter + ATG
gtcatgtcaaagttagcctcctcccaaaccgacaagtctctgatgaggcactgtccacttataagctggagcatccaccggagaagaaccatgactcgtgtgtgaaaagatatctggagaaacacaagtggttacacactgctttgctgcttcttgttcttcttgggacttgtatggttattggagatggacttctcactccagctatctccggtatgtatgcttctgtgtttgtagacagatattccagtgtccaattgctagttaaaagagttttctaatcttttctttttcttgtatgtagttttctctgctgtgtcaggtcttgagctgaatatgtctaaagaacatcaccaatgtaagtacacaaagactgggtagtgttagtttttgctacttgagttctgatgaatgatggcttcctttgttgttcaaacgtgcagatgcagtaattcctattacctgcttcatactagtctgccttttctcgcttcagcattttgggacacatcgtgttgggtttgttttcgcgcctattgtcctcacttggctgctctgtataagtggtattggcttgtacaatataatacagtggaatcctcatatatacaaagctctttctcctacatacatgttcatgttcttgagaaagacgagagtaagcggatggatgtctctaggcgggatcttgttgtgcataactggtgagatatataagaaatcgatattgttaatgtcgccataaataatgtcagtaatctaactcgttgagtctttgttttaggtgctgaggccatgtttgctgatcttggtcacttcaattacgcagcaattcaggttagtttctactttagcttggatgatttacttattgttatatcgccacaggtttcaataaatctttgttttgtttgctgtagattgcgtttaccttcctggtttatccggctcttatattggcatacatggggcaagctgcttacttatcccggcatcaccattctgctcatgcaattgggttttacgtctctgtaccaagtcagtaatttgccttacttcaagaactcaatttttttttggtgttgatcattgaaaacgtaatctgatcttttgtttatataactccatggttttgaacagaatgtttgcactggcctgtgcttgctgtagcaattcttgcttctgttgtgggaagccaagcgatcatcagtgggactttctcaatcataaaccagagccagtctctcggatgcttccctcgagtcaaagtcattcacacgtccgataagatgcatggtcagatttacataccggagattaactggatgctcatgattctctgcatcgctgttactatcgggtttagagatgtcaaacacctgggaaatgcatcaggtatgagattcttttatcaactcaagaattttggattcttcgactttgagattatattcctttgtggttggttgcaggtttggctgtaatggcggttatgctagtgacaacatgtcttacctcattagtcattgttctttgctggcacaagcctccaattctagcgctagcgttccttctctttttcggttcaatagaacttctctacttctcggcctcactcaccaaatttcgtgaaggcgcttggcttccgatcctcttatctctaatattcatgatcatcatgttcgtttggcactacaccaccattaagaaatacgagtttgatctccagaataaagtctcgcttgaatggcttcttgcattgggtccaagcctcggaatttctcgagttccaggtatcggtttagtcttcacggatttaacctctggaatccccgccaatttctcccggttcgtcaccaacctccctgccttccaccgtgttcttgtctttgtctgcgtgaaatctgtccctgtcccgttcgttccacctgctgagagatacctcgtgggtcgtgttggtcccgttgaccaccgctcttacagatgcatcgttcggtatggataccgtgacgtccatcaagacgtggactcattcgaaacagagctcgtaagcaagctggcggatttcatccgttacgattggcacaaaagaacacaacaagaagacgacaacgctcgttctgtccagtccaacgaatcctcaagcgagtcaagactagccgtgatcggaacagtagcttacgagatcgaagacaatctccaaccagagagtgtctccatcggattctccacagtcgaaagcatggaagacgtcatacaaatggccgaaccagccccaaccgccaccataagacgggtgaggtttgcggttgaggaaaacagttacgaggacgaaggatcaacatcgtcagcagaagcagatgcggaactgagaagcgagctgagggatttgctggcagcgcaagaagcaggaactgcgtttatattgggacattcacatgtgaaagcgaaacaaggatcatcggtgatgaagagattagcagttaatttcggttataatttcttgagaaggaactgtagaggacctgacgtggctcttaaggttccacctgtttctcttttagaagtcggcatggtttatgttgtttgacttatgaaaaaactaaatatatgaaaacctaattcctctgttgtaaattcgtcatgtttagcttcatagatctctgtttctgtgtttgtgagtctggggtttgacttttaacaaatcttaagaccaagatggtcagaggatcatatatgccaaatgaattagtttattatacacatgaaacgacatcgtatggagaggggtccaaaacggtgcgttggaagttggagaatgggcatggataatggcgggaataacctaggagatatggcgggaaaggcccaactatacacacttgacattgcccttaattcgtgtttgagcaaagactcaatctttcatctctagattcttggcgattctcgctacatagtactttggtaaagagtgaaatcaaaggttggttttgagat

SEQ ID NO: 11188 - DNA, 3000 bp, Unknown; identical to SEQ ID NO: 11180
  misc_feature (1)..( 3000): cDNA_ID_2701887_gDNA_ID_2214482_Annot_ID_133293 3000 nt of promoter + ATG

SEQ ID NO: 11189 - DNA, 3000 bp, Unknown; identical to SEQ ID NO: 11179
  misc_feature (1)..( 3000): cDNA_ID_4254625_gDNA_ID_2214482_Annot_ID_133295 3000 nt of promoter + ATG

SEQ ID NO: 11190 - DNA, 3000 bp, Unknown
  misc_feature (1)..( 3000): cDNA_ID_2701895_gDNA_ID_2214482_Annot_ID_133296 3000 nt of promoter + ATG
aaattgcccgttgaacatgatgatgcattgattacaagtcttttgttgtataacttttaacacacaaaaatagtattttatcaacaacaaaaaaaaaaccttcaacaaaaatgtgaggtatgatcttatgagttatgaccaacgtaaaatgaagtaaaagacaaattaataaatacttaagtgtattgaagcatgtgcaagtatgggccacttgattaggaatcgaagttggtctaaccgcaacatttgcatgtggccacaaccttcaaagtcccttgatcttattatatcattaatgatccattcacatttttttcttttctaactgtttaattttgttgtccacaaacatattttacaatacatatataaatctggccgcaacaaaaaataaaataaatatatcttactctgctcaaggttaacggtggcatacattgttgactttgcttctagttatccacacaagtcacccatttggccatttctaaatttgatgttccatttcgttggagaaaaaaacccctatgtgtgtattaatgtatgaaagaataccaaaagataataaggatattcattgggatttaacgagaaataaaaggcacaattctctcgcaaattggtcaaaaatacgaataaataaatcaactaaatacccaaaaaggtgaaagaattagagacaccccaatgtacttcatatagtaaacatttaaatatgattatcgcttggcacaattattcactcgagtacccctatatatacccattccttccatttgtagattccatattattcacgattctcatcaaatcatctccgatactcacaaccgaaataactaacccctcctcaacaaaaaacaacaaaacatgtacactccatcatacttaaaatattcaataatctcaattatatccgtattattcctccaaggaactcatggagacgacggaggttggcaaggtggtcacgccacgttttacggcggcgaagatgcttccggcaccatgggtacgtatgaccaatcccaatatctaaaaatgcataagttagctaaattgtctctttatccacgtgtaagttagctaacaagtggcatgcacaaatcaggcggagcttgtggctatggaaatttgtatggccaaggttacgggacgaacacggcggctttaagtacggctctattcaacaacggactcacgtgtggcgcgtgctatgagatgaagtgtaacgatgacccgaggtggtgtctcgggtcaaccatcaccgtcacagctacaaacttttgcccacctaaccctggcctctccaacgataatggaggttggtgcaatcctcctcttcagcatttcgacctcgccgagccagcttttcttcagatcgctcagtatcgtgccggcattgttcctgtctctttccgaaggtccgtttacttttctttaaacttgggacgctaagtgataagattgcgaaaagacaattaactgacagtttttaacatgtagtcccaatccatatatagtagtgtttactattaacaaattttcaaaacattaaaattgtaggtttatttgggaaaagaaaaacacacttttttttaacaaaaccaacctttaccttataaatttactagtccgaaactaatagacaagtcttttgtagctagtagctaccatagttaaaacttaatacccaacaaagaatttgttcctaattaatctctatttaatgagcttatcttaactaaatagtatatgttttttgggtcttaaatgggatatagcatttttctgataatgtttaacactaaaaccacactattaagcaatagcctatgcaagatcttgtatgtataagtccatgtttcttaaataatggcttaattttgtcggtgtttttacgtgattattgcagagtaccatgtatgaagaaaggaggaataaggtttacgatcaacggacactcatacttcaacctcgttctgatctccaacgtaggaggagcaggagacgtacacgccgtctcaatcaaaggctcaaaaacacagtcgtggcaagcgatgtctagaaactggggacaaaactggcagagcaattcatacatgaacgaccaaagcctttccttccaggtaacgaccagcgatggtcgcacactcgttagcaacgacgtggctccttctaattggcagttcggacaaacctaccaaggtggtcagttctgatccaaaccatcatccacatctctctgttttgggtgctgacgtggctgcatattgctgaggtggctcgtaagcacccgcttaattagcttagccttttttttctcttatttacgaattattgcttcaatggttgtattttcattgtgcctacaaaaaagcaaggtttttttacatgtttattggatttttttcttctctttataagccaatatcgacgcccaaaagaatgaaattacacatgaattgatttaataatttcgaattttatttaatcaactacaaaggtttttttttttttccttacacaaagtgtttatatacacgattataaactatccggacaaaccggttcaccaaacgaaaatcaaatgtgtaaaccacattatcatctctaatagcaaccccgccaaaaataagccattgtatcttgtagtaaacttgtatgattgtatccatcacatcacaatttgatgtttatgaaatctttgagtgctttctcatctaatcaggcccataagtaggccattatcatcactattagtaatgggccaaaaccccgtgaatttggtcacgcacgactcaaatgagacgacaatggttgacctctggactctcgagtctccctggattactacactcgagctcgacgatccttagaccaacttcgtcttcttcctcgagagcttctctgatctccttcgccgttaataatttccacacgatcgcttcttcttcgtctactctctcttctcgcttgacaactgtatcatcgtccatg

SEQ ID NO: 11191 - DNA, 3000 bp, Unknown; identical to SEQ ID NO: 11178
  misc_feature (1)..( 3000): cDNA_ID_1581498_gDNA_ID_2214482_Annot_ID_133297 3000 nt of promoter + ATG

SEQ ID NO: 11192 - DNA, 926 bp, Unknown; identical to SEQ ID NO: 11177
  misc_feature (1)..( 926): cDNA_ID_3593818_gDNA_ID_2214482_Annot_ID_133298 3000 nt of promoter + ATG

SEQ ID NO: 11193 - DNA, 3000 bp, Unknown; identical to SEQ ID NO: 11174
  misc_feature (1)..( 3000): cDNA_ID_3039172_gDNA_ID_2214482_Annot_ID_183383 3000 nt of promoter + ATG

SEQ ID NO: 11194 - DNA, 1542 bp, Unknown
  misc_feature (1)..( 1542): cDNA_ID_3435695_gDNA_ID_2214483_Annot_ID_133299 3000 nt of promoter + ATG
aagcttatgtcaaaaatatttaattaaaatatatgtaatttatatgttgattgagttatgagtatcaagtaaaaaccctaatccgttattaaaatatcaatgattataacgtatttataaacgaaaaaaaaaagaacatctagaattttcgatatttgatcctcaagttaaacttggaaaaatttggatgtatgaaatattttgtcgtccacttatacaataaagtatgaaacatggatgcatgaaggctagacatccaatgtctaaaaatactatatataatgcttttggtagggtcttttctttatcatgtctcacttctgtttctatccctcattttaaatagccaatataatttcactctttactataaaattattatataaacatcattttgattgaactacctaaaaggaagaaacgtataggaatttttggagcctcaagattgtaataatgtctcatagtttgacttgcaaaagctaaattaaacgcctaaatcattaccattaaataaatgaacttttgtacgcaattgattcagacacaaggaccgaccaattcgaaaacaatgaatggatatgattcatccttatgaaagcttgacaacaaactcggttttggctggttaacctagactcggtttatttaaaccagacaataatttctttcgtcgtcgttttatttgaataggtgcgtcaaaaataaaagctgaaattcttggttgcaaaagcccaacaggcctgtggagatagctttttagattgattaaatgggccgaattgggctgacacatgacgagaatgtggctatagaaattgttagtgagagggtccgggtccaaaaatgttgcagaagtgatatagtatttatttaattaaaaacatattattcgacgtatttttaacgctcactggatttataagtagagattttttgtgtctcacaaaaacaaaaaaatcatcgtgaaacgttcgaaggccattttctttggacgaccatcggcgttaaggagagagcttagatctcgtgccgtcgtgcgacgttgttttccggtacgtttattcctgttgattccttctctgtctctctcgattcactgctacttctgtttggattcctttcgcgcgatctctggatccgtgcgttattcattggctcgtcgttttcagatctgttgcgtttcttctgttttctgttatgagtggatgcgttttcttgtgattcgcttgtttgtaatgctggatctgtatctgcgtcgtgggaattcaaagtgatagtagttgatattttttccagatcaggcatgttctcgtataatcaggtctaatggttgatgattctgcggaattatagatctaagatcttgattgatttagatttgaggatatgaatgagattcgtaggtccacaaaggtcttgttatctctgctgctagatagatgattatccaattgcgtttcgtagttatttttatggattcaaggaattgcgtgtaattgagagttttactctgttttgtgaacaggcttgatcaaaatg

SEQ ID NO: 11195 - DNA, 3000 bp, Unknown
  misc_feature (1)..( 3000): cDNA_ID_2701949_gDNA_ID_2214483_Annot_ID_133300 3000 nt of
atagggcaatagataagactctctaaaaaggaagatggctaatgaatattaaatcatcttgtatttatatcccttattgaccgatccgtatttaggtcatgaggtcgtgtttacatcgccttcagcaaatgaatcttttttctagattctctttatttttatgttttattaacacgttcatttttattcacaactttgatcgtaaaatgcatgataatagataacaaactcgtaatatatcgaggagagtaagcagtatctataaatatttagttgtgtgcatggcgttaaaaggatgacgtatagatgatgacgcagaggagattcctctgaagagagttcgaactttaaactttaataaaacaaagcatgtggtacaaaactcgaaaggcatgatgagaccataggacgtccatgttttagcatctatatatcatttttccgtcaacccacctatagagaagtatacataaaattaaatgtatggtttaataatttggagatccattttctggttgatgttcaatgtatcaaatagtctttgataaagcatctgatatatttgatattccctctaaagaaacatcacataatcaaacttcaaactcaaaagaactccacatcaatatttttgttttgattaatggttagaaagtaatgactcagtcaattcagaatcctgaaacgtataaaccaatattgagttcgaacttccaattcttacgttgtatacattttggtgtataaaaaatgaaaggaatgcattttcagcctttaaatttatgcatagaatataataataagtttctaactaaaggtcaaatcatttaattgtatttaacatttttgacacaactattttatcttgcaagaaataaatatgtaaactggaaaagtagttgagaaaacaaaatagttatttttatgccatgagaaggatgtgtgtaaaataagttagaaaatgctctaagaaaagagaaacataaaaggatttttaagaagtcttacagttgacaatatgaaaactttagtaaaagtctaccataaaccgtaaaaaaaatgaaattttaattctggaagtaaatgtaatgcatgttgcctaaactcggacactatgtggtagattttgattggtcggaatatatgatctccgaaaagcaacaatgtcaaagctgcgtgaagaaaaaataagctagaaagtaaattatatacatgtacaataatggaaacatatgaataatattaaggagccaaaatcaaaaatgaccggcgatgattaaggtaataaaagtcaaagctcaacacaaccgacgcttttggcaggaaattcgaagacatatggtaagagtcccactttctcattattaatctcttttctttgtcaaaatttgcaacacaaaacacgtttagagtcaatgtcaacatcaggattcagcagtatggtatacggtttgaagagaagcgagaggtaagtgtctgtgtagcaaatgcttgaatctgcttcttggcatctacaaactacaaagtatcaaaaacatatgaataatcatataataaaatattaattgcaccatgccatcattggcttgagactcaagccttgagtgttagaatcataaatagttttgttacctttttggcatttggtgaaatccaacggtgtttgcaaacactaagagtcaagcaaactccaataacaaaaacataatgatccaagcagtgctgtagaaatagttacataaaagttcatacaaaagtttcatactatggtgacaaatgaaacctatagagacttaggctttattgggcccaatgtttgtgagctacgagcccaaatcaagtgaaagataatgaaactacaaaaaatgtaattaaataaagctctttgtagatttagctggacaaattttttaaaaaatcaatgaaagttaaaaaggacttgtggaaaatgtgacgcgagacatttctaccgacatctgagaagaagtgactgtatatccaataaggaaagagaaaggaattggatcttcgatggagcccacgagtgttcactacgcaccatggaattggttcatatggcccattaagagattaatgggcccaaatcagatggcgcgtgtatctcacggtgattcttcacccaggtaaattgctaatgcggtgtctatgttgtcaaatctgtcgttctcaatgagaaatctccatttttcacgtggttaattttcctgtttataattttttttttttttttaaagtagtatcacaataattaattggaaatgaagggcatggaattgaagttatctaacttccttttaaattttcagaaactgcaattttatttagattcaataatcttttaaaattaggttgtaattattagtgcctcatcagtagttagaaaagtaacaagaattgaaattttcgacttttaaaagtgtttctctttagtggttatggaaaatgagatctttgtagatagagattactccttctgataattcttcaatacagtgttatctacactgtttctttcccgtatggtttcagtatcttgttaaaatacattagcaaatgactttaataaattagcaaaaataagtatgacttagaaaaaaaaaggtgtgtattaaactaaaatgcaagaaagaggactagggaagtgtacaatgcacctcgtagcagggaataacatgttctgatttcccacaaaacaccgtagctagctagctgcttctagcgttttctccgtataaccgtttggtttaaatttctccggtacggtcccactttccagaactttcacggtttcaccaaacgccaatcaccaccgtctgttctcctacttacacgtgtacgtatcagatttcacgatcgtaacccatccaagcgcctatattaaccctgtttatcccgctaccgtaagtcctcatcagcaaacacaaacacacgactagataaactctaaatcctcacagcagatcacgtgctaatcacatg

SEQ ID NO: 11196 - DNA, 3000 bp, Unknown
  misc_feature (1)..( 3000): cDNA_ID_2701913_gDNA_ID_2214483_Annot_ID_133301 3000 nt of promoter + ATG
gatcggtcaataagggatataaatacaagatgatttaatattcattagccatcttcctttttagagagtcttatctattgccctataatatttgatttaaactgtttactaagattttgcgattgaccttatagagattttttgttggaggctttatgtgttatgtcgcatcaaatcggaattagacataaccagatgacaaaaaagagagcctttgcgtatgaatatgacagaattttgagcgtgtaagttaaaaagacgagattgtgggttctacttttggtagttctgctgattttgatagatcgcaaacgtctttttatgttgatttttcatctttttgttgattatttatctctttctttttgtgctttcctttttaaaactatagatctacttgtccggtgagacgatcgtatatataggatagtacacgttttggcatcaaacttgatttcctattctcgccaagcagttttaatttcttgtcttatcaaacaggctttaagattgttcttgagtaatatgcaatttagcagtagaaaaaaacagtgaaatattccttcaactcataaatcaatataattgacacaaaagaccggtcttatttcatgtcaatagaaaatggtattttctctcgtggtttgttacttttctgttcttataaggctaacctctagtggggatgcaaagttctagatttagacttgttcgttagatgactaggtggttagaatttagattcgcgtcgttgtttactgtgttcgggataatcgtttttagttgggatttgtcttcgcgggttcatctatcctttgctctactctgtttgtggttaaagattctctagtccgcgatcttcgagctcttatttccgcgagttttgctctcctccgactttcatgttgatctcatgagcttatcttcttgattttagtatattttcttgtggtcccatgtatcgggcttttgttttcggggatttctttattttctgccggctatgttgtacgaaaacgcattccaaaactgtatttcacccatgtattatataatgaaaatctttcagttaaaaaaaaaaaaaaaaaaaaaaaaaactagcttatttgggttgtcgtctatatcacatatctaatcgatgtaacaattcactgaatcgggtgttacaaataacatttgttttcttcactaaaagtataagatactggtacaacgcgaaatctaacctatattcgaatcaaatgacacgtcatcacttgggtgtctatttgtccacagttgaaagttataagaagcagacaagtgtctcataaagacatcgagatctgattcggttctcaggtacatacagttaatcgggagtgttgctttcccctagaactatggaggctactatttaagtgtcgttgtgtaacaaaaatcctgtgtttacttgcattacttaaactcctttactttaatagttttatatatgttttcgacctccctttttcgacggagtggatcgctatgacatgtaggcatctgattgtatttgctaatctgtttttgttagtatgttaaatttttaacccaatatatgtttatagtgcttatatattcttactttagttacatatgaatatatgatcattgatgaattaaacaatataatgtaataattaaatttgatttccctgatcgaattataatttatatgttttgtaatacgaatcaattaaaatattttcttgttacacattttgataaaatgtcgtagaacgttacttaaaagtaatgatgcattaacaaaatgtacaacatatattataaaagttatcatcaatattataggcattcgactttcagaatgtgtatcaataatcgaagtagtaatggaacgattattgaaagtatactacggtctctctttacttcatcgtggattctcattaaaaacaaaagtactttctctaccggcaactattgaaagtatattattgtttttaataactttgatagtgtttcttaattattattcccaacgtacgataaaattttgtttgataaaactcacaaaagtttagtatatttctgtaaatatatgcatagaagtcatagtgattgacagaggaaagacgtctctttgactactcttcaatcgaaaacaaaatgtgctaaaatttcaaaagcaaagtccctaaactcgcctaactccatttctcatttgactttgccttaaatgtcaatagtcctatgttatttagctacattcaaaattgggaattaagaattattttagactccatatacttagaaacgaatccgtattggaaactaatttccatttagtaatagtatttaagtattattatgcttaccgagtagcatgtagtagtttcttaatgttagctaatttcaaagcaaacgacgaatattaaatcgtgattgcacacaacaagaagtgattaataaatcattaatttcgcccatagtaatcactaaccagagtaattttgaacaagactaaggatgtacaataacttacgtctgcgatactgtgtggtaataaatatagaaactttatgaaatagaactctcttaccaaagaaagaaaaagcaagagtgcgtgttactatacatctgaacaagtcaaagggtcaaaccttagtattttaaaattacacaaacaattgaccaaatggagagctaattatgtttagcataatttactatatagttgcaaaattccactttagaaacagaataaaaaaataaaaattgaacataacacttatgccgtgttccagtcactcttcaacattctactcattttcaaatatcctttttataaaatactacttttaaaattatttgattcttatgttccttcactatatatatataaatatcgcacattgcttaatcacttcaaatctaatccacaaaaccattcacaccatctcatcttctttctctctatctcttttcctttcctcatttaaagtttctttataagaa

SEQ ID NO: 11197 - DNA, 3000 bp, Unknown
  misc_feature (1)..( 3000): cDNA_ID_1807651_gDNA_ID_2214483_Annot_ID_133303 3000 nt of promoter + ATG
aaaaattgaacataacacttatgccgtgttccagtcactcttcaacattctactcattttcaaatatcctttttataaaatactacttttaaaattatttgattcttatgttccttcactatatatatataaatatcgcacattgcttaatcacttcaaatctaatccacaaaaccattcacaccatctcatcttctttctctctatctcttttcctttcctcatttaaagtttctttataagaaatggaagattacgagcgaataaactcaaactctccaacacatgaagaagattctgatgtacggaaaggtccatggaccgaggaagaagatgcaatcctagtcaacttcgtctctatccatggcgatgctcgttggaaccacatcgctcgttcctctggtatcatcaaaacatcaatctctaaatatacatatacacaaaggctttatatatagataaacttatatatattttactcatatatgtgcagggctaaagcgaactggtaagagttgtagattaagatggcttaattacttacgtccagatgttagaagaggcaacatcactctcgaagaacaatttatgatcctcaaactccattctctttggggcaataggtacacactatatatctcaaatgttaatattttgctattctatatgttactagttaagtatgttattaatatatgtcttttttttcaattgaatatataaggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaaggaaatatacgattactatacgtaacgaggaattcaattgcgtcacgtttggtgtaatattcattcgtgcgtgatgccaattttagatacggccttggtatacgaatcttgacttaattattatcttttcttttcctctcttgttttaatcccctgattaaattaagatttgatcatcagacgaggatatttgtgattcactgatttgtgatattgatatatgtgaattatttgatataacgttttaaaaaccaacaaaaaaaaaaaatcattccaaggaaaagttcttaattttgatactcgaaaagagcgtagactgactcgaatcagttcatattttctttggttcgttttatttacgacaaaattcactaacaaaaattaaaaaacgacaaaacgaaaatatgactaaatttatttttttgacagttaaccactgattattggttcaaattgtcacaacacatgatttatcttgatagaaatttagtagtccagaatgctgcatggttgatcctaagaaaaacaaatcatgcaaggaccaaggacttacattacttaattatacttaaacgctttataaaattcacatcaagtgattcctgacgatgatccagtaaaacccttcatccatatcgttgcttccacacgtagtttcgataataaactcgtgattatcgccaagatgcgatgtatcaaccactgaaattctcttccttgtcacgttttcgtctccgacgatatttctgtaaagtttcgcagcagacgaagaagaatccgatgtctccggctcgtctttaggcgtaagacggcaactcatcagtgctctaaggagcatcactatcgacgccatgtgtctctgacgtcgtaggatgctttagttggctttatctcgtatctaatcactttcaacatttaagacacacacaaaacatatgtatatatattgtgtgcatgcgtttgtgtgtgagcttgtgtcagtgtgtgtaatagtcttaacaaccattgtcgagtgttgaaagttggaacaagacagcacaaggaggaagccatcatgcatcgaggggatatctagttttggtaagttttaatagtgaatatactaaatggcccttgaccgattgccaacatagagtctacatcagtagcgaatcaaaggtattatggtctttactcatggttttgacgtggaagagacaacaaatagaatagttcatcttcagcaagaaacaatgagaggagaagagagaattttgaaaaaggagctttaagaaaaaagtctgatctaatccttttatcggtcaacgattgttggacaaccttctagattcctcttcttttttgggtaacttgagcattttggtcagtgaacctgtaaacaaatatttagtgtttcttttgaaaattatgtttttgtttatataataatccaatagtataagtttctttctagtttctacagcctaaaatttgattaatttataatcaaattaaccacttttaaagttttgatttttttggatggtaacattagaaacgatgacatattaacgaaacttgtagctacacataaactgctgaccgatcccaaaggttgaaagattctttggcgctaaaaaatccccagttcccaaatcggcgtcctcgtttgaaaccctaattcctgaatcgaagcagatcctgatcgaatcgaaggtgttcgaatgatagctacccagtaaattcagaaccctaattaaca

SEQ ID NO: 11198 - DNA, 3000 bp, Unknown
  misc_feature (1)..( 3000): cDNA_ID_2701905_gDNA_ID_2214483_Annot_ID_133304 3000 nt of promoter + ATG
cttcttctctttcccttttctacttggttatccagtttatctgattatttctggtgaatctgtcaaattttcagcttcatgtatacttgagaacctatggacttgaacaaatggtccaagctgcaagctctgctgttggtcttcgaacgatcaagcgggttgagcagactctgcaagatctcggggtttgtctttgcttcttgttctgtttaactctttctatttgtctatctcatttgcttatctttccccattgattgatgatgagacttaactaatgttataaaaggcacccgtactgaagctagctttgaatgtgttctatgtaattagttgggattttggttcgggtagaggctagtaggttcttgtcagtttatttgattgtagccactcttaagatttactaaatggattttttgagtatatagagttttctgtttacaggttaatttaaagccaaaggttcctaccaaaactgtatgcgatgagcatcttgagctaagaaaagaaatattaacactactgaatcttcagaagcaggtaaaccatacaatacaagtcttatctcacatagattcacaaatatacagctatttgtttatttaacttgttgccaaaacatggtggggtcgtaacttcagctgcaatataaggaatcagaaggttcatcacatcgtgaagggtcgtatgccgcaatgccagacactccaaaggtgagcaacaaactttgtttattggttctcgctacagtttcatcttcctgttgatctctttaatttctatatatatttgatcaggatcgtgttttcgcaccggacccattcagttttggaggtacattatttccttatcttgttggtttcagcattgtatgcactacttaaccatctctaagttcattttgtgtgtttatttcagctgaaagaccaatcaagaaggaacaaaaacgcaaggtggtgcacatcagagtttgctcttctttatttttcgtaccaattcctccgaaaatcctttgcatctacatgtaaaacttgaatcttaattaaaatatgtttgggaatcctgcagggtcctggaagacaagcagatactccttcaccagctcataagcgtccgagaaagttgaaagcctctgatctctaaaatctctctactcggtgcatactgactcgcaatttcatgtgtatgtatttgcctttttccggtgatttccgcaatgttttcagttcttaaattatttctgatctctaaaatctctctacttgtactcagacaccgcactatcttgtcaagccaattagagaaattgagaaaatgttgcacattatatttatgactagtaagaattattacatctaaagacattttcgaaaatgttaaattacaaatggttgattggtatgataaagaaaagaataaaaattaattagatagaagagagagtaaactatcgaaataagaaacacaatatcaggaggtggaaggcgaggagacacattcataagaatgtagataacagggagcttgaggtgggtagagacagagaagaagacagttgacaacaattgttgagtcttgaaggagtctcgctacatacatgtaaagaaaaacaaggattactactttatttcttcaaacttatagattcttctattgataggcaaaaatcttagcttcaatgtgtttatatgtatgccaaaactccaaccaaagaaagaatgtccatactttttctctcaacttagcaataagtcccattatacagtgggatttaagattactgaaattttcaacacttagaaatcttgagtttttagtatactaccaattagaccaaaaaataactaaatttgttccacatgtgacagaggtatactagttattataatcaatatcattatcaatattaagcacaactacattcgaatgactaacagagattcctacgaaaaaacaataatctgaagcaatagaagtaagagaagcaactatacatttggaatcgaatagccgatatgggaatccgccacagattctggagaagaatttgcagtttgtcggagagagcttttgattgaagaaatcagacaaaagttttggaggagagatctcgaaccggaacaaaaagtttacattagtattgaaattagaactaatttgcggttcggtttacactgggctaaagaggaaaaaaaaaaattcacgcgatggtgattttgaagacaactgcgttgataaaaaaaggcatgatttcaaaaggtgaacccctacagaattgctctcacgctctcaacgcgcactttgtgcgagtagatctgaaatacagccttgtgattggctaaaaaactctaaaaaaatagaaatagtagacatgttgctagcttatgttattatttagcttttctacaaaacgccgtcgttttttatttcgatcgtttcagcttttggcattgatccgaaccaatcggttcaactggctaagtctatccacaggtttgtataaaaaatctcatttggtcatgaaattaagcactaaatttatattaattaatcatttaatgcttatagacaaattctatttcatatttctaacgaatcagacctaattgtacgaaataaattattggttctgaaaatatcaattgggaaattaaaacccggttcaatttgaaaccggaaacaagactagctacgcctggaaactctcacacagagtcacaggagaagctcccgcgtctgcaaggaacggataaagtctctctctttctcactctctctcaatgaagaagaagatgctgacgagtcccagtaacgcacttcacagtagtactccacagttctggccagttcgccggagcagactttgccgttcccggaatttccctcgttttcactccggcgaacgcagcagcggcggaggaggaaaattgtgctcgctctctcttctctccggaagtggcgccagtaaattcagtgtcagagctctagttaggcctg

SEQ ID NO: 11199 - DNA, 3000 bp, Unknown
  misc_feature (1)..( 3000): cDNA_ID_2701901_gDNA_ID_2214483_Annot_ID_133305 3000 nt of promoter + ATG
aaattccattcggaaatagagaggtaatttcttcataaagctgtacccttttgatttcattggttgtttcatctggtcaaatttgaattcggagatgattggtaggatttgagacctttcgctctatagtagagaagcaaagctcgctgctttagatgtatgtgttgaacttgttttagcttcttcttaagtttttcatctttttctttctttttgtctactgtgtagattttagttgagactggtctcatggggagacaagcaagttctgcagtcacggtgacagatggagaaactgtaagtgtgctgtttcattcaatttccaaaactttcaactttttttcttagttcctcgagtttgtattcttcagtttagcttctgttacatgcttatctcttaatcggctttgtttcattatctaatctgtctacttgtcattgtagattgtcttcacatccgtttgtctagctgatgttccgagtgagccatcagattttcttcccctttatgttcactatcaggagcgattctcagctgtaggtcgaactaggtaagcgtttttcaattttggagtctcttgctgtaagaagaccatgtcattgcctaaatgatgatctaaatggaccttcttgtggtacagtggtggattttttaagcgagaagggagaaccaaagatcacgaggtatgtactaatgctgtttttggtttcgtctatttcgccatccttcttaacatgttgatttttatgcaggttctgatttgtaggttacttttctttgccttcctgcagcctcctacatcaccggacaggaagagctaaaagcatgcttaaatgattggaaatccaatggtttagtggtgtctggtttggttagagatcagagggagaagttgattcaggaagtgtcttccacgttcagtggcaagctcaacattcttgtaagttcccttctcctgcaaaatgcttgttaaaactgactctagttttttctcagcattgtgatcagaatcgtcattgatcttgaaatagtttattgcattagctctgcatccttataagtttattcagagagacgggagtcgccattagctcaaggatcagggaataatatgggtggttctgtgatgaatggtaatactcctccatcactagactgtcttttatctccaaaatccaaatggatcctcttaattaatgatgagtttctacatcatgaaaattgatcatgtcatggtgtttccagctaatgaatctgtttcacctgtaacctcttccccggttataacttcaacaccgttggaacatacagaggctggaactaaaggaaagacggtccccaagaagacacttcagccaatggaaatgaatcaactcgagagaaggtatcactttaacataattgtcattatttttatttaactctgagatggttcttctttgtgtttaacactaatatgcacagatgcgtgagaagcattatagtgaagataacagtcgtaagaggaaaagaggagaactggagcataattcggacctcaacgagactggtatgtcttaactctcattcgaccttctgaaattcatgatcagcttgcaatgttacaaaggctgagttccattatacgagtaataaatattactatactaaagcaatttcattaattatcttgttaatttgtgcatgcgttgatctccagtgctaccctctgattggactcccgatcctgtgaagaattttgctgctgatgatgatgatgaggaaaccaaagcaaaggatgcaacaatggttctgccttttgtgaagaagtcaccggtttggaagatatatgaatcaatggaggtcttcaaaagagtaccacaaagtcctcatttcagcccattgtttgaagcaaaagaagatttccgtgaaggttttgctttgggtatgatggtgactttttctggggtattagaaaaagtagaagatctgaaaaccgacgttcccatacgccaactaaatagccttaaagactcatttaccgagctagagaagcatggattcacggtcacagcgcctttatctcggatcgccaagctgttagctctcaaagatagacaactaaaaatattggaggaactaaaagttttcgacaaagagatgaaagatgaatctagcaaaaagcataaagctgagcaagagtttggtgagatggaacgcaagattcttgaagtgaaaaacaaggttctggagctgcagaagcaagaagcggctctggaaaaacagaaggatgcaacctatgaaaagatatgtaaaatggagtcacgtgcaagagatcttggtgtagagcttgaagatgtggagtgagttggagacaattctgtcagctccctggtaagttaagaaaaaaaacaaaactataatgatctattctgactcaaaagatttatctgagttcgttgttcgttataggttatgatgtttagcttttaatcttgaagccattagcttaacttcattttcctttttgtggatttcaggtgaaaaaacaaaacaaagaaggaacaaaagcgtaaagggtttataggatcaagatcagagtcaaggagagaagctgacgtggcaaagacttgtgagtgattaagtcaaagagagaagctgacgtggcaaagaaaaatgaagactgaataattaattaattaatatcagtgagagcagataaaaacaattaattaagatgggctcgttaatttaggcccaatagatttctttgtaactttcatcgcgccaaaaaaatgaagaattattcattaatataaagtaattaattaaggagtatgatatgacgacttctcagattcctatgtaaagctaatccattttcagaaacagagtttgggtttctctccgctttagggttttctgtggaagaagaaaaaggcgggggttttctctctctttgttctgaggtttttttttttttaatgtaatcagagtaacgacattggtagtatctgggg

SEQ ID NO: 11200 - DNA, 3000 bp, Unknown
  misc_feature (1)..( 3000): cDNA_ID_1807232_gDNA_ID_2214483_Annot_ID_133306 3000 nt of promoter + ATG
aggttggaaaaatttaatgatacattgtacgttttctaggttttgttctaaatgctcataaacctacttggatttggaaataaatgagagcttacatatatagaacaatactctatttccacaaaaattatttgctactcatatacaaatgtaggtttagaaaaaatccactttagcaaaaagagatgggaaattaatgaaaattcacttgactttctttgttttgtgagcaattttcgatttcaaagtaatggtcggacttagactttttcctgttcttttttgctgacttaataataagctgaaacttaacagttagaagttggaacaagatataaataaaaaagctaagttgtcaaacataaagttgaaaatgatttggtgatgtcaattaaataaaaagttgaaaactaatcatttgtatttgaccggcggttacttggaataagactaagaattattgtactttctatttaatgggtttgctaagttttttatcagatcattttaagcaaaatatcgataacttttcgaagagattagttgaaaatactaagcattatatatatttaaatatgatggatcagtatatatagttttgaaaatcacactgcaggatccgttggaattggtggctgagaacttttatgatcttcttaaaattttaatccgtaaataaattatacgagttggattggttcgcgtcttctaatgcgtattgacatctataataaaagctatcagaaaagttgctgatctttttctgtatcttattaaatatgtagacccgagcagagaaatgtggatcaattaataaatatcatgtacggatgaacaagagagaagaaaaaagtataataatactatagagcgaaaagtattgcatgatggagaaactctcaacaatttcaaacatgaacgacttcttacaaaacaatgtatctttagttgtcacaatctttgaaattctacaaatagagaagacggaaaaagatgaaaatgaaattagtgtttttctttggcaaggtccttggatctcttaaaagtgattagatcaacggtaatgttttagatatcctacatgtgcattgattcgataaaagcatttaaatagtgaatattacaaacaaaaatagatacttacatcatgaaatagaaacaaaatcaaactgggttgctacttaccagtaatcacgtgacggtaactggctaactgcaatagtatatccaaaacaactttaagaaatggatacgaaatgttttagttttgggaaaatgtcaaataaagatttcgtcacaaatccatcaatccagtatagaacacttttatcaaaatgattttgcaaattgattcttagagtacgatacaagttgcaaactggaaaaataattttgcagttgcaacaaataataataaatgattgtgcaaattgattctcaaattaagtaggaaacaagttgtagtagatatagactgtttttacatgatgttaattccaaaaggattcattgccatacaaatggttttctcatagaggacgtaatatcaattaatggaaaatagtagttgaagatttatagaagaaaaaaaaaactttccgcaaacaacactatatatatatatattggatcaaaaataaaaagagttaaatgaaagaaatacacagacctggcctgtatcaaccaactcatatattattatataaaccaacatccatttctcagctcctcatcaaattatcttctttctctttctctctgatcatttccaaattatttctaagctaagaaaatctttaaaaataacaaagcttctaaaataataatccgacctaccggattcaaaccattgatctgaagatcatctataaaccagtccttgatctataaactaaaataaggtcggttgcttaatctttgttacccttttatttttgtggttataattatattatcttcattttgtttccttttatgattaatcgatcatatcaggatagatatttcgttaagtttatagtttaaatccagaattttatgtttagaaaagagaatgggaagagttgaagtgtttaacgtctatgaatattcctcacgtcaagaaaaaagaaaaaaaactatgaatggtcctctctcgatgtccttacattggttagagagcgttgcaactacaatacatacatcactttcatcatatttattgtctttttcagaggttttcatatttcgactgaattcttcaatttgcaatattatgaataatagagaagatgatgaaaaaaggataaagagagtgaagccagggttatgcatgctctcacgtttagggcgtgactctaaactagcgatttagtttacggtattattaaaaataatattagtcacataatatttgtaattttagtcgaaattaatgacagaaaaatactagacgctaggatttgtacttccttgaatccttggaaaatatacgtatgtaattaatattattcattatcaaaccacaaatacggaaaccaagtttgtgtcaaatccaaatggagtagtttggtatcttaggttgttgtttatcataaatgagaaactttggggttgcactcgatcggtatggttaggtggaccggactggtgacaattaatgccattgatctataactgttagattataatctaaaggttccattgcagaacaattcatcaaactttaatatctatgtatttatgtatgttcccaactcacagaatttcacggaattgcaaaactatgataaattctgctaccttaatgaatacactatgaacttgactaaaaaaacaagaataaagtatgataaattccctcattttatatttctcttatctatttcacatttttgcttgaaaatttgtaccattaatctctctattcggcagtgttaaattttattatttaactccgtcggttggattcattttaaatttctcttcagggaagaaaaaaacaagagagagaaatagaga

SEQ ID NO: 11201 - DNA, 2063 bp, Unknown
  misc_feature (1)..( 2063): cDNA_ID_3039207_gDNA_ID_2214483_Annot_ID_183438 3000 nt of promoter + ATG
tgagaataggaaacaacaatacgtaagagttttaataagcaaaaaaaaaaatcttatgtgtgagaagacagatacaccccttacttgttgttgcattttcttaaaccgcgtgagaattataggggtataattgactctttagcggctgggccgacaaatagatcggcttaatttttgttgttttcttacaaattcatatataacctttttaccttcagattttaactggtgataccgtgccgatgcatttttcttgttaaaatctacttttctgaaccgccaaaaatatatataagtgaacgaattcaaatttgcaaaataacacagaagagcatcaaacaagcacactcgtatcatttactttagattaatcaatttaatgctagaagataaacgattttgaattcattcacttaacttcacaaattttgttatcaaacaataaaattgtatacatttcaggtgtttttttttttgtcaaattatttagttcacttattccttaatatatttactgtttctcatcaccttgaggctggccacaaactggttctattctatatgtcaaatttgtacatcggcccatgcttgataaagcccattacactgcatcaacataattacatgggcttgtttgttgttacccatcttgttgaaaccaaagattaattcccataccagcaaggcagcaattttaaaaccgtctaagaaactctcgatcaattcatctttctctcggctcaacgtcgttttgacacatacatctccacatccacaaaaaaataataaggaacgtatgcgagtgacctaagatcatctcagcctcatctaaacttaattgagttttttattatcaatttcacgaaactgcaaatgtaatcgaaccaaacacattatgaaacatatgttgtgtattgtactattcatattcatttatcacattacaatcatcaaccaaaccaaaaacacaaacataacaacaagggacaagaagaacaaacattgatccatacctaaagtttcataattcgaacatcaaaaacatattttttaattatcataagtacgacactcatcagtctcaggattatcattgcaatactcttccaaaggatcggagccaccagctttcttcttgtccctagcatgactcgccgccgcactcagctcctccacctcgtcccaagccgctacacactccccgctcaccggatcatcagcgcatgtctccttagcttcttgtatactcttctccaccttctccgatatctctccttccgatgtagccttaaccacaaccatccgcttcatcgaaccgaatttccacgggtaattcaaccggaccggacctaatacacgagccacaggtcgaacgaccactcgtggagtcgcgacgttgaggccagctgcagctatggttgtcatcgtcggaggattttgatggaggagaaaagttttttgatgtgaagagatgaagaagataaaatatactcgttcacgttattaaactctgtgaacacaatcctcttatcttctaagaaccaagcatattttgccacgtgtacttagattttttcacaaaaagtagtattctaccaatttgagaaacataagtttttccccggaatatttattttatcagccgttgaacattttttcttgaaaattatagaagctttttttttaatttttgactgaaataataaaaatttgttatcattttctcttctgtaattttcatagacataaacttctcatgaaaagtagcataataaattaataattactatatttttgagtatttcattttgttgagaaaaagggggaggacgactgacttataatgggccatattccaggaaataagcgctagttgggccatagataaggcccacataagcagtgaccactaccgatatttttcctgatattttttgttttcctggttaaaaatacatacagatacagtcgtcgttttgattagtgaaccgtcgaatagaaaaagagagaatcattcagagcactttaaaaaggttaaaaaagtcaagtattaaaaaaagatg

SEQ ID NO: 11202 - DNA, 3000 bp, Unknown
  misc_feature (1)..( 3000): cDNA_ID_1807374_gDNA_ID_2214483_Annot_ID_183436 3000 nt of promoter + ATG
agcaactggtggcaagtgccgaagctgctgtagaggaagtcgtcaggcgtggagtaagcattgctttatcctaaatccatcacctcggtattgtatgaaacccaacagttttgaaacttactattgtttgttcttttttcaaggtggctgatcgaagcaaaattgcagttgggggacactcctatggagcttttatgactgcaaatcttcttgctcatgctcctcatcttttcgcctgcgggattgccagatctggggcttacaacagaacactcacgccctttggtttccaggtgccaagaccaattgtctttctcctctcattctctgcattttgatagttaatttacttcgcttttttggttattctttaactatgcctgtaaattttcagaacgaggaccgaactctgtgggaagccactaacgtctatgtagagatgagcccattcatgtctgctaataaaatcaagaagccaatcttacttattcatggtgaagaagacaataacccaggaactctaacaatgcaggttacttcattgatatcacttgaaaggattggttcacaccaagttatcactggattggttctctctaactgtattcatttcacttactttgtataacagtcagaccgattcttcaatgcactaaaaggccacggcgctctttgccgtcttgttgttcttcctcacgagagccacgggtactcagcacgggaaagcattatgcacgttctctgggaaactgaccgttggcttcaaaaatactgtgttccaaacacatcagatgcagatacaagtcccgaccagtccaaagaagggtcagattctgcagacaaagtatccacaggcacaggtggtggtaatccggagtttggtgagcatgaagttcactccaagctcaggagatcacttctctggtaaactctctcaccaccattcccaaacagaaaacaaaaccacaagaattctcacatttgattatacttttttcagagttcccaaaagtggttcactagccacatgcagcatgcgagtgcacttgcagaaacagagagcacaaaaaaaggcagatgcaacacaaacttatttttcatacaaaacattgattcataataatatgaaaaaaagtttttgaattacttgaaatgctggaaacactctttcaagtgcaaaacttcgatcaataagtttcataaatattcaccttttgtaatttctcgaaacaaaacaaaagagattatgtctgaatgaacatcacatctgaatttgttacaaatcccattctcagatttgtttatttcttaagaacccaacaaaaaaaagaaaaaaaagacagaaatggaaatcaaacaatcttcaggaaccagttattgagcggcttaattactcttcagcagctacaacactgatctcacctctctcaagcaagtcatagaaagttctggttttcctctgttcgttccaatggtgcatcttccaaagaccaccagcagctaaaccgagtgccaaaccgataaataactccttgacaacgctaggccctttcaatgtcgcatgtgcaaccttgtgtcctgccatctcttctttcttcttctcaacctaccaaaagtaacaaatgtaactcactaccaactcgaaagattggatcttttttgcatcaagcataaccacaaatcagaaatgtattgatactacatatatacaagcatgacccgttataaagaataaccccaaaaacccaacatgaatcagtcctaacaaacaaaagctagaaatgtaatgaccatataaacctgtgcttaagatatgaactccatctatatactgccaatggattttcctatcttgaggcaattagtgatttgtatgactggaagatcgaaaaacttacaattcaatatcaatgacataaactagcaatctacagcccaatctataaattgacatccttcaatcgattaaaaaaaaaaaaaaaaaacagcctaatatccagaatccgcataacgaaagtttaaaaatcttccctcgaacgaaaatgataaacgttcattactacaaaaccataaagcttgaaattctttcccacaagagaaatcagatagaggaacgatggatcccgatccatgagatcgacgcaataagaagaaggggcattgatgcgaatcggttaaatcaaaaatcactcgttaatttctatctagaagaacaatcgaaacaaactagcaaatctagaaatcaaaagaaaaggagagagagagatgagtctggggatttaccaagtcggagtgtggaggtgtagacgacgaccggaacgaatgaagacgaggattcaggtgtgcgcaagagattaatcaatttaatttagtcactctcatggatcatacattttctctgtcaacctattgggctaacatctgagaccggcccattactgttcaactccagtcaattttgtctaaaaataataatatcatcaaaatttcaaaacacctaacatttgatgcgacccaaagaaagcaaaaccacaaattattatattgacagaaattaattctaataaataagaaaacacgatacaactatattaaaaaaaaacgtgtcaaattgaatattttctcaactgtatgaagtaaatggcccaaatgatattttcagctcacctaatatataaccaacttgtgaatttaaagcttcaacggaaatagtatagggcattaaattggtaaaaaggtacaaacatgaaacaacagtaatcaaaaatacaaaatgtaactattcgtattgaattctggacacagattctgggcccaatgatacattcaacgggccgccaaaactagtgcaaggttgtatgtgcatctaagtaagtgggccccatattttccaaatgttcgctcaccaaccaaactctctctgtatctattccacactttcttaaggtggtcttcctcgcacccaatttattactctctataactgtctttttcaaaatg

SEQ ID NO: 11203 - DNA, 3000 bp, Unknown
  misc_feature (1)..( 3000): cDNA_ID_3039211_gDNA_ID_2214483_Annot_ID_183432 3000 nt of promoter + ATG
acaataagctacaccattatcttccattgtagagcatatataggcatagaaacgctcttcgctcttaacagattacttaactgatgaactgagaactccccaatctccaatactgagaaacaaaacatgtagaatcattacaccaattaagcaaacagagattgtcaatttgaaatccaacgagtgcatcatcagaatctcagatcaatcaattgaacatacaaacaagcactaaactttcctagagatagcggatccacaactctatacgaattgaaaccaacactaaaacgatcgaatcgaagattaaaccaacacagaaaaatacaaactttaaacaatacgatcatcaacaggacataaccaaaaccaagtcaagagagaagccacgaagaataccttgattgctcagcaaagacgaattgagagaatcgagaagacgacgacgacgatgatgataagaagaatcgttgggaaaaagggagaattgaagcaaggaagaattagggttaggggaagaattgggaataaaaagaattaagaagaagaaagcgtaagaagacaagtagtaaagaggtgagagacttattatctcctccttcaccattttttgctatttcgacaccaacaacccacacacaaaaaaaaatataccaaaaaaaaaagaagctcaaagaacccttttttatcgctcttcttcgacagctagaatcggtgagccgactcagagcataaactcgctttccttttttatcggtttttgctaatccctcttctctactctcatctatctctctcgtttgtttctttttttttcttctgctgcgttggttttgtttagacatgccgatgcagcgcatgttaagaagatgcacatcagtgtatgttagcccatgcccctttctgtcatgtcacaaaaagacacgtgtggtttttcttctcacgtgacgccgatgttctgattagttctgatgttattaagaagatgcataacaaaatcaaagaaaaattaattgaacttactatttttattaatattataaatgaatttaattgagccgttatgacaaaacgacggtgttttattgttatagtgaacgttgtcatttttaattaacaaatatattaacaaaaaattaatctttttaataataggatatgttatcccacttaactatatgcctaatattgcgaggttatagtatttatttagataatcaacgaaagtttagtatttatttggaaaatcgatataagtttcatatttattttgtttcatcgaagatttaaatcaacgttttcaataagttgaagatttttgtgacatttttcccaaaatcaactgtatttaaatctttcaaatgatgtttattatgtgaaagcttatgattaatccaacaaattagttaaaatttggtatctaattcatgttaagaatttatcagtgatttcttaccgcttaattggctaactttagctaaagtggcaaaaggactgatgtatataagttgataaaaaaatggatgtatatatacataacataatataaatttcaaacttcgaaacatttttttgaaaagttcatatgataagtggatctaacggttctggaccttttgagacatggccaaaacgttgctacaaagcttcttcataagatcatcaagagacgccgtcggcgaatcaacatcaggaatatccacgaaattatcagaacaagtcgacacatcggagatggctgcactcaataccgaatccaatctcccgtaatctccctcctccatggccatcttcgcatcttcaagacctgagatcaacgaatcgtaattctcgacgcaaacactcatcgcctctttcaccggcatcggcgttttcctatcttccaccacacgtttcgcgtaatccaaagtcgcgttcgctttttttaacagagattcagcttccattcgcatcacatccttaggagcaattcctccgtctcctccttctccttctgcttgtttctgtagatccgggagaatcgcggcgatgcattcgttgttgtagtctgtgtttttgcagagatctttcgccgtcgtgtcgattttcattgacgagaaatcgaatttgtttatatgttcaaatttaggagctagatcagctatgtttgtgacagagtcgaagttgatgtctatgtcttcttgggatggtccgggtgcggagactgccgccgtgggagctaaattagatccggtgttaatgtcttcagaggtgggggatggtgcggaggctgggacgaccgagattgatgatacgggtggttcgatgagcgaagggtcaggtgaggaagcagggacttgggatgtctcttctactgaacggccggtggcgtggacgttggatacgccggagaatgtataacaacaaacagtaactccgatgaggataattgctttgtatggctccattttcttaacaaaagtttttttaattaactggtgatgattaagaatttaaaaggtacacaacacaattattaactatatatattgactggttttaaatgtgtcaaaattttggaaaagctaaattacatgagaggttttaaaaaggtgcgctcatttttgctcaaaacccaaaattaaaccctataattattcttactagtaaaaccattaataatgcataaaaattatcttatctgatctaattattacatgttataatccataaatgttacaaagaaaaaacactaatccactaattgggtggttttacaaaaattgacccttagaaaaaaaaaaaaaaaatgctaaacaaaggcccactagaggcccaaatgtatagacgatgacaagtcggtgaaccgggaaaataattttacttgagattgtttccttcctctccgattttacataccaccgggaaaaaacacgaagccctaaatttcgtcgtaattggcaacagttaagctctttgctaaaagctctagctgagaagcgaaattcgaagtgaagaatg

SEQ ID NO: 11204 - DNA, 3000 bp, Unknown
  misc_feature (1)..( 3000): cDNA_ID_3039223_gDNA_ID_2214483_Annot_ID_183428 3000 nt of promoter + ATG
atatcagcagaatctattatatgttgaatgttctgtcttccaataaatgatacaaaaataaatcttaaactaggatttaatccgtggtacaccacgggacaaatattttttatatatatatatataataatatgaattttacggttttagtttagtattaaagttatataattttatattaatattgtaactaaaaaaattggtgatgataaaataataaaataaatatttaacatgtgttatatcaatccaaacccgtcctgctattcatatcaatctaaatccgtcccgctatattttttgtctcatgattttttaattttttataagtttaaatattagttgttgaattagttatgattgtgattttataccgaaaaagttatggacttttaatttcatggaatattcaaaccaagataaggaatgtttttaggtgcacatataattgggtttgctcattttacgggattgtaaatgtattttggtttgtttcacaatgtttgttttaattgattgccgatatttaatagaaataatttaaatagttcaaattttggttgttttaagatttagtgaatattgtaggtgagataaggagaagataatttatcgtgttttgcgtgacatatgggattaccatatatttcgaatatttttggtttgttacacaattaattgccttaaaaaaatacaaactattaattaaaaaaaattaaataattaaaatccagtgacaaccattgtaaataaatcccaactccatgatttatttcacaaaatggatgcaaaaatgtatatatagatttagaaataaaaaaatggatcaaataaaaaactcaaaattttatgataaaaaaaactaaaagatcaaccaatattaagaaaatatatttagtaataatactatactataatatatagctatgatagtttagtttaattaacggcactgtattttaactattattgatttggcccataattaaaatacttattgggctagaggcaggaattacagttggggctaagcccattaatactagtgggtttaatttggccctttaacttaaatactgtgatccataaactgatatatggttaaactgtacgacgatacagatgatttaggtctctcttcttcttcttctttttcttcttgagcgccggcgaaaaaagtctctgtgagaaaaagatacgacgattgtcattagaagagtcgtattacatgttttgtgcttgaatctaattcaacaggctttatgtaagagattctttaacaattcctataatctttgttgttggattagattcacgcacaaactcgtaatctgtcttttcgatttttaccagatctgtcttcgatttcgaatcgatctcttttgattttggtgattttaagatttagatgttgctttaatttgggaatcgtaaacaagatctacatgtctacttttggaatcattcccttgcgttgatgatttctatcgttttctatttccaaatttggtattacctatgtttggtatgaatctcgattcgagagcccgacaaaaagttatcactctgtttatttatgcatattaaagttttcaagcactcatttcctaattgtcttgcttaattatgctttcttaagactttcaaagactttacttgagttactggatttgattgatgcaaacgacttgtccttaatccatttatgtctgtgtattaatgtctggaatcatatgacagttgttgttattgctttagcattttcttacgatccactggtaaagagaatctctttctcatagtcctgttctacgttctttgttggtttgtttgtccgagaaagcagatcaaaatcttttgtaaaaatattgtgaccaaattaaacttaaacatctttaagtcactctgattgtggggtgtgtctactattaacatttactaggtcaagatatttacttgtataattcaaagattttatatctgatttcaattaattttcttataacaaataccaaggaactcttacttattcagccaggtggtttgggaatactcaatggtagatcagaattttttcatgtctttatggatttactacactacatgaacaataatgttactagcgagaaacgtaagtttttcttgtaacaaaagtataaccaaatatatgaacaagtaaatagttcgttaataatagcattaataaacataaattcatattttagtgtggcacaatctgtagttaattaagagtcttaaaattaccctgccaataaaacggtcaaattacaatagaataaagtggtaattaagaaaaacaaagtacgtagcatcgaatcttcctctctctggctaaactaattcaaagtttcaactagagaggaattaatacgtacaaagtaatgtattaatttggttttaaaaaaataagagtgctgtgtagctttaaaagattttaaagccaaaactaataggtgactttaaaaaaaaataaaaaacaaagagtaaaaaaaaaaagagtgctgtgaaagctttaaaagattttaaaggcaaaaaaatcttgattggcaaaaaaaaactttgaagacttttaaaatctttctaaagtcttaaatgcttctgtcaatcacccccgaaatcgttaaaatatatgttatttagtttaggaaggtagaatatcagaccaaatatattttgtttggtatttttttatagtcaaataaaaaaactccaaatgtttaaacttatttttgttaaaaaattacatttaaattatatatatggaaatatttaatgtgaaatatttaaatatttataagatgatatcataccacatatgtacatatggatcagtgaatgcaaggtaaacacgctcgctctgtgaacagtttaatatataaacacctaattacatttacttagatgtgaattataaaaaatcaattctatacgatgaagagggtagcatcttacaattacaaaattgtgtgtatggtcgta

SEQ ID NO: 11205 - DNA, 3000 bp, Unknown
  misc_feature (1)..( 3000): cDNA_ID_2701945_gDNA_ID_2214483_Annot_ID_183426 3000 nt of promoter + ATG
tcgtctctatttgttctattgtttttttcatataaaaagtgttggttgatgggcttttataattcaaaattcgaagatttgacttactgtatatgatatgttattgtatatcccaatactctaaaatactgaaatgttttgagtaccgtcgcgggattacgtgatatagtggaagactggtgactcggaaccctgtgactcgtgaccggagtgaaattattattattctaaccattgattatcctgatttctcgcttttttaaaaaataaaataattttgtttctcctttaaaaaaaaaatccactatgctattgagatcctagacgtatccaagaagcaaccctagggtagtcaaaaatttaatatatttttttctttttttttggtggaataatattttttttttctgtatcgttcggtgatacgaatctaccttttctaacacctatttattttgttttgaatctagttttctttaagtaatgtaatttcacgactgaactgaaccatcaaatctcaaaagacctctgattaattttcatccatctttagaaaaatagtgaagtttgtttgatgaattgggacaatttagttaatatattggtggtatacagaaaattattaattattaattattttttttaatgtacttgcttctttcttgctcgcgcgatctaacggcagcaagggaaggagggagtaacgaaggatgaagcgtgggccattgaatttgagatagtgccacgtggacagtttagttaatgggacccataagccgacaaaaagaggacacgtgtagaatatatttgcacaaagacgtccgtagagagaaacatacgccaccattgatgcccgtccgcaaaccaacgccaacaccgagccgcgcgtcttttggccgacctttgattgagacgcttttctttattatccaatttcaaaattaagaaataaactaggcgaaaaaaacaaccaaaaatgttttgactaggactgatcctataatagtcaggtcgtagtaactagtaatatctgtaaacttgaaacattattatgaaatacggtcgaagaaaattaaattaaaataggttactaaaaaaaggggggaaacaaaatcatggaagcatgcaaaaggagagctaagtttgcaagcaaattatacgagagtgggtcaccactcactcttgtacaccacacgtgcatgcttcttctttccttattttttgtttcgcaaaatcaaaaacaaatttagttttcgcaaagccgaggtaaacaaattcaaaaaggataaagcaaattatatataggaaaatcggtaaaaaaagaacaaaaagagaaattcaaatcttgactttgtttaacctttagcttttcttctttagtcatcgggatcaccgctgtttataaaaaagatccatgaggcatgcaggagttatactaatccgggcccttcactttgatctattccgattttctttgggtccactaacctttaaacatatggagtagtactataatcttatttatcaaattatatagtatatccgcctacatcaataattggtgctacgaatgtataaaaaacactaatcttaacgtaattaggaaagtagaaagaatattgtgtattacctagtagtaagtatgtgagaaaccgatttgtttgattgaataaaatttaacagtagacagtttgtgatatgcaacctgcaacgtatacatgttcgtggccccaaactgaactaaatattatcataaccttgctatatgtttccacgtatttcaatacaaaaatatacacaatcaacacacatgtatatgtcatagctttgtaaccagagttttacaagttttctgcgttctttggacaaattttcctttcgcttaattattaaaaactaaagtattacttcgttcacaagcaccaacagaaagaagaagaagaatattagacctgcggtgcaggctttttatcagatatttttcttcgcataataacattccaaaagacaaaaagaagatgtgaacacggtccattaaattcggccttttcgatataaatatgatactaatatatgttaattctccaccactttaaattatttattttcataaaaacgtcgaagattttagattcatacgtgcttctttcctgatcaaaagtagtgtcgatcacatttttcttttcgctttacaaatttactactgattattttgtctaataacaacgaaacattaatactacgaaatttcgacataaaaatgattcttgatcacgattcacggacaacggtctcaccgcccacacatgactcatggcttgagtctatatattgaaacaatttaggaaacaataaggacaagtctctttttttgtttaaagatgaacaaatttttgtgttcacattaataaaaactaaaaagaggattcccatgcacacgaaccaacaccaagagcctttttattgtattttaatttctttatttgagccaacaactatttattttcgttcttctttcacactagctctaaaaaccggtttaactaaaccagtcaaaaaccggacgtatgaaagcgttcactgtcttctctgacttacgcgttgaccaatgactacagtattttgaaaaaaccttcgtgtgatataaccggttactggaagtctgtaaccatccgtactgtatatttaacctgctattgccggtcaataaaaaaaaatcaaggaccaccatttaacacagtgcggtgacaaatatcaaatccttgagtcattattatctctttcctctcttacgccatacatttcatctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatg

SEQ ID NO: 11206 - DNA, 3000 bp, Unknown
  misc_feature (1)..( 3000): cDNA_ID_2717174_gDNA_ID_2214483_Annot_ID_183424 3000 nt of promoter + ATG
tgttgagtccagaagctgttcgataaaaagtctcagagacaaaaaaaaaaagaagtatcctaaagaaagcatttttaatgaacaggttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggtatcagcaaatatatccatatcctttgaccatagttttacaacaacaagaagaaaaatcaaatctttttccttgttgttttgtttcttcttttttgatttgctcttgggtacatgcactatgttaatttgttggatctagcactgtcccattgtttcttaatgtttgggtgttagtgtttactaattaaatttactactgtttacagtgtccaaagaaagacttaattgtgaaccaaagttgattttgtgtaaatggtgtttcgtttgcaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaacttatattataaatgtgtgaacttataatttataacacaaaaatgcaccagattcttaaaaaaaatatgtggactagtaaacatgattttgtaaatattaggattggcaaaaacttcttaatcgcataataataatttgtcgttttgtaaattactgatcgtaggcgatttacaacaatggtcgtcttttaaaatttgttatgggctttgcatgaacactatgtcaaagctaggctttgtagttcgtgtttttttttttaattgaaaacttatttgatctatgattctaatatagtagccttctagggtttcaggttaatcaatctctctctagtcaaatacacagtcagttaattgttttttgtttgtttcgcttcgatatatgtcttggaatctggaaaaattaactagtttcatagtaatcaacaagattaattaagcgagataactaaagaggaaattaatgcgaaactggaagcataaacccaactacttctacctactcttctctatgtttctatcgacccttcatgatttctcttatttatttttaaaactttatttaccccttttgttcttgttgctgtttcatgattacactgcggtgaagaataaagacgtatgcactgtgttattgttgttagctattttcaattatttaaaaaaaaaaattcaaaacaaaggagaaaaatttgtcactctcttcactaattttagtcttcttttaaaaagggtttggttaaaatggttgtgaaacagagcaaataccaatcatagctttgtgtcatccccaaagggcatagacttgtggccttgtgagaataaagtagagaaacaagttaccatgcaaataaactttttttgtttcctttttctttttgttacttttgtagccatgtgtgtgtgagaaaatgttctacataacagaacaaggaaggaaaaacaatcttatgaggtaatatcacttttttgtctttttgtctagtgagtgcatagcaacgccattggctttagtatgtttgtattgacctttacggtgagtgataatccctaaccgaagaaggtacataatcattgtcccaaacaaagccacgaatgcaaccgaaagcaaacgtaccaaaactctcgatggcttaaaagtaaatgactaaaagacaaacttaagagacccattgtatcaaagaaaacaactaacaattttgctcatcatgtctccaagtttattccactttcaatatacatttgttagatccaaaagactctcaagccgtaacaatatcattgaagaaatacttattttaccttagcagttttgaatcaaaacgacaatagctactaaagaagaagaagtcaatgaaggtattcaaaccctgatgtcaaactcaaccttggggtagtaaatttcgaattaagtgacgatcaaattcgcagtctcaaatgctttctatgcacttcgtattgcaaatgcaatgcttaaggatacccttaattctatttgcgtcagtccacttttttttttttgttgtattttgtttaagtggtgtaagtgtttttttctctttctattgtaccatatccatccttgtcaaagtaagaggaggctggagaggttctttgtgatcaataatcaaaatgctagtgtttttactttttaacaaacaaaaaaagaatgagagagtcagaaaaatatattcagagaaacatgggctttacatacataggtcggcccacaagggaacttaacgggccttggtgcctaaaacaaatatcaaaagagacaaaaggggttaacctgaaaagtcctcgcgccgctgcttatcgttgagcctaaaatctatctgtctctcgttttgttcgttcgtaatg

SEQ ID NO: 11207 - DNA, 3000 bp, Unknown; identical to SEQ ID NO: 11200
  misc_feature (1)..( 3000): cDNA_ID_3039233_gDNA_ID_2214483_Annot_ID_183423 3000 nt of promoter + ATG

SEQ ID NO: 11208 - DNA, 3000 bp, Unknown
  misc_feature (1)..( 3000): cDNA_ID_2701901_gDNA_ID_2214483_Annot_ID_183421 3000 nt of promoter + ATG
ttggtttcgtctatttcgccatccttcttaacatgttgatttttatgcaggttctgatttgtaggttacttttctttgccttcctgcagcctcctacatcaccggacaggaagagctaaaagcatgcttaaatgattggaaatccaatggtttagtggtgtctggtttggttagagatcagagggagaagttgattcaggaagtgtcttccacgttcagtggcaagctcaacattcttgtaagttcccttctcctgcaaaatgcttgttaaaactgactctagttttttctcagcattgtgatcagaatcgtcattgatcttgaaatagtttattgcattagctctgcatccttataagtttattcagagagacgggagtcgccattagctcaaggatcagggaataatatgggtggttctgtgatgaatggtaatactcctccatcactagactgtcttttatctccaaaatccaaatggatcctcttaattaatgatgagtttctacatcatgaaaattgatcatgtcatggtgtttccagctaatgaatctgtttcacctgtaacctcttccccggttataacttcaacaccgttggaacatacagaggctggaactaaaggaaagacggtccccaagaagacacttcagccaatggaaatgaatcaactcgagagaaggtatcactttaacataattgtcattatttttatttaactctgagatggttcttctttgtgtttaacactaatatgcacagatgcgtgagaagcattatagtgaagataacagtcgtaagaggaaaagaggagaactggagcataattcggacctcaacgagactggtatgtcttaactctcattcgaccttctgaaattcatgatcagcttgcaatgttacaaaggctgagttccattatacgagtaataaatattactatactaaagcaatttcattaattatcttgttaatttgtgcatgcgttgatctccagtgctaccctctgattggactcccgatcctgtgaagaattttgctgctgatgatgatgatgaggaaaccaaagcaaaggatgcaacaatggttctgccttttgtgaagaagtcaccggtttggaagatatatgaatcaatggaggtcttcaaaagagtaccacaaagtcctcatttcagcccattgtttgaagcaaaagaagatttccgtgaaggttttgctttgggtatgatggtgactttttctggggtattagaaaaagtagaagatctgaaaaccgacgttcccatacgccaactaaatagccttaaagactcatttaccgagctagagaagcatggattcacggtcacagcgcctttatctcggatcgccaagctgttagctctcaaagatagacaactaaaaatattggaggaactaaaagttttcgacaaagagatgaaagatgaatctagcaaaaagcataaagctgagcaagagtttggtgagatggaacgcaagattcttgaagtgaaaaacaaggttctggagctgcagaagcaagaagcggctctggaaaaacagaaggatgcaacctatgaaaagatatgtaaaatggagtcacgtgcaagagatcttggtgtagagcttgaagatgtggagtgagttggagacaattctgtcagctccctggtaagttaagaaaaaaaacaaaactataatgatctattctgactcaaaagatttatctgagttcgttgttcgttataggttatgatgtttagcttttaatcttgaagccattagcttaacttcattttcctttttgtggatttcaggtgaaaaaacaaaacaaagaaggaacaaaagcgtaaagggtttataggatcaagatcagagtcaaggagagaagctgacgtggcaaagacttgtgagtgattaagtcaaagagagaagctgacgtggcaaagaaaaatgaagactgaataattaattaattaatatcagtgagagcagataaaaacaattaattaagatgggctcgttaatttaggcccaatagatttctttgtaactttcatcgcgccaaaaaaatgaagaattattcattaatataaagtaattaattaaggagtatgatatgacgacttctcagattcctatgtaaagctaatccattttcagaaacagagtttgggtttctctccgctttagggttttctgtggaagaagaaaaaggcgggggttttctctctctttgttctgaggtttttttttttttaatgtaatcagagtaacgacattggtagtatctggggatggaggaaacgattaggaaaggttctgaagtggaagtgtcttctacagaagaaggttttgcagatgcatggttcagaggtatcctccaagaaaatcctaccaaatcaggtcgcaaaaagctccgtgttcgttacttgactctgttaaacgacgacgctttgtctcctcttatcgagaacattgaaccgaggtttattcgaccggttccgccggagaatgaatacaacggtatcgttttggaggaaggaacggtggttgatgctgaccacaaagacggatggtggaccggtgtcattattaagaaattggagaatggcaagttttgggtttattatgattctccacctgacattattgagttcgagagaaaccaattgagacctcatttgcgctggtccggttggaaatggctccgaccagatattcaggtacgaggttgatgtaatccaagttgggttttttttttccttaattttgttgctttgttactaaagattgaaacttttatctgttgcatgttgtgatccattattaaatccgtttttttttcatgcttggagctgtctctgttttgttgcatgctatgttttgattgaaatggttaaaggcttgatctttgactttgattcttagtgtagactttgatgtttctgattgttttccttgaaggaattggataagtccatgtttagctccgggaca

SEQ ID NO: 11209 - DNA, 3000 bp, Unknown
  misc_feature (1)..( 3000): cDNA_ID_3039239_gDNA_ID_2214483_Annot_ID_183420 3000 nt of promoter + ATG
tttcccttttctacttggttatccagtttatctgattatttctggtgaatctgtcaaattttcagcttcatgtatacttgagaacctatggacttgaacaaatggtccaagctgcaagctctgctgttggtcttcgaacgatcaagcgggttgagcagactctgcaagatctcggggtttgtctttgcttcttgttctgtttaactctttctatttgtctatctcatttgcttatctttccccattgattgatgatgagacttaactaatgttataaaaggcacccgtactgaagctagctttgaatgtgttctatgtaattagttgggattttggttcgggtagaggctagtaggttcttgtcagtttatttgattgtagccactcttaagatttactaaatggattttttgagtatatagagttttctgtttacaggttaatttaaagccaaaggttcctaccaaaactgtatgcgatgagcatcttgagctaagaaaagaaatattaacactactgaatcttcagaagcaggtaaaccatacaatacaagtcttatctcacatagattcacaaatatacagctatttgtttatttaacttgttgccaaaacatggtggggtcgtaacttcagctgcaatataaggaatcagaaggttcatcacatcgtgaagggtcgtatgccgcaatgccagacactccaaaggtgagcaacaaactttgtttattggttctcgctacagtttcatcttcctgttgatctctttaatttctatatatatttgatcaggatcgtgttttcgcaccggacccattcagttttggaggtacattatttccttatcttgttggtttcagcattgtatgcactacttaaccatctctaagttcattttgtgtgtttatttcagctgaaagaccaatcaagaaggaacaaaaacgcaaggtggtgcacatcagagtttgctcttctttatttttcgtaccaattcctccgaaaatcctttgcatctacatgtaaaacttgaatcttaattaaaatatgtttgggaatcctgcagggtcctggaagacaagcagatactccttcaccagctcataagcgtccgagaaagttgaaagcctctgatctctaaaatctctctactcggtgcatactgactcgcaatttcatgtgtatgtatttgcctttttccggtgatttccgcaatgttttcagttcttaaattatttctgatctctaaaatctctctacttgtactcagacaccgcactatcttgtcaagccaattagagaaattgagaaaatgttgcacattatatttatgactagtaagaattattacatctaaagacattttcgaaaatgttaaattacaaatggttgattggtatgataaagaaaagaataaaaattaattagatagaagagagagtaaactatcgaaataagaaacacaatatcaggaggtggaaggcgaggagacacattcataagaatgtagataacagggagcttgaggtgggtagagacagagaagaagacagttgacaacaattgttgagtcttgaaggagtctcgctacatacatgtaaagaaaaacaaggattactactttatttcttcaaacttatagattcttctattgataggcaaaaatcttagcttcaatgtgtttatatgtatgccaaaactccaaccaaagaaagaatgtccatactttttctctcaacttagcaataagtcccattatacagtgggatttaagattactgaaattttcaacacttagaaatcttgagtttttagtatactaccaattagaccaaaaaataactaaatttgttccacatgtgacagaggtatactagttattataatcaatatcattatcaatattaagcacaactacattcgaatgactaacagagattcctacgaaaaaacaataatctgaagcaatagaagtaagagaagcaactatacatttggaatcgaatagccgatatgggaatccgccacagattctggagaagaatttgcagtttgtcggagagagcttttgattgaagaaatcagacaaaagttttggaggagagatctcgaaccggaacaaaaagtttacattagtattgaaattagaactaatttgcggttcggtttacactgggctaaagaggaaaaaaaaaaattcacgcgatggtgattttgaagacaactgcgttgataaaaaaaggcatgatttcaaaaggtgaacccctacagaattgctctcacgctctcaacgcgcactttgtgcgagtagatctgaaatacagccttgtgattggctaaaaaactctaaaaaaatagaaatagtagacatgttgctagcttatgttattatttagcttttctacaaaacgccgtcgttttttatttcgatcgtttcagcttttggcattgatccgaaccaatcggttcaactggctaagtctatccacaggtttgtataaaaaatctcatttggtcatgaaattaagcactaaatttatattaattaatcatttaatgcttatagacaaattctatttcatatttctaacgaatcagacctaattgtacgaaataaattattggttctgaaaatatcaattgggaaattaaaacccggttcaatttgaaaccggaaacaagactagctacgcctggaaactctcacacagagtcacaggagaagctcccgcgtctgcaaggaacggataaagtctctctctttctcactctctctcaatgaagaagaagatgctgacgagtcccagtaacgcacttcacagtagtactccacagttctggccagttcgccggagcagactttgccgttcccggaatttccctcgttttcactccggcgaacgcagcagcggcggaggaggaaaattgtgctcgctctctcttctctccggaagtggcgccagtaaattcagtgtcagagctctagttaggcctgatgataccg

SEQ ID NO: 11210 - DNA, 3000 bp, Unknown; identical to SEQ ID NO: 11196
  misc_feature (1)..( 3000): cDNA_ID_2701913_gDNA_ID_2214483_Annot_ID_183417 3000 nt of promoter + ATG

SEQ ID NO: 11211 - DNA, 3000 bp, Unknown; identical to SEQ ID NO: 11195
  misc_feature (1)..( 3000): cDNA_ID_2701949_gDNA_ID_2214483_Annot_ID_183416 3000 nt of promoter + ATG

SEQ ID NO: 11212 - DNA, 1542 bp, Unknown; identical to SEQ ID NO: 11194
  misc_feature (1)..( 1542): cDNA_ID_3435695_gDNA_ID_2214483_Annot_ID_183415 3000 nt of promoter + ATG

SEQ ID NO: 11213 - DNA, 3000 bp, Unknown; identical to SEQ ID NO: 11206
  misc_feature (1)..( 3000): cDNA_ID_2717174_gDNA_ID_2214483_Annot_ID_133307 3000 nt of promoter + ATG

SEQ ID NO: 11214 - DNA, 3000 bp, Unknown; identical to SEQ ID NO: 11205
  misc_feature (1)..( 3000): cDNA_ID_2701945_gDNA_ID_2214483_Annot_ID_133308 3000 nt of promoter + ATG

SEQ ID NO: 11215 - DNA, 3000 bp, Unknown; identical to SEQ ID NO: 11204
  misc_feature (1)..( 3000): cDNA_ID_2701953_gDNA_ID_2214483_Annot_ID_133310 3000 nt of promoter + ATG

SEQ ID NO: 11216 - DNA, 3000 bp, Unknown; identical to SEQ ID NO: 11203
  misc_feature (1)..( 3000): cDNA_ID_2701929_gDNA_ID_2214483_Annot_ID_133315 3000 nt of promoter + ATG

SEQ ID NO: 11217 - DNA, 3000 bp, Unknown; identical to SEQ ID NO: 11202
  misc_feature (1)..( 3000): cDNA_ID_1807374_gDNA_ID_2214483_Annot_ID_133319 3000 nt of promoter + ATG

SEQ ID NO: 11218 - DNA, 2063 bp, Unknown; identical to SEQ ID NO: 11201
  misc_feature (1)..( 2063): cDNA_ID_2701916_gDNA_ID_2214483_Annot_ID_133321 3000 nt of promoter + ATG

SEQ ID NO: 11219 - DNA, 3000 bp, Unknown
  misc_feature (1)..( 3000): cDNA_ID_2707474_gDNA_ID_2214484_Annot_ID_133324 3000 nt of promoter + ATG
aatatggagaagtcaaacacctaattaataagatatttcttgttaaaggaattgaaataaagtgttaaatacgttaaagtggactaaaaaaaaaaagaaaaaaatcttcttttatatggtaatgtatctgtgaaatctcgttaatatctttacgtagactatattcaaagcttctatgtttactccaacagaacatgaacatcaccttcaagctctttaaaacgccatcactaacttaattcaccactatagaggaatcaaaataacaggaagtgatcaaatacacaatgtatatatctaaaaccatagtgtttggtctctttgttgcaacactcctcgtgtcttgcaatgcggatgcaaacaccacgcagccgcttttcccggcgattctaatattcggcgactcaacggcagacacaggcaataacaactactactcacaagccgtcttcaaggctaatcacctcccttatggcgttgatcttcccggccacgaagctaacggaagattctcaaacggaaagctaatctctgacgtaatctccacaaaactcaacatcaaagagtttgttcctccgtttctacaaccgaacatctccgaccaagacattgtcactggagtctgttttgcatccgcgggtgctggctacgatgacgagacctcactatctagcaaagctattccggtctcacaacagccaagcatgttcaagaattatattgctcgtctcaaaggtatcgtaggagacaagaaagcgatggagattattaacaacgctttagtggtcataagcgcagggcctaatgatttcatcttgaacttttacgatatccccataaggcgtctcgagtatcctactatctatggctaccaagattttgttctcaagaggcttgacggttttgtccgggtaaaatcttgaaatttttgttttcatggtctgggaccagattatttcatggagctatatttgtcgtgctgactctcgaatcttttcttcttgtgtgcaggagctttatagtttaggttgccggaatattctagtcggagggttgccgccaatgggatgtttaccgatccaattgaccgcgaaattgagaaccattttgggaatttgtgtggaacaagaaaacaaagactccattttgtacaatcagaagcttgtaaagaaattgcctgagatccaagcgtctctacccggaagcaagttcctttacgctaacgtctacgaccctgtgatggacatgatccgaaaccctagcaaatacggtatatacaattttttcccttgttccacaagtcatctaaatctgaaccttactaacttatgcaatatatactcatcgtcgtacaaataaaaacaggattcaaggagacgaagaaaggatgttgcggaacaggatacttggaaacaagcttcttgtgcacttccttgtcaaagacttgtccgaatcattcggatcacttgttttgggactccattcatccctccgaggcagcttacaaatacctagggaacttcatagatgctcagattcaagagtggcttaagacttaagtcaaacttcacgatttacgaattaattaactaaacaatgtattttacttaattagcaactaaacaaatttatggcccttaaaatattcaaaaaaaaaaatgtcaattttcaggcaacctaatttaatacgagatgtacttgtttgggtgtgagttaagtaagctactgatttttcaagttgaagataaacctgcttcctcccaattaaaacacacatttacttaaatattgaatatgattataacattattaatatttttttgaatgtaaataagtcatattagttagtacttaatagcttgatcatccttaatccccaactttgtttcaacgttgaaaatagctccgcgtgcacctttacaagtttagtatcgttttacttacaaagtttatgtagcagaggtgtcaaatttaggcgtcgataaacatctaatgtatatttatctatataaacgaaattgggatatagaagtgagggtgtgagtgagaccatggcccatggacgtatgtagtgtgactcaaaaggtcaactaacaatttatttaaaagtaaaggttagttacttagttatagagttcaataccaaatccataccacaattttcaactcccatcgaaccacttctttcattttttattttcattggctggttttgtattgcaaccgctattatgctgcgcgactcattagctaggttttctagtttacgtataagaggatatgcagaaaagaacaataaagataacccgaaaactttattgtattttagtttaggactaaattaatttgaagaaaagaagagaatattatctattttaggatataatatagaagtacgtaaattaaatgtatacgccataatgccaagaataataaaaatgaacttatgcaaattaattttaaggaaaaacaaaaaaaaaacttatgcaaattaaaaacgtgtatcgttgtatgctaagggaaaccgaagaagatacatatgtttgaacgtaaacattaatttcattagagaagaagaatgtgaagatcttctaagtgctccaacttaaagaaaaacatcaatttaaatcttagttaataaatatcatttttagctaattcttcccaattaaaacaaacaaagtaaaacaagaaatttttgatttgcatgatttttaataatcaaataataaaggatcctagtttcgaattagtctagtgggtgtaccgaatcaacttaacccattgtgagattttcttttttttctccctcctgctgactctaaacctaatattagtttccactttggtaaaatataataaattgtttaattgctaacgaattcacgaagacctctgttgtttcccgcttagtgtgtataaataccactccttccttttctccaaactcatctcacaaatctccaacacagagagcttctcacagtgaagcaaacaatg

SEQ ID NO: 11220 - DNA, 3000 bp, Unknown
  misc_feature (1)..( 3000): cDNA_ID_2707482_gDNA_ID_2214484_Annot_ID_133327 3000 nt of promoter + ATG
cttcattcagaatctcccacacgagacaacaagcatgatgctacagcttctcttcgaacagtaccctggattcaaagagataagaatgatcgacgcaaaaccaggaatcgcgtttgtagagtacgaagatgatgttcaagcttccatagctatgcaacctcttcaaggtttcaaaatcactccccagaatccaatggtcatctctttcgccaagaaatgataagagtcttgtttttgtttgtttgttgtcctttaagacgatagtactggaccaaccaaacctggtgtgtataaccaaccaacggttctattggttaacggattaatccggttttggtttaatcattgaaagagacccttgaaacgcggtttcacacttgacgatttatcacaaattaggagacgactcatcaaaaaagaatatcttactggtcaaccattttatagaaatattaaaatcaaaaatgatatttaggccaaagtagaaaaagacaagaagagagagaaacaaaaaaaaccttgctcaatacgccaccgtcgtcgtctttaacccaatctaaaagcctctgttcttttttagttttatcctctttttcatttcaagatcaatttcataaaaaagtttccttttttagcgaatcctctgttttagaaatcttaaagttgtctcctttattaaagaccatcatgtcttccacttctttcaccgaccttcttggttcttccggcgttgactgttacgaagatgatgaagacttgagagtttctgggtcgagttttggtgggtactatccagagagaaccgggtctggtttacctaagttcaagacggctcaaccaccacctcttccgatttcacaatcttctcataacttcactttctccgattaccttgattctcctctgcttctcagctcctcacacgtaataaagcttccattttttcttaattttcttctatttattgcagaaatgaaaaaaaaaaagacaatcttttgatctctggcttgtgttttgtcttgtttacttgcagagtttgatatctccaacaacaggaacgtttccattgcaaggctttaatggaacaacaaacaatcactcagattttccctggcagctacaatctcaaccatcaaacgcttcttctgtatgtgtttccttattagcgttttgaaacatcttcacttgctttgtattgatgaatcaaacttagtttcgttttttgttattttccaggctttgcaagaaacatatggtgttcaagatcacgagaagaagcaggagatgattcctaatgagattgcaacacaaaacaacaatcaaagttttggaacagaacgtcagataaagataccagcatacatggtgagtaggaactctaatgatggttatggttggagaaaatacggtcagaaacaagtgaagaagagcgaaaaccctaggagttacttcaagtgtacgtatcctgattgtgtttccaagaagattgttgagacggcttctgatggacagatcactgagatcatttataaaggtggtcataatcatcctaagcctgagttcaccaagagaccatctcaatcttcattaccatcatcggttaatgggaggcgcttgtttaatcctgcttctgttgttagtgaacctcatgatcaatcagagaactcttcgatttcgtttgactatagtgatcttgagcagaaaagttttaaatcagagtatggtgagatagatgaagaggaggaacaacctgagatgaagaggatgtaagtagttttttttaattagtggaagcaaaaggtttcttcttgggttttggaaatgacatgttttgagttttgtgtaacaggaaaagagaaggtgaagatgaagggatgtctatagaagtaagcaaaggagttaaagagccaagagttgtggttcagacaataagtgatattgatgttcttatagatggctttagatggaggaaatatggtcaaaaagttgtcaaaggaaatactaatccaaggttgtttatacaaaacttagtttctcaaattgttaacatgtttcaagtttctaatcctctctttgttgtaacaggagctactacaagtgcacattccaaggttgtggagtgaagaagcaagtggaaagatccgcagcagacgagagagcagttctcactacctatgaaggaagacacaatcacgatatcccaaccgcgctacgtcgctcgtgaaattattgggacttagtcactagtaatatgatttaggctttctaaaaacaaaaaatcttactatggcttatcttttgtgctcattcacagtttgtttatttgtttgttacacagtcaatactttgttttgtacagagtggtgcttagtagtgtttttattattatcttggccttatagaataacctctcttctcatctgtgtgactttaaacacttgagagtccattttatagttcttgtgtattggtcttttgtttgatttatgtacatttttaatattcaaatttgataaagcaataataatggtttgtaacccactttgcttgattggtgcaacacatctagcattctatctccacattgtgtgagttcattttatttattattagaacttagaagtgaaaccaaaaccacaaatttagaatggttgagattatgaggaaagatgatcaaccaaacataataatagaaagaaacaataaatagaaacaacaaatataggctcatctttcttctaccttctctcacatacctctatctctctctctttgatctcaccaaagtcgaagaaccaatctatcttttgtgtatttactgataagaagaagttagccttcatagccacaagtaaaaacagagtcctctgttttcttctctcattctcccttacattttctcatcaaaaatgaaaacataacattgatagtttcccaaacctagtctctctccctctttctactcgctttcttcgttttactgataaggaaaagactatg

SEQ ID NO: 11221 - DNA, 3000 bp, Unknown
  misc_feature (1)..( 3000): cDNA_ID_2701968_gDNA_ID_2214484_Annot_ID_183463 3000 nt of promoter + ATG
atgtttagtgattgattgcataaactgggtttggttggtaggttcactgtaaacccgaggcggagaataaggcagcacaatggagagatcactagtggtgcttggagaacaaagaagaaacgtccatgggaaatggttctctgtatctatggtttccccaccaatgtctctgcccttcaggtccttttgctaccctaaagcaaaagattccttgccaaaagattctgtttttacttcttttgttctccagttgtggcctcgctcttgaatgttttgctaacgtaaaaaaaacctttttgcagtttgaatgggcttggcagcatccgagagaatcggttgcagttagagaagctgctgcggctttcaaatccttctctggggttgctagtaagatcaagcttgtatatacaatgttaaatcttccagcttggaataggtaaggaagcttcttgttgttgttgctatgctttggtatccattttcttataacttatatgtctctttgtgtcttgttgatcagtttgaacctcacggttaattatttctcgtcaaagtatgcacaccacggtggtaaatctccaagtttacctttacatatgaaagttcaagtttgtgctatggaggatcttcagtatttcacaaaggtagatgacagttctcaacccgaagatgaagagagtcccgaggttaatgaagaggatgatgatgatgatgatgatgatagtagcaacctaagccagcctgggaattcaaatacaagctcatcggatgaccggcattttgaaaaagcgaaagaacctgtaactgtatttgatgaagaagacagattagcaaatttcagtggttttggcttattagatgaagaagagactgttgaagatgaagtatcacatatcactgttggatccattagagctactgagaaagaacccgagactgtattcaatgacagattagcaagtttcacttgttttggcttagtagagattgttgaagatgaagtatcacatggaactataggatccactgaagctatggagaaagagtgtaggaaaagaaggaaccatatcacctcaacgacgactgaggttgatgtagaggtgatagatctgatgactccatcaccaagctgcagagctggatcatctatgaagagacgaagagtttctgagtttatagatttgactatgtctcctaatttcatagagtcgtagaagtaatacacgagaatttgtgtgaaaatcaaaatcaactttgttgtaattttcttttatatctaataaaagatttcaaaccttttgaatctgagtctctcatcttcttccaagagcctattcatgaatcgttttttcgtaatttctaacttacgtcgcaaaacttaggttcttaaacgacacttaatttaaaacgggggagtatgtattttgtgttagtgtatatctgttgtcactttatgatttcaaaagtataatgaatattgttgttgattaagaaagaaaaatccatattgttagtctccaaatctccattattgcgtaatctaaagttacttagtggtgctttctagtttctagttgcaccaattaagattcacctcaacttttggttctcaacagaattgacacaacttctgcgaatacatgttataacaaggcaacaaaccctttcgtaataatactatttcataattattttagttccaagatatatgtccacatgaacatcaacatttacacttgagaaaaggaaaattcgtttaccgattatcgaagagtgtgaaattgatgagatcggcagtgtccacatgttctcgatgttgattgttgactttatatttttgttcagtcatgcatatcaaaacgtgagcgtacttgacactagagaaaaagaaaattagcacgaacaatagttttgcaatcatggtcaatgatttaaactataaactagttaagcatttaatttggggttttagatgtaaacatccttcacgtgcaatcacatgtccaatagtatgcatttctttcttcttttgtaaccattgtcttttgtatatatatcgtgttagattttttctacagcttgacatatttcacatttagtagcaactaacacgtgaagaggttgaccaaagataaaacaacgaaaaaagttcgttgtcgcccattttaacatataaaatgagtaatatttatagcaccaaaattagtctttttaaggattaaaatttattttctacgggtactattgctagttgctacgtttaaaccataatctgattgagtctgatcaaatcggtatggttcatcgtgattgtagaaaccttgtgcttgctcaaatacaaggactggtacaattgcgcaatgttttgtttaagtttttttttttaatcttcaactaactttctttaaccacctactctaatgtttatatatattatgaatgttttgatcgtgggtcgaccttatttaaattaaatcaccaaaaaagctatattattatggtcttcttcaaccacatatcttttagtatcgattgttgtattttttagtaacaacatgcaatatacaataacaaaagttacaaaacttacatatataaaccattaagctacaaaattttggtccgatactacttatgatctgttccaaatctcgagcttactcataactcgaatattgataattaataccttaacgtacaagagcaggacagtaagacttctttaaacatatagtatacaatataattaagtatagaagtctatagattttcccttttaaataaagaaagatcatttaattcaccctaatgactctccttattaaagaaactcttcttcttcttccttgcttctcttcctcctcctcctccattgatactctaaaataaacttataaatagcatgcgtgaatgtcccgagaaaggtaaaactaaatcaacatatatacatctatttacgatctttttgattgataaatcaaatcggtggtggtgaaaatg

SEQ ID NO: 11222 - DNA, 3000 bp, Unknown
  misc_feature (1)..( 3000): cDNA_ID_1807086_gDNA_ID_2214484_Annot_ID_183462 3000 nt of promoter + ATG
gattttcccttttaaataaagaaagatcatttaattcaccctaatgactctccttattaaagaaactcttcttcttcttccttgcttctcttcctcctcctcctccattgatactctaaaataaacttataaatagcatgcgtgaatgtcccgagaaaggtaaaactaaatcaacatatatacatctatttacgatctttttgattgataaatcaaatcggtggtggtgaaaatgattggaaacaacagggaaggatttggagagtactacgagaccgtcaagaagataaagaaagatccagccttcgagacaacgacggatcatgccgtgatgggaatcaggagacatgtggcggtgcctccggggacaacgttgaacaccgtaacaccatgcgccgcttgtaagctcctccgccgtcgttgtgcggaggagtgtcctttctcgccttacttctcgccgcatgaacctcacaagttcgctgccgttcataaagtctttggtgcaagcaacgtctccaagatgcttctggtacacatattttctacattaatgaatatttattttcttttcttagttaaggtttcttaatttgattactcttttgatatcgtatttgattaatctgaatatatagttgaacggatctaccatttttgatatttgactctttccaaatatattcaaaacatatatttatcccatttgttatagtcgaggtggtttatctaactagtataggtagaaattcattatcctaagatgcacatacatactaagattgagtattggtaagttatttacttttcgtacataatatttgattgagctatatgtatattaacttatggaataagaaaatgttgtaggaagtgggagagagccaaagaggagacgcagcaaatagtttagtatacgaagcaaacctaagacttagagatccaatctacggttgcatgggagcaatctcagctcttcaacaccacattcagtctcttcaatccgaactcacgaccgtccgtacggaaatcctacgccacaaataccaagaagccaccaccatcacttctctccaaaacaacttcaacagcactacaacaacttcatcagtgagttgtgatcagcatgctctcgcctcggcgattctcctcccaccaccaccgccaccacctcctactccacgaccaccaaggttgttgtcctctcagccagctccaccgcctacgccacccgtttctttgccatctccgtccatggttgtgtcgtcctcttcatcttctaattcatctgccaccaattctatgtataatcctcctccatcttcgacggctggatatagcaattctctgtccagtgataataatgttcattactttgattaaatcagaattctgtgttccttaatttttttaaaatactattatagcccttattataagctacgagattgaatggtgatccatgttaaagatagggttttcaacttttgatttattttatttttcatattgattaatgggttccattaccatactaacgtacgtaaatacaatggtaaagaatcttagtatcatgagggtattactcatgactcatatgacaattttagtaaccaacacgaagttgaaaaaacatttacacaaaataacacaattccacattaaatcagaatcagaaatctaacatattgttagtcctgaaaattgagaaattctactaatgaaattatgagcttataattattaaattacatgagaattaacattaaatggaggcgttgactaaacatataaatttggcaacgagcattcccacgtacctctaattgtcattaatatataaatattaaatatagtttttaattaaaggtattaattgatcaattaattaatcataacccaaacagaatctatttatatcccataacagagttccagagtcaccacatgacgcaattacatacatatagtactagtatttcttgattacacagtgtcccacaagctcttaataatttacattaatgtttcttaatctcaaccattacctacaggctacagctcatgttttgcttgttaacatacacaatgtattctatatacatgtatgcagtatgtatatattttcttagatttttataaatactattttgtaattctgctatataaaagtataatatatgatatatccatcaatgtataactaaaatttgttacgaaaaaaatcttttaaaaaacactagaagttttttttttaaaaagacttaacaataaaactttgtagattttagtgagattcactgaagatcaaacgattttcagttttttttaaaagaaattagtaaaagtttggtactgagaaaatgtagctcttaaaaaaaaagagagaggattggattcaccattcacaaaatggtaaaaatactaaaactaaagtgaaagagagaaagcaatattttcttcttaacacatctaattgcacaaatacatgaaacaacaattattaatcttcttaactctaaacaacaattttatcttttaaaatatgatttttaagattatcaaactttgatacaactagttaataactctacttcacattgctcgttagcgaatctactcacaaatattcagttttgggcagcaaaattcagtaacattcaatttaaattcatcaagagggagggcaataagataacacatgatttggcgaaatttggttgtaattcatcttgtttttattctgattctagaactcttcctagttggcttcaaaaacatcactgtaacaactctatttaatcaatgaatttgttttgacgtaaaaaataaataaatatgattttaaagataattagtagtatttaagacgaaatgcgtgacgtttcatggaatcaaaacggcgcgtagtgcaacaagtatatggttaactgatacgccacgaaatagtcggggataactaattcaatcgttaccgaaccaattcaccggcgagagagaatg

SEQ ID NO: 11223 - DNA, 3000 bp, Unknown
  misc_feature (1)..( 3000): cDNA_ID_2701975_gDNA_ID_2214484_Annot_ID_183460 3000 nt of promoter + ATG
gctacggggatttatgcggtggctacgagtcttgtctcggttcctgcggttttagtacttgtaggcattgctctgtttcttcttgctcctcttgctataccaattggagttggatttaaagagcttatgtcctctagaaaaactcaacaaaaggtgcacgatcttgaagctcctgtcgataaattttatttcgtagaagaagatcacacgaaagaagaagaagagtttgagaaggcaataattggagttaaagaagaggtcgagtggacacaactatggaagaaactcgatttttggatatactttggactctatttgttcggtccaacggtcgggctagtgtttacgaacaatcttggtcagatcgctgagtctcgtggctccaccgccaccagttccttggtcgctctctcgtcgtcgttcgggtttttcggccgcttgttaccatcattactcgactacttcttttctaggtaaaaatcacttactttttttttacccttttgattaattagcaagatactaattaaaacctaatcaattaattccttcataatacaactacgttgacctagcacgtataattataacatatgttgcattctttgcatctatctacgtgtttggtctcattcatcgaacaaccttcgacaaatcgacacattctttataatcaatctcctaatttataggaaaaaaacaatatttattctaacattttatttttctttactacaggaacaaatacatgccatcaagtccggtttctatggcgggttcactggtagcaatggtagcttcgtttctcctcctccttattgactccgacattgctctctacatcggcacggcgatgattggcatcttctccggagccttgacttcactctctgtcacaatgacggcagagctttttgggacgaagcattttggagttaaccacaacattgttgtcggaagtattccccttggatctttttctttcggtttgttagccgctaaaatttaccgcgacggagctgctctttacggagatgatggcaagtgttttgggatgcattgctttcaaaccactttggtattttggggaatgctttgttcgatcgccgcacttctcgccgccgttttgtatatacgcaaccgcaagttctattcgcagaagccgtagaagaagaagaagaaccaacaacaagaagttttgatggcaaaccgtagcacattttccgttggtatcaagcaacgcaatttttttggtacatccgtagatttttatttaacctatggaaaccggttaaagtgtaaccgacggtcaggtttttgtgtatatagactagtagaggatgtaaaaactagatatagtaacaaaagcatatatgcattgaattattattgatcgaaatttttataaagatcctttttaattattattcttaatcatggttttatttatttatttaagaaatagtgaaatgtattcttaataatgtttgagagcaaatcaaattttgtttttgtttttggctgaattaagctagatcatttatgaatgctggagaatttaaaacgactttgtttgattattaatggaaaaaaggacttgacgaaatttcgggagagtcttattaatatatgcctacataatattctgttggtacgtacgtagttggtgttcttgttggttcgaacgtgggttattatttaactaattttaattgtaatgtgaaccaggttttatgggaccccaacaacaatcaataaactttcacctaaatcaattcttttcattactttatgatgtccagatatttttttattggtaagtgattattagacatacgtcggttttgcgagagtgacgacgtgaacgttttcacccacaaaggagaactaaaccaatatatggtcgagatcaagacatgcatgatttacgcagcatttaagatttgaacttcatacctatatacaatttatgccacaaaacattttcagtgaacgttaaaatccaagtatccaattgttagtataatctagatacacaaacaatgataaaaataacattttgaaattaagaaaggataattttcatagtattaaacctggtgtaaataacttggagatagataaatatatcattcttttaaatttgttgtcatgatcagtggttaagtccacggaacaacttacaataaatgacaccatacgtggctactgaggaggcccggccaattttaaacaagatattatgtatcttaatttgaattggttagtacttttacatgttggttaacgtagtctagactcagagagccttttaaaacaataacaaaattctttaagaaaaataacccaattgcaaacggtccttaacatgtacatgactactagcatataacatcttgacccattgtagtaaactagtaggtataaaataaatattttataaacatcatgatttcaagtgtttatggccaattttcaacatgaatagtttatttgaatcacgtccgtacaatccgtctccaaggaggtaaaatgactttgccaaatatgtagttcatggctcagattaattagcattatttgtcttaacataaaaaaaatacaaaattaatagtagtttaagataagaaacgttatattcattgatttacttaatgcattgtttttaataaaatgttatttattacaaaaatatttttgtattttcaatatgctgatggacataaaacccttttcaaactaattgaccaacaaaaatttatctactttttttttacaaatttagtttcaatttcttctgtttttgaccatactatagttatatctttatttagatcttgttttttctttttatcttttgttatatttcaagaagaacaaacttacaaaataagagaaccagtatggttcaaaaaccaactcactcctacaaaagtcaaaagttgtccttataaattgtgaaacaagaaataaaaacaacaaatcaaattaattatcaca

SEQ ID NO: 11224 - DNA, 3000 bp, Unknown
  misc_feature (1)..( 3000): cDNA_ID_2994242_gDNA_ID_2214484_Annot_ID_183454 3000 nt of promoter + ATG
cctggatccatcgatcattcactagtagtcgcaatggttgccatatttcttcaaggatgaaagtgaaacatcctcgatttattttctcagtgtaaagaaaaatgtaacacagaaacaaaaaggcattttagtacattgcatttttaatgccttttgattcaatcggctcacacgtgaattgtattatctatcacatgaatattgagatatactaaggtctaaggttaaatcttttttcagaacaaatttgcaagctcagctggaaaaatacaacatcatttacattattttaaaaagttgttgaacatttgaatcaaaatgattcacaagacttttgttggaattttgcaataaaaaaattgatctcgagtctataaaagtccaatcccgaccactcattctatttccggttcaattctgtctagccggtcaaattcaaatccggtccatccggtcggctcattcacgttggtacaaaagtttaggaaatcgaaccaacaaactaaacggcgtcgttaaatagtctgatgttgaaacgcagctatttcttttactcttcttcgtctctctcattcccagttcccaccattagggctctctctaaattcctcagtctcgagaatcttcatcgtcttcacgagctcactcgaagatgttaacggcagatataccaccgaatcaatcaatctacatccaaaacctcaacgaaaggatcaagaaagagggtaaacttctcttctcgtttaatctaattcgtcaagtaaatttccaaattcttagatgttgaaacctccatgaacttcctgtaccaatgattcaagcttctacagtactgaatgttagggtttttgcttgtttttagcttatatagagtgttcgtttctaaatactagggtttcagaatcgtattgaatctagtgacaaggttataaggaagatatatatgttggtgttgtctgttttcgccattgtatggataattgttatagacgtgtgaagtagtgttggctcagggcagtatcatcaatctcatgctttatctgacttggtttttgttttctcagaattgaagagatctctttactgtttgttctctcagtttgggaggatacttgatgtggttgctttgaagactccgaagctccgaggacaagcttgggttacttttagtgaagtcactgctgctggtcatgctgttcgtcagatgcaaaattttcccttctatgataaaccaatggtcagtatttcatcactcttgagtatatcaatctctttatagtttccatgaaagtgatcttctatgtgttgtatagatcgatagaagcaaatcgttagtgtgtttgtgtaattgattactaacaatttgttttggaacctttgacctttttctattcccaatccattggtagtcatatatgtgtttagattttgttgctgttgatgagtaaccaatgattagtatccactaccttttctgtcttgagtatatcaatctctgtataatttccctggaagtgatattctgtgtgttgtatagattgattgatgcggtaaaagcagaaatccttagtgtgtttatgtgattaccaatgattacctttgactgtgttattctcaatcaacatttagttatatgtgtgtttggattttgttgctgaccttctcaaatcacattctcttatgatttctgttgtcaaaatgtttgttctgtttgatatatacattgtttttataactaaatcttacctctttcgattgtttgtaaactattcaactacttccaatcaggttgagatttattattattcatactttttatgtgatcttttaagtgcagcgcttacaatatgcaaaagcaaagtcagattgtctagctaaagctgagggaactttcgttccaaaagataagaagaggaagcaagaagaaaaaggttttaaactttatttcttctttttgcattttgtcgtagatgttggttcaatgatacaactataaaattttcacttgcatctaaagttaacaaacttcctttcttactttcagttgaaagaaagcgtgaagattcccaacgaccaaacacggctaatggcccaagtgctaatggtccaagtgccaataacggagtccctgcggtaagtgttcttgttctcaccttcatcttcagaaaaatcttccattgttggatcatgtgaaccaaactattgttatctggagatgatgctgatgttttgcgttttatctctgctcttcttaatgcagccttcgttccagccgagcgggcaagaaacaatgccaccaaacaacatactcttcattcagaatctcccacacgagacaacaagcatgatgctacagcttctcttcgaacagtaccctggattcaaagagataagaatgatcgacgcaaaaccaggaatcgcgtttgtagagtacgaagatgatgttcaagcttccatagctatgcaacctcttcaaggtttcaaaatcactccccagaatccaatggtcatctctttcgccaagaaatgataagagtcttgtttttgtttgtttgttgtcctttaagacgatagtactggaccaaccaaacctggtgtgtataaccaaccaacggttctattggttaacggattaatccggttttggtttaatcattgaaagagacccttgaaacgcggtttcacacttgacgatttatcacaaattaggagacgactcatcaaaaaagaatatcttactggtcaaccattttatagaaatattaaaatcaaaaatgatatttaggccaaagtagaaaaagacaagaagagagagaaacaaaaaaaaccttgctcaatacgccaccgtcgtcgtctttaacccaatctaaaagcctctgttcttttttagttttatcctctttttcatttcaagatcaatttcataaaaaagtttccttttttagcgaatcctctgttttagaaatcttaaagttgtctcctttattaaagaccatcatg

SEQ ID NO: 11225 - DNA, 3000 bp, Unknown; identical to SEQ ID NO: 11220
  misc_feature (1)..( 3000): cDNA_ID_2707482_gDNA_ID_2214484_Annot_ID_183453 3000 nt of promoter + ATG

SEQ ID NO: 11226 - DNA, 3000 bp, Unknown; identical to SEQ ID NO: 11219
  misc_feature (1)..( 3000): cDNA_ID_2707474_gDNA_ID_2214484_Annot_ID_183449 3000 nt of promoter + ATG

SEQ ID NO: 11227 - DNA, 3000 bp, Unknown; identical to SEQ ID NO: 11224
  misc_feature (1)..( 3000): cDNA_ID_2994242_gDNA_ID_2214484_Annot_ID_133328 3000 nt of promoter + ATG

SEQ ID NO: 11228 - DNA, 3000 bp, Unknown
  misc_feature (1)..( 3000): cDNA_ID_2701983_gDNA_ID_2214484_Annot_ID_133332 3000 nt of promoter + ATG
taaaaaaacctaagtcaatttgaaaaagcttaacagagaagtgttttttcttttttttttggtgaacgatatagatttttaaaatatcaaaatcaatatctctgaatttaacataatttcctttttatctttacttaaccgacaaaccattccctatttttaactgataagcggtcaactgataagtgataggacatgataacacagtttacctctaaatcctttagaagaaaaaacgtttcgagaagttactaatccaaccctcctttaaatgcagataaatgtagaaatcagcttaattagacaaaacaatatatttttttataaagtaattacctttcttttcgaattgttgcttgttttgggtgggcaagggactggtactcgcataatttcttggatgagtgtttctttgaatacttcggtaaccatgttatgcgcatgttcttttagtttttttttttcgttttgttctcttatcaagaaacttatgtttagtaaattatattgtgtgactaattttatttaagaaagtactgattcaatattgttgaatttcaaatgactttcatgtgcattttttttcatcttttgatcttataaacatgttttatttgtaaagaaaccaactaacttttttagtatttggcgatactaaaaacttttattacatctcataaatttttaatatgtctcaaatactgaagaaatctcatacttgattaaatttgtgaagtaattttatactggtgcaatgtggggtgactactttaacaataatcgattacaaaagcaatatccaaagtgttacttaagagtcttattctcagttttttatatacttttttactaccatttttagaatcgattattacttatgttttctctaatcagtaaaaatttgtatcgctttgtatcactaatcaaattcggtatctaaactctaaataaaattgttaaaatatgtattattgcttgggtttaaatgagattaacaagtcacttataactaaaagttcagtaaactgtctttagtctcttccatttagatatataaattatgttttagtttatagaatccacaaaaattagatttcgcagaccagatctattgaatggtttaactttaagatattaaggtagatacatcgacgtgcaccaacacgcctacatgaatcttgtattcatatttggcgcagacatgcatgtacatttgctatgtgtacttttttttttctttcatctgaacatgattttttaatttcatttctgcattacgctgactcctgaattttgataaatgtttttttgagcattttatgctcatctataattcaaaaaaacacattacgtcaaatttaaacctgaatgataacacgaatttttttgacaaaattataaactacacaagttccaatttctttctcgattgcatttatagttttaaacttcaactttaccaaatatatatttaataaaataataatatacaaatgcagcatttaaattttcgaaattcaacattattggaaatacttacaacgaaacacgtattctgacaaaaaaatatattaacattttgtatagaataacatggcgctataattcaacgctatatttactcatttatttgtactttacacaatgatagattatattcaactactatttaattaaagtctaaccaatcaattttgtacggcacaatataattattcaaattcttaagatatatgacataaagtgtactaatacagaattggcatataaatatttgatataacaatttaatgttcacacctaaataaaaatgaacgtgattgattctttcattttcttatactacgtttcatgatgaaattaaatgctaattatgtaaaataatgcccttgtttttcggaaacgcacaagcatggcaaaaggtttaggatctaagccgtctctcgtctgcaattgaccaactttcttttgtgacttgatttctacgtgggaaaaatggacaatatattctatagtttaagatgataaaatatttctcactgcaaaaagaatgaataagaacatacgaggaagaatgttaaagacagcaaaaaaaagaaataagtcgtatctagttggttgatatccaactgtcgtttcttcatcagataaatttccaataatttcagacgacaccaactccagtgttactccagttgccatgcggcttatcttcaacctatttttgaaggctattaagtattaacatatttaatatctccaaattaaacatttgctacctaccttaattgaaacattcaaatctaagctcctttgcgatattaattatgacttataaaccaactttaagaaagaaaaaaaaattgtttgtcacacataatattaattgcatgatagagcaatgagagaagaacacattagtgttgggaaagaattttattactctcataagaatgaactagataatcatccacgttgtgtgaggggacaacaaactattagatatttgaagaagttttattatacagaattatatatatatacgattgtaaacaacggatgccattttttcttataaagagaggccatggattatattcttcaattgaaatagagaaacataggagaattgtttactatcatggatcatataactagtttgttaagtttccccttaattataagcatcctacaaaaaaaaggagttttaaggtctatgcgtagactctcgtaggtctcaaactactcctattattagtatagatttcattctttctctcccgaaaaccaaaaactattttttttggatttttgtaactaaattctaaaacagaaacaaaaatctaaaaatcttccttcaaacgctgagataattgctcactgttttgacagtttcaattctttaatgattggtcaagcgaagctttttgaacattttgctggctatccattgatgagtatttcgaaatcaactctcaaaaaagttattgtgtgatcatg

SEQ ID NO: 11229 - DNA, 3000 bp, Unknown; identical to SEQ ID NO: 11223
  misc_feature (1)..( 3000): cDNA_ID_2701975_gDNA_ID_2214484_Annot_ID_133334 3000 nt of promoter + ATG

SEQ ID NO: 11230 - DNA, 3000 bp, Unknown
  misc_feature (1)..( 3000): cDNA_ID_2701972_gDNA_ID_2214484_Annot_ID_133335 3000 nt of promoter + ATG
tttggcaacgagcattcccacgtacctctaattgtcattaatatataaatattaaatatagtttttaattaaaggtattaattgatcaattaattaatcataacccaaacagaatctatttatatcccataacagagttccagagtcaccacatgacgcaattacatacatatagtactagtatttcttgattacacagtgtcccacaagctcttaataatttacattaatgtttcttaatctcaaccattacctacaggctacagctcatgttttgcttgttaacatacacaatgtattctatatacatgtatgcagtatgtatatattttcttagatttttataaatactattttgtaattctgctatataaaagtataatatatgatatatccatcaatgtataactaaaatttgttacgaaaaaaatcttttaaaaaacactagaagttttttttttaaaaagacttaacaataaaactttgtagattttagtgagattcactgaagatcaaacgattttcagttttttttaaaagaaattagtaaaagtttggtactgagaaaatgtagctcttaaaaaaaaagagagaggattggattcaccattcacaaaatggtaaaaatactaaaactaaagtgaaagagagaaagcaatattttcttcttaacacatctaattgcacaaatacatgaaacaacaattattaatcttcttaactctaaacaacaattttatcttttaaaatatgatttttaagattatcaaactttgatacaactagttaataactctacttcacattgctcgttagcgaatctactcacaaatattcagttttgggcagcaaaattcagtaacattcaatttaaattcatcaagagggagggcaataagataacacatgatttggcgaaatttggttgtaattcatcttgtttttattctgattctagaactcttcctagttggcttcaaaaacatcactgtaacaactctatttaatcaatgaatttgttttgacgtaaaaaataaataaatatgattttaaagataattagtagtatttaagacgaaatgcgtgacgtttcatggaatcaaaacggcgcgtagtgcaacaagtatatggttaactgatacgccacgaaatagtcggggataactaattcaatcgttaccgaaccaattcaccggcgagagagaatgaatacgccgatgtcactctcggcggcgcgtggccgtatgctaccttttttagagaaggagaaatcagaagaagagtctgaaactctggaatcgagtctcttacagctaatcgacgacaatcgtcgatcatcgttacagctccgggaaaaaaccggtacgtaaatcgacccattcctcagctaattctgattcaaataatcgagaatgaaaaagtgagattcacagagacacaaaatggaaaacagagagatcgagaaaggaagcaatcaggcacgcggcgagaacggcggatctgctagtgaaggcggtgaacggaggagtagaggaatgtttcgttaacgagaaacggattgagtcggagattaggaatcttgccattacggtggcgaaattcggcaaacaaacggatcagtggcttgccgtcactcacgccgttaatagcgccgtaaaggtttctgatcatctctattttctacgagtcttcaaaatcacgtttcgtcttctttgttttgttcaatgatggatctgtgtgttgattttgttaggaaattggagattttgagaattggatgaagacgatggagtttgattgtaagaaaatcactgctgcaattcgaaacattcatgaagatcaacaataagagcaagttattgtgattcattcacttgttggtgttttttgatagagagttcttatagccattgatgttatataccacttctttagtgtttctctgtttgagtagtggaaatgattggatcaaaagagtttgatagtctactcaaaataaaaacatgaactactcttttggccttgttgggttgtctttgtgagtgttacaagatattttcttcgtacttctcttcttcataggcttgttctttagcctgagtaggattcatcatgtgccttattatcaagacagactctctctttttgacctcttttgctgagtgagtgcggttaggctgatctagctcgtctggtatcatactcccgacctatgccataacattcttttgtttgtcaaaagaatgacaacatcaaaaagcatcttcacctatcaaaatgcagctgagttgttttcctttaactacttttcaaataacgttcttcaaacatgttttcagcaagccgcaagagaaaataagctatttttatgagaagaactaaaaccacagggaggcaagtcactatgacttaagatatataatacatcatcagaaagtttgaatgatagttaagcctcagttagacccacaaccttttctgcgcgagtatctgctaggcaatgacatagaaatgtaagcttttaactgttaagtggctctcttttaacgaccataaatgagaagcataatcatgtggaaaccaaatcaaggttagtaccttcaaaacatgtttgaaagagaagagcttaacgtaatccagtttacaaaacgaaaaactaacgaatatcacgaatagtgagtgtacagcttggcaatttcgagaattggaatctcaacctagataataaggtagagaagtttagatctacgtaggaatcaattgtcaatatgaaatgttcagttctaaaagacgatcccaaaacgcgatcgtgcataggatatataaaaaaaaaactacacgttgatatatagttcagttccaacgtcctgatgttttacaatatatataacaaaaccgtgttttaaattgacaaaacggcacgtagtttgacaaaagaaatcaccggagcttttatgttagcgccggttctagaaacttagccaagttttatttctcatg

SEQ ID NO: 11231 - DNA, 3000 bp, Unknown; identical to SEQ ID NO: 11222
  misc_feature (1)..( 3000): cDNA_ID_1807086_gDNA_ID_2214484_Annot_ID_133336 3000 nt of promoter + ATG

SEQ ID NO: 11232 - DNA, 3000 bp, Unknown; identical to SEQ ID NO: 11221
  misc_feature (1)..( 3000): cDNA_ID_2701968_gDNA_ID_2214484_Annot_ID_133337 3000 nt of promoter + ATG

SEQ ID NO: 11233 - DNA, 3000 bp, Unknown
  misc_feature (1)..( 3000): cDNA_ID_2717194_gDNA_ID_2214485_Annot_ID_133341 3000 nt of promoter + ATG
tttcaccatgttggagggaagatcaaggtacaagatgctcccatcacttgttactcgagcaccagttggcccaaacaatttttgcagcaaatatctcgtaatggcctgtatatttggagtcaacgagttgattataatgatttaaacaaaaacaaagcacaacagagagacagacagaaaatggaaaataagcattttaccccaaaaatcccaaaaacagccaaatgaattaggcatgatatgtactccaaggactttggtaacactcgctcttcctcctttccctgtgcaacccacgagctacaatagatcaaaacattggacaaagaaaccaatactaacaatgatgtgactatgcaaagttagaggtagtctctacggagttgtttatttcaggtgacaagagtgacttggtcggtaaaggagatgctgttatgtcctcaggcaaagttttatttacggaagcagtgttgaaagctcgaaggtcatgtaatatatcttgttcttgacgagaagtatcatgagtcccttgttctataaaatcatcagcagacaaacggctgcttctaccagcactatgccttctccgaagtgagcggtccccaatatcccctgcctctgagacactctcactatcgacgtcattgtcaattaggtgaggcaaactacgtgataagcttaaagaagaggctacactgctctcccgactaaaagacttggcttgataaggttctatgctgctttgacccgtatccataggcgttgtagccaaagcataagattcttaaatgatgctccacctgcacatattttaagccacagccacacacacaagaaagaagacatgaaggaatgtgcaaaaagagacaagagataatcgaacaatgtggcaagtaaacattcgagaaattcctaatgcttattaaagacactgtttgaaaagtttagctgtaatcttcaaaaccatagctttttgatactaagacaacaaattcaaaaaagttcacatattcatgatagattatgactttagtttattactttctacagaagcagaataagaatgacctggtgaagggatccaaaaacagttttcaagattttgtcctccactatcccttaaaacaaaagataaaaatttacttgcgttttagttagtggaaatcgaaaaaaaggtagactaaaataatcacttgttcaccaatagagaaaaaaacgaaaatcttaaaaagttgtacaggtggcaaagacgaatgaatacttttcttagattgggacctgttttgggtttggattttgagctagacatttaaaattcagcagctttacctaatggcgaattcaatcttaatcgtgaagaatcaaatttgatcccaaaagtcgccggcggagaaatcgagctaacaggagacaatcgaaaaccatcaatttattctctggtttattggatgttaagggaagtaggttcgattgtagaagatggacgaacaacaaagcagaagacgattgtaactttgtttagtcgaacacacatgtacagacaagtagagttggtttagtcgggaaaatcgcaccctaaaaaaaacaaaaacaatacataagttttaaaatatttctaaattatgggccacaaagagctggcccagtagccccgcttctcataacagattttttttgtctctggcggataacaaaaatatccttggaaacgacagcccaaacaaaatcatctttaacatatatttagatgttacttgaaatttgatcatatattttgaaaaaatccagataaattattaaaagttaatggtattaaaaaaaaagtttcattgtttttagttgaagaaaatagtgtcattttgattctacatttgatataattttactaaaaattgttttttttctgtgttaaaaaaaaacagcatttttgaggattgaatatgaaggtggatttctttaaagttgtgtcacaactgataaaaataaaaataagaatcaagttggggagtggcaatgaaaggaataattctaatggcggcttttattggcaaccttcggaaaaataataaaaacattcgtatactttgccgtcaaacttaggaacgtcgtcgttttcgtcgtaatataattggcgtaacgcaactctaaaacgaatcaggatgttccacgtacactacactaggcttttaatgtggagcccgtgagagagccacccctacttggcattgacgcaaagatttatatttgggtcaacatcagcaactgtacttaagtacttatatatattaattataagattatcttcttctttttttttggtttaatataagattaccttcttaatatcacgacaactaatctaatcttctccttattttttgggttttttgatagaagaagaaaggtcccgtaaataaatgaaacagtttcggaattcttctatttttgtcgaccacttgtgttatccgcagctagttgcaaaattcttttgtttgattgtataatcaaattgattaatgaatcaaataaattggcaggaaaaaaaaaaaaaaaaaaaaggaagcacaaatgtcagtgaggtgagcccaagtcttcgccacctctctctgctttcttagtttgctactttgctttgccttttcccaaagaagaaccataaaagtatgatttcttattgaagccaagactagaatctatcgtctagggttctttctgggttccaaggaaaaatgggttcatcgaagaggcaattcaaggccatgctccgcaagaattggctcctcaaaactcgtcatcccttcgttacttcagctgaggtttctctctttttctttgctcctcaaaactatgtcgttttcatgcttattcactgctcgtcttaatgggtcttcttctccttgatgctgaatgcaatttttgtttttaaaatttcgaattgttgatcaaattttgcttctttctcttattcattggcagattttgcttccgactattgtaatg

SEQ ID NO: 11234 - DNA, 3000 bp, Unknown
  misc_feature (1)..( 3000): cDNA_ID_2702019_gDNA_ID_2214485_Annot_ID_183490 3000 nt of promoter + ATG
taacaactttacgttttggtaattgtggaatcaaccatgataatcttatattattcgatattaatcaaaatatggcttaaatagttaaaactcacacataagtccataagttccaattgtataatattatacttttaataaattatattatatttatacatatgaataaaaaggaaggtttcaggaattcatggttacaaaatgagtttaaaaagatgaacatttcccccaaaacactaattagatcgtacggttggtgagcctaaagaagtagtgctactaataaatgagaataatagtttttggtacgacatcccacaaatccttaatgatgagagcataaatctcggcataatcttcgtttcaagagttcgaaagcatattcatgaatattcacaaatgattacgcagaaagtcagtttgataggtaaagcatccataagctaatgactaagttttcattgtaatcattggttaacattttctctaacaatgttaattattgaaaatttaaaacaattaactacacttcttatctccccttcttcacgagtttaaagcgacgaggtgcttccatcattatgtcttctctttttcttgttgctcttcttatgattcgtctttaactcattcgcctatttgtgaaaaaaatagattgcttgaaaagcataaaactaatcaactgaaaaaatgtatatgcataattaaaaatcaattcatagaaaaattcagtcgtactttcgtcaattcatggatttattttttgttgtagctaaaacttcagttgtactaccaaaacaagaagaagttcaacgtcttgttgatagtatcatgagttgtgaaaactcacgtgaaaagaaatgtaactatgtaataaagttttttatagtattaatagaataaaacttgcttaattggtggtgttatttatatatacttaattaggcaattaggtttcaagaagaggaaaaaaacgatgggacggaggtggtgagtggtggtggtcggagcagacaaagaagggtcctacaatttgcctaaccgtaaagagccacattcctttttcttttaccccatcccgtgagtgaaccccactcttcctcattctattattctcaatctatattttcaaaaataaacataaatatacaaactctttgcagcataaaggaatatgttgataaaacggagctttgtttatgattttgtttcattatgatatattttttttaaaacatttaccaacaatttcttagaaacataaattaagagctaactagtatatctagtatttctcgaaacccaaactcatgttcttaattttttatttttttctggaatgttaatgactatcggatatttgagtataattgtatgaatttgcttgactgttgcatactttgaatctttctttctagtttacaattgtgcaaattaaatcaaactcgttttcagtattttaccttttagtactatacttaattatgtcatctgtatcaggtaatagttagaggaaagaggaaaatggtgtaatataaacaacaattatttgtatgtgagtttacgaccatcatctagcttaaagtacacaccaatgagaatatgaacacagtttagctcaactcatatatgatctatccgacatcttttcaatgttttgggtcgcgtaggagtatcggaagcagcttaagacatagctatttaataaattgttggtatgttttatttataacaattatcacaaaatcaaaagatactaatctcgctgtttgaggcagacatctgagaaaacatgtcttctaccaacattcaagatttgacaaatcgttgtttacgtattgttatattgagcatcttacaacaaaaatttacgtgtattttgaaactcggaaatcaatcatatctattgatattaacacacagtgtttcctgactatcgtcgcagacgaataataatagtaataatcttccacctcgtgtgattctataatcttatattcttgacataaatgtcgtcaaaatttggtatacatcaaacatggatcgtgtttaaagtaatcatcaaaaatcaccacacgagagtagattccctattgtcaaatatagatcaaagagaaaacatgtaggctacaaatataacctagtccctacgaataagaaaaatgtcattataccacaaatgataactgcaaagtgtgtgtaaattttgattttaaaagaaggtaaaaaaataaaaaagatagatttggaaacaatcttttacctctttggtattgaacattgtgacagtatcaatcagtatggtacagaaaaaacgtcagaggaaaagaattatcaaaaaacgtacactcttcattttcattaaaatcttttttttttcttccaaaaaacaaaagcagaaaaaatgtgtcagaaagatttatgcagctttcattcattcatcacttgcactgtctcgtgaagaaaattaaacttttttgtatcagaaattaattacattaaaagaaaagaaaaaaaaaattccctcctttccaagtgcgtttgctttgtggagtctctctcttctctctctctgtctgtgtgtgaagtgagaggatctttgtttggttctgcaatcataatttcgtgatatactaaaaaaaatgcaatttcctcttctctcttataagcagagaccctactactctttgatcgaattttccttgctctcttctctttgttctctcatgtttttttctccctaaatttatgggctttgctctctctctaagccacactcacactctaaagcactcgtctttcttcttctttttcttcagaaacagttattttgacttgaaaaaccagagctttaatcctggattcatggcaaaaagagcattacttttcttttcctctctcactttcttgtttcatttggcttaaaaattcaatgataattttgtatttgggggaaagaagaagaagaacaagagtgtgtgattgattcaattcttaaaa

SEQ ID NO: 11235 - DNA, 3000 bp, Unknown
  misc_feature (1)..( 3000): cDNA_ID_3039306_gDNA_ID_2214485_Annot_ID_183488 3000 nt of promoter + ATG
aaatagcgttattttaaatttcagtaagaaaaattattttgcatttcataaggccagtgtgttcttaattctaatttaatttcagtaacacatgtcacatgaagggtgaaactaatacaaagaactaaactataagctccgatctttttagtttaattaacgatgataaattgttgtttacgctgatatattatagttttcatcgtagaactaaatgtaaaatttcgctttttatgtttacgtgtagggcttctcccaaatgggaactttgagcaaattcctaacaaatcaaacatgagaaagaggcaaataattggcaaatactctcttccacattgggaaatctccggccacgtagagctagtctctggcggtccacagcccggtggtttttacttcgcagtgccacgtggagtccacgcagctaggctagggaacttagcatcaatatctcagtatgtgaaagtgaaaagcggcttggtctattctctaacgtttggtgtcacgaggacttgtgctcaagacgagaacatcagaatctctgtgcctggtcagaccaatgagctaccaatccaaacattgttcagtaccaacggtggtgatacgtacgcatgggcttttaaggcaacgtctgacttggttaaggtcactttttataatcctggtgttcaagaagaccctacttgtggcccaatcgttgacgctgttgccattaaggagattcttcctctccggtataccaaaggtaacaactttcaattccggttcggtattggtcgtgtctcattccacattccggtttgactttattttagaatattaaccgattcacatacaaatcttgaaatctaccacacaatggcttagtatataggtttcatttccggtttggattcatttcttttatattttaaccgggttaaattggatttctggtttttgaagagtaaattcaatttaaccaaaacttccacataccagtttggttttgcaatttggtccttatcttttcatattattttctctttcgcccctaacttttaatttgtttacgtaaaaatcaaccagggaaccttgtgaaaaacggcggatttgagaccggtccacacgtattcagcaacttctctaccggaattttaattccggcgaagatacaagacctaatctcaccgcttccgggatggatcgtcgaatctctaaaaccggttaagtacatcgataaccgccacttcaaggttccctcaggtctcgcagcaatcgagcttgttgccggaagagaaagcgcaatcgctcagatcatccgtaccgtctccggtaaaaactacattctctcgtttgttgtgggagacgcacacaatggttgtcacggatcgatgatggtggaggcgtttgcgggaatatcggcgtttaaggttacattcgaatctaatgataaaggagcgttcaaagtggggcgtttcgcgtttcgtgccgattcgaatcgcacaaggataactttctatagtgggttttatcataccaagcttcatgattttggacatctttgtgggcctgtgcttgataatgttagtgtttttttggcccattaaattattacaaaagtaaaataaatattgttcgatttcaattatataattttctatacttctgtaaaaaggtcgttaagaaactgatattcaaaaaatatcgatattcatatttcttgatccaaaaaatattgcattgtatttatatatatctaatatactgagtgacaaaaaaaaatagtatattacactgaacaatgggattttaaatctgtggatctgtagatcagatataaaagattacataccaaaacgtcatagcctaaaagaaaatcagattcaaaatcacaactaatattcaatctatttttatttgtggacgtaaatttgacttaaagagcaaatcatggcgatgattatgagcggagaccatatatggacttctggaactccgcttaacatatctctcgtgtacacacatgcgcatttaattataaatcttattgacacaaatttctttgttttaacgttttttttctttgtaagttaaacgtaaagctttattaaacaaagaacaaatactacgtagattgcggagaaaagaaccaaaaagttgattatgttttgcttacatataaactcagtgaatgcaattagatgaacacagacgattagctaggtttcgtcattgtaatttataaattcatgttggtgcttgcatctactctaaaatttgatgaattcagcgccagttaataaatattatgctccatagattggcttttttcgcccactttggtgagtgcaacttttccgatagtaattttatcaaaaagaaaagaaaaggcacaacaattcctttattttgttaattaaagggaaaaattggctagacgacaattcatttaacatgttgagatttttttttgtcatcgatcgacggttggacttggagttcatttaatgtcttgattatatttttcacagcagcatcgctcgtgatatgtttgaatcacaccatgcacatgttaggattcgtgcttggaaggttcgttgcatatttttcagcgtctgatagctcactgcacacaaagtcacaaagcacaagacacgtatttttaattattcttttggtaaagtgtaaattagtaattttccatcgtttaatacaaaaccgaagtaacatgacagacagtgagtcatacattgcggctcgtaaggtgcggtctttaacgtggttcgagtttcccttcgtatacttctacacggaaactttctctcataaacaatttttttgccgacaatttagttttgttgttgtatatttccaaaaatgtacatgctgctgcttcctctttgtttcttatttataatatctcatgtcaagtgataactgataagtataaaacctcctatatatagcccacaaggtcctcattgatataggcgaactaattaataagactttaaaatg

SEQ ID NO: 11236 - DNA, 3000 bp, Unknown
  misc_feature (1)..( 3000): cDNA_ID_3039309_gDNA_ID_2214485_Annot_ID_183487 3000 nt of promoter + ATG
ttatttgtggacgtaaatttgacttaaagagcaaatcatggcgatgattatgagcggagaccatatatggacttctggaactccgcttaacatatctctcgtgtacacacatgcgcatttaattataaatcttattgacacaaatttctttgttttaacgttttttttctttgtaagttaaacgtaaagctttattaaacaaagaacaaatactacgtagattgcggagaaaagaaccaaaaagttgattatgttttgcttacatataaactcagtgaatgcaattagatgaacacagacgattagctaggtttcgtcattgtaatttataaattcatgttggtgcttgcatctactctaaaatttgatgaattcagcgccagttaataaatattatgctccatagattggcttttttcgcccactttggtgagtgcaacttttccgatagtaattttatcaaaaagaaaagaaaaggcacaacaattcctttattttgttaattaaagggaaaaattggctagacgacaattcatttaacatgttgagatttttttttgtcatcgatcgacggttggacttggagttcatttaatgtcttgattatatttttcacagcagcatcgctcgtgatatgtttgaatcacaccatgcacatgttaggattcgtgcttggaaggttcgttgcatatttttcagcgtctgatagctcactgcacacaaagtcacaaagcacaagacacgtatttttaattattcttttggtaaagtgtaaattagtaattttccatcgtttaatacaaaaccgaagtaacatgacagacagtgagtcatacattgcggctcgtaaggtgcggtctttaacgtggttcgagtttcccttcgtatacttctacacggaaactttctctcataaacaatttttttgccgacaatttagttttgttgttgtatatttccaaaaatgtacatgctgctgcttcctctttgtttcttatttataatatctcatgtcaagtgataactgataagtataaaacctcctatatatagcccacaaggtcctcattgatataggcgaactaattaataagactttaaaatgtctctctatcactctcttagcattttcctcctcctatctctctgccatggctcttacagtcttcaaccacgtcgagttcctcatctagacggtaagacaatcaacatgaagttataatattcatttctatatcaattaatttgataaactaattaaacatgacgttgtaatattcatggtttccatatctatagggattctcccaaatggaaacttcgagataacccctctcaaatcaaacatgaagggtcgacaaataatcggggctaactctcttcctcattgggaaatcgccgggcacgtggagctagtctccggtggacctcagcctggaggattctatttccccgttccacgtggagtccacgcggttagactcggaaacttgggcaccatctctcagaacgtgagggtgaagagtggtttggtctactctctaacgttcggagctacgaggacttgtgctcaggatgagaacatcaaagtctctgtgcctggtcaggccaatgagcttccgctccagaccgtctttagctccgacggtggagacacttacgcttgggctttcaaggcaacttctgatgtggttaaggtcactttccataaccctggtgttcaagaagaccgcacgtgtggacctctcttagatgttgtcgcaatcaaggagattcttcctctccggtataccagaggtaaatcaattaacatatccggtttagttaatgtaatatattttgagcttttgcagtttgatccttatactttagctatgtgtttatgcttagcctgtaacattgttttgttctcttaggaaacttggtgaaaaatggaggattcgagatcggtccacatgttttcgctaatttctcaaccggaatcttgattccagcaagaatccaagacttcatctctcctcttccgggatggatcgtcgaatcccttaaaccagtgaagtatatcgatagacgtcatttcaaagttccttatggacaaggggccgtcgagctagttgccggaagagaaagcgcaatagctcagatcatccgaaccatcgctggtaaagcctatatgctctcattcgcggttggtgatgcacaaaacggttgccacgggtcgatgatggtggaagcgttcgcaggaagagaaccgtttaagctttcttttatgtcagaaggtaaaggagcgttcaaaacagggcattttaggtttgttgctgattcggatcgaacgaggctaacgttttatagtgcgttttatcatacaaagcttcatgacttcggccatctttgtgggcctgttcttgatagcgttgttgttaccctggcccgttaacaatttgtggcttttaattcttattagactgaatattcgaaacactatactctattcgtaacgaatttgtggttgcactacattttgttgtttcttgtcattagtcttgtcactcataccagtgatgcagaaaatatttataatatgtatggaaactttgtggaaattaaactaaaattaaaaagaatggtgagatagatttcaatttaataataatttacatctttcatccatataatgtatattgctaaaatatgatgtattcaaagtgaattctgaatctctgatataagaacatagaaattcaaaattttacaaagaccagtttacatggtcaactagaattaataagacttcttctatagctcatgggatatattcattatacaaatgacgtggctaaatctataccgtagataatattcagacgtagacgttagcacagtagataaattcctgtcctctgtatcttctctgagctgagaaaagaaaaaacagacgccggagaagagataaagaggtaagaagacccaccgaagacgaaacgtaatcgaacaaagatg
